US009771598B2

(12) United States Patent
Etzioni et al.

(10) Patent No.: US 9,771,598 B2
(45) Date of Patent: Sep. 26, 2017

(54) ISOLATED POLYNUCLEOTIDES AND POLYPEPTIDES, CONSTRUCT AND PLANTS COMPRISING SAME AND METHODS OF USING SAME FOR INCREASING NITROGEN USE EFFICIENCY OF PLANTS

(71) Applicant: Evogene Ltd., Rechovot (IL)

(72) Inventors: Adi Etzioni, Kibbutz Tzora (IL); Hagai Karchi, Moshav Sitriya (IL)

(73) Assignee: Evogene Ltd., Rehovot (IL)

( * ) Notice: Subject to any disclaimer, the term of this patent is extended or adjusted under 35 U.S.C. 154(b) by 0 days.

(21) Appl. No.: 14/655,384

(22) PCT Filed: Dec. 19, 2013

(86) PCT No.: PCT/IL2013/051043
§ 371 (c)(1),
(2) Date: Jun. 25, 2015

(87) PCT Pub. No.: WO2014/102774
PCT Pub. Date: Jul. 3, 2014

(65) Prior Publication Data
US 2015/0376641 A1    Dec. 31, 2015

Related U.S. Application Data

(60) Provisional application No. 61/827,801, filed on May 28, 2013, provisional application No. 61/745,877, filed on Dec. 26, 2012.

(51) Int. Cl.
*C12N 15/82* (2006.01)
*C07K 14/415* (2006.01)

(52) U.S. Cl.
CPC ........ *C12N 15/8271* (2013.01); *C07K 14/415* (2013.01); *C12N 15/8247* (2013.01); *C12N 15/8261* (2013.01); *C12N 15/8273* (2013.01)

(58) Field of Classification Search
None
See application file for complete search history.

(56) References Cited

U.S. PATENT DOCUMENTS

| | | | |
|---|---|---|---|
| 6,084,153 A | 7/2000 | Good et al. | |
| 2002/0046419 A1 | 4/2002 | Choo et al. | |
| 2004/0123343 A1* | 6/2004 | La Rosa | C07K 14/415 800/278 |
| 2005/0108791 A1 | 5/2005 | Edgerton | |
| 2006/0179511 A1 | 8/2006 | Chomet et al. | |
| 2011/0131679 A2 | 6/2011 | La Rosa et al. | |

FOREIGN PATENT DOCUMENTS

| | | |
|---|---|---|
| WO | WO 2004/081173 | 9/2004 |
| WO | WO 2004/104162 | 12/2004 |
| WO | WO 2004/111183 | 12/2004 |
| WO | WO 2005/121364 | 12/2005 |
| WO | WO 2007/020638 | 2/2007 |
| WO | WO 2007/049275 | 5/2007 |
| WO | WO 2008/075364 | 6/2008 |
| WO | WO 2008/122980 | 10/2008 |
| WO | WO 2009/013750 | 1/2009 |
| WO | WO 2009/083958 | 7/2009 |
| WO | WO 2009/141824 | 11/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |
| WO | WO 2013/027223 | 2/2013 |
| WO | WO 2013/078153 | 5/2013 |
| WO | WO 2013/080203 | 6/2013 |
| WO | WO 2013/098819 | 7/2013 |
| WO | WO 2013/128448 | 9/2013 |
| WO | WO 2013/179211 | 12/2013 |
| WO | WO 2014/033714 | 3/2014 |
| WO | WO 2014/102773 | 7/2014 |
| WO | WO 2014/102774 | 7/2014 |
| WO | WO 2014/188428 | 11/2014 |
| WO | WO 2015/029031 | 3/2015 |
| WO | WO 2015/181823 | 12/2015 |
| WO | WO 2016/030885 | 3/2016 |

OTHER PUBLICATIONS

International Preliminary Report on Patentability Dated Jul. 9, 2015 From the International Bureau of WIPO Re. Application No. PCT/IL2013/051043.
International Search Report and the Written Opinion Dated Feb. 24, 2014 From the International Searching Authority Re. Application No. PCT/IL2013/051043.
Invitation to Pay Additional Fees Dated Jan. 21, 2014 From the International Searching Authority Re. Application No. PCT/IL2013/051043.
Matsumoto et al. "Hordeum Vulgare Subsp. Vulgare mRNA for Predicted Protein, Complete CDS, Clone: NIASHv1038.118", Database NCBI [Online], GeneBank Accession No. AK356707, May 20, 2011.
Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.

* cited by examiner

*Primary Examiner* — Brent Page

(57) ABSTRACT

Provided are isolated polypeptides which are at least 80% homologous to SEQ ID NOs: 496-794, 2898-3645, and 3647-4855, isolated polynucleotides which are at least 80% identical to SEQ ID NOs: 1-495 and 795-2897, nucleic acid constructs comprising same, transgenic cells expressing same, transgenic plants expressing same and method of using same for increasing fertilizer use efficiency, nitrogen use efficiency, yield, growth rate, biomass, vigor, oil content, photosynthetic capacity, seed yield, fiber yield, fiber quality, fiber length, and/or abiotic stress tolerance of a plant.

23 Claims, 10 Drawing Sheets pQFN, pQFNc

Normal conditions

Osmotic stress (15 % PEG)

Nitrogen limiting conditions pQNa_RP

ISOLATED POLYNUCLEOTIDES AND POLYPEPTIDES, CONSTRUCT AND PLANTS COMPRISING SAME AND METHODS OF USING SAME FOR INCREASING NITROGEN USE EFFICIENCY OF PLANTS

RELATED APPLICATIONS

This application is a National Phase of PCT Patent Application No. PCT/IL2013/051043 having International filing date of Dec. 19, 2013, which claims the benefit of priority under 35 USC §119(e) of U.S. Provisional Patent Application Nos. 61/827,801 filed on May 28, 2013 and 61/745,877 filed on Dec. 26, 2012. The contents of the above applications are all incorporated by reference as if fully set forth herein in their entirety.

SEQUENCE LISTING STATEMENT

The ASCII file, entitled 62550SequenceListing.txt, created on 24 Jun., 2015 comprising 14,819,951 bytes, submitted concurrently with the filing of this application is incorporated herein by reference.

FIELD AND BACKGROUND OF THE INVENTION

The present invention, in some embodiments thereof, relates to isolated polypeptides and polynucleotides, nucleic acid constructs comprising same, transgenic cells comprising same, transgenic plants exogenously expressing same and more particularly, but not exclusively, to methods of using same for increasing fertilizer use efficiency (e.g., nitrogen use efficiency), yield (e.g., seed yield, oil yield), biomass, growth rate, vigor, oil content, fiber yield, fiber quality, fiber length, fiber length, photosynthetic capacity, and/or abiotic stress tolerance of a plant.

A common approach to promote plant growth has been, and continues to be, the use of natural as well as synthetic nutrients (fertilizers). Thus, fertilizers are the fuel behind the "green revolution", directly responsible for the exceptional increase in crop yields during the last 40 years, and are considered the number one overhead expense in agriculture. For example, inorganic nitrogenous fertilizers such as ammonium nitrate, potassium nitrate, or urea, typically accounts for 40% of the costs associated with crops such as corn and wheat. Of the three macronutrients provided as main fertilizers [Nitrogen (N), Phosphate (P) and Potassium (K)], nitrogen is often the rate-limiting element in plant growth and all field crops have a fundamental dependence on inorganic nitrogenous fertilizer. Nitrogen is responsible for biosynthesis of amino and nucleic acids, prosthetic groups, plant hormones, plant chemical defenses, etc. and usually needs to be replenished every year, particularly for cereals, which comprise more than half of the cultivated areas worldwide. Thus, nitrogen is translocated to the shoot, where it is stored in the leaves and stalk during the rapid step of plant development and up until flowering. In corn for example, plants accumulate the bulk of their organic nitrogen during the period of grain germination, and until flowering. Once fertilization of the plant has occurred, grains begin to form and become the main sink of plant nitrogen. The stored nitrogen can be then redistributed from the leaves and stalk that served as storage compartments until grain formation.

Since fertilizer is rapidly depleted from most soil types, it must be supplied to growing crops two or three times during the growing season. In addition, the low nitrogen use efficiency (NUE) of the main crops (e.g., in the range of only 30-70%) negatively affects the input expenses for the farmer, due to the excess fertilizer applied. Moreover, the over and inefficient use of fertilizers are major factors responsible for environmental problems such as eutrophication of groundwater, lakes, rivers and seas, nitrate pollution in drinking water which can cause methemoglobinemia, phosphate pollution, atmospheric pollution and the like. However, in spite of the negative impact of fertilizers on the environment, and the limits on fertilizer use, which have been legislated in several countries, the use of fertilizers is expected to increase in order to support food and fiber production for rapid population growth on limited land resources. For example, it has been estimated that by 2050, more than 150 million tons of nitrogenous fertilizer will be used worldwide annually.

Increased use efficiency of nitrogen by plants should enable crops to be cultivated with lower fertilizer input, or alternatively to be cultivated on soils of poorer quality and would therefore have significant economic impact in both developed and developing agricultural systems.

Genetic improvement of fertilizer use efficiency (FUE) in plants can be generated either via traditional breeding or via genetic engineering.

Attempts to generate plants with increased FUE have been described in U.S. Pat. Appl. Publication No. 20020046419 (U.S. Pat. No. 7,262,055 to Choo, et al.); U.S. Pat. Appl. No. 20050108791 to Edgerton et al.; U.S. Pat. Appl. No. 20060179511 to Chomet et al.; Good, A, et al. 2007 (Engineering nitrogen use efficiency with alanine aminotransferase. Canadian Journal of Botany 85: 252-262); and Good A G et al. 2004 (Trends Plant Sci. 9:597-605).

Yanagisawa et al. (Proc. Natl. Acad. Sci. U.S.A. 2004 101:7833-8) describe Dof1 transgenic plants which exhibit improved growth under low-nitrogen conditions.

U.S. Pat. No. 6,084,153 to Good et al. discloses the use of a stress responsive promoter to control the expression of Alanine Amine Transferase (AlaAT) and transgenic canola plants with improved drought and nitrogen deficiency tolerance when compared to control plants.

Yield is affected by various factors, such as, the number and size of the plant organs, plant architecture (for example, the number of branches), grains set length, number of filled grains, vigor (e.g. seedling), growth rate, root development, utilization of water, nutrients (e.g., nitrogen) and fertilizers, and stress tolerance.

Crops such as, corn, rice, wheat, canola and soybean account for over half of total human caloric intake, whether through direct consumption of the seeds themselves or through consumption of meat products raised on processed seeds or forage. Seeds are also a source of sugars, proteins and oils and metabolites used in industrial processes. The ability to increase plant yield, whether through increase dry matter accumulation rate, modifying cellulose or lignin composition, increase stalk strength, enlarge meristem size, change of plant branching pattern, erectness of leaves, increase in fertilization efficiency, enhanced seed dry matter accumulation rate, modification of seed development, enhanced seed filling or by increasing the content of oil, starch or protein in the seeds would have many applications in agricultural and non-agricultural uses such as in the biotechnological production of pharmaceuticals, antibodies or vaccines.

Vegetable or seed oils are the major source of energy and nutrition in human and animal diet. They are also used for the production of industrial products, such as paints, inks and lubricants. In addition, plant oils represent renewable sources of long-chain hydrocarbons which can be used as fuel. Since the currently used fossil fuels are finite resources and are gradually being depleted, fast growing biomass crops may be used as alternative fuels or for energy feedstocks and may reduce the dependence on fossil energy supplies. However, the major bottleneck for increasing consumption of plant oils as bio-fuel is the oil price, which is still higher than fossil fuel. In addition, the production rate of plant oil is limited by the availability of agricultural land and water. Thus, increasing plant oil yields from the same growing area can effectively overcome the shortage in production space and can decrease vegetable oil prices at the same time.

Studies aiming at increasing plant oil yields focus on the identification of genes involved in oil metabolism as well as in genes capable of increasing plant and seed yields in transgenic plants. Genes known to be involved in increasing plant oil yields include those participating in fatty acid synthesis or sequestering such as desaturase [e.g., DELTA6, DELTA12 or acyl-ACP (Ssi2; *Arabidopsis* Information Resource (TAIR; *arabidopsis* (dot) org/), TAIR No. AT2G43710)], OleosinA (TAIR No. AT3G01570) or FAD3 (TAIR No. AT2G29980), and various transcription factors and activators such as Led 1 [TAIR No. AT1G21970, Lotan et al. 1998. Cell. 26; 93(7):1195-205], Lec2 [TAIR No. AT1G28300, Santos Mendoza et al. 2005, FEBS Lett. 579 (21):4666-70], Fus3 (TAIR No. AT3G26790), ABI3 [TAIR No. AT3G24650, Lara et al. 2003. J Biol Chem. 278(23): 21003-11] and Wri1 [TAIR No. AT3G54320, Cernac and Benning, 2004. Plant J. 40(4): 575-85].

Genetic engineering efforts aiming at increasing oil content in plants (e.g., in seeds) include upregulating endoplasmic reticulum (FAD3) and plastidal (FAD7) fatty acid desaturases in potato (Zabrouskov V., et al., 2002; Physiol Plant. 116:172-185); over-expressing the GmDof4 and GmDof11 transcription factors (Wang H W et al., 2007; Plant J. 52:716-29); over-expressing a yeast glycerol-3-phosphate dehydrogenase under the control of a seed-specific promoter (Vigeolas H, et al. 2007, Plant Biotechnol J. 5:431-41; U.S. Pat. Appl. No. 20060168684); using *Arabidopsis* FAE1 and yeast SLC1-1 genes for improvements in erucic acid and oil content in rapeseed (Katavic V, et al., 2000, Biochem Soc Trans. 28:935-7).

Various patent applications disclose genes and proteins which can increase oil content in plants. These include for example, U.S. Pat. Appl. No. 20080076179 (lipid metabolism protein); U.S. Pat. Appl. No. 20060206961 (the Ypr140w polypeptide); U.S. Pat. Appl. No. 20060174373 [triacylglycerols synthesis enhancing protein (TEP)]; U.S. Pat. Appl. Nos. 20070169219, 20070006345, 20070006346 and 20060195943 (disclose transgenic plants with improved nitrogen use efficiency which can be used for the conversion into fuel or chemical feedstocks); WO2008/122980 (polynucleotides for increasing oil content, growth rate, biomass, yield and/or vigor of a plant).

Abiotic stress (ABS; also referred to as "environmental stress") conditions such as salinity, drought, flood, suboptimal temperature and toxic chemical pollution, cause substantial damage to agricultural plants. Most plants have evolved strategies to protect themselves against these conditions. However, if the severity and duration of the stress conditions are too great, the effects on plant development, growth and yield of most crop plants are profound. Furthermore, most of the crop plants are highly susceptible to abiotic stress and thus necessitate optimal growth conditions for commercial crop yields. Continuous exposure to stress causes major alterations in the plant metabolism which ultimately leads to cell death and consequently yield losses.

Drought is a gradual phenomenon, which involves periods of abnormally dry weather that persists long enough to produce serious hydrologic imbalances such as crop damage, water supply shortage and increased susceptibility to various diseases. In severe cases, drought can last many years and results in devastating effects on agriculture and water supplies. Furthermore, drought is associated with increase susceptibility to various diseases.

For most crop plants, the land regions of the world are too arid. In addition, overuse of available water results in increased loss of agriculturally-usable land (desertification), and increase of salt accumulation in soils adds to the loss of available water in soils.

Salinity, high salt levels, affects one in five hectares of irrigated land. None of the top five food crops, i.e., wheat, corn, rice, potatoes, and soybean, can tolerate excessive salt. Detrimental effects of salt on plants result from both water deficit, which leads to osmotic stress (similar to drought stress), and the effect of excess sodium ions on critical biochemical processes. As with freezing and drought, high salt causes water deficit; and the presence of high salt makes it difficult for plant roots to extract water from their environment. Soil salinity is thus one of the more important variables that determine whether a plant may thrive. In many parts of the world, sizable land areas are uncultivable due to naturally high soil salinity. Thus, salination of soils that are used for agricultural production is a significant and increasing problem in regions that rely heavily on agriculture, and is worsen by over-utilization, over-fertilization and water shortage, typically caused by climatic change and the demands of increasing population. Salt tolerance is of particular importance early in a plant's lifecycle, since evaporation from the soil surface causes upward water movement, and salt accumulates in the upper soil layer where the seeds are placed. On the other hand, germination normally takes place at a salt concentration which is higher than the mean salt level in the whole soil profile.

Salt and drought stress signal transduction consist of ionic and osmotic homeostasis signaling pathways. The ionic aspect of salt stress is signaled via the SOS pathway where a calcium-responsive SOS3-SOS2 protein kinase complex controls the expression and activity of ion transporters such as SOS1. The osmotic component of salt stress involves complex plant reactions that overlap with drought and/or cold stress responses.

Suboptimal temperatures affect plant growth and development through the whole plant life cycle. Thus, low temperatures reduce germination rate and high temperatures result in leaf necrosis. In addition, mature plants that are exposed to excess of heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat. High-temperature damage to pollen almost always occurs in conjunction with drought stress, and rarely occurs under well-watered conditions. Combined stress can alter plant metabolism in novel ways. Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. The underlying mechanisms of chilling sensitivity are not completely understood yet, but probably involve the level of membrane saturation and other physiological deficiencies. Excessive light conditions, which occur under clear atmospheric conditions subsequent to cold late summer/autumn nights, can lead to photoinhibition of photosynthesis (disruption of photosynthesis). In addition, chilling may lead to yield losses and lower product quality through the delayed ripening of maize.

Common aspects of drought, cold and salt stress response [Reviewed in Xiong and Zhu (2002) Plant Cell Environ. 25: 131-139] include: (a) transient changes in the cytoplasmic calcium levels early in the signaling event; (b) signal transduction via mitogen-activated and/or calcium dependent protein kinases (CDPKs) and protein phosphatases; (c) increases in abscisic acid levels in response to stress triggering a subset of responses; (d) inositol phosphates as signal molecules (at least for a subset of the stress responsive transcriptional changes; (e) activation of phospholipases which in turn generates a diverse array of second messenger molecules, some of which might regulate the activity of stress responsive kinases; (f) induction of late embryogenesis abundant (LEA) type genes including the CRT/DRE responsive COR/RD genes; (g) increased levels of antioxidants and compatible osmolytes such as proline and soluble sugars; and (h) accumulation of reactive oxygen species such as superoxide, hydrogen peroxide, and hydroxyl radicals. Abscisic acid biosynthesis is regulated by osmotic stress at multiple steps. Both ABA-dependent and -independent osmotic stress signaling first modify constitutively expressed transcription factors, leading to the expression of early response transcriptional activators, which then activate downstream stress tolerance effector genes.

Several genes which increase tolerance to cold or salt stress can also improve drought stress protection, these include for example, the transcription factor AtCBF/DREB1, OsCDPK7 (Saijo et al. 2000, Plant J. 23: 319-327) or AVP1 (a vacuolar pyrophosphatase-proton pump, Gaxiola et al. 2001, Proc. Natl. Acad. Sci. USA 98: 11444-11449).

Studies have shown that plant adaptations to adverse environmental conditions are complex genetic traits with polygenic nature. Conventional means for crop and horticultural improvements utilize selective breeding techniques to identify plants having desirable characteristics. However, selective breeding is tedious, time consuming and has an unpredictable outcome. Furthermore, limited germplasm resources for yield improvement and incompatibility in crosses between distantly related plant species represent significant problems encountered in conventional breeding. Advances in genetic engineering have allowed mankind to modify the germplasm of plants by expression of genes-of-interest in plants. Such a technology has the capacity to generate crops or plants with improved economic, agronomic or horticultural traits.

Genetic engineering efforts, aimed at conferring abiotic stress tolerance to transgenic crops, have been described in various publications [Apse and Blumwald (Curr Opin Biotechnol. 13:146-150, 2002), Quesada et al. (Plant Physiol. 130:951-963, 2002), Holmström et al. (Nature 379: 683-684, 1996), Xu et al. (Plant Physiol 110: 249-257, 1996), Pilon-Smits and Ebskamp (Plant Physiol 107: 125-130, 1995) and Tarczynski et al. (Science 259: 508-510, 1993)].

Various patents and patent applications disclose genes and proteins which can be used for increasing tolerance of plants to abiotic stresses. These include for example, U.S. Pat. Nos. 5,296,462 and 5,356,816 (for increasing tolerance to cold stress); U.S. Pat. No. 6,670,528 (for increasing ABST); U.S. Pat. No. 6,720,477 (for increasing ABST); U.S. application Ser. Nos. 09/938,842 and 10/342,224 (for increasing ABST); U.S. application Ser. No. 10/231,035 (for increasing ABST); WO2004/104162 (for increasing ABST and biomass); WO2007/020638 (for increasing ABST, biomass, vigor and/or yield); WO2007/049275 (for increasing ABST, biomass, vigor and/or yield); WO2010/076756 (for increasing ABST, biomass and/or yield);. WO2009/083958 (for increasing water use efficiency, fertilizer use efficiency, biotic/abiotic stress tolerance, yield and/or biomass); WO2010/020941 (for increasing nitrogen use efficiency, abiotic stress tolerance, yield and/or biomass); WO2009/141824 (for increasing plant utility); WO2010/049897 (for increasing plant yield).

Nutrient deficiencies cause adaptations of the root architecture, particularly notably for example is the root proliferation within nutrient rich patches to increase nutrient uptake. Nutrient deficiencies cause also the activation of plant metabolic pathways which maximize the absorption, assimilation and distribution processes such as by activating architectural changes. Engineering the expression of the triggered genes may cause the plant to exhibit the architectural changes and enhanced metabolism also under other conditions.

In addition, it is widely known that the plants usually respond to water deficiency by creating a deeper root system that allows access to moisture located in deeper soil layers. Triggering this effect will allow the plants to access nutrients and water located in deeper soil horizons particularly those readily dissolved in water like nitrates.

Cotton and cotton by-products provide raw materials that are used to produce a wealth of consumer-based products in addition to textiles including cotton foodstuffs, livestock feed, fertilizer and paper. The production, marketing, consumption and trade of cotton-based products generate an excess of $100 billion annually in the U.S. alone, making cotton the number one value-added crop.

Even though 90% of cotton's value as a crop resides in the fiber (lint), yield and fiber quality has declined due to general erosion in genetic diversity of cotton varieties, and an increased vulnerability of the crop to environmental conditions.

There are many varieties of cotton plant, from which cotton fibers with a range of characteristics can be obtained and used for various applications. Cotton fibers may be characterized according to a variety of properties, some of which are considered highly desirable within the textile industry for the production of increasingly high quality products and optimal exploitation of modem spinning technologies. Commercially desirable properties include length, length uniformity, fineness, maturity ratio, decreased fuzz fiber production, micronaire, bundle strength, and single fiber strength. Much effort has been put into the improvement of the characteristics of cotton fibers mainly focusing on fiber length and fiber fineness. In particular, there is a great demand for cotton fibers of specific lengths.

A cotton fiber is composed of a single cell that has differentiated from an epidermal cell of the seed coat, developing through four stages, i.e., initiation, elongation, secondary cell wall thickening and maturation stages. More specifically, the elongation of a cotton fiber commences in the epidermal cell of the ovule immediately following flowering, after which the cotton fiber rapidly elongates for approximately 21 days. Fiber elongation is then terminated, and a secondary cell wall is formed and grown through maturation to become a mature cotton fiber.

Several candidate genes which are associated with the elongation, formation, quality and yield of cotton fibers were disclosed in various patent applications such as U.S. Pat. No. 5,880,100 and U.S. patent application Ser. Nos. 08/580,545, 08/867,484 and 09/262,653 (describing genes involved in cotton fiber elongation stage); WO0245485 (improving fiber quality by modulating sucrose synthase); U.S. Pat. No. 6,472,588 and WO0117333 (increasing fiber quality by transformation with a DNA encoding sucrose phosphate synthase); WO9508914 (using a fiber-specific promoter and a coding sequence encoding cotton peroxidase); WO9626639 (using an ovary specific promoter sequence to express plant growth modifying hormones in cotton ovule tissue, for altering fiber quality characteristics such as fiber dimension and strength); U.S. Pat. Nos. 5,981,834, 5,597, 718, 5,620,882, 5,521,708 and 5,495,070 (coding sequences to alter the fiber characteristics of transgenic fiber producing plants); U.S. patent applications U.S. 2002049999 and U.S. 2003074697 (expressing a gene coding for endoxyloglucan transferase, catalase or peroxidase for improving cotton fiber characteristics); WO 01/40250 (improving cotton fiber quality by modulating transcription factor gene expression); WO 96/40924 (a cotton fiber transcriptional initiation regulatory region associated which is expressed in cotton fiber); EP0834566 (a gene which controls the fiber formation mechanism in cotton plant); WO2005/121364 (improving cotton fiber quality by modulating gene expression); WO2008/075364 (improving fiber quality, yield/biomass/vigor and/or abiotic stress tolerance of plants).

WO publication No. 2004/104162 discloses methods of increasing abiotic stress tolerance and/or biomass in plants and plants generated thereby.

WO publication No. 2004/111183 discloses nucleotide sequences for regulating gene expression in plant trichomes and constructs and methods utilizing same.

WO publication No. 2004/081173 discloses novel plant derived regulatory sequences and constructs and methods of using such sequences for directing expression of exogenous polynucleotide sequences in plants.

WO publication No. 2005/121364 discloses polynucleotides and polypeptides involved in plant fiber development and methods of using same for improving fiber quality, yield and/or biomass of a fiber producing plant.

WO publication No. 2007/049275 discloses isolated polypeptides, polynucleotides encoding same, transgenic plants expressing same and methods of using same for increasing fertilizer use efficiency, plant abiotic stress tolerance and biomass.

WO publication No. 2007/020638 discloses methods of increasing abiotic stress tolerance and/or biomass in plants and plants generated thereby.

WO publication No. 2008/122980 discloses genes constructs and methods for increasing oil content, growth rate and biomass of plants.

WO publication No. 2008/075364 discloses polynucleotides involved in plant fiber development and methods of using same.

WO publication No. 2009/083958 discloses methods of increasing water use efficiency, fertilizer use efficiency, biotic/abiotic stress tolerance, yield and biomass in plant and plants generated thereby.

WO publication No. 2009/141824 discloses isolated polynucleotides and methods using same for increasing plant utility.

WO publication No. 2009/013750 discloses genes, constructs and methods of increasing abiotic stress tolerance, biomass and/or yield in plants generated thereby.

WO publication No. 2010/020941 discloses methods of increasing nitrogen use efficiency, abiotic stress tolerance, yield and biomass in plants and plants generated thereby.

WO publication No. 2010/076756 discloses isolated polynucleotides for increasing abiotic stress tolerance, yield, biomass, growth rate, vigor, oil content, fiber yield, fiber quality, and/or nitrogen use efficiency of a plant.

WO2010/100595 publication discloses isolated polynucleotides and polypeptides, and methods of using same for increasing plant yield and/or agricultural characteristics.

WO publication No. 2010/049897 discloses isolated polynucleotides and polypeptides and methods of using same for increasing plant yield, biomass, growth rate, vigor, oil content, abiotic stress tolerance of plants and nitrogen use efficiency.

WO2010/143138 publication discloses isolated polynucleotides and polypeptides, and methods of using same for increasing nitrogen use efficiency, fertilizer use efficiency, yield, growth rate, vigor, biomass, oil content, abiotic stress tolerance and/or water use efficiency.

WO publication No. 2011/080674 discloses isolated polynucleotides and polypeptides and methods of using same for increasing plant yield, biomass, growth rate, vigor, oil content, abiotic stress tolerance of plants and nitrogen use efficiency.

WO2011/015985 publication discloses polynucleotides and polypeptides for increasing desirable plant qualities.

WO2011/135527 publication discloses isolated polynucleotides and polypeptides for increasing plant yield and/or agricultural characteristics.

WO2012/028993 publication discloses isolated polynucleotides and polypeptides, and methods of using same for increasing nitrogen use efficiency, yield, growth rate, vigor, biomass, oil content, and/or abiotic stress tolerance.

WO2012/085862 publication discloses isolated polynucleotides and polypeptides, and methods of using same for improving plant properties.

WO2012/150598 publication discloses isolated polynucleotides and polypeptides and methods of using same for increasing plant yield, biomass, growth rate, vigor, oil content, abiotic stress tolerance of plants and nitrogen use efficiency.

WO2013/027223 publication discloses isolated polynucleotides and polypeptides, and methods of using same for increasing plant yield and/or agricultural characteristics.

WO2013/080203 publication discloses isolated polynucleotides and polypeptides, and methods of using same for increasing nitrogen use efficiency, yield, growth rate, vigor, biomass, oil content, and/or abiotic stress tolerance.

WO2013/098819 publication discloses isolated polynucleotides and polypeptides, and methods of using same for increasing yield of plants.

WO2013/128448 publication discloses isolated polynucleotides and polypeptides and methods of using same for increasing plant yield, biomass, growth rate, vigor, oil content, abiotic stress tolerance of plants and nitrogen use efficiency.

SUMMARY OF THE INVENTION

According to an aspect of some embodiments of the present invention there is provided a method of increasing nitrogen use efficiency, yield, growth rate, biomass, vigor, oil content, seed yield, fiber yield, fiber quality, fiber length, photosynthetic capacity, and/or abiotic stress tolerance of a plant, comprising expressing within the plant an exogenous polynucleotide comprising a nucleic acid sequence encoding a polypeptide at least 80% identical to SEQ ID NO: 496-794, 2898-3645, 3647-4854 or 4855, thereby increasing the nitrogen use efficiency, yield, growth rate, biomass, vigor, oil content, seed yield, fiber yield, fiber quality, fiber length, photosynthetic capacity, and/or abiotic stress tolerance of the plant.

According to an aspect of some embodiments of the present invention there is provided a method of increasing nitrogen use efficiency, yield, growth rate, biomass, vigor, oil content, seed yield, fiber yield, fiber quality, fiber length, photosynthetic capacity, and/or abiotic stress tolerance of a plant, comprising expressing within the plant an exogenous polynucleotide comprising a nucleic acid sequence encoding a polypeptide selected from the group consisting of SEQ ID NOs: 496-794, 2898-4854 and 4855, thereby increasing the nitrogen use efficiency, yield, growth rate, biomass, vigor, oil content, seed yield, fiber yield, fiber quality, fiber length, photosynthetic capacity, and/or abiotic stress tolerance of the plant.

According to an aspect of some embodiments of the present invention there is provided a method of producing a crop comprising growing a crop plant transformed with an exogenous polynucleotide comprising a nucleic acid sequence encoding a polypeptide at least 80% homologous to the amino acid sequence selected from the group consisting of SEQ ID NOs: 496-794, 2898-3645, 3647-4854 and 4855, wherein the crop plant is derived from plants selected for increased nitrogen use efficiency, increased yield, increased growth rate, increased biomass, increased vigor, increased oil content, increased seed yield, increased fiber yield, increased fiber quality, increased fiber length, increased photosynthetic capacity, and/or increased abiotic stress tolerance as compared to a wild type plant of the same species which is grown under the same growth conditions, and the crop plant having the increased nitrogen use efficiency, increased yield, increased growth rate, increased biomass, increased vigor, increased oil content, increased seed yield, increased fiber yield, increased fiber quality, increased fiber length, increased photosynthetic capacity, and/or increased abiotic stress tolerance, thereby producing the crop.

According to an aspect of some embodiments of the present invention there is provided a method of increasing nitrogen use efficiency, yield, growth rate, biomass, vigor, oil content, seed yield, fiber yield, fiber quality, fiber length, photosynthetic capacity, and/or abiotic stress tolerance of a plant, comprising expressing within the plant an exogenous polynucleotide comprising a nucleic acid sequence at least 80% identical to SEQ ID NO: 1-495, 795-2896 or 2897, thereby increasing the nitrogen use efficiency, yield, growth rate, biomass, vigor, oil content, seed yield, fiber yield, fiber quality, fiber length, photosynthetic capacity, and/or abiotic stress tolerance of the plant.

According to an aspect of some embodiments of the present invention there is provided a method of increasing nitrogen use efficiency, yield, growth rate, biomass, vigor, oil content, seed yield, fiber yield, fiber quality, fiber length, photosynthetic capacity, and/or abiotic stress tolerance of a plant, comprising expressing within the plant an exogenous polynucleotide comprising the nucleic acid sequence selected from the group consisting of SEQ ID NOs: 1-495, 795-2896 and 2897, thereby increasing the nitrogen use efficiency, yield, growth rate, biomass, vigor, oil content, seed yield, fiber yield, fiber quality, fiber length, photosynthetic capacity, and/or abiotic stress tolerance of the plant.

According to an aspect of some embodiments of the present invention there is provided a method of producing a crop comprising growing a crop plant transformed with an exogenous polynucleotide which comprises a nucleic acid sequence which is at least 80% identical to the nucleic acid sequence selected from the group consisting of SEQ ID NOs: 1-495, 795-2896 and 2897, wherein the crop plant is derived from plants (parent plants) selected for increased nitrogen use efficiency, increased yield, increased growth rate, increased biomass, increased vigor, increased oil content, increased seed yield, increased fiber yield, increased fiber quality, increased fiber length, increased photosynthetic capacity, and/or increased abiotic stress tolerance as compared to a wild type plant of the same species which is grown under the same growth conditions, and the crop plant having the increased nitrogen use efficiency, increased yield, increased growth rate, increased biomass, increased vigor, increased oil content, increased seed yield, increased fiber yield, increased fiber quality, increased fiber length, increased photosynthetic capacity, and/or increased abiotic stress tolerance, thereby producing the crop.

According to an aspect of some embodiments of the present invention there is provided an isolated polynucleotide comprising a nucleic acid sequence encoding a polypeptide which comprises an amino acid sequence at least 80% homologous to the amino acid sequence set forth in SEQ ID NO:496-794, 2898-3645, 3647-4854 or 4855, wherein the amino acid sequence is capable of increasing nitrogen use efficiency, yield, growth rate, biomass, vigor, oil content, seed yield, fiber yield, fiber quality, fiber length, photosynthetic capacity, and/or abiotic stress tolerance of a plant.

According to an aspect of some embodiments of the present invention there is provided an isolated polynucleotide comprising a nucleic acid sequence encoding a polypeptide which comprises the amino acid sequence selected from the group consisting of SEQ ID NOs: 496-794, 2898-4854 and 4855.

According to an aspect of some embodiments of the present invention there is provided an isolated polynucleotide comprising a nucleic acid sequence at least 80% identical to SEQ ID NO: 1-495, 795-2896 or 2897, wherein the nucleic acid sequence is capable of increasing nitrogen use efficiency, yield, growth rate, biomass, vigor, oil content, seed yield, fiber yield, fiber quality, fiber length, photosynthetic capacity, and/or abiotic stress tolerance of a plant.

According to an aspect of some embodiments of the present invention there is provided an isolated polynucleotide comprising the nucleic acid sequence selected from the group consisting of SEQ ID NOs: 1-495, 795-2896 and 2897.

According to an aspect of some embodiments of the present invention there is provided a nucleic acid construct comprising the isolated polynucleotide of some embodiments of the invention, and a promoter for directing transcription of the nucleic acid sequence in a host cell.

According to an aspect of some embodiments of the present invention there is provided an isolated polypeptide comprising an amino acid sequence at least 80% homologous to SEQ ID NO: 496-794, 2898-3645, 3647-4854 or 4855, wherein the amino acid sequence is capable of increasing nitrogen use efficiency, yield, growth rate, biomass, vigor, oil content, seed yield, fiber yield, fiber quality, fiber length, photosynthetic capacity, and/or abiotic stress tolerance of a plant.

According to an aspect of some embodiments of the present invention there is provided an isolated polypeptide comprising the amino acid sequence selected from the group consisting of SEQ ID NOs: 496-794, 2898-4854 and 4855.

According to an aspect of some embodiments of the present invention there is provided a plant cell exogenously expressing the polynucleotide of some embodiments of the invention, or the nucleic acid construct of some embodiments of the invention.

According to an aspect of some embodiments of the present invention there is provided a plant cell exogenously expressing the polypeptide of some embodiments of the invention.

According to an aspect of some embodiments of the present invention there is provided a transgenic plant comprising the nucleic acid construct of some embodiments of the invention or the plant cell of some embodiments of the invention.

According to an aspect of some embodiments of the present invention there is provided a method of growing a crop, the method comprising seeding seeds and/or planting plantlets of a plant transformed with the isolated polynucleotide of some embodiments of the invention, or with the nucleic acid construct of some embodiments of the invention, wherein the plant is derived from plants selected for at least one trait selected from the group consisting of: increased nitrogen use efficiency, increased abiotic stress tolerance, increased biomass, increased growth rate, increased vigor, increased yield and increased fiber yield, increased fiber quality, increased fiber length, increased photosynthetic capacity, and increased oil content as compared to a non-transformed plant, thereby growing the crop.

According to an aspect of some embodiments of the present invention there is provided a method of selecting a transformed plant having increased nitrogen use efficiency, yield, growth rate, biomass, vigor, oil content, seed yield, fiber yield, fiber quality, fiber length, photosynthetic capacity, and/or abiotic stress tolerance as compared to a wild type plant of the same species which is grown under the same growth conditions, the method comprising:

(a) providing plants transformed with an exogenous polynucleotide encoding a polypeptide comprising an amino acid sequence at least 80% homologous to the amino acid sequence selected from the group consisting of SEQ ID NOs:496-794, 2898-3645, 3647-4854 and 4855, (b) selecting from the plants a plant having nitrogen use efficiency, increased yield, growth rate, biomass, vigor, oil content, seed yield, fiber yield, fiber quality, fiber length, photosynthetic capacity, and/or abiotic stress tolerance, thereby selecting the plant having increased nitrogen use efficiency, yield, growth rate, biomass, vigor, oil content, seed yield, fiber yield, fiber quality, fiber length, photosynthetic capacity, and/or abiotic stress tolerance as compared to the wild type plant of the same species which is grown under the same growth conditions.

According to an aspect of some embodiments of the present invention there is provided a method of selecting a transformed plant having increased nitrogen use efficiency, yield, growth rate, biomass, vigor, oil content, seed yield, fiber yield, fiber quality, fiber length, photosynthetic capacity, and/or abiotic stress tolerance as compared to a wild type plant of the same species which is grown under the same growth conditions, the method comprising:

(a) providing plants transformed with an exogenous polynucleotide encoding a polypeptide comprising an amino acid sequence at least 80% identical to the nucleic acid sequence selected from the group consisting of SEQ ID NOs: 1-495, 795-2896 and 2897, (b) selecting from the plants a plant having increased nitrogen use efficiency, yield, growth rate, biomass, vigor, oil content, seed yield, fiber yield, fiber quality, fiber length, photosynthetic capacity, and/or abiotic stress tolerance, thereby selecting the plant having increased nitrogen use efficiency, yield, growth rate, biomass, vigor, oil content, seed yield, fiber yield, fiber quality, fiber length, photosynthetic capacity, and/or abiotic stress tolerance as compared to the wild type plant of the same species which is grown under the same growth conditions.

According to some embodiments of the invention, the nucleic acid sequence encodes an amino acid sequence selected from the group consisting of SEQ ID NOs: 496-794, 2898-4854 and 4855.

According to some embodiments of the invention, the nucleic acid sequence is selected from the group consisting of SEQ ID NOs: 1-495, 795-2896 and 2897.

According to some embodiments of the invention, the polynucleotide consists of the nucleic acid sequence selected from the group consisting of SEQ ID NOs: 1-495, 795-2896 and 2897.

According to some embodiments of the invention, the nucleic acid sequence encodes the amino acid sequence selected from the group consisting of SEQ ID NOs: 496-794, 2898-4854 and 4855.

According to some embodiments of the invention, the host cell is a plant cell.

According to some embodiments of the invention, the plant cell forms part of a plant.

According to some embodiments of the invention, the method further comprising growing the plant expressing the exogenous polynucleotide under the abiotic stress.

According to some embodiments of the invention, the abiotic stress is selected from the group consisting of salinity, drought, osmotic stress, water deprivation, flood, etiolation, low temperature, high temperature, heavy metal toxicity, anaerobiosis, nutrient deficiency, nitrogen deficiency, nutrient excess, atmospheric pollution and UV irradiation.

According to some embodiments of the invention, the yield comprises seed yield or oil yield.

According to some embodiments of the invention, the method further comprising growing the plant expressing the exogenous polynucleotide under nitrogen-limiting conditions.

According to some embodiments of the invention, the promoter is heterologous to the isolated polynucleotide and/or to the host cell.

According to some embodiments of the invention, the isolated polynucleotide is heterologous to the plant cell.

According to some embodiments of the invention, the non-transformed plant is a wild type plant of identical genetic background.

According to some embodiments of the invention, the non-transformed plant is a wild type plant of the same species.

According to some embodiments of the invention, the non-transformed plant is grown under identical growth conditions.

According to some embodiments of the invention, the method further comprising selecting a plant having an increased nitrogen use efficiency, yield, growth rate, biomass, vigor, oil content, seed yield, fiber yield, fiber quality, fiber length, photosynthetic capacity, and/or abiotic stress tolerance as compared to the wild type plant of the same species which is grown under the same growth conditions.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3C-D) or nitrogen-limiting (FIGS. 3E-F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions. FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

DESCRIPTION OF SPECIFIC EMBODIMENTS OF THE INVENTION

Figure 1:
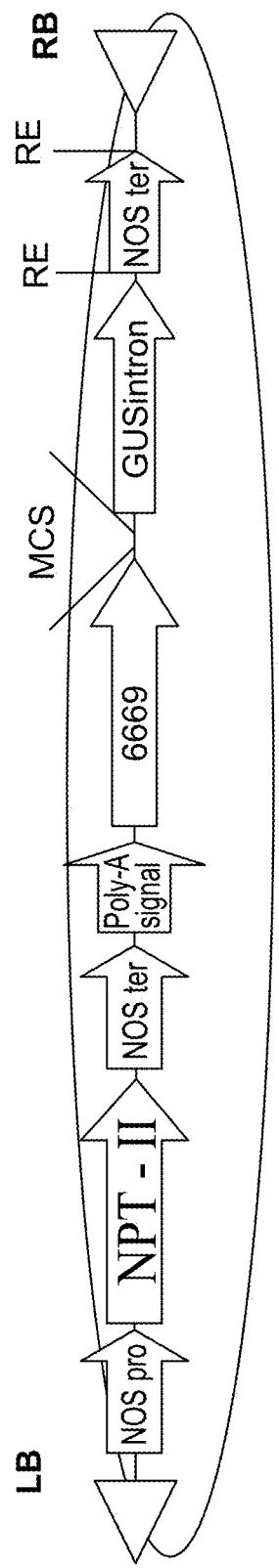
FIG. 1 is a schematic illustration of the modified pGI binary plasmid containing the new At6669 promoter (SEQ ID NO:4880) and the GUSintron (pQYN 6669) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the vector while replacing the GUS-intron reporter gene.
Figure 2:
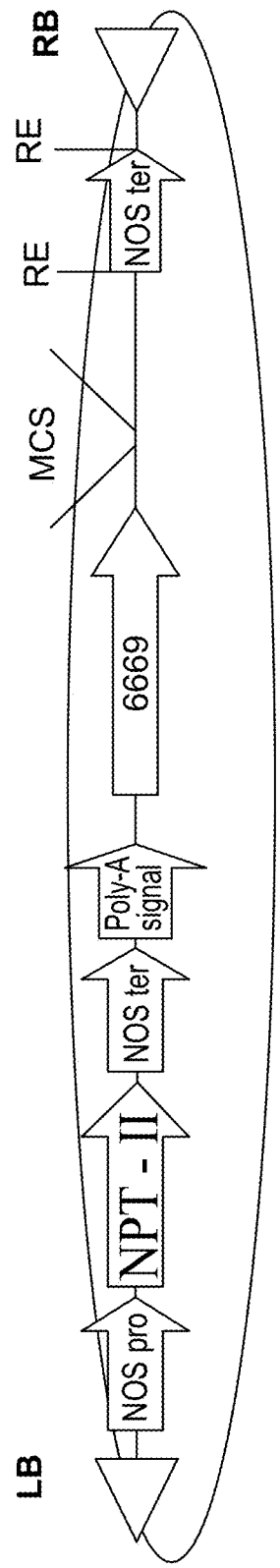
FIG. 2 is a schematic illustration of the modified pGI binary plasmid containing the new At6669 promoter (SEQ ID NO: 4880) (pQFN or pQFNc) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); The isolated polynucleotide sequences of the invention were cloned into the MCS of the vector.

The present inventors have identified novel polypeptides and polynucleotides which can be used to generate nucleic acid constructs, transgenic plants and to increase nitrogen use efficiency, fertilizer use efficiency, yield, growth rate, vigor, biomass, oil content, fiber yield, fiber quality, fiber length, photosynthetic capacity, abiotic stress tolerance and/or water use efficiency of a plant.

Thus, as shown in the Examples section which follows, the present inventors have utilized bioinformatics tools to identify polynucleotides which enhance/increase fertilizer use efficiency (e.g., nitrogen use efficiency), yield (e.g., seed yield, oil yield, oil content), growth rate, biomass, vigor, fiber yield, fiber quality, fiber length, photosynthetic capacity, and/or abiotic stress tolerance of a plant. Genes which affect the trait-of-interest were identified (SEQ ID NOs: 496-794) for polypeptides; and SEQ ID NOs: 1-495 (for polynucleotides) based on expression profiles of genes of several *Arabidopsis*, Barley, *Sorghum*, Maize, tomato, and Foxtail millet ecotypes and accessions in various tissues and growth conditions, homology with genes known to affect the trait-of-interest and using digital expression profile in specific tissues and conditions (Tables 1, and 3-99, Examples 1 and 3-11 of the Examples section which follows). Homologous (e.g., orthologous) polypeptides and polynucleotides having the same function were also identified [SEQ ID NOs: 2898-4855 (for polypeptides), and SEQ ID NOs: 795-2897 (for polynucleotides); Table 2, Example 2 of the Examples section which follows]. The polynucleotides of some embodiments of the invention were cloned into binary vectors (Example 12, Table 100), and were further transformed into *Arabidopsis* and *Brachypodium* plants (Examples 13-15). Transgenic plants over-expressing the identified polynucleotides were found to exhibit increased biomass, growth rate, vigor and yield under normal growth conditions or under nitrogen limiting growth conditions (Tables 101-128; Examples 16-20), and increased tolerance to abiotic stress conditions (e.g., nutrient deficiency) as compared to control plants grown under the same growth conditions. Altogether, these results suggest the use of the novel polynucleotides and polypeptides of the invention (e.g., SEQ ID NOs: 496-794 and 2898-4855 and SEQ ID NOs: 1-495 and 795-2897) for increasing nitrogen use efficiency, fertilizer use efficiency, yield (e.g., oil yield, seed yield and oil content), growth rate, biomass, vigor, fiber yield, fiber quality, fiber length, photosynthetic capacity, water use efficiency and/or abiotic stress tolerance of a plant.

Thus, according to an aspect of some embodiments of the invention, there is provided method of increasing fertilizer use efficiency (e.g., nitrogen use efficiency), oil content, yield, growth rate, biomass, vigor, fiber yield, fiber quality, fiber length, photosynthetic capacity, and/or abiotic stress tolerance of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 496-794, 2898-3645, 3647-4854 and 4855, thereby increasing the fertilizer use efficiency (e.g., nitrogen use efficiency), oil content, yield, growth rate, biomass, vigor, fiber yield, fiber quality, fiber length, photosynthetic capacity, and/or abiotic stress tolerance of the plant.

As used herein the phrase "plant yield" refers to the amount (e.g., as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the phrase "growth rate" refers to the increase in plant organ/tissue size per time (can be measured in $cm^2$ per day or cm/day).

As used herein the phrase "photosynthetic capacity" (also known as "$A_{max}$") is a measure of the maximum rate at which leaves are able to fix carbon during photosynthesis. It is typically measured as the amount of carbon dioxide that is fixed per square meter per second, for example as µmol $m^{-2}$ $sec^{-1}$. Plants are able to increase their photosynthetic capacity by several modes of action, such as by increasing the total leaves area (e.g., by increase of leaves area, increase in the number of leaves, and increase in plant's vigor, e.g., the ability of the plant to grow new leaves along time course) as well as by increasing the ability of the plant to efficiently execute carbon fixation in the leaves. Hence, the increase in total leaves area can be used as a reliable measurement parameter for photosynthetic capacity increment.

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in improved field stand.

Improving early vigor is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigor into plants would be of great importance in agriculture. For example, poor early vigor has been a limitation to the introduction of maize (*Zea mays* L.) hybrids based on Corn Belt germplasm in the European Atlantic.

It should be noted that a plant yield can be determined under stress (e.g., abiotic stress, nitrogen-limiting conditions) and/or non-stress (normal) conditions.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, osmotic stress, water deprivation, drought, flooding, freezing, low or high temperature, heavy metal toxicity, anaerobiosis, nutrient deficiency (e.g., nitrogen deficiency or limited nitrogen), atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related. Zhu (2002) Ann Rev. Plant Biol. 53: 247-273 et al. note that "most studies on water stress signaling have focused on salt stress primarily because plant responses to salt and drought are closely related and the mechanisms overlap". Many examples of similar responses and pathways to this set of stresses have been documented. For example, the CBF transcription factors have been shown to condition resistance to salt, freezing and drought (Kasuga et al. (1999) Nature Biotech. 17: 287-291). The *Arabidopsis* rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In *Mesembryanthemum crystallinum* (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al. (1992) Planta 188: 265-270). In addition to the induction of cold-acclimation proteins, strategies that allow plants to survive in low water conditions may include, for example, reduced surface area, or surface oil or wax production. In another example increased solute content of the plant prevents evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control resistance to the other stresses. Nonetheless, if a gene conditions resistance to one of these stresses, it would be apparent to one skilled in the art to test for resistance to these related stresses. Methods of assessing stress resistance are further provided in the Examples section which follows.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield.

It should be noted that improved ABST will confer plants with improved vigor also under non-stress conditions, resulting in crops having improved biomass and/or yield e.g., elongated fibers for the cotton industry, higher oil content.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of *Sorghum vulgare* used in the manufacture of brushes and brooms).

Example of fiber producing plants, include, but are not limited to, agricultural crops such as cotton, silk cotton tree (Kapok, *Ceiba pentandra*), desert willow, creosote bush, winterfat, balsa, kenaf, roselle, jute, sisal abaca, flax, corn, sugar cane, hemp, ramie, kapok, coir, bamboo, spanish moss and *Agave* spp. (e.g. sisal).

As used herein the phrase "fiber quality" refers to at least one fiber parameter which is agriculturally desired, or required in the fiber industry (further described hereinbelow). Examples of such parameters, include but are not limited to, fiber length, fiber strength, fiber fitness, fiber weight per unit length, maturity ratio and uniformity (further described hereinbelow).

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in fertilizer use efficiency, nitrogen use efficiency, yield, seed yield, biomass, growth rate, vigor, oil content, fiber yield, fiber quality, fiber length, photosynthetic capacity, and/or abiotic stress tolerance of a plant as compared to a native plant or a wild type plant [i.e., a plant not modified with the biomolecules (polynucleotide or polypeptides) of the invention, e.g., a non-transformed plant of the same species which is grown under the same (e.g., identical) growth conditions].

The phrase "expressing within the plant an exogenous polynucleotide" as used herein refers to upregulating the expression level of an exogenous polynucleotide within the plant by introducing the exogenous polynucleotide into a plant cell or plant and expressing by recombinant means, as further described herein below.

As used herein "expressing" refers to expression at the mRNA and optionally polypeptide level.

As used herein, the phrase "exogenous polynucleotide" refers to a heterologous nucleic acid sequence which may not be naturally expressed within the plant (e.g., a nucleic acid sequence from a different species) or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

According to some embodiments of the invention, the exogenous polynucleotide of the invention comprises a nucleic acid sequence encoding a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 496-794, 2898-3645, 3647-4854 and 4855.

Homologous sequences include both orthologous and paralogous sequences. The term "paralogous" relates to gene-duplications within the genome of a species leading to paralogous genes. The term "orthologous" relates to homologous genes in different organisms due to ancestral relationship. Thus, orthologs are evolutionary counterparts derived from a single ancestral gene in the last common ancestor of given two species (Koonin E V and Galperin M Y (Sequence-Evolution-Function: Computational Approaches in Comparative Genomics, Boston: Kluwer Academic; 2003. Chapter 2, Evolutionary Concept in Genetics and Genomics. Available from: ncbi (dot) nlm (dot) nih (dot) gov/books/NBK20255) and therefore have great likelihood of having the same function.

One option to identify orthologues in monocot plant species is by performing a reciprocal blast search. This may be done by a first blast involving blasting the sequence-of-interest against any sequence database, such as the publicly available NCBI database which may be found at: ncbi (dot) nlm (dot) nih (dot) gov. If orthologues in rice were sought, the sequence-of-interest would be blasted against, for example, the 28,469 full-length cDNA clones from *Oryza sativa* Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [ebi (dot) ac (dot) uk/Tools/clustalw2/index (dot) html], followed by a neighbor-joining tree (wikipedia (dot) org/wiki/Neighbor-joining) which helps visualizing the clustering.

Homology (e.g., percent homology, sequence identity+ sequence similarity) can be determined using any homology comparison software computing a pairwise sequence alignment.

As used herein, "sequence identity" or "identity" in the context of two nucleic acid or polypeptide sequences includes reference to the residues in the two sequences which are the same when aligned. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are said to have "sequence similarity" or "similarity". Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Henikoff S and Henikoff J G. [Amino acid substitution matrices from protein blocks. Proc. Natl. Acad. Sci. U.S.A. 1992, 89(22): 10915-9].

Identity (e.g., percent homology) can be determined using any homology comparison software, including for example, the BlastN software of the National Center of Biotechnology Information (NCBI) such as by using default parameters.

According to some embodiments of the invention, the identity is a global identity, i.e., an identity over the entire amino acid or nucleic acid sequences of the invention and not over portions thereof.

According to some embodiments of the invention, the term "homology" or "homologous" refers to identity of two or more nucleic acid sequences; or identity of two or more amino acid sequences; or the identity of an amino acid sequence to one or more nucleic acid sequence.

According to some embodiments of the invention, the homology is a global homology, i.e., an homology over the entire amino acid or nucleic acid sequences of the invention and not over portions thereof.

The degree of homology or identity between two or more sequences can be determined using various known sequence comparison tools. Following is a non-limiting description of such tools which can be used along with some embodiments of the invention.

Pairwise global alignment was defined by S. B. Needleman and C. D. Wunsch, "A general method applicable to the search of similarities in the amino acid sequence of two proteins" Journal of Molecular Biology, 1970, pages 443-53, volume 48).

For example, when starting from a polypeptide sequence and comparing to other polypeptide sequences, the EMBOSS-6.0.1 Needleman-Wunsch algorithm (available from emboss(dot)sourceforge(dot)net/apps/cvs/emboss/apps/needle(dot)html) can be used to find the optimum alignment (including gaps) of two sequences along their entire length—a "Global alignment". Default parameters for Needleman-Wunsch algorithm (EMBOSS-6.0.1) include: gapopen=10; gapextend=0.5; datafile=EBLOSUM62; brief=YES.

According to some embodiments of the invention, the parameters used with the EMBOSS-6.0.1 tool (for protein-protein comparison) include: gapopen=8; gapextend=2; datafile=EBLOSUM62; brief=YES.

According to some embodiments of the invention, the threshold used to determine homology using the EMBOSS-6.0.1 Needleman-Wunsch algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting from a polypeptide sequence and comparing to polynucleotide sequences, the OneModel FramePlus algorithm [Halperin, E., Faigler, S. and Gill-More, R. (1999)—FramePlus: aligning DNA to protein sequences. Bioinformatics, 15, 867-873) (available from biocceleration (dot)com/Products(dot)html] can be used with following default parameters: model=frame+_p2n.model mode=local. According to some embodiments of the invention, the parameters used with the OneModel FramePlus algorithm are model=frame+_p2n.model, mode=qglobal.

According to some embodiments of the invention, the threshold used to determine homology using the OneModel FramePlus algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting with a polynucleotide sequence and comparing to other polynucleotide sequences the EMBOSS-6.0.1 Needleman-Wunsch algorithm (available from emboss(dot)sourceforge(dot)net/apps/cvs/emboss/apps/needle(dot)html) can be used with the following default parameters: (EMBOSS-6.0.1) gapopen=10; gapextend=0.5; datafile=EDNAFULL; brief=YES.

According to some embodiments of the invention, the parameters used with the EMBOSS-6.0.1 Needleman-Wunsch algorithm are gapopen=10; gapextend=0.2; datafile=EDNAFULL; brief=YES.

According to some embodiments of the invention, the threshold used to determine homology using the EMBOSS-6.0.1 Needleman-Wunsch algorithm for comparison of polynucleotides with polynucleotides is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiment, determination of the degree of homology further requires employing the Smith-Waterman algorithm (for protein-protein comparison or nucleotide-nucleotide comparison).

Default parameters for GenCore 6.0 Smith-Waterman algorithm include: model=sw.model.

According to some embodiments of the invention, the threshold used to determine homology using the Smith-Waterman algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiments of the invention, the global homology is performed on sequences which are pre-selected by local homology to the polypeptide or polynucleotide of interest (e.g., 60% identity over 60% of the sequence length), prior to performing the global homology to the polypeptide or polynucleotide of interest (e.g., 80% global homology on the entire sequence). For example, homologous sequences are selected using the BLAST software with the Blastp and tBlastn algorithms as filters for the first stage, and the needle (EMBOSS package) or Frame+ algorithm alignment for the second stage. Local identity (Blast alignments) is defined with a very permissive cut-off—60% Identity on a span of 60% of the sequences lengths because it is used only as a filter for the global alignment stage. In this specific embodiment (when the local identity is used), the default filtering of the Blast package is not utilized (by setting the parameter "-F F").

In the second stage, homologs are defined based on a global identity of at least 80% to the core gene polypeptide sequence.

According to some embodiments of the invention, two distinct forms for finding the optimal global alignment for protein or nucleotide sequences are used:
1. Between two proteins (following the blastp filter): EMBOSS-6.0.1 Needleman-Wunsch algorithm with the following modified parameters: gapopen=8 gapextend=2. The rest of the parameters are unchanged from the default options listed here:

Standard (Mandatory) qualifiers:
[-asequence] sequence Sequence filename and optional format, or reference (input USA)
[-bsequence] seqall Sequence(s) filename and optional format, or reference (input USA)
-gapopen float [10.0 for any sequence]. The gap open penalty is the score taken away when a gap is created. The best value depends on the choice of comparison matrix. The default value assumes you are using the EBLOSUM62 matrix for protein sequences, and the EDNAFULL matrix for nucleotide sequences. (Floating point number from 1.0 to 100.0)
-gapextend float [0.5 for any sequence]. The gap extension, penalty is added to the standard gap penalty for each base or residue in the gap. This is how long gaps are penalized. Usually you will expect a few long gaps rather than many short gaps, so the gap extension penalty should be lower than the gap penalty. An exception is where one or both sequences are single reads with possible sequencing errors in which case you would expect many single base gaps. You can get this result by setting the gap open penalty to zero (or very low) and using the gap extension penalty to control gap scoring. (Floating point number from 0.0 to 10.0)
[-outfile] align [*.needle] Output alignment file name Additional (Optional) qualifiers:
-datafile matrixf [EBLOSUM62 for protein, EDNAFULL for DNA]. This is the scoring matrix file used when comparing sequences. By default it is the file 'EBLOSUM62' (for proteins) or the file 'EDNAFULL' (for nucleic sequences). These files are found in the 'data' directory of the EMBOSS installation.

Advanced (Unprompted) Qualifiers:
-[no]brief boolean [Y] Brief identity and similarity Associated qualifiers:
"-asequence" associated qualifiers
-sbegin1 integer Start of the sequence to be used
-send1 integer End of the sequence to be used
-sreverse1 boolean Reverse (if DNA)
-sask1 boolean Ask for begin/end/reverse
-snucleotide1 boolean Sequence is nucleotide
-sprotein1 boolean Sequence is protein
-slower1 boolean Make lower case
-supper1 boolean Make upper case
-sformat1 string Input sequence format
-sdbname1 string Database name
-sid1 string Entryname
-ufo1 string UFO features
-fformat1 string Features format
-fopenfile1 string Features file name
"-bsequence" associated qualifiers
-sbegin2 integer Start of each sequence to be used
-send2 integer End of each sequence to be used
-sreverse2 boolean Reverse (if DNA)
-sask2 boolean Ask for begin/end/reverse
-snucleotide2 boolean Sequence is nucleotide
-sprotein2 boolean Sequence is protein
-slower2 boolean Make lower case
-supper2 boolean Make upper case
-sformat2 string Input sequence format
-sdbname2 string Database name
-sid2 string Entryname
-ufo2 string UFO features
-fformat2 string Features format
-fopenfile2 string Features file name
"-outfile" associated qualifiers
-aformat3 string Alignment format
-aextension3 string File name extension
-aname3 string Base file name
-awidth3 integer Alignment width
-aaccshow3 boolean Show accession number in the header
-adesshow3 boolean Show description in the header
-ausashow3 boolean Show the full USA in the alignment
-aglobal3 boolean Show the full sequence in alignment General qualifiers:
-auto boolean Turn off prompts
-stdout boolean Write first file to standard output
-filter boolean Read first file from standard input, write first file to standard output
-options boolean Prompt for standard and additional values
-debug boolean Write debug output to program.dbg
-verbose boolean Report some/full command line options
-help boolean Report command line options. More information on associated and general qualifiers can be found with -help -verbose
-warning boolean Report warnings
-error boolean Report errors
-fatal boolean Report fatal errors
-die boolean Report dying program messages 2. Between a protein sequence and a nucleotide sequence (following the tblastn filter): GenCore 6.0 OneModel application utilizing the Frame+ algorithm with the following parameters: model=frame+_p2n.model mode=qglobal -q=protein.sequence -db=nucleotide.sequence. The rest of the parameters are unchanged from the default options:

Usage:
om -model=<model_fname> [-q=]query [-db=]database [options]
-model=<model_fname> Specifies the model that you want to run. All models supplied by Compugen are located in the directory $CGNROOT/models/.

Valid Command Line Parameters:
-dev=<dev_name> Selects the device to be used by the application.
Valid devices are:
bic—Bioccelerator (valid for SW, XSW, FRAME_N2P, and FRAME_P2N models).
xlg—BioXL/G (valid for all models except XSW).
xlp—BioXL/P (valid for SW, FRAME+_N2P, and FRAME_P2N models).
xlh—BioXL/H (valid for SW, FRAME+_N2P, and FRAME_P2N models).
soft—Software device (for all models).
-q=<query> Defines the query set. The query can be a sequence file or a database reference. You can specify a query by its name or by accession number. The format is detected automatically. However, you may specify a format using the -qfmt parameter. If you do not specify a query, the program prompts for one. If the query set is a database reference, an output file is produced for each sequence in the query.

-db=<database name> Chooses the database set. The database set can be a sequence file or a database reference. The database format is detected automatically. However, you may specify a format using -dfmt parameter.
-qacc Add this parameter to the command line if you specify query using accession numbers.
-dacc Add this parameter to the command line if you specify a database using accession numbers.
-dfmt/-qfmt=<format_type> Chooses the database/query format type. Possible formats are:
  fasta—fasta with seq type auto-detected.
  fastap—fasta protein seq.
  fastan—fasta nucleic seq.
  gcg—gcg format, type is auto-detected.
  gcg9seq—gcg9 format, type is auto-detected.
  gcg9seqp—gcg9 format protein seq.
  gcg9seqn—gcg9 format nucleic seq.
  nbrf—nbrf seq, type is auto-detected.
  nbrfp—nbrf protein seq.
  nbrfn—nbrf nucleic seq.
  embl—embl and swissprot format.
  genbank—genbank format (nucleic).
  blast—blast format.
  nbrf_gcg—nbrf-gcg seq, type is auto-detected.
  nbrf_gcgp—nbrf-gcg protein seq.
  nbrf_gcgn—nbrf-gcg nucleic seq.
  raw—raw ascii sequence, type is auto-detected.
  rawp—raw ascii protein sequence.
  rawn—raw ascii nucleic sequence.
  pir—pir codata format, type is auto-detected.
  profile—gcg profile (valid only for -qfmt
  in SW, XSW, FRAME_P2N, and FRAME+_P2N).
-out=<out_fname> The name of the output file.
-suffix=<name> The output file name suffix.
-gapop=<n> Gap open penalty. This parameter is not valid for FRAME+. For FrameSearch the default is 12.0. For other searches the default is 10.0.
-gapext=<n> Gap extend penalty. This parameter is not valid for FRAME+. For FrameSearch the default is 4.0. For other models: the default for protein searches is 0.05, and the default for nucleic searches is 1.0.
-qgapop=<n> The penalty for opening a gap in the query sequence. The default is 10.0. Valid for XSW.
-qgapext=<n> The penalty for extending a gap in the query sequence. The default is 0.05. Valid for XSW.
-start=<n> The position in the query sequence to begin the search.
-end=<n> The position in the query sequence to stop the search.
-qtrans Performs a translated search, relevant for a nucleic query against a protein database. The nucleic query is translated to six reading frames and a result is given for each frame.
  Valid for SW and XSW.
-dtrans Performs a translated search, relevant for a protein query against a DNA database. Each database entry is translated to six reading frames and a result is given for each frame.
  Valid for SW and XSW.
Note: "-qtrans" and "-dtrans" options are mutually exclusive.
-matrix=<matrix_file> Specifies the comparison matrix to be used in the search. The matrix must be in the BLAST format. If the matrix file is not located in $CGNROOT/tables/matrix, specify the full path as the value of the -matrix parameter.
-trans=<transtab_name> Translation table. The default location for the table is $CGNROOT/tables/trans.
-onestrand Restricts the search to just the top strand of the query/database nucleic sequence.
-list=<n> The maximum size of the output hit list. The default is 50.
-docalign=<n> The number of documentation lines preceding each alignment. The default is 10.
-thr_score=<score_name> The score that places limits on the display of results. Scores that are smaller than -thr_min value or larger than -thr_max value are not shown. Valid options are: quality.
  zscore.
  escore.
-thr_max=<n> The score upper threshold. Results that are larger than -thr_max value are not shown.
-thr_min=<n> The score lower threshold. Results that are lower than -thr_min value are not shown.
-align=<n> The number of alignments reported in the output file.
-noalign Do not display alignment.
Note: "-align" and "-noalign" parameters are mutually exclusive.
-outfmt=<format_name> Specifies the output format type. The default format is PFS.
Possible values are:
  PFS—PFS text format
  FASTA—FASTA text format
  BLAST—BLAST text format
-nonorm Do not perform score normalization.
-norm=<norm_name> Specifies the normalization method. Valid options are:
  log—logarithm normalization.
  std—standard normalization.
  stat—Pearson statistical method.
Note: "-nonorm" and "-norm" parameters cannot be used together.
Note: Parameters -xgapop, -xgapext, -fgapop, -fgapext, -ygapop, -ygapext, -delop, and -delext apply only to FRAME+.
-xgapop=<n> The penalty for opening a gap when inserting a codon (triplet). The default is 12.0.
-xgapext=<n> The penalty for extending a gap when inserting a codon (triplet). The default is 4.0.
-ygapop=<n> The penalty for opening a gap when deleting an amino acid. The default is 12.0.
-ygapext=<n> The penalty for extending a gap when deleting an amino acid. The default is 4.0.
-fgapop=<n> The penalty for opening a gap when inserting a DNA base. The default is 6.0.
-fgapext=<n> The penalty for extending a gap when inserting a DNA base. The default is 7.0.
-delop=<n> The penalty for opening a gap when deleting a DNA base. The default is 6.0.
-delext=<n> The penalty for extending a gap when deleting a DNA base. The default is 7.0.
-silent No screen output is produced.
-host=<host_name> The name of the host on which the server runs. By default, the application uses the host specified in the file $CGNROOT/cgnhosts.
-wait Do not go to the background when the device is busy. This option is not relevant for the Parseq or Soft pseudo device.
-batch Run the job in the background. When this option is specified, the file "$CGNROOT/defaults/batch.defaults" is used for choosing the batch command. If this file does not exist, the command "at now" is used to run the job.

Note: "-batch" and "-wait" parameters are mutually exclusive.
-version Prints the software version number.
-help Displays this help message. To get more specific help type: "om -model=<model_fname>-help".

According to some embodiments the homology is a local homology or a local identity.

Local alignments tools include, but are not limited to the BlastP, BlastN, BlastX or TBLASTN software of the National Center of Biotechnology Information (NCBI), FASTA, and the Smith-Waterman algorithm.

A tblastn search allows the comparison between a protein sequence to the six-frame translations of a nucleotide database. It can be a very productive way of finding homologous protein coding regions in unannotated nucleotide sequences such as expressed sequence tags (ESTs) and draft genome records (HTG), located in the BLAST databases est and htgs, respectively.

Default parameters for blastp include: Max target sequences: 100; Expected threshold: $e^{-5}$; Word size: 3; Max matches in a query range: 0; Scoring parameters: Matrix—BLOSUM62; filters and masking: Filter—low complexity regions.

Local alignments tools, which can be used include, but are not limited to, the tBLASTX algorithm, which compares the six-frame conceptual translation products of a nucleotide query sequence (both strands) against a protein sequence database. Default parameters include: Max target sequences: 100; Expected threshold: 10; Word size: 3; Max matches in a query range: 0; Scoring parameters: Matrix—BLOSUM62; filters and masking: Filter—low complexity regions.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:496-794, 2898-3645, 3647-4854 and 4855.

According to some embodiments of the invention, the exogenous polynucleotide of the invention encodes a polypeptide having the amino acid sequence selected from the group consisting of SEQ ID NOs: 496-794, 2898-4854 and 4855.

According to some embodiments of the invention, the method of increasing fertilizer use efficiency, nitrogen use efficiency, yield, biomass, growth rate, vigor, oil content, fiber yield, fiber quality, fiber length, photosynthetic capacity, and/or abiotic stress tolerance of a plant, is effected by expressing within the plant an exogenous polynucleotide comprising a nucleic acid sequence encoding a polypeptide at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:496-794, 2898-3645, 3647-4854 and 4855, thereby increasing the fertilizer use efficiency, nitrogen use efficiency, yield, biomass, growth rate, vigor, oil content, fiber yield, fiber quality, fiber length, photosynthetic capacity and/or abiotic stress tolerance of the plant.

According to some embodiments of the invention, the exogenous polynucleotide encodes a polypeptide consisting of the amino acid sequence set forth by SEQ ID NO:496-794, 2898-4854 or 4855.

According to an aspect of some embodiments of the invention, the method of increasing fertilizer use efficiency, nitrogen use efficiency, yield, biomass, growth rate, vigor, oil content, fiber yield, fiber quality, fiber length, photosynthetic capacity, and/or abiotic stress tolerance of a plant is effected by expressing within the plant an exogenous polynucleotide comprising a nucleic acid sequence encoding a polypeptide comprising an amino acid sequence selected from the group consisting of SEQ ID NOs:496-794, 2898-4854 and 4855, thereby increasing the fertilizer use efficiency, nitrogen use efficiency, yield, biomass, growth rate, vigor, oil content, fiber yield, fiber quality, fiber length, photosynthetic capacity, and/or abiotic stress tolerance of the plant.

According to an aspect of some embodiments of the invention, there is provided a method of increasing fertilizer use efficiency, nitrogen use efficiency, yield, biomass, growth rate, vigor, oil content, fiber yield, fiber quality, fiber length, photosynthetic capacity, and/or abiotic stress tolerance of a plant, comprising expressing within the plant an exogenous polynucleotide comprising a nucleic acid sequence encoding a polypeptide selected from the group consisting of SEQ ID NOs: 496-794, 2898-4854 and 4855, thereby increasing the fertilizer use efficiency, nitrogen use efficiency, yield, biomass, growth rate, vigor, oil content, fiber yield, fiber quality, fiber length, photosynthetic capacity, and/or abiotic stress tolerance of the plant.

According to some embodiments of the invention, the exogenous polynucleotide encodes a polypeptide consisting of the amino acid sequence set forth by SEQ ID NO: 496-794, 2898-4854 or 4855.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-495, 795-2896 and 2897.

According to an aspect of some embodiments of the invention, there is provided a method of increasing fertilizer use efficiency, nitrogen use efficiency, yield, biomass, growth rate, vigor, oil content, fiber yield, fiber quality, fiber length, photosynthetic capacity, and/or abiotic stress tolerance of a plant, comprising expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-495, 795-2896 and 2897, thereby increasing the fertilizer use efficiency, nitrogen use efficiency, yield, biomass, growth rate, vigor, oil content, fiber yield, fiber quality, fiber length, photosynthetic capacity, and/or abiotic stress tolerance of the plant.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-495, 795-2896 and 2897.

According to some embodiments of the invention the exogenous polynucleotide is set forth by SEQ ID NO: 1-495, 795-2896 or 2897.

According to some embodiments of the invention the method of increasing fertilizer use efficiency, nitrogen use efficiency, yield, growth rate, biomass, vigor, oil content, seed yield, fiber yield, fiber quality, fiber length, photosynthetic capacity, and/or abiotic stress tolerance of a plant further comprising selecting a plant having an increased fertilizer use efficiency, nitrogen use efficiency, yield, growth rate, biomass, vigor, oil content, seed yield, fiber yield, fiber quality, fiber length, photosynthetic capacity, and/or abiotic stress tolerance as compared to the wild type plant of the same species which is grown under the same growth conditions.

It should be noted that selecting a transformed plant having an increased trait as compared to a native (or non-transformed) plant grown under the same growth conditions is performed by selecting for the trait, e.g., validating the ability of the transformed plant to exhibit the increased trait using well known assays (e.g., seedling analyses, greenhouse assays) as is further described herein below.

According to an aspect of some embodiments of the invention, there is provided a method of selecting a transformed plant having increased fertilizer use efficiency, nitrogen use efficiency, yield, growth rate, biomass, vigor, oil content, seed yield, fiber yield, fiber quality, fiber length, photosynthetic capacity, and/or abiotic stress tolerance as compared to a wild type plant of the same species which is grown under the same growth conditions, the method comprising:

(a) providing plants transformed with an exogenous polynucleotide encoding a polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (e.g., having sequence similarity or sequence identity) to the amino acid sequence selected from the group consisting of SEQ ID NOs: 496-794, 2898-3645, 3647-4854 and 4855, (b) selecting from said plants a plant having increased fertilizer use efficiency, nitrogen use efficiency, yield, growth rate, biomass, vigor, oil content, seed yield, fiber yield, fiber quality, fiber length, photosynthetic capacity, and/or abiotic stress tolerance, thereby selecting the plant having increased fertilizer use efficiency, nitrogen use efficiency, yield, growth rate, biomass, vigor, oil content, seed yield, fiber yield, fiber quality, fiber length, photosynthetic capacity, and/or abiotic stress tolerance as compared to the wild type plant of the same species which is grown under the same growth conditions.

According to an aspect of some embodiments of the invention, there is provided a method of selecting a transformed plant having increased fertilizer use efficiency, nitrogen use efficiency, yield, growth rate, biomass, vigor, oil content, seed yield, fiber yield, fiber quality, fiber length, photosynthetic capacity, and/or abiotic stress tolerance as compared to a wild type plant of the same species which is grown under the same growth conditions, the method comprising:

(a) providing plants transformed with an exogenous polynucleotide encoding a polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-495, 795-2896 and 2897, (b) selecting from said plants a plant having increased fertilizer use efficiency, nitrogen use efficiency, yield, growth rate, biomass, vigor, oil content, seed yield, fiber yield, fiber quality, fiber length, photosynthetic capacity, and/or abiotic stress tolerance, thereby selecting the plant having increased fertilizer use efficiency, nitrogen use efficiency, yield, growth rate, biomass, vigor, oil content, seed yield, fiber yield, fiber quality, fiber length, photosynthetic capacity, and/or abiotic stress tolerance as compared to the wild type plant of the same species which is grown under the same growth conditions.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N[(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (kazusa (dot) or (dot) jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase "non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Non-limiting examples of non-coding RNA polynucleotides are provided in SEQ ID NOs: 217, 218, 219, 287, 288, 495, 997, 1003, 1543 and 1703.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

According to some embodiments of the invention, the exogenous polynucleotide encodes a polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the amino acid sequence of a naturally occurring plant orthologue of the polypeptide selected from the group consisting of SEQ ID NOs: 496-794, and 2898-4855.

According to some embodiments of the invention, the polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the amino acid sequence of a naturally occurring plant orthologue of the polypeptide selected from the group consisting of SEQ ID NOs: 496-794, and 2898-4855.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-495, 795-2896 and 2897.

According to some embodiments of the invention the nucleic acid sequence is capable of increasing nitrogen use efficiency, fertilizer use efficiency, yield, growth rate, vigor, biomass, oil content, fiber yield, fiber quality, fiber length, photosynthetic capacity, abiotic stress tolerance and/or water use efficiency of a plant.

According to some embodiments of the invention the isolated polynucleotide comprising the nucleic acid sequence selected from the group consisting of SEQ ID NOs: 1-495, 795-2896 and 2897.

According to some embodiments of the invention the isolated polynucleotide is set forth by SEQ ID NO: 1-495, 795-2896 or 2897.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NOs: 496-794, 2898-3645, 3647-4854 and 4855.

According to some embodiments of the invention the amino acid sequence is capable of increasing nitrogen use efficiency, fertilizer use efficiency, yield, growth rate, vigor, biomass, oil content, fiber yield, fiber quality, fiber length, photosynthetic capacity, abiotic stress tolerance and/or water use efficiency of a plant.

The invention provides an isolated polynucleotide comprising a nucleic acid sequence encoding a polypeptide which comprises the amino acid sequence selected from the group consisting of SEQ ID NOs:496-794, 2898-4854 and 4855.

According to an aspect of some embodiments of the invention, there is provided a nucleic acid construct comprising the isolated polynucleotide of the invention, and a promoter for directing transcription of the nucleic acid sequence in a host cell.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NOs: 496-794, 2898-3645, 3647-4854 and 4855.

According to some embodiments of the invention, the polypeptide comprising an amino acid sequence selected from the group consisting of SEQ ID NOs:496-794, 2898-4854 and 4855.

According to some embodiments of the invention, the polypeptide is set forth by SEQ ID NO: 496-794, 2898-4854 or 4855.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses a whole plant, a grafted plant, ancestor(s) and progeny of the plants and plant parts, including seeds, shoots, stems, roots (including tubers), rootstock, scion, and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising Acacia spp., Acer spp., Actinidia spp., Aesculus spp., Agathis australis, Albizia amara, Alsophila tricolor, Andropogon spp., Arachis spp, Areca catechu, Astelia fragrans, Astragalus cicer, Baikiaea plurijuga, Betula spp., Brassica spp., Bruguiera gymnorrhiza, Burkea africana, Butea frondosa, Cadaba farinosa, Calliandra spp, Camellia sinensis, Canna indica, Capsicum spp., Cassia spp., Centroema pubescens, Chacoomeles spp., Cinnamomum cassia, Coffea arabica, Colophospermum mopane, Coronillia varia, Cotoneaster serotina, Crataegus spp., Cucumis spp., Cupressus spp., Cyathea dealbata, Cydonia oblonga, Cryptomeria japonica, Cymbopogon spp., Cynthea dealbata, Cydonia oblonga, Dalbergia monetaria, Davallia divaricata, Desmodium spp., Dicksonia squarosa, Dibeteropogon amplectens, Dioclea spp, Dolichos spp., Dorycnium rectum, Echinochloa pyramidalis, Ehraffia spp., Eleusine coracana, Eragrestis spp., Erythrina spp., Eucalypfus spp., Euclea schimperi, Eulalia vi/losa, Pagopyrum spp., Feijoa sellowlana, Fragaria spp., Flemingia spp, Freycinetia banksli, Geranium thunbergii, Ginkgo biloba, Glycine javanica, Gliricidia spp, Gossypium hirsutum, Grevillea spp., Guibourtia coleosperma, Hedysarum spp., Hemaffhia altissima, Heteropogon contoffus, Hordeum vulgare, Hyparrhenia rufa, Hypericum erectum, Hypeffhelia dissolute, Indigo incamata, Iris spp., Leptarrhena pyrolifolia, Lespediza spp., Lettuca spp., Leucaena leucocephala, Loudetia simplex, Lotonus bainesli, Lotus spp., Macrotyloma axillare, Malus spp., Manihot esculenta, Medicago saliva, Metasequoia glyptostroboides, Musa sapientum, Nicotianum spp., Onobrychis spp., Ornithopus spp., Oryza spp., Peltophorum africanum, Pennisetum spp., Persea gratissima, Petunia spp., Phaseolus spp., Phoenix canariensis, Phormium cookianum, Photinia spp., Picea glauca, Pinus spp., Pisum sativam, Podocarpus totara, Pogonarthria fleckii, Pogonaffhria squarrosa, Populus spp., Prosopis cineraria, Pseudotsuga menziesii, Pterolobium stellatum, Pyrus communis, Quercus spp., Rhaphiolepis umbellata, Rhopalostylis sapida, Rhus natalensis, Ribes grossularia, Ribes spp., Robinia pseudoacacia, Rosa spp., Rubus spp., Salix spp., Schyzachyrium sanguineum, Sciadopitys vefficillata, Sequoia sempervirens, Sequoiadendron giganteum, Sorghum bicolor, Spinacia spp., Sporobolus fimbriatus, Stiburus alopecuroides, Stylosanthos humilis, Tadehagi spp, Taxodium distichum, Themeda triandra, Trifolium spp., Triticum spp., Tsuga heterophylla, Vaccinium spp., Vicia spp., Vitis vinifera, Watsonia pyramidata, Zantedeschia aethiopica, Zea mays, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barley, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, poplar and cotton.

According to some embodiments of the invention the plant is a dicotyledonous plant.

According to some embodiments of the invention the plant is a monocotyledonous plant.

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of some embodiments of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

According to some embodiments of the invention, the promoter is heterologous to the isolated polynucleotide and/or to the host cell.

As used herein the phrase "heterologous promoter" refers to a promoter from a different species or from the same species but from a different gene locus as of the isolated polynucleotide sequence.

According to some embodiments of the invention, the isolated polynucleotide is heterologous to the plant cell.

Any suitable promoter sequence can be used by the nucleic acid construct of the present invention. Preferably the promoter is a constitutive promoter, a tissue-specific, or an abiotic stress-inducible promoter.

According to some embodiments of the invention, the promoter is a plant promoter, which is suitable for expression of the exogenous polynucleotide in a plant cell.

Suitable promoters for expression in wheat include, but are not limited to, Wheat SPA promoter (SEQ ID NO: 4856; Albanietal, Plant Cell, 9: 171-184, 1997, which is fully incorporated herein by reference), wheat LMW (SEQ ID NO: 4857 (longer LMW promoter), and SEQ ID NO: 4858 (LMW promoter) and HMW glutenin-1 (SEQ ID NO: 4859 (Wheat HMW glutenin-1 longer promoter); and SEQ ID NO: 4860 (Wheat HMW glutenin-1 Promoter); Thomas and Flavell, The Plant Cell 2:1171-1180; Furtado et al., 2009 Plant Biotechnology Journal 7:240-253, each of which is fully incorporated herein by reference), wheat alpha, beta and gamma gliadins [e.g., SEQ ID NO: 4861 (wheat alpha gliadin, B genome, promoter); SEQ ID NO: 4862 (wheat gamma gliadin promoter); EMBO 3:1409-15, 1984, which is fully incorporated herein by reference], wheat TdPR60 [SEQ ID NO: 4863 (wheat TdPR60 longer promoter) or SEQ ID NO:4864 (wheat TdPR60 promoter); Kovalchuk et al., Plant Mol Biol 71:81-98, 2009, which is fully incorporated herein by reference], maize Ub1 Promoter [cultivar Nongda 105 (SEQ ID NO: 4865); GenBank: DQ141598.1; Taylor et al., Plant Cell Rep 1993 12: 491-495, which is fully incorporated herein by reference; and cultivar B73 (SEQ ID NO:4866); Christensen, A H, et al. Plant Mol. Biol. 18 (4), 675-689 (1992), which is fully incorporated herein by reference]; rice actin 1 (SEQ ID NO: 4867; Mc Elroy et al. 1990, The Plant Cell, Vol. 2, 163-171, which is fully incorporated herein by reference), rice GOS2 [SEQ ID NO: 4868 (rice GOS2 longer promoter) and SEQ ID NO: 4869 (rice GOS2 Promoter); De Pater et al. Plant J. 1992; 2: 837-44, which is fully incorporated herein by reference], arabidopsis Pho1 [SEQ ID NO: 4870 (arabidopsis Pho1 Promoter); Hamburger et al., Plant Cell. 2002; 14: 889-902, which is fully incorporated herein by reference], ExpansinB promoters, e.g., rice ExpB5 [SEQ ID NO:4871 (rice ExpB5 longer promoter) and SEQ ID NO: 4872 (rice ExpB5 promoter)] and Barley ExpB1 [SEQ ID NO: 4873 (barley ExpB1 Promoter), Won et al. Mol Cells. 2010; 30:369-76, which is fully incorporated herein by reference], barley SS2 (sucrose synthase 2) [(SEQ ID NO: 4874), Guerin and Carbonero, Plant Physiology May 1997 vol. 114 no. 1 55-62, which is fully incorporated herein by reference], and rice PG5a [SEQ ID NO:4875, U.S. Pat. No. 7,700,835, Nakase et al., Plant Mol Biol. 32:621-30, 1996, each of which is fully incorporated herein by reference].

Suitable constitutive promoters include, for example, CaMV 35S promoter [SEQ ID NO: 4876 (CaMV 35S (QFNC) Promoter); SEQ ID NO: 4877 (PJJ 35S from Brachypodium); SEQ ID NO: 4878 (CaMV 35S (OLD) Promoter) (Odell et al., Nature 313:810-812, 1985)], Arabidopsis At6669 promoter (SEQ ID NO: 4879 (Arabidopsis At6669 (OLD) Promoter); see PCT Publication No. WO04081173A2 or the new At6669 promoter (SEQ ID NO: 4880 (Arabidopsis At6669 (NEW) Promoter)); maize Ub1 Promoter [cultivar Nongda 105 (SEQ ID NO:4865); GenBank: DQ141598.1; Taylor et al., Plant Cell Rep 1993 12: 491-495, which is fully incorporated herein by reference; and cultivar B73 (SEQ ID NO:4866); Christensen, A H, et al. Plant Mol. Biol. 18 (4), 675-689 (1992), which is fully incorporated herein by reference]; rice actin 1 (SEQ ID NO: 4867, McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); rice GOS2 [SEQ ID NO: 4868 (rice GOS2 longer Promoter) and SEQ ID NO: 4869 (rice GOS2 Promoter), de Pater et al, Plant J November; 2(6):837-44, 1992]; RBCS promoter (SEQ ID NO: 4881); Rice cyclophilin (Bucholz et al, Plant Mol Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608, 149; 5,608,144; 5,604,121; 5,569,597: 5,466,785; 5,399, 680; 5,268,463; and 5,608,142.

Suitable tissue-specific promoters include, but not limited to, leaf-specific promoters [e.g., AT5G06690 (Thioredoxin) (high expression, SEQ ID NO: 4882), AT5G61520 (At-STP3) (low expression, SEQ ID NO: 4883) described in Buttner et al 2000 Plant, Cell and Environment 23, 175-184, or the promoters described in Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993; as well as *Arabidopsis* STP3 (AT5G61520) promoter (Buttner et al., Plant, Cell and Environment 23:175-184, 2000)], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO: 4884 (*Brassica napus* NAPIN Promoter) from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), rice PG5a (SEQ ID NO: 4875; U.S. Pat. No. 7,700,835), early seed development *Arabidopsis* BAN (AT1G61720) (SEQ ID NO: 4885, US 2009/0031450 A1), late seed development *Arabidopsis* ABI3 (AT3G24650) (SEQ ID NO: 4886 (*Arabidopsis* ABI3 (AT3G24650) longer Promoter) or 4887 (*Arabidopsis* ABI3 (AT3G24650) Promoter)) (Ng et al., Plant Molecular Biology 54: 25-38, 2004), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143). 323-32 1990), napA (Stalberg, et al, Planta 199: 515-519, 1996), Wheat SPA (SEQ ID NO:4856; Albanietal, Plant Cell, 9: 171-184, 1997), sunflower oleosin (Cummins, et al., Plant Mol. Biol. 19: 873-876, 1992)], endosperm specific promoters [e.g., wheat LMW (SEQ ID NO: 4857 (Wheat LMW Longer Promoter), and SEQ ID NO: 4858 (Wheat LMW Promoter) and HMW glutenin-1 [(SEQ ID NO: 4859 (Wheat HMW glutenin-1 longer Promoter)); and SEQ ID NO: 4860 (Wheat HMW glutenin-1 Promoter), Thomas and Flavell, The Plant Cell 2:1171-1180, 1990; Mol Gen Genet 216:81-90, 1989; NAR 17:461-2), wheat alpha, beta and gamma gliadins (SEQ ID NO: 4861 (wheat alpha gliadin (B genome) promoter); SEQ ID NO: 4862 (wheat gamma gliadin promoter); EMBO 3:1409-15, 1984), Barley ltr1 promoter, barley B1, C, D hordein (Theor Appl Gen 98:1253-62, 1999; Plant J 4:343-55, 1993; Mol Gen Genet 250:750-60, 1996), Barley DOF (Mena et al, The Plant Journal, 116(1): 53-62, 1998), Biz2 (EP99106056.7), Barley SS2 (SEQ ID NO: 4874 (Barley SS2 Promoter); Guerin and Carbonero Plant Physiology 114: 1 55-62, 1997), wheat Tarp60 (Kovalchuk et al., Plant Mol Biol 71:81-98, 2009), barley D-hordein (D-Hor) and B-hordein (B-Hor) (Agnelo Furtado, Robert J. Henry and Alessandro Pellegrineschi (2009)], Synthetic promoter (Vicente-Carbajosa et al., Plant J. 13: 629-640, 1998), rice prolamin NRP33, rice-globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma et al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen Genet. 217: 240-245; 1989), *Arabidopsis apetala*-3 (Tilly et al., Development. 125:1647-57, 1998), *Arabidopsis* APETALA 1 (AT1G69120, AP1) (SEQ ID NO: 4888 (*Arabidopsis* (AT1G69120) *APETALA* 1)) (Hempel et al., Development 124:3845-3853, 1997)], and root promoters [e.g., the ROOTP promoter [SEQ ID NO: 4889]; rice ExpB5 (SEQ ID NO:4872 (rice ExpB5 Promoter); or SEQ ID NO: 4871 (rice ExpB5 longer Promoter)) and barley ExpB1 promoters (SEQ ID NO:4873) (Won et al. Mol. Cells 30: 369-376, 2010); *arabidopsis* ATTPS-CIN (AT3G25820) promoter (SEQ ID NO: 4890; Chen et al., Plant Phys 135:1956-66, 2004); *arabidopsis* Pho1 promoter (SEQ ID NO: 4870, Hamburger et al., Plant Cell. 14: 889-902, 2002), which is also slightly induced by stress].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S. and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/

Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual AS, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced from the seedlings to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Taylor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

According to some embodiments, there is provided a method of improving nitrogen use efficiency, fertilizer use efficiency, yield, growth rate, biomass, vigor, oil content, seed yield, fiber yield, fiber quality, fiber length, photosynthetic capacity, and/or abiotic stress tolerance of a grafted plant, the method comprising providing a scion that does not transgenically express a polynucleotide encoding a polypeptide at least 80% homologous to the amino acid sequence selected from the group consisting of SEQ ID NOs: 496-794, and 2898-4855 and a plant rootstock that transgenically expresses a polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs: 496-794, 2898-3645, 3647-4854 and 4855 (e.g., in a constitutive or an abiotic stress responsive manner), thereby improving the nitrogen use efficiency, fertilizer use efficiency, yield, growth rate, biomass, vigor, oil content, seed yield, fiber yield, fiber quality, fiber length, photosynthetic capacity, and/or abiotic stress tolerance of the grafted plant.

In some embodiments, the plant scion is non-transgenic.

Several embodiments relate to a grafted plant exhibiting improved nitrogen use efficiency, fertilizer use efficiency, yield, growth rate, biomass, vigor, oil content, seed yield, fiber yield, fiber quality, fiber length, photosynthetic capacity, and/or abiotic stress tolerance, comprising a scion that does not transgenically express a polynucleotide encoding a polypeptide at least 80% homologous to the amino acid sequence selected from the group consisting of SEQ ID NOs: 496-794 and 2898-4855 and a plant rootstock that transgenically expresses a polynucleotide encoding a polypeptide at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs: 496-794, 2898-3645, 3647-4854 and 4855.

In some embodiments, the plant root stock transgenically expresses a polynucleotide encoding a polypeptide at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs: 496-794, 2898-3645, 3647-4854 and 4855 in a stress responsive manner.

According to some embodiments of the invention, the plant root stock transgenically expresses a polynucleotide encoding a polypeptide selected from the group consisting of SEQ ID NOs: 496-794, 2898-4854 and 4855.

According to some embodiments of the invention, the plant root stock transgenically expresses a polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-495, and 795-2897.

According to some embodiments of the invention, the plant root stock transgenically expresses a polynucleotide selected from the group consisting of SEQ ID NOs: 1-495, and 795-2897.

Since processes which increase nitrogen use efficiency, fertilizer use efficiency, oil content, yield, seed yield, fiber yield, fiber quality, fiber length, photosynthetic capacity, growth rate, biomass, vigor and/or abiotic stress tolerance of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on nitrogen use efficiency, fertilizer use efficiency, oil content, yield, seed yield, fiber yield, fiber quality, fiber length, photosynthetic capacity, growth rate, biomass, vigor and/or abiotic stress tolerance.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, growth, biomass, yield and/or vigor traits, using conventional plant breeding techniques.

According to some embodiments of the invention, the method further comprising growing the plant expressing the exogenous polynucleotide under the abiotic stress.

Non-limiting examples of abiotic stress conditions include, salinity, osmotic stress, drought, water deprivation, excess of water (e.g., flood, waterlogging), etiolation, low temperature (e.g., cold stress), high temperature, heavy metal toxicity, anaerobiosis, nutrient deficiency (e.g., nitrogen deficiency or nitrogen limitation), nutrient excess, atmospheric pollution and UV irradiation.

According to some embodiments of the invention, the method further comprising growing the plant expressing the exogenous polynucleotide under fertilizer limiting conditions (e.g., nitrogen-limiting conditions). Non-limiting examples include growing the plant on soils with low nitrogen content (40-50% Nitrogen of the content present under normal or optimal conditions), or even under sever nitrogen deficiency (0-10% Nitrogen of the content present under normal or optimal conditions).

Thus, the invention encompasses plants exogenously expressing the polynucleotide(s), the nucleic acid constructs and/or polypeptide(s) of the invention.

Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., biomass, growth rate, oil content, yield, abiotic stress tolerance, water use efficiency, nitrogen use efficiency and/or fertilizer use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

Thus, according to an additional embodiment of the present invention, there is provided a method of evaluating a trait of a plant, the method comprising: (a) expressing in a plant or a portion thereof the nucleic acid construct of some embodiments of the invention; and (b) evaluating a trait of a plant as compared to a wild type plant of the same type (e.g., a plant not transformed with the claimed biomolecules); thereby evaluating the trait of the plant.

According to an aspect of some embodiments of the invention there is provided a method of producing a crop comprising growing a crop of a plant expressing an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 496-794, 2898-3645, 3647-4854 and 4855, wherein said plant is derived from a plant selected for increased fertilizer use efficiency, increased nitrogen use efficiency, increased abiotic stress tolerance, increased water use efficiency, increased growth rate, increased vigor, increased biomass, increased oil content, increased yield, increased seed yield, increased fiber yield, increased fiber quality, increased fiber length, and/or increased photosynthetic capacity as compared to a control plant, thereby producing the crop.

According to an aspect of some embodiments of the present invention there is provided a method of producing a crop comprising growing a crop plant transformed with an exogenous polynucleotide encoding a polypeptide at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 496-794, 2898-3645, 3647-4854 and 4855, wherein the crop plant is derived from plants selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a wild type plant of the same species which is grown under the same growth conditions, and the crop plant having the increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency), thereby producing the crop.

According to some embodiments of the invention the polypeptide is selected from the group consisting of SEQ ID NOs: 496-794, 2898-4854 and 4855.

According to an aspect of some embodiments of the invention there is provided a method of producing a crop comprising growing a crop of a plant expressing an exogenous polynucleotide which comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-495, 795-2896 and 2897, wherein said plant is derived from a plant (parent plant) that has been transformed to express the exogenous polynucleotide and that has been selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a control plant, thereby producing the crop.

According to an aspect of some embodiments of the present invention there is provided a method of producing a crop comprising growing a crop plant transformed with an exogenous polynucleotide at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the nucleic acid sequence selected from the group consisting of SEQ ID NOs: 1-495, 795-2896 and 2897, wherein the crop plant is derived from plants selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a wild type plant of the same species which is grown under the same growth conditions, and the crop plant having the increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency), thereby producing the crop.

According to some embodiments of the invention the exogenous polynucleotide is selected from the group consisting of SEQ ID NOs: 1-495, 795-2896 and 2897.

According to an aspect of some embodiments of the invention there is provided a method of growing a crop comprising seeding seeds and/or planting plantlets of a plant transformed with the exogenous polynucleotide of the invention, e.g., the polynucleotide which encodes the polypeptide of some embodiments of the invention, wherein the plant is derived from plants selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a non-transformed plant.

According to some embodiments of the invention the method of growing a crop comprising seeding seeds and/or planting plantlets of a plant transformed with an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to SEQ ID NO: 496-794, 2898-3645, 3647-4854 or 4855, wherein the plant is derived from plants selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a non-transformed plant, thereby growing the crop.

According to some embodiments of the invention the polypeptide is selected from the group consisting of SEQ ID NOs: 496-794, 2898-4854 and 4855.

According to some embodiments of the invention the method of growing a crop comprising seeding seeds and/or planting plantlets of a plant transformed with an exogenous polynucleotide comprising the nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to SEQ ID NO: 1-495, 795-2896 or 2897, wherein the plant is derived from plants selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a non-transformed plant, thereby growing the crop.

According to some embodiments of the invention the exogenous polynucleotide is selected from the group consisting of SEQ ID NOs: 1-495, 795-2896 and 2897.

The effect of the transgene (the exogenous polynucleotide encoding the polypeptide) on abiotic stress tolerance can be determined using known methods such as detailed below and in the Examples section which follows.

Abiotic stress tolerance—Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity tolerance assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic tolerance test—Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Drought tolerance assay/Osmoticum assay—Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control *Arabidopsis* plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold stress tolerance—To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat stress tolerance—Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water use efficiency—can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

$$RWC=[(FW-DW)/(TW-DW)]\times 100 \qquad \text{Formula I}$$

Fertilizer use efficiency—To analyze whether the transgenic plants are more responsive to fertilizers, plants are grown in agar plates or pots with a limited amount of fertilizer, as described, for example, in Examples 15-17 hereinbelow and in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen use efficiency—To analyze whether the transgenic plants (e.g., *Arabidopsis* plants) are more responsive to nitrogen, plant are grown in 0.75-3 mM (nitrogen deficient conditions) or 6-10 mM (optimal nitrogen concentration). Plants are allowed to grow for additional 25 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen use efficiency assay using plantlets—The assay is done according to Yanagisawa-S. et al. with minor modifications ("Metabolic engineering with Dof1 transcription factor in plants: Improved nitrogen assimilation and growth under low-nitrogen conditions" *Proc. Natl. Acad. Sci. USA* 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.75 mM (nitrogen deficient conditions) or 6-15 mM (optimal nitrogen concentration). Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock—transgenic plants expressing the uidA reporter gene (GUS) under the same promoter or transgenic plants carrying the same promoter but lacking a reporter gene are used as control.

Nitrogen determination—The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Germination tests—Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant vigor—The plant vigor can be calculated by the increase in growth parameters such as leaf area, fiber length, rosette diameter, plant fresh weight and the like per time.

Growth rate—The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Evaluation of growth rate can be done by measuring plant biomass produced, rosette area, leaf size or root length per time (can be measured in $cm^2$ per day of leaf area).

Relative growth area can be calculated using Formula II.

Relative growth rate area=Regression coefficient of area along time course   Formula II Thus, the relative growth area rate is in units of area units (e.g., $mm^2$/day or $cm^2$/day) and the relative length growth rate is in units of length units (e.g., cm/day or mm/day).

For example, RGR can be determined for plant height (Formula III), SPAD (Formula IV), Number of tillers (Formula V), root length (Formula VI), vegetative growth (Formula VII), leaf number (Formula VIII), rosette area (Formula IX), rosette diameter (Formula X), plot coverage (Formula XI), leaf blade area (Formula XII), and leaf area (Formula XIII).

Relative growth rate of Plant height=Regression coefficient of Plant height along time course (measured in cm/day).   Formula III Relative growth rate of SPAD=Regression coefficient of SPAD measurements along time course.   Formula IV Relative growth rate of Number of tillers=Regression coefficient of Number of tillers along time course(measured in units of "number of tillers/day").   Formula V Relative growth rate of root length=Regression coefficient of root length along time course(measured in cm per day).   Formula VI Vegetative growth rate analysis—was calculated according to Formula VII below.

Relative growth rate of vegetative growth=Regression coefficient of vegetative weight along time course(measured in grams per day).   Formula VII Relative growth rate of leaf number=Regression coefficient of leaf number along time course (measured in number per day).   Formula VIII Relative growth rate of rosette area=Regression coefficient of rosette area along time course (measured in $cm^2$ per day).   Formula IX Relative growth rate of rosette diameter=Regression coefficient of rosette diameter along time course (measured in cm per day).   Formula X Relative growth rate of plot coverage=Regression coefficient of plot(measured in $cm^2$ per day).   Formula XI Relative growth rate of leaf blade area=Regression coefficient of leaf area along time course(measured in $cm^2$ per day).   Formula XII Relative growth rate of leaf area=Regression coefficient of leaf area along time course(measured in $cm^2$ per day).   Formula XIII 1000 Seed Weight=number of seed in sample/sample weight×1000   Formula XIV The Harvest Index can be calculated using Formulas XV, XVI, XVII, XVIII and XXXVII below.

Harvest Index(seed)=Average seed yield per plant/ Average dry weight.   Formula XV Harvest Index(*Sorghum*)=Average grain dry weight per Head/(Average vegetative dry weight per Head+Average Head dry weight)   Formula XVI Harvest Index(Maize)=Average grain weight per plant/(Average vegetative dry weight per plant plus Average grain weight per plant)   Formula XVII Harvest Index (for barley)—The harvest index is calculated using Formula XVIII.

Harvest Index(for barley and wheat)=Average spike dry weight per plant/(Average vegetative dry weight per plant+Average spike dry weight per plant).   Formula XVIII Following is a non-limited list of additional parameters which can be detected in order to show the effect of the transgene on the desired plant's traits:

Grain circularity=4×3.14(grain area/$perimeter^2$)   Formula XIX internode volume=3.14×$(d/2)^2$×l   Formula XX Normalized ear weight per plant+vegetative dry weight.     Formula XXI Root/Shoot Ratio=total weight of the root at harvest/total weight of the vegetative portion above ground at harvest.(=RBiH/BiH)     Formula XXII Ratio of the number of pods per node on main stem at pod set=Total number of pods on main stem/Total number of nodes on main stem.     Formula XXIII Ratio of total number of seeds in main stem to number of seeds on lateral branches=Total number of seeds on main stem at pod set/Total number of seeds on lateral branches at pod set.     Formula XXIV Petiole Relative Area=(Petiole area)/Rosette area (measured in %).     Formula XXV % reproductive tiller percentage=Number of Reproductive tillers/number of tillers)×100.     Formula XXVI Spikes Index=Average Spikes weight per plant/(Average vegetative dry weight per plant plus Average Spikes weight per plant).     Formula XXVII Relative growth rate of root coverage=Regression coefficient of root coverage along time course.     Formula XXVIII Seed Oil yield=Seed yield per plant (gr.)*Oil % in seed.     Formula XXIX shoot/root Ratio=total weight of the vegetative portion above ground at harvest/total weight of the root at harvest.     Formula XXX Spikelets Index=Average Spikelets weight per plant/(Average vegetative dry weight per plant plus Average Spikelets weight per plant).     Formula XXXI % Canopy coverage=(1−(PAR_DOWN/PAR_UP))×100.     Formula XXXII leaf mass fraction=Leaf area/shoot FW.     Formula XXXIII Relative growth rate based on dry weight=Regression coefficient of dry weight along time course.     Formula XXXIV Total dry matter(for Maize)=Normalized ear weight per plant+vegetative dry weight.     Formula XXXV $$\text{Agronomical } NUE = \frac{\text{Yield per plant (Kg.)}^{X\ Nitrogen\ Fertilization} - \text{Yield per plant (Kg.)}^{0\%\ Nitrogen\ Fertilization}}{Fertilizer^X} \quad \text{Formula XXXVI}$$

Harvest Index(*brachypodium*)=Average grain weight/average dry(vegetative+spikelet)weight per plant.     Formula XXXVII Harvest Index for *Sorghum**(* when the plants were not dried)=FW(fresh weight)Heads/(FW Heads+FW Plants)     Formula XXXVIII Grain Fill Rate [mg/Day]—

Rate of dry matter accumulation in grain. The grain fill rate is calculated using Formula XXXIX Grain fill rate [mg/day]=[Grain weight*ear−1×1000]/[Grain number*ear−1]×[Grain filling duration]     Formula XXXIX Grain protein concentration—Grain protein content (g grain protein $m^{-2}$) is estimated as the product of the mass of grain N (g grain N $m^{-2}$) multiplied by the N/protein conversion ratio of k-5.13 (Mosse 1990, supra). The grain protein concentration is estimated as the ratio of grain protein content per unit mass of the grain (g grain protein $kg^{-1}$ grain).

Fiber length—Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (cottoninc (dot) com/ClassificationofCotton/?Pg=4#Length).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil content—The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle E R., 1963, Journal of the American Oil Chemists' Society; Springer Berlin/

Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods.

According to some embodiments of the invention, the oil comprises a seed oil.

According to some embodiments of the invention, the oil comprises a vegetative portion oil (oil of the vegetative portion of the plant).

According to some embodiments of the invention, the plant cell forms a part of a plant.

According to another embodiment of the present invention, there is provided a food or feed comprising the plants or a portion thereof of the present invention.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989);

Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Experimental and Bioinformatics Methods

RNA extraction—Tissues growing at various growth conditions (as described below) were sampled and RNA was extracted using TRIzol Reagent from Invitrogen [Hypertext Transfer Protocol://World Wide Web (dot) invitrogen (dot) com/content (dot)cfm?pageid=469]. Approximately 30-50 mg of tissue was taken from samples. The weighed tissues were ground using pestle and mortar in liquid nitrogen and resuspended in 500 µl of TRIzol Reagent. To the homogenized lysate, 100 µl of chloroform was added followed by precipitation using isopropanol and two washes with 75% ethanol. The RNA was eluted in 30 µl of RNase-free water. RNA samples were cleaned up using Qiagen's RNeasy minikit clean-up protocol as per the manufacturer's protocol (QIAGEN Inc, CA USA). For convenience, each microarray expression information tissue type has received an expression Set ID.

Correlation analysis—was performed for selected genes according to some embodiments of the invention, in which the characterized parameters (measured parameters according to the correlation IDs) were used as "x axis" for correlation with the tissue transcriptom which was used as the "Y axis". For each gene and measured parameter a correlation coefficient "R" was calculated (using Pearson correlation) along with a p-value for the significance of the correlation. When the correlation coefficient (R) between the levels of a gene's expression in a certain tissue and a phenotypic performance across ecotypes/variety/hybrid is high in absolute value (between 0.5-1), there is an association between the gene (specifically the expression level of this gene) the phenotypic characteristic (e.g., improved nitrogen use efficiency, abiotic stress tolerance, yield, growth rate and the like).

Example 1

Identifying Genes which Increase Nitrogen Use Efficiency (NUE), Fertilizer Use Efficiency (FUE), Yield, Growth Rate, Vigor, Biomass, Oil Content, Abiotic Stress Tolerance (ABST) and/or Water Use Efficiency (WUE) in Plants The present inventors have identified polynucleotides which upregulation of expression thereof in plants increases nitrogen use efficiency (NUE), fertilizer use efficiency (FUE), yield (e.g., seed yield, oil yield, biomass, grain quantity and/or quality), growth rate, vigor, biomass, oil content, fiber yield, fiber quality, fiber length, abiotic stress tolerance (ABST) and/or water use efficiency (WUE) of a plant.

All nucleotide sequence datasets used here were originated from publicly available databases or from performing sequencing using the Solexa technology (e.g. Barley and Sorghum). Sequence data from 100 different plant species was introduced into a single, comprehensive database. Other information on gene expression, protein annotation, enzymes and pathways were also incorporated. Major databases used include:

Genomes
  Arabidopsis genome [TAIR genome version 6 (arabidopsis (dot) org/)]
  Rice genome [IRGSP build 4.0 (rgp (dot) dna (dot) affrc (dot) go (dot) jp/IRGSP/)].
  Poplar [Populus trichocarpa release 1.1 from JGI (assembly release v1.0) (genome (dot) jgi-psf (dot) org/)]
  Brachypodium [JGI 4× assembly, brachpodium (dot) org)]
  Soybean [DOE-JGI SCP, version Glyma0 or Glyma1 (phytozome (dot) net/)]
  Grape [French-Italian Public Consortium for Grapevine Genome Characterization grapevine genome (genoscope (dot) cns (dot) fr/)]
  Castobean [TIGR/J Craig Venter Institute 4× assembly [(msc (dot) jcvi (dot) org/r_communis]
  Sorghum [DOE-JGI SCP, version Sbi1 [phytozome (dot) net/)].
  Maize [maizesequence (dot) org/]
  Cucumber [cucumber (dot) genomics (dot) org (dot) cn/page/cucumber/index (dot) jsp]
  Tomato [solgenomics (dot) net/tomato/]
  Cassava [phytozome (dot) net/cassava (dot) php]
Expressed EST and mRNA sequences were extracted from the following databases:
  GenBank (ncbi (dot) nlm (dot) nih (dot) gov/Genbank/).
  RefSeq (ncbi (dot) nlm (dot) nih (dot) gov/RefSeq/).
  TAIR (arabidopsis (dot) org/).
Protein and pathway databases
  Uniprot [uniprot (dot) org/].
  AraCyc [arabidopsis (dot) org/biocyc/index (dot) jsp].
  ENZYME [expasy (dot) org/enzyme/].
Microarray datasets were downloaded from:
  GEO (ncbi (dot) nlm (dot) nih (dot) gov/geo/)
  TAIR (Arabidopsis (dot) org/).
  Proprietary micro-array data (See WO2008/122980 and Examples 3-11 below).
QTL and SNPs information
  Gramene [gramene (dot) org/qtl/].
  Panzea [panzea (dot) org/index (dot) html].
  Soybean QTL: [soybeanbreederstoolbox(dot) com/].

Database Assembly—was performed to build a wide, rich, reliable annotated and easy database comprised of publicly available genomic mRNA, ESTs DNA sequences, data from various crops as well as gene expression, protein annotation and pathway, QTLs data, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST clustering and gene assembly—For gene clustering and assembly of organisms with available genome sequence data (arabidopsis, rice, castorbean, grape, brachypodium, poplar, soybean, sorghum) the genomic LEADS version (GANG) was employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene annotation—Predicted genes and proteins were annotated as follows:

Sequences blast search [blast (dot) ncbi (dot) nlm (dot) nih (dot) gov/Blast (dot) cgi] against all plant UniProt [uniprot (dot) org/] was performed. Open reading frames of each putative transcript were analyzed and longest ORF with higher number of homologues was selected as predicted protein of the transcript. The predicted proteins were analyzed by InterPro [ebi (dot) ac (dot) uk/interpro/].

Blast against proteins from AraCyc and ENZYME databases was used to map the predicted transcripts to AraCyc pathways.

Predicted proteins from different species were compared using blast algorithm [ncbi (dot) nlm (dot) nih (dot) gov/ Blast (dot) cgi] to validate the accuracy of the predicted protein sequence, and for efficient detection of orthologs.

Gene expression profiling—Several data sources were exploited for gene expression profiling, namely microarray data and digital expression profile (see below). According to gene expression profile, a correlation analysis was performed to identify genes which are co-regulated under different development stages and environmental conditions and associated with different phenotypes.

Publicly available microarray datasets were downloaded from TAIR and NCBI GEO sites, renormalized, and integrated into the database. Expression profiling is one of the most important resource data for identifying genes important for yield.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis Of The Melon Fruit Transcriptome Based On 454 Pyrosequencing) in: Plant & Animal Genomes XVII Conference, San Diego, Calif. Transcriptomic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags (ESTs) that assembled into 67,477 unigenes (32,357 singletons and 35,120 contigs). Analysis of the data obtained against the Cucurbit Genomics Database [icugi (dot) org/] confirmed the accuracy of the sequencing and assembly. Expression patterns of selected genes fitted well their qRT-PCR data.

Overall, 215 genes were identified to have a major impact on nitrogen use efficiency, fertilizer use efficiency, yield (e.g., seed yield, oil yield, grain quantity and/or quality), growth rate, vigor, biomass, oil content, fiber yield, fiber quality, fiber length, abiotic stress tolerance and/or water use efficiency when expression thereof is increased in plants. The identified genes, their curated polynucleotide and polypeptide sequences, as well as their updated sequences according to GenBank database are summarized in Table 1, hereinbelow.

TABLE 1

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster tag | Organism | Polyn. SEQ ID NO: | Polyp. SEQ ID NO: |
|---|---|---|---|---|
| LNU749 | barley\|10v2\|AV834836 | barley | 1 | 496 |
| LNU749 | barley\|10v2\|AV834836 | barley | 1 | 712 |
| LNU750 | barley\|10v2\|BE215751 | barley | 2 | 497 |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster tag | Organism | Polyn. SEQ ID NO: | Polyp. SEQ ID NO: |
|---|---|---|---|---|
| LNU750 | barley\|10v2\|BE215751 | barley | 2 | 497 |
| LNU751 | barley\|10v2\|BE413235 | barley | 3 | 498 |
| LNU752 | barley\|10v2\|BE421033 | barley | 4 | 499 |
| LNU753 | barley\|10v2\|BE422116 | barley | 5 | 500 |
| LNU754 | barley\|10v2\|BE601673 | barley | 6 | 501 |
| LNU756 | barley\|10v2\|BF620955 | barley | 7 | 502 |
| LNU757 | barley\|10v2\|BF624113 | barley | 8 | 503 |
| LNU758 | barley\|10v2\|BF629458 | barley | 9 | 504 |
| LNU759 | barley\|10v2\|BM376337 | barley | 10 | 505 |
| LNU760 | barley\|12v1\|CX630466 | barley | 11 | 506 |
| LNU761 | barley\|12v1\|AJ463320 | barley | 12 | 507 |
| LNU762 | barley\|12v1\|AV834698 | barley | 13 | 508 |
| LNU763 | barley\|12v1\|AV836421 | barley | 14 | 509 |
| LNU764 | barley\|12v1\|AV914625 | barley | 15 | 510 |
| LNU766 | barley\|12v1\|AW983189 | barley | 16 | 511 |
| LNU767 | barley\|12v1\|BE196490 | barley | 17 | 512 |
| LNU768 | barley\|12v1\|BE216887 | barley | 18 | 513 |
| LNU769 | barley\|12v1\|BE437319 | barley | 19 | 514 |
| LNU770 | barley\|12v1\|BE602491 | barley | 20 | 515 |
| LNU771 | barley\|12v1\|BF064919 | barley | 21 | 516 |
| LNU772 | barley\|12v1\|BF253521 | barley | 22 | 517 |
| LNU773 | barley\|12v1\|BF256991 | barley | 23 | 518 |
| LNU774 | barley\|12v1\|BF258839 | barley | 24 | 519 |
| LNU775 | barley\|12v1\|BF266348 | barley | 25 | 520 |
| LNU776 | barley\|12v1\|BF266777 | barley | 26 | 521 |
| LNU777 | barley\|12v1\|BF628559 | barley | 27 | 522 |
| LNU778 | barley\|12v1\|BG300262 | barley | 28 | 523 |
| LNU779 | barley\|12v1\|BG309380 | barley | 29 | 524 |
| LNU780 | barley\|12v1\|BI779788 | barley | 30 | 525 |
| LNU781 | barley\|12v1\|BI948718 | barley | 31 | 526 |
| LNU782 | barley\|12v1\|BI950988 | barley | 32 | 527 |
| LNU783 | barley\|12v1\|BI957813 | barley | 33 | 528 |
| LNU784 | barley\|12v1\|BQ762763 | barley | 34 | 529 |
| LNU785 | barley\|12v1\|BU986731 | barley | 35 | 530 |
| LNU786 | barley\|12v1\|EX599010 | barley | 36 | 531 |
| LNU787 | brachypodium\|12v1\|BRADI1G37175 | brachypodium | 37 | 532 |
| LNU788 | brachypodium\|12v1\|BRADI1G51187 | brachypodium | 38 | 533 |
| LNU789 | brachypodium\|12v1\|BRADI1G64180 | brachypodium | 39 | 534 |
| LNU790 | brachypodium\|12v1\|BRADI1G64950 | brachypodium | 40 | 535 |
| LNU791 | brachypodium\|12v1\|BRADI1G69030 | brachypodium | 41 | 536 |
| LNU792 | brachypodium\|12v1\|BRADI2G51430 | brachypodium | 42 | 537 |
| LNU793 | brachypodium\|12v1\|BRADI2G53980 | brachypodium | 43 | 538 |
| LNU794 | brachypodium\|12v1\|BRADI3G16630T2 | brachypodium | 44 | 539 |
| LNU795 | brachypodium\|12v1\|BRADI4G01230 | brachypodium | 45 | 540 |
| LNU796 | brachypodium\|12v1\|BRADI4G05020 | brachypodium | 46 | 541 |
| LNU797 | brachypodium\|12v1\|BRADI4G07060 | brachypodium | 47 | 542 |
| LNU798 | brachypodium\|12v1\|BRADI4G27334 | brachypodium | 48 | 543 |
| LNU799 | brachypodium\|12v1\|BRADI4G29720 | brachypodium | 49 | 544 |
| LNU800 | brachypodium\|12v1\|BRADI5G16060 | brachypodium | 50 | 545 |
| LNU801 | foxtail_millet\|11v3\|PHY7SI000598M | foxtail_millet | 51 | 546 |
| LNU802 | foxtail_millet\|11v3\|PHY7SI000948M | foxtail_millet | 52 | 547 |
| LNU803 | foxtail_millet\|11v3\|PHY7SI003585M | foxtail_millet | 53 | 548 |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster tag | Organism | Polyn. SEQ ID NO: | Polyp. SEQ ID NO: |
|---|---|---|---|---|
| LNU804 | foxtail_millet\|11v3\|PHY7SI009882M | foxtail_millet | 54 | 549 |
| LNU805 | foxtail_millet\|11v3\|PHY7SI013938M | foxtail_millet | 55 | 550 |
| LNU806 | foxtail_millet\|11v3\|PHY7SI014253M | foxtail_millet | 56 | 551 |
| LNU807 | foxtail_millet\|11v3\|PHY7SI021778M | foxtail_millet | 57 | 552 |
| LNU808 | foxtail_millet\|11v3\|PHY7SI023199M | foxtail_millet | 58 | 553 |
| LNU809 | foxtail_millet\|11v3\|PHY7SI036241M | foxtail_millet | 59 | 554 |
| LNU810 | foxtail_millet\|11v3\|SICRP086135 | foxtail_millet | 60 | 555 |
| LNU811 | maize\|10v1\|AI601011 | maize | 61 | 556 |
| LNU813 | maize\|10v1\|AI629666 | maize | 62 | 557 |
| LNU814 | maize\|10v1\|AI637029 | maize | 63 | 558 |
| LNU815 | maize\|10v1\|AI979480 | maize | 64 | 559 |
| LNU816 | maize\|10v1\|AI979737 | maize | 65 | 560 |
| LNU817 | maize\|10v1\|AW231541 | maize | 66 | 561 |
| LNU818 | maize\|10v1\|AW267199 | maize | 67 | 562 |
| LNU819 | maize\|10v1\|AW282410 | maize | 68 | 563 |
| LNU820 | maize\|10v1\|AW288911 | maize | 69 | 564 |
| LNU821 | maize\|10v1\|AW497499 | maize | 70 | 565 |
| LNU822 | maize\|10v1\|AW927651 | maize | 71 | 566 |
| LNU823 | maize\|10v1\|BE512590 | maize | 72 | 567 |
| LNU824 | maize\|10v1\|BE552882 | maize | 73 | 568 |
| LNU825 | maize\|10v1\|BE575202 | maize | 74 | 569 |
| LNU828 | maize\|10v1\|BG458848 | maize | 75 | 570 |
| LNU829 | maize\|10v1\|BG549052 | maize | 76 | 571 |
| LNU830 | maize\|10v1\|BI679654 | maize | 77 | 572 |
| LNU831 | maize\|10v1\|BM269210 | maize | 78 | 573 |
| LNU832 | maize\|10v1\|BM895367 | maize | 79 | 574 |
| LNU833 | maize\|10v1\|BU036574 | maize | 80 | 575 |
| LNU834 | maize\|10v1\|CB816561 | maize | 81 | 576 |
| LNU835 | maize\|10v1\|CD986056 | maize | 82 | 577 |
| LNU837 | maize\|10v1\|CF064369 | maize | 83 | 578 |
| LNU838 | maize\|10v1\|CF634284 | maize | 84 | 579 |
| LNU839 | maize\|10v1\|CO523359 | maize | 85 | 580 |
| LNU840 | maize\|10v1\|DN208554 | maize | 86 | 581 |
| LNU841 | maize\|10v1\|DN225757 | maize | 87 | 582 |
| LNU843 | maize\|10v1\|EE187987 | maize | 88 | 583 |
| LNU844 | maize\|10v1\|T18396 | maize | 89 | 584 |
| LNU845 | maize\|10v1\|W21625 | maize | 90 | 585 |
| LNU846 | maize\|gb170\|AF093537 | maize | 91 | 586 |
| LNU847 | medicago\|12v1\|AL366283 | medicago | 92 | 587 |
| LNU848 | rice\|11v1\|AF072694 | rice | 93 | 588 |
| LNU849 | rice\|11v1\|AU057716 | rice | 94 | 589 |
| LNU850 | rice\|11v1\|BI306328 | rice | 95 | 590 |
| LNU851 | rice\|11v1\|BI813446 | rice | 96 | 591 |
| LNU852 | rice\|11v1\|CA764428 | rice | 97 | 592 |
| LNU853 | rice\|11v1\|CB645176 | rice | 98 | 593 |
| LNU854 | rice\|11v1\|GFXAF377947X27 | rice | 99 | 594 |
| LNU856 | sorghum\|09v1\|SB10G011070 | sorghum | 100 | 595 |
| LNU857 | sorghum\|11v1\|SB10G007600 | sorghum | 101 | 596 |
| LNU858 | sorghum\|12v1\|AW285114 | sorghum | 102 | 597 |
| LNU861 | sorghum\|12v1\|BE918914 | sorghum | 103 | 598 |
| LNU862 | sorghum\|12v1\|BG356040 | sorghum | 104 | 599 |
| LNU864 | sorghum\|12v1\|CD424245 | sorghum | 105 | 600 |
| LNU865 | sorghum\|12v1\|SB0169S002030 | sorghum | 106 | 601 |
| LNU866 | sorghum\|12v1\|SB01G003110 | sorghum | 107 | 602 |
| LNU867 | sorghum\|12v1\|SB01G004510 | sorghum | 108 | 603 |
| LNU868 | sorghum\|12v1\|SB01G005240 | sorghum | 109 | 604 |
| LNU869 | sorghum\|12v1\|SB01G006870 | sorghum | 110 | 605 |
| LNU870 | sorghum\|12v1\|SB01G006930 | sorghum | 111 | 606 |
| LNU871 | sorghum\|12v1\|SB01G007380 | sorghum | 112 | 607 |
| LNU872 | sorghum\|12v1\|SB01G011260 | sorghum | 113 | 608 |
| LNU873 | sorghum\|12v1\|SB01G011890 | sorghum | 114 | 609 |
| LNU874 | sorghum\|12v1\|SB01G015540 | sorghum | 115 | 610 |
| LNU875 | sorghum\|12v1\|SB01G017100 | sorghum | 116 | 611 |
| LNU876 | sorghum\|12v1\|SB01G032593P1 | sorghum | 117 | 612 |
| LNU878 | sorghum\|12v1\|SB01G035780 | sorghum | 118 | 613 |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster tag | Organism | Polyn. SEQ ID NO: | Polyp. SEQ ID NO: |
|---|---|---|---|---|
| LNU879 | sorghum|12v1|SB01G040060 | sorghum | 119 | 614 |
| LNU880 | sorghum|12v1|SB01G046630 | sorghum | 120 | 615 |
| LNU881 | sorghum|12v1|SB01G047345 | sorghum | 121 | 616 |
| LNU882 | sorghum|12v1|SB01G048200 | sorghum | 122 | 617 |
| LNU883 | sorghum|12v1|SB01G048670 | sorghum | 123 | 618 |
| LNU884 | sorghum|12v1|SB01G048910 | sorghum | 124 | 619 |
| LNU885 | sorghum|12v1|SB02G001450 | sorghum | 125 | 620 |
| LNU886 | sorghum|12v1|SB02G002020 | sorghum | 126 | 621 |
| LNU887 | sorghum|12v1|SB02G003980 | sorghum | 127 | 622 |
| LNU888 | sorghum|12v1|SB02G009320 | sorghum | 128 | 623 |
| LNU889 | sorghum|12v1|SB02G023760 | sorghum | 129 | 624 |
| LNU890 | sorghum|12v1|SB02G027260 | sorghum | 130 | 625 |
| LNU892 | sorghum|12v1|SB02G033210 | sorghum | 131 | 626 |
| LNU893 | sorghum|12v1|SB02G036470 | sorghum | 132 | 627 |
| LNU894 | sorghum|12v1|SB02G039430 | sorghum | 133 | 628 |
| LNU895 | sorghum|12v1|SB02G042020 | sorghum | 134 | 629 |
| LNU896 | sorghum|12v1|SB02G043060 | sorghum | 135 | 630 |
| LNU897 | sorghum|12v1|SB02G043340 | sorghum | 136 | 631 |
| LNU898 | sorghum|12v1|SB03G001900 | sorghum | 137 | 632 |
| LNU899 | sorghum|12v1|SB03G003880 | sorghum | 138 | 633 |
| LNU900 | sorghum|12v1|SB03G004920 | sorghum | 139 | 634 |
| LNU901 | sorghum|12v1|SB03G006670 | sorghum | 140 | 635 |
| LNU902 | sorghum|12v1|SB03G009240 | sorghum | 141 | 636 |
| LNU903 | sorghum|12v1|SB03G013600 | sorghum | 142 | 637 |
| LNU904 | sorghum|12v1|SB03G015670 | sorghum | 143 | 638 |
| LNU905 | sorghum|12v1|SB03G025980 | sorghum | 144 | 639 |
| LNU906 | sorghum|12v1|SB03G028220 | sorghum | 145 | 640 |
| LNU907 | sorghum|12v1|SB03G029160 | sorghum | 146 | 641 |
| LNU908 | sorghum|12v1|SB03G030720 | sorghum | 147 | 642 |
| LNU909 | sorghum|12v1|SB03G032235 | sorghum | 148 | 643 |
| LNU910 | sorghum|12v1|SB03G034870 | sorghum | 149 | 644 |
| LNU911 | sorghum|12v1|SB03G035900 | sorghum | 150 | 645 |
| LNU912 | sorghum|12v1|SB03G037390 | sorghum | 151 | 646 |
| LNU913 | sorghum|12v1|SB03G039370 | sorghum | 152 | 647 |
| LNU914 | sorghum|12v1|SB04G000560 | sorghum | 153 | 648 |
| LNU915 | sorghum|12v1|SB04G000860 | sorghum | 154 | 649 |
| LNU916 | sorghum|12v1|SB04G003110 | sorghum | 155 | 650 |
| LNU917 | sorghum|12v1|SB04G005810 | sorghum | 156 | 651 |
| LNU918 | sorghum|12v1|SB04G005960 | sorghum | 157 | 652 |
| LNU919 | sorghum|12v1|SB04G008660 | sorghum | 158 | 653 |
| LNU920 | sorghum|12v1|SB04G019220 | sorghum | 159 | 654 |
| LNU921 | sorghum|12v1|SB04G023720 | sorghum | 160 | 655 |
| LNU922 | sorghum|12v1|SB04G031020 | sorghum | 161 | 656 |
| LNU923 | sorghum|12v1|SB04G031630 | sorghum | 162 | 657 |
| LNU924 | sorghum|12v1|SB04G031790 | sorghum | 163 | 658 |
| LNU925 | sorghum|12v1|SB04G031980 | sorghum | 164 | 659 |
| LNU926 | sorghum|12v1|SB04G032240 | sorghum | 165 | 660 |
| LNU928 | sorghum|12v1|SB04G035530 | sorghum | 166 | 661 |
| LNU929 | sorghum|12v1|SB04G036780 | sorghum | 167 | 662 |
| LNU930 | sorghum|12v1|SB04G037720 | sorghum | 168 | 663 |
| LNU931 | sorghum|12v1|SB05G000570 | sorghum | 169 | 664 |
| LNU932 | sorghum|12v1|SB05G001300 | sorghum | 170 | 665 |
| LNU933 | sorghum|12v1|SB05G005230 | sorghum | 171 | 666 |
| LNU934 | sorghum|12v1|SB05G006950 | sorghum | 172 | 667 |
| LNU935 | sorghum|12v1|SB05G020340 | sorghum | 173 | 668 |
| LNU936 | sorghum|12v1|SB05G021410 | sorghum | 174 | 669 |
| LNU938 | sorghum|12v1|SB05G025900 | sorghum | 175 | 670 |
| LNU939 | sorghum|12v1|SB06G015080 | sorghum | 176 | 671 |
| LNU940 | sorghum|12v1|SB06G016140 | sorghum | 177 | 672 |
| LNU941 | sorghum|12v1|SB06G018480 | sorghum | 178 | 673 |
| LNU942 | sorghum|12v1|SB06G019950 | sorghum | 179 | 674 |
| LNU943 | sorghum|12v1|SB06G020900 | sorghum | 180 | 675 |
| LNU944 | sorghum|12v1|SB07G000250 | sorghum | 181 | 676 |
| LNU945 | sorghum|12v1|SB07G004040 | sorghum | 182 | 677 |
| LNU946 | sorghum|12v1|SB07G004390 | sorghum | 183 | 678 |
| LNU947 | sorghum|12v1|SB07G021870 | sorghum | 184 | 679 |
| LNU948 | sorghum|12v1|SB07G027790 | sorghum | 185 | 680 |
| LNU949 | sorghum|12v1|SB08G002580 | sorghum | 186 | 681 |
| LNU950 | sorghum|12v1|SB08G002740 | sorghum | 187 | 682 |
| LNU951 | sorghum|12v1|SB08G003140 | sorghum | 188 | 683 |
| LNU952 | sorghum|12v1|SB08G007610 | sorghum | 189 | 684 |
| LNU953 | sorghum|12v1|SB08G015020 | sorghum | 190 | 685 |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster tag | Organism | Polyn. SEQ ID NO: | Polyp. SEQ ID NO: |
|---|---|---|---|---|
| LNU954 | sorghum|12v1|SB08G016400 | sorghum | 191 | 686 |
| LNU955 | sorghum|12v1|SB08G016530 | sorghum | 192 | 687 |
| LNU956 | sorghum|12v1|SB08G018765 | sorghum | 193 | 688 |
| LNU957 | sorghum|12v1|SB08G020600 | sorghum | 194 | 689 |
| LNU958 | sorghum|12v1|SB08G021920 | sorghum | 195 | 690 |
| LNU959 | sorghum|12v1|SB09G021265 | sorghum | 196 | 691 |
| LNU960 | sorghum|12v1|SB09G021520 | sorghum | 197 | 692 |
| LNU961 | sorghum|12v1|SB09G026930 | sorghum | 198 | 693 |
| LNU962 | sorghum|12v1|SB09G026990 | sorghum | 199 | 694 |
| LNU963 | sorghum|12v1|SB10G002960 | sorghum | 200 | 695 |
| LNU964 | sorghum|12v1|SB10G023640 | sorghum | 201 | 696 |
| LNU965 | sorghum|12v1|SB10G026450 | sorghum | 202 | 697 |
| LNU966 | sorghum|12v1|SB10G026910 | sorghum | 203 | 698 |
| LNU967 | sorghum|12v1|SB10G028680 | sorghum | 204 | 699 |
| LNU968 | sorghum|12v1|SB10G030200 | sorghum | 205 | 700 |
| LNU969 | sorghum|12v1|XM_002468645 | sorghum | 206 | 701 |
| LNU970 | soybean|11v1|GLYMA13G20220 | soybean | 207 | 702 |
| LNU971 | tomato|11v1|AI772930 | tomato | 208 | 703 |
| LNU972 | tomato|11v1|AI775263 | tomato | 209 | 704 |
| LNU975 | tomato|11v1|BI422101 | tomato | 210 | 705 |
| LNU976 | wheat|12v3|CA596628 | wheat | 211 | 706 |
| LNU977 | wheat|12v3|CK152213 | wheat | 212 | 707 |
| LNU760_H1 | brachypodium|12v1|BRADI1G02117 | brachypodium | 213 | 708 |
| LNU832_H2 | sorghum|12v1|SB03G013780 | sorghum | 214 | 709 |
| LNU834_H1 | sorghum|12v1|SB02G003380 | sorghum | 215 | 710 |
| LNU861_H3 | maize|10v1|CF635645 | maize | 216 | 711 |
| LNU859 | sorghum|12v1|AW677786 | sorghum | 217 | |
| LNU860 | sorghum|12v1|BE362249 | sorghum | 218 | |
| LNU863 | sorghum|12v1|BG410755 | sorghum | 219 | |
| LNU750 | barley|10v2|BE215751 | barley | 220 | 713 |
| LNU760 | barley|10v2|CX630466 | barley | 221 | 714 |
| LNU771 | barley|12v1|BF064919 | barley | 222 | 715 |
| LNU772 | barley|12v1|BF253521 | barley | 223 | 716 |
| LNU783 | barley|12v1|BI957813 | barley | 224 | 528 |
| LNU785 | barley|12v1|BU986731 | barley | 225 | 717 |
| LNU786 | barley|12v1|EX599010 | barley | 226 | 718 |
| LNU787 | brachypodium|12v1|BRADI1G37175 | brachypodium | 227 | 719 |
| LNU790 | brachypodium|12v1|BRADI1G64950 | brachypodium | 228 | 535 |
| LNU792 | brachypodium|12v1|BRADI2G51430 | brachypodium | 229 | 537 |
| LNU793 | brachypodium|12v1|BRADI2G53980 | brachypodium | 230 | 538 |
| LNU795 | brachypodium|12v1|BRADI4G01230 | brachypodium | 231 | 720 |
| LNU801 | foxtail_millet|11v3|PHY7SI000598M | foxtail_millet | 232 | 546 |
| LNU802 | foxtail_millet|11v3|PHY7SI000948M | foxtail_millet | 233 | 547 |
| LNU806 | foxtail_millet|11v3|PHY7SI014253M | foxtail_millet | 234 | 721 |
| LNU807 | foxtail_millet|11v3|PHY7SI021778M | foxtail_millet | 235 | 552 |
| LNU830 | maize|10v1|BI679654 | maize | 236 | 572 |
| LNU837 | maize|10v1|CF064369 | maize | 237 | 722 |
| LNU839 | maize|10v1|CO523359 | maize | 238 | 580 |
| LNU843 | maize|10v1|EE187987 | maize | 239 | 723 |
| LNU845 | maize|10v1|W21625 | maize | 240 | 724 |
| LNU847 | medicago|12v1|AL366283 | medicago | 241 | 725 |
| LNU848 | rice|11v1|AF072694 | rice | 242 | 588 |
| LNU851 | rice|11v1|BI813446 | rice | 243 | 591 |
| LNU856 | sorghum|09v1|SB10G011070 | sorghum | 244 | 726 |
| LNU858 | sorghum|12v1|AW285114 | sorghum | 245 | 727 |
| LNU862 | sorghum|12v1|BG356040 | sorghum | 246 | 728 |
| LNU864 | sorghum|12v1|CD424245 | sorghum | 247 | 600 |
| LNU866 | sorghum|12v1|SB01G003110 | sorghum | 248 | 729 |
| LNU870 | sorghum|12v1|SB01G006930 | sorghum | 249 | 730 |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster tag | Organism | Polyn. SEQ ID NO: | Polyp. SEQ ID NO: |
|---|---|---|---|---|
| LNU873 | sorghum\|12v1\|SB01G011890 | sorghum | 250 | 609 |
| LNU876 | sorghum\|12v1\|SB01G032593P1 | sorghum | 251 | 612 |
| LNU886 | sorghum\|12v1\|SB02G002020 | sorghum | 252 | 731 |
| LNU887 | sorghum\|12v1\|SB02G003980 | sorghum | 253 | 622 |
| LNU889 | sorghum\|12v1\|SB02G023760 | sorghum | 254 | 624 |
| LNU892 | sorghum\|12v1\|SB02G033210 | sorghum | 255 | 732 |
| LNU896 | sorghum\|12v1\|SB02G043060 | sorghum | 256 | 733 |
| LNU897 | sorghum\|12v1\|SB02G043340 | sorghum | 257 | 631 |
| LNU902 | sorghum\|12v1\|SB03G009240 | sorghum | 258 | 636 |
| LNU905 | sorghum\|12v1\|SB03G025980 | sorghum | 259 | 639 |
| LNU906 | sorghum\|12v1\|SB03G028220 | sorghum | 260 | 734 |
| LNU908 | sorghum\|12v1\|SB03G030720 | sorghum | 261 | 735 |
| LNU910 | sorghum\|12v1\|SB03G034870 | sorghum | 262 | 736 |
| LNU911 | sorghum\|12v1\|SB03G035900 | sorghum | 263 | 737 |
| LNU914 | sorghum\|12v1\|SB04G000560 | sorghum | 264 | 648 |
| LNU919 | sorghum\|12v1\|SB04G008660 | sorghum | 265 | 653 |
| LNU920 | sorghum\|12v1\|SB04G019220 | sorghum | 266 | 654 |
| LNU921 | sorghum\|12v1\|SB04G023720 | sorghum | 267 | 655 |
| LNU926 | sorghum\|12v1\|SB04G032240 | sorghum | 268 | 660 |
| LNU929 | sorghum\|12v1\|SB04G036780 | sorghum | 269 | 662 |
| LNU931 | sorghum\|12v1\|SB05G000570 | sorghum | 270 | 664 |
| LNU932 | sorghum\|12v1\|SB05G001300 | sorghum | 271 | 738 |
| LNU935 | sorghum\|12v1\|SB05G020340 | sorghum | 272 | 668 |
| LNU936 | sorghum\|12v1\|SB05G021410 | sorghum | 273 | 669 |
| LNU938 | sorghum\|12v1\|SB05G025900 | sorghum | 274 | 670 |
| LNU946 | sorghum\|12v1\|SB07G004390 | sorghum | 275 | 678 |
| LNU951 | sorghum\|12v1\|SB08G003140 | sorghum | 276 | 739 |
| LNU954 | sorghum\|12v1\|SB08G016400 | sorghum | 277 | 740 |
| LNU956 | sorghum\|12v1\|SB08G018765 | sorghum | 278 | 741 |
| LNU960 | sorghum\|12v1\|SB09G021520 | sorghum | 279 | 692 |
| LNU962 | sorghum\|12v1\|SB09G026990 | sorghum | 280 | 694 |
| LNU967 | sorghum\|12v1\|SB10G028680 | sorghum | 281 | 699 |
| LNU969 | sorghum\|12v1\|XM_002468645 | sorghum | 282 | 742 |
| LNU972 | tomato\|11v1\|AI775263 | tomato | 283 | 743 |
| LNU975 | tomato\|11v1\|BI422101 | tomato | 284 | 744 |
| LNU977 | wheat\|12v3\|CK152213 | wheat | 285 | 745 |
| LNU861_H3 | maize\|10v1\|CF635645 | maize | 286 | 746 |
| LNU859 | sorghum\|12v1\|AW677786 | sorghum | 287 | |
| LNU863 | sorghum\|12v1\|BG410755 | sorghum | 288 | |
| LNU749 | barley\|10v2\|AV834836 | barley | 289 | 747 |
| LNU751 | barley\|10v2\|BE413235 | barley | 290 | 498 |
| LNU752 | barley\|10v2\|BE421033 | barley | 291 | 748 |
| LNU753 | barley\|10v2\|BE422116 | barley | 292 | 500 |
| LNU754 | barley\|10v2\|BE601673 | barley | 293 | 501 |
| LNU756 | barley\|10v2\|BF620955 | barley | 294 | 502 |
| LNU757 | barley\|10v2\|BF624113 | barley | 295 | 503 |
| LNU758 | barley\|10v2\|BF629458 | barley | 296 | 504 |
| LNU759 | barley\|10v2\|BM376337 | barley | 297 | 505 |
| LNU761 | barley\|12v1\|AJ463320 | barley | 298 | 507 |
| LNU762 | barley\|12v1\|AV834698 | barley | 299 | 508 |
| LNU763 | barley\|12v1\|AV836421 | barley | 300 | 509 |
| LNU764 | barley\|12v1\|AV914625 | barley | 301 | 510 |
| LNU766 | barley\|12v1\|AW983189 | barley | 302 | 749 |
| LNU767 | barley\|12v1\|BE196490 | barley | 303 | 512 |
| LNU768 | barley\|12v1\|BE216887 | barley | 304 | 513 |
| LNU769 | barley\|12v1\|BE437319 | barley | 305 | 750 |
| LNU770 | barley\|12v1\|BE602491 | barley | 306 | 515 |
| LNU771 | barley\|12v1\|BF064919 | barley | 307 | 516 |
| LNU772 | barley\|12v1\|BF253521 | barley | 308 | 517 |
| LNU773 | barley\|12v1\|BF256991 | barley | 309 | 751 |
| LNU774 | barley\|12v1\|BF258839 | barley | 310 | 519 |
| LNU775 | barley\|12v1\|BF266348 | barley | 311 | 520 |
| LNU776 | barley\|12v1\|BF266777 | barley | 312 | 752 |
| LNU777 | barley\|12v1\|BF628559 | barley | 313 | 522 |
| LNU778 | barley\|12v1\|BG300262 | barley | 314 | 523 |
| LNU779 | barley\|12v1\|BG309380 | barley | 315 | 524 |
| LNU780 | barley\|12v1\|BI779788 | barley | 316 | 753 |
| LNU781 | barley\|12v1\|BI948718 | barley | 317 | 526 |
| LNU782 | barley\|12v1\|BI950988 | barley | 318 | 527 |
| LNU783 | barley\|12v1\|BI957813 | barley | 319 | 528 |
| LNU784 | barley\|12v1\|BQ762763 | barley | 320 | 754 |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster tag | Organism | Polyn. SEQ ID NO: | Polyp. SEQ ID NO: |
|---|---|---|---|---|
| LNU785 | barley\|12v1\|BU986731 | barley | 321 | 530 |
| LNU786 | barley\|12v1\|EX599010 | barley | 322 | 755 |
| LNU787 | brachypodium\|12v1\|BRADI1G37175 | brachypodium | 323 | 532 |
| LNU788 | brachypodium1\|12v1\|BRADI1G51187 | brachypodium | 324 | 756 |
| LNU789 | brachypodium\|12v1\|BRADI1G64180 | brachypodium | 325 | 534 |
| LNU790 | brachypodium\|12v1\|BRADI1G64950 | brachypodium | 326 | 535 |
| LNU791 | brachypodium\|12v1\|BRADI1G69030 | brachypodium | 327 | 536 |
| LNU792 | brachypodium\|12v1\|BRADI2G51430 | brachypodium | 328 | 537 |
| LNU793 | brachypodium\|12v1\|BRADI2G53980 | brachypodium | 329 | 538 |
| LNU794 | brachypodium\|12v1\|BRADI3G16630T2 | brachypodium | 330 | 539 |
| LNU795 | brachypodium\|12v1\|BRADI4G01230 | brachypodium | 331 | 757 |
| LNU796 | brachypodium\|12v1\|BRADI4G05020 | brachypodium | 332 | 541 |
| LNU797 | brachypodium\|12v1\|BRADI4G07060 | brachypodium | 333 | 542 |
| LNU798 | brachypodium\|12v1\|BRADI4G27334 | brachypodium | 334 | 543 |
| LNU799 | brachypodium\|12v1\|BRADI4G29720 | brachypodium | 335 | 544 |
| LNU800 | brachypodium\|12v1\|BRADI5G16060 | brachypodium | 336 | 545 |
| LNU801 | foxtail_millet\|11v3\|PHY7SI000598M | foxtail_millet | 337 | 546 |
| LNU802 | foxtail_millet\|11v3\|PHY7SI000948M | foxtail_millet | 338 | 547 |
| LNU803 | foxtail_millet\|11v3\|PHY7SI003585M | foxtail_millet | 339 | 548 |
| LNU804 | foxtail_millet\|11v3\|PHY7SI009882M | foxtail_millet | 340 | 758 |
| LNU805 | foxtail_millet\|11v3\|PHY7SI013938M | foxtail_millet | 341 | 550 |
| LNU806 | foxtail_millet\|11v3\|PHY7SI014253M | foxtail_millet | 342 | 759 |
| LNU807 | foxtail_millet\|11v3\|PHY7SI021778M | foxtail_millet | 343 | 552 |
| LNU808 | foxtail_millet\|11v3\|PHY7SI023199M | foxtail_millet | 344 | 553 |
| LNU809 | foxtail_millet\|11v3\|PHY7SI036241M | foxtail_millet | 345 | 760 |
| LNU811 | maize\|10v1\|AI601011 | maize | 346 | 556 |
| LNU813 | maize\|10v1\|AI629666 | maize | 347 | 557 |
| LNU814 | maize\|10v1\|AI637029 | maize | 348 | 558 |
| LNU815 | maize\|10v1\|AI979480 | maize | 349 | 559 |
| LNU816 | maize\|10v1\|AI979737 | maize | 350 | 761 |
| LNU817 | maize\|10v1\|AW231541 | maize | 351 | 762 |
| LNU818 | maize\|10v1\|AW267199 | maize | 352 | 763 |
| LNU819 | maize\|10v1\|AW282410 | maize | 353 | 563 |
| LNU820 | maize\|10v1\|AW288911 | maize | 354 | 564 |
| LNU821 | maize\|10v1\|AW497499 | maize | 355 | 764 |
| LNU822 | maize\|10v1\|AW927651 | maize | 356 | 566 |
| LNU823 | maize\|10v1\|BE512590 | maize | 357 | 567 |
| LNU824 | maize\|10v1\|BE552882 | maize | 358 | 765 |
| LNU825 | maize\|10v1\|BE575202 | maize | 359 | 766 |
| LNU828 | maize\|10v1\|BG458848 | maize | 360 | 570 |
| LNU829 | maize\|10v1\|BG549052 | maize | 361 | 767 |
| LNU830 | maize\|10v1\|BI679654 | maize | 362 | 572 |
| LNU831 | maize\|10v1\|BM269210 | maize | 363 | 768 |
| LNU833 | maize\|10v1\|BUO36574 | maize | 364 | 769 |
| LNU835 | maize\|10v1\|CD986056 | maize | 365 | 577 |
| LNU837 | maize\|10v1\|CF064369 | maize | 366 | 770 |
| LNU838 | maize\|10v1\|CF634284 | maize | 367 | 579 |
| LNU839 | maize\|10v1\|CO523359 | maize | 368 | 580 |
| LNU840 | maize\|10v1\|DN208554 | maize | 369 | 581 |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster tag | Organism | Polyn. SEQ ID NO: | Polyp. SEQ ID NO: |
|---|---|---|---|---|
| LNU841 | maize\|10v1\|DN225757 | maize | 370 | 582 |
| LNU843 | maize\|10v1\|EE187987 | maize | 371 | 583 |
| LNU844 | maize\|10v1\|T18396 | maize | 372 | 584 |
| LNU845 | maize\|10v1\|W21625 | maize | 373 | 771 |
| LNU846 | maize\|gb170\|AF093537 | maize | 374 | 586 |
| LNU847 | medicago\|12v1\|AL366283 | medicago | 375 | 772 |
| LNU848 | rice\|11v1\|AF072694 | rice | 376 | 588 |
| LNU849 | rice\|11v1\|AU057716 | rice | 377 | 589 |
| LNU850 | rice\|11v1\|BI306328 | rice | 378 | 590 |
| LNU851 | rice\|11v1\|BI813446 | rice | 379 | 591 |
| LNU852 | rice\|11v1\|CA764428 | rice | 380 | 592 |
| LNU853 | rice\|11v1\|CB645176 | rice | 381 | 593 |
| LNU854 | rice\|11v1\|GFXAF377947X27 | rice | 382 | 594 |
| LNU856 | sorghum\|09v1\|SB10G011070 | sorghum | 383 | 595 |
| LNU857 | sorghum\|11v1\|SB10G007600 | sorghum | 384 | 773 |
| LNU858 | sorghum\|12v1\|AW285114 | sorghum | 385 | 774 |
| LNU862 | sorghum\|12v1\|BG356040 | sorghum | 386 | 599 |
| LNU864 | sorghum\|12v1\|CD424245 | sorghum | 387 | 600 |
| LNU865 | sorghum\|12v1\|SB0169S002030 | sorghum | 388 | 601 |
| LNU866 | sorghum\|12v1\|SB01G003110 | sorghum | 389 | 775 |
| LNU867 | sorghum\|12v1\|SB01G004510 | sorghum | 390 | 603 |
| LNU868 | sorghum\|12v1\|SB01G005240 | sorghum | 391 | 604 |
| LNU869 | sorghum\|12v1\|SB01G006870 | sorghum | 392 | 605 |
| LNU870 | sorghum\|12v1\|SB01G006930 | sorghum | 393 | 606 |
| LNU871 | sorghum\|12v1\|SB01G007380 | sorghum | 394 | 607 |
| LNU872 | sorghum\|12v1\|SB01G011260 | sorghum | 395 | 608 |
| LNU873 | sorghum\|12v1\|SB01G011890 | sorghum | 396 | 609 |
| LNU874 | sorghum\|12v1\|SB01G015540 | sorghum | 397 | 610 |
| LNU875 | sorghum\|12v1\|SB01G017100 | sorghum | 398 | 611 |
| LNU876 | sorghum\|12v1\|SB01G032593P1 | sorghum | 399 | 612 |
| LNU878 | sorghum\|12v1\|SB01G035780 | sorghum | 400 | 613 |
| LNU879 | sorghum\|12v1\|SB01G040060 | sorghum | 401 | 614 |
| LNU880 | sorghum\|12v1\|SB01G046630 | sorghum | 402 | 615 |
| LNU881 | sorghum\|12v1\|SB01G047345 | sorghum | 403 | 616 |
| LNU882 | sorghum\|12v1\|SB01G048200 | sorghum | 404 | 617 |
| LNU884 | sorghum\|12v1\|SB01G048910 | sorghum | 405 | 619 |
| LNU885 | sorghum\|12v1\|SB02G001450 | sorghum | 406 | 620 |
| LNU886 | sorghum\|12v1\|SB02G002020 | sorghum | 407 | 776 |
| LNU887 | sorghum\|12v1\|SB02G003980 | sorghum | 408 | 622 |
| LNU888 | sorghum\|12v1\|SB02G009320 | sorghum | 409 | 623 |
| LNU889 | sorghum\|12v1\|SB02G023760 | sorghum | 410 | 624 |
| LNU890 | sorghum\|12v1\|SB02G027260 | sorghum | 411 | 625 |
| LNU892 | sorghum\|12v1\|SB02G033210 | sorghum | 412 | 626 |
| LNU893 | sorghum\|12v1\|SB02G036470 | sorghum | 413 | 627 |
| LNU894 | sorghum\|12v1\|SB02G039430 | sorghum | 414 | 628 |
| LNU895 | sorghum\|12v1\|SB02G042020 | sorghum | 415 | 629 |
| LNU896 | sorghum\|12v1\|SB02G043060 | sorghum | 416 | 630 |
| LNU897 | sorghum\|12v1\|SB02G043340 | sorghum | 417 | 777 |
| LNU898 | sorghum\|12v1\|SB03G001900 | sorghum | 418 | 778 |
| LNU899 | sorghum\|12v1\|SB03G003880 | sorghum | 419 | 633 |
| LNU900 | sorghum\|12v1\|SB03G004920 | sorghum | 420 | 779 |
| LNU901 | sorghum\|12v1\|SB03G006670 | sorghum | 421 | 780 |
| LNU902 | sorghum\|12v1\|SB03G009240 | sorghum | 422 | 636 |
| LNU903 | sorghum\|12v1\|SB03G013600 | sorghum | 423 | 637 |
| LNU904 | sorghum\|12v1\|SB03G015670 | sorghum | 424 | 781 |
| LNU905 | sorghum\|12v1\|SB03G025980 | sorghum | 425 | 639 |
| LNU906 | sorghum\|12v1\|SB03G028220 | sorghum | 426 | 782 |
| LNU907 | sorghum\|12v1\|SB03G029160 | sorghum | 427 | 783 |
| LNU908 | sorghum\|12v1\|SB03G030720 | sorghum | 428 | 642 |
| LNU909 | sorghum\|12v1\|SB03G032235 | sorghum | 429 | 784 |
| LNU910 | sorghum\|12v1\|SB03G034870 | sorghum | 430 | 644 |
| LNU911 | sorghum\|12v1\|SB03G035900 | sorghum | 431 | 785 |
| LNU912 | sorghum\|12v1\|SB03G037390 | sorghum | 432 | 646 |
| LNU913 | sorghum\|12v1\|SB03G039370 | sorghum | 433 | 647 |
| LNU914 | sorghum\|12v1\|SB04G000560 | sorghum | 434 | 648 |
| LNU915 | sorghum\|12v1\|SB04G000860 | sorghum | 435 | 649 |
| LNU916 | sorghum\|12v1\|SB04G003110 | sorghum | 436 | 650 |
| LNU917 | sorghum\|12v1\|SB04G005810 | sorghum | 437 | 651 |
| LNU918 | sorghum\|12v1\|SB04G005960 | sorghum | 438 | 652 |
| LNU919 | sorghum\|12v1\|SB04G008660 | sorghum | 439 | 653 |
| LNU920 | sorghum\|12v1\|SB04G019220 | sorghum | 440 | 654 |
| LNU921 | sorghum\|12v1\|SB04G023720 | sorghum | 441 | 655 |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster tag | Organism | Polyn. SEQ ID NO: | Polyp. SEQ ID NO: |
|---|---|---|---|---|
| LNU922 | sorghum|12v1|SB04G031020 | sorghum | 442 | 656 |
| LNU923 | sorghum|12v1|SB04G031630 | sorghum | 443 | 657 |
| LNU924 | sorghum|12v1|SB04G031790 | sorghum | 444 | 658 |
| LNU925 | sorghum|12v1|SB04G031980 | sorghum | 445 | 659 |
| LNU926 | sorghum|12v1|SB04G032240 | sorghum | 446 | 660 |
| LNU928 | sorghum|12v1|SB04G035530 | sorghum | 447 | 661 |
| LNU930 | sorghum|12v1|SB04G037720 | sorghum | 448 | 786 |
| LNU931 | sorghum|12v1|SB05G000570 | sorghum | 449 | 664 |
| LNU932 | sorghum|12v1|SB05G001300 | sorghum | 450 | 787 |
| LNU933 | sorghum|12v1|SB05G005230 | sorghum | 451 | 666 |
| LNU934 | sorghum|12v1|SB05G006950 | sorghum | 452 | 667 |
| LNU935 | sorghum|12v1|SB05G020340 | sorghum | 453 | 788 |
| LNU936 | sorghum|12v1|SB05G021410 | sorghum | 454 | 669 |
| LNU938 | sorghum|12v1|SB05G025900 | sorghum | 455 | 789 |
| LNU940 | sorghum|12v1|SB06G016140 | sorghum | 456 | 672 |
| LNU941 | sorghum|12v1|SB06G018480 | sorghum | 457 | 673 |
| LNU942 | sorghum|12v1|SB06G019950 | sorghum | 458 | 674 |
| LNU943 | sorghum|12v1|SB06G020900 | sorghum | 459 | 675 |
| LNU944 | sorghum|12v1|SB07G000250 | sorghum | 460 | 676 |
| LNU945 | sorghum|12v1|SB07G004040 | sorghum | 461 | 677 |
| LNU946 | sorghum|12v1|SB07G004390 | sorghum | 462 | 678 |
| LNU947 | sorghum|12v1|SB07G021870 | sorghum | 463 | 679 |
| LNU948 | sorghum|12v1|SB07G027790 | sorghum | 464 | 680 |
| LNU949 | sorghum|12v1|SB08G002580 | sorghum | 465 | 681 |
| LNU950 | sorghum|12v1|SB08G002740 | sorghum | 466 | 682 |
| LNU951 | sorghum|12v1|SB08G003140 | sorghum | 467 | 790 |
| LNU952 | sorghum|12v1|SB08G007610 | sorghum | 468 | 684 |
| LNU953 | sorghum|12v1|SB08G015020 | sorghum | 469 | 685 |
| LNU954 | sorghum|12v1|SB08G016400 | sorghum | 470 | 791 |
| LNU955 | sorghum|12v1|SB08G016530 | sorghum | 471 | 687 |
| LNU956 | sorghum|12v1|SB08G018765 | sorghum | 472 | 792 |
| LNU957 | sorghum|12v1|SB08G020600 | sorghum | 473 | 689 |
| LNU958 | sorghum|12v1|SB08G021920 | sorghum | 474 | 690 |
| LNU959 | sorghum|12v1|SB09G021265 | sorghum | 475 | 691 |
| LNU960 | sorghum|12v1|SB09G021520 | sorghum | 476 | 692 |
| LNU961 | sorghum|12v1|SB09G026930 | sorghum | 477 | 693 |
| LNU962 | sorghum|12v1|SB09G026990 | sorghum | 478 | 694 |
| LNU963 | sorghum|12v1|SB10G002960 | sorghum | 479 | 695 |
| LNU964 | sorghum|12v1|SB10G023640 | sorghum | 480 | 696 |
| LNU965 | sorghum|12v1|SB10G026450 | sorghum | 481 | 697 |
| LNU966 | sorghum|12v1|SB10G026910 | sorghum | 482 | 698 |
| LNU967 | sorghum|12v1|SB10G028680 | sorghum | 483 | 699 |
| LNU968 | sorghum|12v1|SB10G030200 | sorghum | 484 | 793 |
| LNU970 | soybean|11v1|GLYMA13G20220 | soybean | 485 | 702 |
| LNU971 | tomato|11v1|AI772930 | tomato | 486 | 703 |
| LNU972 | tomato|11v1|AI775263 | tomato | 487 | 704 |
| LNU975 | tomato|11v1|BI422101 | tomato | 488 | 705 |
| LNU976 | wheat|12v3|CA596628 | wheat | 489 | 706 |
| LNU977 | wheat|12v3|CK152213 | wheat | 490 | 794 |
| LNU760_H1 | brachypodium|12v1|BRADI1G02117 | brachypodium | 491 | 708 |
| LNU832_H2 | sorghum|12v1|SB03G013780 | sorghum | 492 | 709 |
| LNU834_H1 | sorghum|12v1|SB02G003380 | sorghum | 493 | 710 |
| LNU861_H3 | maize|10v1|CF635645 | maize | 494 | 711 |
| LNU859 | sorghum|12v1|AW677786 | sorghum | 495 | — |

Table 1. Provided are the gene names, cluster names, organisms fmor which they are derived, and the sequence identifiers of the polynucleotides and polypeptide sequences. "Polyp." = polypeptide; "Polyn."—Polynucleotide.

Example 2

Identification of Homologous (E.G., Orthologous) Sequences that Increase Nitrogen Use Efficiency, Fertilizer Use Efficiency, Yield, Growth Rate, Vigor, Biomass, Oil Content, Abiotic Stress Tolerance and/or Water Use Efficiency in Plants The concepts of orthology and paralogy have recently been applied to functional characterizations and classifications on the scale of whole-genome comparisons. Orthologs and paralogs constitute two major types of homologs: The first evolved from a common ancestor by specialization, and the latter is related by duplication events. It is assumed that paralogs arising from ancient duplication events are likely to have diverged in function while true orthologs are more likely to retain identical function over evolutionary time.

To further investigate and identify putative orthologs of the genes affecting nitrogen use efficiency, fertilizer use efficiency, yield (e.g., seed yield, oil yield, biomass, grain quantity and/or quality), growth rate, vigor, biomass, oil content, abiotic stress tolerance and/or water use efficiency, all sequences were aligned using the BLAST (/Basic Local Alignment Search Tool/). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly. Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level—identical amino acids in the protein domains and similarity in expression profiles.

The search and identification of homologous genes involves the screening of sequence information available, for example, in public databases, which include but are not limited to the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST programs. There are five implementations of BLAST, three designed for nucleotide sequence queries (BLASTN, BLASTX, and TBLASTX) and two designed for protein sequence queries (BLASTP and TBLASTN) (Coulson, Trends in Biotechnology: 76-80, 1994; Birren et al., Genome Analysis, I: 543, 1997). Such methods involve alignment and comparison of sequences. The BLAST algorithm calculates percent sequence identity and performs a statistical analysis of the similarity between the two sequences. The software for performing BLAST analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbor-joining tree of the proteins homologous to the genes of some embodiments of the invention may be used to provide an overview of structural and ancestral relationships. Sequence identity may be calculated using an alignment program as described above. It is expected that other plants will carry a similar functional gene (orthologue) or a family of similar genes and those genes will provide the same preferred phenotype as the genes presented here. Advantageously, these family members may be useful in the methods of some embodiments of the invention. Example of other plants include, but not limited to, barley (*Hordeum vulgare*), Arabidopsis (*Arabidopsis thaliana*), maize (*Zea mays*), cotton (*Gossypium*), Oilseed rape (*Brassica napus*), Rice (*Oryza sativa*), Sugar cane (*Saccharum officinarum*), Sorghum (*Sorghum bicolor*), Soybean (*Glycine max*), Sunflower (*Helianthus annuus*), Tomato (*Lycopersicon esculentum*) and Wheat (*Triticum aestivum*).

The above-mentioned analyses for sequence homology is preferably carried out on a full-length sequence, but may also be based on a comparison of certain regions such as conserved domains. The identification of such domains would also be well within the realm of the person skilled in the art and would involve, for example, a computer readable format of the nucleic acids of some embodiments of the invention, the use of alignment software programs and the use of publicly available information on protein domains, conserved motifs and boxes. This information is available in the PRODOM (biochem (dot) ucl (dot) ac (dot) uk/bsm/dbbrowser/protocol/prodomqry (dot) html), PIR (pir (dot) Georgetown (dot) edu/) or Pfam (sanger (dot) ac (dot) uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution Tables are well known in the art [see for example Creighton (1984) Proteins. W.H. Freeman and Company]. Homologues of a nucleic acid encompass nucleic acids having nucleotide substitutions, deletions and/or insertions relative to the unmodified nucleic acid in question and having similar biological and functional activity as the unmodified nucleic acid from which they are derived.

Polynucleotides and polypeptides with significant homology to the identified genes described in Table 1 (Example 1 above) were identified from the databases using BLAST software with the Blastp and tBlastn algorithms as filters for the first stage, and the needle (EMBOSS package) or Frame+ algorithm alignment for the second stage. Local identity (Blast alignments) was defined with a very permissive cutoff—60% Identity on a span of 60% of the sequences lengths because it is used only as a filter for the global alignment stage. The default filtering of the Blast package was not utilized (by setting the parameter "-F F").

In the second stage, homologs were defined based on a global identity of at least 80% to the core gene polypeptide sequence.

Two distinct forms for finding the optimal global alignment for protein or nucleotide sequences were used in this application:

1. Between Two Proteins (Following the Blastp Filter): EMBOSS-6.0.1 Needleman-Wunsch algorithm with the following modified parameters: gapopen=8 gapextend=2. The rest of the parameters were unchanged from the default options described hereinabove.

2. Between a Protein Sequence and a Nucleotide Sequence (Following the tblastn Filter): GenCore 6.0 OneModel application utilizing the Frame+ algorithm with the following parameters: model=frame+_p2n.model mode=qglobal -q=protein.sequence -db=nucleotide.sequence. The rest of the parameters are unchanged from the default options described hereinabove.

The query polypeptide sequences were SEQ ID NOs: 496-794 and the query polynucleotides were SEQ ID NOs: 1-495, and the identified orthologous and homologous sequences having at least 80% global sequence identity are provided in Table 2, below. These homologous genes are expected to increase plant yield, seed yield, oil yield, oil content, growth rate, fiber yield, fiber quality, fiber length, photosynthetic capacity, biomass, vigor, ABST and/or NUE of a plant.

TABLE 2

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU751_H1 | wheat\|12v3\|CA652300 | 795 | 2898 | 498 | 89.1 | globlastp |
| LNU751_H2 | rye\|12v1\|DRR001012.339395 | 796 | 2899 | 498 | 88.45 | glotblastn |
| LNU752_H3 | rye\|12v1\|DRR001012.155230 | 797 | 2900 | 499 | 96.4 | globlastp |
| LNU752_H4 | oat\|11v1\|GR316906_P1 | 798 | 2901 | 499 | 90.7 | globlastp |
| LNU752_H5 | brachypodium\|12v1\|BRADI2G38247_P1 | 799 | 2902 | 499 | 88.4 | globlastp |
| LNU752_H6 | rye\|12v1\|DRR001012.244869 | 800 | 2903 | 499 | 84.8 | globlastp |
| LNU753_H1 | pseudoroegneria\|gb167\|FF341151 | 801 | 2904 | 500 | 96.4 | globlastp |
| LNU753_H2 | wheat\|12v3\|CA619061 | 802 | 2905 | 500 | 95.5 | globlastp |
| LNU753_H3 | rye\|12v1\|DRR001013.175630 | 803 | 2906 | 500 | 93.7 | globlastp |
| LNU753_H4 | brachypodium\|12v1\|BRADI1G76060_T1 | 804 | 2907 | 500 | 90.6 | glotblastn |
| LNU753_H5 | rice\|11v1\|GFXAC099399X6 | 805 | 2908 | 500 | 87 | globlastp |
| LNU753_H6 | barley\|12v1\|BE060847_P1 | 806 | 2909 | 500 | 80.3 | globlastp |
| LNU753_H7 | wheat\|12v3\|BF474874 | 807 | 2910 | 500 | 80.3 | globlastp |
| LNU753_H8 | rice\|11v1\|BM037785 | 808 | 2911 | 500 | 80 | globlastp |
| LNU754_H1 | wheat\|12v3\|BE413658 | 809 | 2912 | 501 | 95.8 | globlastp |
| LNU754_H2 | leymus\|gb166\|EG390263_P1 | 810 | 2913 | 501 | 95 | globlastp |
| LNU754_H3 | pseudoroegneria\|gb167\|FF349286 | 811 | 2914 | 501 | 95 | globlastp |
| LNU754_H4 | rye\|12v1\|DRR001012.101669 | 812 | 2915 | 501 | 95 | globlastp |
| LNU754_H5 | brachypodium\|12v1\|BRADI2G06900_P1 | 813 | 2916 | 501 | 91.2 | globlastp |
| LNU754_H6 | oat\|11v1\|GR365468_P1 | 814 | 2917 | 501 | 88.7 | globlastp |
| LNU754_H7 | sorghum\|12v1\|SB03G001930 | 815 | 2918 | 501 | 85.4 | globlastp |
| LNU754_H8 | millet\|10v1\|EVO454PM027276_P1 | 816 | 2919 | 501 | 84.1 | globlastp |
| LNU754_H9 | maize\|10v1\|AI600590_P1 | 817 | 2920 | 501 | 83.9 | globlastp |
| LNU754_H13 | switchgrass\|12v1\|FE624722_P1 | 818 | 2921 | 501 | 83.7 | globlastp |
| LNU754_H10 | foxtail_millet\|11v3\|PHY7SI002752M_P1 | 819 | 2922 | 501 | 83.3 | globlastp |
| LNU754_H11 | rice\|11v1\|BE228738 | 820 | 2923 | 501 | 82 | globlastp |
| LNU754_H12 | switchgrass\|gb167\|FE624722 | 821 | 2924 | 501 | 82 | globlastp |
| LNU756_H1 | rye\|12v1\|DRR001012.433563 | 822 | 2925 | 502 | 94.9 | globlastp |
| LNU756_H2 | rye\|12v1\|BE493902 | 823 | 2926 | 502 | 94.6 | globlastp |
| LNU756_H3 | rye\|12v1\|DRR001012.24867 | 824 | 2926 | 502 | 94.6 | globlastp |
| LNU756_H4 | wheat\|12v3\|BG606914 | 825 | 2927 | 502 | 94.6 | globlastp |
| LNU756_H5 | brachypodium\|12v1\|BRADI2G24030_P1 | 826 | 2928 | 502 | 93.5 | globlastp |
| LNU756_H6 | oat\|11v1\|GR329669_P1 | 827 | 2929 | 502 | 92.4 | globlastp |
| LNU756_H7 | rice\|11v1\|BF475232 | 828 | 2930 | 502 | 82.61 | glotblastn |
| LNU756_H8 | foxtail_millet\|11v3\|EC612148_P1 | 829 | 2931 | 502 | 81.5 | globlastp |
| LNU756_H9 | sugarcane\|10v1\|BU103174 | 830 | 2932 | 502 | 80.4 | globlastp |
| LNU756_H10 | sorghum\|12v1\|SB09G021710 | 831 | 2933 | 502 | 80.1 | globlastp |
| LNU756_H12 | switchgrass\|12v1\|DN150091_P1 | 832 | 2934 | 502 | 80 | globlastp |
| LNU756_H11 | switchgrass\|gb167\|DN150091 | 833 | 2934 | 502 | 80 | globlastp |
| LNU757_H1 | wheat\|12v3\|CA645023 | 834 | 2935 | 503 | 98.2 | globlastp |
| LNU757_H2 | rye\|12v1\|DRR001012.10473 | 835 | 2936 | 503 | 97 | globlastp |
| LNU757_H3 | rye\|12v1\|DRR001012.121839 | 836 | 2937 | 503 | 97 | globlastp |
| LNU757_H4 | rye\|12v1\|DRR001012.768638 | 837 | 2938 | 503 | 95.9 | globlastp |
| LNU757_H5 | wheat\|12v3\|BE426208 | 838 | 2939 | 503 | 93.5 | globlastp |
| LNU757_H6 | oat\|11v1\|GR328666_P1 | 839 | 2940 | 503 | 91.8 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU758_H1 | wheat\|12v3\|BG906982 | 840 | 2941 | 504 | 91.6 | globlastp |
| LNU758_H2 | pseudoroegneria\|gb167\|FF345629 | 841 | 2942 | 504 | 87.1 | globlastp |
| LNU759_H1 | rye\|12v1\|DRR001012.140285 | 842 | 2943 | 505 | 94 | globlastp |
| LNU759_H2 | wheat\|12v3\|CA742547 | 843 | 2944 | 505 | 93 | globlastp |
| LNU759_H3 | wheat\|12v3\|SRR043326X66986D1 | 844 | 2944 | 505 | 93 | globlastp |
| LNU759_H4 | foxtail_millet\|11v3\|PHY7SI023760M_P1 | 845 | 2945 | 505 | 90 | globlastp |
| LNU759_H5 | rice\|11v1\|CF293997 | 846 | 2946 | 505 | 87.4 | globlastp |
| LNU759_H11 | switchgrass\|12v1\|FL787656_P1 | 847 | 2947 | 505 | 87 | globlastp |
| LNU759_H6 | switchgrass\|gb167\|FL787656 | 848 | 2947 | 505 | 87 | globlastp |
| LNU759_H7 | cynodon\|10v1\|ES299636_P1 | 849 | 2948 | 505 | 86.1 | globlastp |
| LNU759_H12 | switchgrass\|12v1\|FL779827_P1 | 850 | 2949 | 505 | 86 | globlastp |
| LNU759_H8 | sorghum\|12v1\|SB09G022720 | 851 | 2950 | 505 | 83.5 | globlastp |
| LNU759_H9 | brachypodium\|12v1\|BRADI2G23060_P1 | 852 | 2951 | 505 | 82.2 | globlastp |
| LNU759_H10 | maize\|10v1\|EE680335_P1 | 853 | 2952 | 505 | 82 | globlastp |
| LNU760_H2 | pseudoroegneria\|gb167\|FF358412 | 854 | 2953 | 506 | 86.75 | glotblastn |
| LNU760_H3 | rye\|12v1\|DRR001014.135934 | 855 | 2954 | 506 | 81.13 | glotblastn |
| LNU760_H4 | switchgrass\|12v1\|FL773680_T1 | 856 | 2955 | 506 | 80.13 | glotblastn |
| LNU761_H1 | wheat\|12v3\|BQ170294 | 857 | 2956 | 507 | 96.1 | globlastp |
| LNU761_H2 | wheat\|12v3\|BG263661 | 858 | 2957 | 507 | 95.3 | globlastp |
| LNU761_H3 | rye\|12v1\|BF429268 | 859 | 2958 | 507 | 95.1 | globlastp |
| LNU761_H4 | brachypodium\|12v1\|BRADI2G61140_P1 | 860 | 2959 | 507 | 84.7 | globlastp |
| LNU761_H5 | foxtail_millet\|11v3\|PHY7SI001000M_P1 | 861 | 2960 | 507 | 84.5 | globlastp |
| LNU761_H9 | switchgrass\|12v1\|FE627078_P1 | 862 | 2961 | 507 | 83.8 | globlastp |
| LNU761_H6 | switchgrass\|gb167\|FE605627 | 863 | 2962 | 507 | 82.8 | globlastp |
| LNU761_H7 | rice\|11v1\|CR278964 | 864 | 2963 | 507 | 82.6 | globlastp |
| LNU761_H8 | sorghum\|12v1\|SB03G046200 | 865 | 2964 | 507 | 81.2 | globlastp |
| LNU762_H1 | rye\|12v1\|DRR001012.142840 | 866 | 2965 | 508 | 93.9 | globlastp |
| LNU762_H2 | rye\|12v1\|DRR001012.108084 | 867 | 2966 | 508 | 93.6 | globlastp |
| LNU762_H3 | wheat\|12v3\|CA653618 | 868 | 2967 | 508 | 92.5 | globlastp |
| LNU762_H4 | brachypodium\|12v1\|BRADI5G07300_P1 | 869 | 2968 | 508 | 87.1 | globlastp |
| LNU762_H5 | foxtail_millet\|11v3\|EC613160_P1 | 870 | 2969 | 508 | 81 | globlastp |
| LNU763_H1 | wheat\|12v3\|BE517537 | 871 | 2970 | 509 | 93.3 | globlastp |
| LNU763_H2 | pseudoroegneria\|gb167\|FF345576 | 872 | 2971 | 509 | 91.3 | globlastp |
| LNU763_H3 | rye\|12v1\|DRR001012.538230 | 873 | 2972 | 509 | 89.7 | globlastp |
| LNU763_H4 | rye\|12v1\|DRR001012.104458 | 874 | 2973 | 509 | 89.1 | globlastp |
| LNU763_H5 | rye\|12v1\|DRR001012.104992 | 875 | 2974 | 509 | 89.1 | globlastp |
| LNU763_H6 | rye\|12v1\|DRR001012.307746 | 876 | 2975 | 509 | 89.1 | glotblastn |
| LNU763_H7 | rye\|12v1\|DRR001012.403113 | 877 | 2976 | 509 | 86.58 | glotblastn |
| LNU764_H1 | wheat\|12v3\|BE419722 | 878 | 2977 | 510 | 96 | globlastp |
| LNU764_H2 | rye\|12v1\|DRR001012.148705 | 879 | 2978 | 510 | 95.6 | globlastp |
| LNU764_H3 | wheat\|12v3\|AL817877 | 880 | 2979 | 510 | 94.8 | globlastp |
| LNU764_H4 | rice\|11v1\|CB680462 | 881 | 2980 | 510 | 83.8 | globlastp |
| LNU764_H5 | brachypodium\|12v1\|BRADI3G14080_P1 | 882 | 2981 | 510 | 83.6 | globlastp |
| LNU764_H6 | sorghum\|12v1\|SB07G002140 | 883 | 2982 | 510 | 82.4 | globlastp |
| LNU764_H7 | foxtail_millet\|11v3\|EC613412_P1 | 884 | 2983 | 510 | 81.3 | globlastp |
| LNU764_H9 | switchgrass\|12v1\|FE638335_P1 | 885 | 2984 | 510 | 80.9 | globlastp |
| LNU764_H8 | switchgrass\|gb167\|FE649051 | 886 | 2985 | 510 | 80.57 | glotblastn |
| LNU764_H10 | switchgrass\|12v1\|FL754424_P1 | 887 | 2986 | 510 | 80.3 | globlastp |
| LNU766_H1 | wheat\|12v3\|BF483178 | 888 | 2987 | 511 | 96.6 | globlastp |
| LNU766_H2 | rye\|12v1\|DRR001012.107386 | 889 | 2988 | 511 | 96.14 | globlastp |
| LNU766_H3 | brachypodium\|12v1\|BRADI2G62060_T1 | 890 | 2989 | 511 | 90.68 | glotblastn |
| LNU766_H5 | rice\|11v1\|BM419326 | 891 | 2990 | 511 | 85.8 | globlastp |
| LNU766_H6 | foxtail_millet\|11v3\|GT090868_P1 | 892 | 2991 | 511 | 85.5 | globlastp |
| LNU766_H11 | switchgrass\|12v1\|DT948944_P1 | 893 | 2992 | 511 | 85.4 | globlastp |
| LNU766_H12 | switchgrass\|12v1\|FE657698_P1 | 894 | 2993 | 511 | 85.3 | globlastp |
| LNU766_H7 | millet\|10v1\|EVO454PM004168_P1 | 895 | 2994 | 511 | 84.9 | globlastp |
| LNU766_H8 | rye\|12v1\|DRR001012.124126 | 896 | 2995 | 511 | 84.7 | globlastp |
| LNU766_H9 | maize\|10v1\|BM259345_P1 | 897 | 2996 | 511 | 84.5 | globlastp |
| LNU766_H10 | sorghum\|12v1\|SB10G025840 | 898 | 2997 | 511 | 84.4 | globlastp |
| LNU767_H1 | rye\|12v1\|DRR001012.555545 | 899 | 2998 | 512 | 92.3 | globlastp |
| LNU767_H2 | wheat\|12v3\|BE419870 | 900 | 2999 | 512 | 91.2 | globlastp |
| LNU767_H3 | lolium\|10v1\|AU246334_P1 | 901 | 3000 | 512 | 84.6 | globlastp |
| LNU768_H1 | wheat\|12v3\|BI479814 | 902 | 3001 | 513 | 99.1 | globlastp |
| LNU768_H2 | rye\|12v1\|DRR001013.174965 | 903 | 3002 | 513 | 98.2 | globlastp |
| LNU768_H3 | rye\|12v1\|DRR001012.20806 | 904 | 3003 | 513 | 97.8 | globlastp |
| LNU768_H4 | rye\|12v1\|DRR001012.266041 | 905 | 3004 | 513 | 97.35 | glotblastn |
| LNU768_H5 | brachypodium\|12v1\|BRADI2G56682_P1 | 906 | 3005 | 513 | 93.4 | globlastp |
| LNU768_H6 | rice\|11v1\|CF294088 | 907 | 3006 | 513 | 93.4 | globlastp |
| LNU768_H15 | switchgrass\|12v1\|FL692202_P1 | 908 | 3007 | 513 | 92.5 | globlastp |
| LNU768_H7 | sorghum\|12v1\|SB01G021690 | 909 | 3008 | 513 | 92.5 | globlastp |
| LNU768_H8 | switchgrass\|gb167\|FL692202 | 910 | 3007 | 513 | 92.5 | globlastp |
| LNU768_H9 | maize\|10v1\|AI941829_P1 | 911 | 3009 | 513 | 92 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU768_H16 | switchgrass\|12v1\|GD014223_P1 | 912 | 3010 | 513 | 91.2 | globlastp |
| LNU768_H10 | foxtail_millet\|11v3\|PHY7SI034560M_T1 | 913 | 3011 | 513 | 90.35 | glotblastn |
| LNU768_H11 | sugarcane\|10v1\|BQ536826 | 914 | 3012 | 513 | 90.3 | globlastp |
| LNU768_H12 | oat\|11v1\|GO596074_P1 | 915 | 3013 | 513 | 84.5 | globlastp |
| LNU768_H13 | amborella\|12v3\|SRR038634.15775_P1 | 916 | 3014 | 513 | 80.1 | globlastp |
| LNU768_H14 | pineapple\|10v1\|DT336500_P1 | 917 | 3015 | 513 | 80.1 | globlastp |
| LNU769_H8 | brachypodium\|12v1\|BRADI4G21820_P1 | 918 | 3016 | 514 | 82.4 | globlastp |
| LNU769_H13 | brachypodium\|12v1\|BRADI2G16170_P1 | 919 | 3017 | 514 | 80.8 | globlastp |
| LNU769_H14 | sorghum\|12v1\|SB05G007470 | 920 | 3018 | 514 | 80.8 | globlastp |
| LNU770_H1 | wheat\|12v3\|BE398561 | 921 | 3019 | 515 | 96 | globlastp |
| LNU770_H2 | rye\|12v1\|DRR001012.712789 | 922 | 3020 | 515 | 94.8 | globlastp |
| LNU770_H3 | brachypodium\|12v1\|BRADI1G56870_P1 | 923 | 3021 | 515 | 82 | globlastp |
| LNU772_H1 | wheat\|12v3\|BM135473 | 924 | 3022 | 517 | 96 | globlastp |
| LNU772_H2 | rye\|12v1\|DRR001012.142915 | 925 | 3023 | 517 | 93.5 | globlastp |
| LNU772_H3 | rye\|12v1\|DRR001012.612512 | 926 | 3024 | 517 | 93 | globlastp |
| LNU772_H4 | brachypodium\|12v1\|BRADI3G08480_P1 | 927 | 3025 | 517 | 90.5 | globlastp |
| LNU772_H5 | oat\|11v1\|GO592678_P1 | 928 | 3026 | 517 | 88.9 | globlastp |
| LNU772_H8 | millet\|10v1\|EVO454PM022643_P1 | 929 | 3027 | 517 | 86.6 | globlastp |
| LNU772_H6 | rice\|11v1\|CB000951 | 930 | 3028 | 517 | 86.3 | globlastp |
| LNU772_H9 | foxtail_millet\|11v3\|PHY7SI018070M_P1 | 931 | 3029 | 517 | 86 | globlastp |
| LNU772_H15 | switchgrass\|12v1\|DN144396_P1 | 932 | 3030 | 517 | 84.3 | globlastp |
| LNU772_H13 | sorghum\|12v1\|SB04G008000 | 933 | 3031 | 517 | 83.9 | globlastp |
| LNU772_H10 | switchgrass\|gb167\|DN144396 | 934 | 3032 | 517 | 83.8 | globlastp |
| LNU772_H11 | maize\|10v1\|AA979978_P1 | 935 | 3033 | 517 | 83.7 | globlastp |
| LNU772_H14 | cynodon\|10v1\|ES292031_P1 | 936 | 3034 | 517 | 82.1 | globlastp |
| LNU773_H1 | rye\|12v1\|DRR001012.115164 | 937 | 3035 | 518 | 94.6 | globlastp |
| LNU773_H2 | brachypodium\|12v1\|BRADI1G02440_P1 | 938 | 3036 | 518 | 84.1 | globlastp |
| LNU773_H3 | foxtail_millet\|11v3\|PHY7SI034229M_P1 | 939 | 3037 | 518 | 82.1 | globlastp |
| LNU773_H4 | foxtail_millet\|11v3\|SICRP053164_P1 | 940 | 3037 | 518 | 82.1 | globlastp |
| LNU773_H5 | rice\|11v1\|CB634493 | 941 | 3038 | 518 | 81.5 | globlastp |
| LNU774_H1 | brachypodium\|12v1\|BRADI4G38810_P1 | 942 | 3039 | 519 | 82.9 | globlastp |
| LNU775_H1 | rye\|12v1\|DRR001012.110859 | 943 | 3040 | 520 | 93.5 | globlastp |
| LNU775_H2 | wheat\|12v3\|CD937862 | 944 | 3041 | 520 | 82.8 | globlastp |
| LNU775_H3 | brachypodium\|12v1\|BRADI2G04447_P1 | 945 | 3042 | 520 | 82.6 | globlastp |
| LNU777_H1 | rye\|12v1\|DRR001012.142992 | 946 | 3043 | 522 | 92.4 | globlastp |
| LNU777_H2 | rye\|12v1\|DRR001012.313229 | 947 | 3044 | 522 | 91.8 | globlastp |
| LNU777_H3 | wheat\|12v3\|BE499027 | 948 | 3045 | 522 | 81.89 | glotblastn |
| LNU778_H1 | wheat\|12v3\|BE402486 | 949 | 3046 | 523 | 96.9 | globlastp |
| LNU778_H2 | wheat\|12v3\|SRR073321X42757D1 | 950 | 3047 | 523 | 96.9 | globlastp |
| LNU778_H3 | wheat\|12v3\|CD871315 | 951 | 3048 | 523 | 91.7 | globlastp |
| LNU778_H4 | brachypodium\|12v1\|BRADI2G46340_P1 | 952 | 3049 | 523 | 91.6 | globlastp |
| LNU778_H5 | rice\|11v1\|BI811994 | 953 | 3050 | 523 | 87.2 | globlastp |
| LNU778_H6 | foxtail_millet\|11v3\|PHY7SI000364M_P1 | 954 | 3051 | 523 | 85.2 | globlastp |
| LNU778_H7 | sorghum\|12v1\|SB03G030890 | 955 | 3052 | 523 | 85.1 | globlastp |
| LNU778_H8 | maize\|10v1\|CA399726_P1 | 956 | 3053 | 523 | 84.5 | globlastp |
| LNU778_H9 | maize\|10v1\|AI615203_T1 | 957 | 3054 | 523 | 83.35 | glotblastn |
| LNU779_H1 | pseudoroegneria\|gb167\|FF346373 | 958 | 3055 | 524 | 98.1 | globlastp |
| LNU779_H2 | rye\|12v1\|BE587009 | 959 | 3056 | 524 | 97.8 | globlastp |
| LNU779_H3 | wheat\|12v3\|BE402818 | 960 | 3057 | 524 | 97.5 | globlastp |
| LNU779_H4 | wheat\|12v3\|BE586120 | 961 | 3058 | 524 | 97.5 | globlastp |
| LNU779_H5 | wheat\|12v3\|CV778626 | 962 | 3059 | 524 | 96.91 | glotblastn |
| LNU779_H6 | oat\|11v1\|CN815634_T1 | 963 | 3060 | 524 | 94.44 | glotblastn |
| LNU779_H7 | brachypodium\|12v1\|BRADI3G42790_P1 | 964 | 3061 | 524 | 91.7 | globlastp |
| LNU779_H8 | rice\|11v1\|BI794901 | 965 | 3062 | 524 | 88.6 | globlastp |
| LNU779_H9 | foxtail_millet\|11v3\|PHY7SI014086M_P1 | 966 | 3063 | 524 | 87.7 | globlastp |
| LNU779_H10 | switchgrass\|gb167\|DN144658 | 967 | 3064 | 524 | 87.7 | globlastp |
| LNU779_H11 | switchgrass\|gb167\|FE631532 | 968 | 3065 | 524 | 87.7 | globlastp |
| LNU779_H12 | millet\|10v1\|EVO454PM012215_P1 | 969 | 3066 | 524 | 87.4 | globlastp |
| LNU779_H13 | maize\|10v1\|AI649552_P1 | 970 | 3067 | 524 | 86.8 | globlastp |
| LNU779_H14 | sorghum\|12v1\|SB07G024220 | 971 | 3068 | 524 | 86.8 | globlastp |
| LNU779_H15 | sugarcane\|10v1\|CA065962 | 972 | 3069 | 524 | 86.8 | globlastp |
| LNU779_H16 | maize\|10v1\|BG354183_P1 | 973 | 3070 | 524 | 83.7 | globlastp |
| LNU779_H17 | switchgrass\|12v1\|FE639284_P1 | 974 | 3071 | 524 | 81.8 | globlastp |
| LNU781_H1 | rye\|12v1\|DRR001012.110372 | 975 | 3072 | 526 | 98.9 | globlastp |
| LNU781_H2 | rye\|12v1\|DRR001012.15876 | 976 | 3073 | 526 | 97.11 | glotblastn |
| LNU781_H3 | wheat\|12v3\|CA666142 | 977 | 3074 | 526 | 96.1 | globlastp |
| LNU781_H4 | brachypodium\|12v1\|BRADI1G07870_P1 | 978 | 3075 | 526 | 91.3 | globlastp |
| LNU781_H5 | foxtail_millet\|11v3\|EC612060_P1 | 979 | 3076 | 526 | 84.2 | globlastp |
| LNU781_H6 | rice\|11v1\|BI118738 | 980 | 3077 | 526 | 84 | globlastp |
| LNU781_H7 | sorghum\|12v1\|SB01G007340 | 981 | 3078 | 526 | 83.7 | globlastp |
| LNU781_H8 | millet\|10v1\|EVO454PM114571_P1 | 982 | 3079 | 526 | 82.4 | globlastp |
| LNU781_H12 | switchgrass\|12v1\|FL756770_P1 | 983 | 3080 | 526 | 82.2 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU781_H9 | maize\|10v1\|CA403670_P1 | 984 | 3081 | 526 | 82.2 | globlastp |
| LNU781_H10 | wheat\|12v3\|CA593786 | 985 | 3082 | 526 | 81.84 | glotblastn |
| LNU781_H13 | switchgrass\|12v1\|FE611031_P1 | 986 | 3083 | 526 | 80.8 | globlastp |
| LNU781_H11 | maize\|10v1\|BM498386_P1 | 987 | 3084 | 526 | 80.3 | globlastp |
| LNU782_H1 | wheat\|12v3\|BQ788965 | 988 | 3085 | 527 | 97.9 | globlastp |
| LNU782_H2 | rye\|12v1\|DRR001012.594129 | 989 | 3086 | 527 | 96.2 | globlastp |
| LNU783_H1 | rye\|12v1\|DRR001012.216554 | 990 | 3087 | 528 | 92.8 | globlastp |
| LNU783_H2 | brachypodium\|12v1\|BRADI2G04360_P1 | 991 | 3088 | 528 | 81.8 | globlastp |
| LNU783_H3 | rice\|11v1\|BE040181 | 992 | 3089 | 528 | 80 | globlastp |
| LNU787_H12 | rye\|12v1\|DRR001012.395832 | 993 | 3090 | 532 | 91.4 | globlastp |
| LNU787_H13 | rye\|12v1\|DRR001012.20638 | 994 | 3091 | 532 | 90.8 | globlastp |
| LNU787_H1 | pseudoroegneria\|gb167\|FF355972 | 995 | 3092 | 532 | 90.5 | globlastp |
| LNU787_H2 | wheat\|12v3\|BG909595 | 996 | 3093 | 532 | 89.9 | globlastp |
| LNU787_H4 | wheat\|12v3\|AL821420 | 997 | — | 532 | 89.63 | glotblastn |
| LNU787_H9 | rice\|11v1\|AU092213 | 998 | 3094 | 532 | 87.7 | globlastp |
| LNU787_H6 | switchgrass\|gb167\|GD010772 | 999 | 3095 | 532 | 86.5 | globlastp |
| LNU787_H8 | foxtail_millet\|11v3\|PHY7SI006894M_P1 | 1000 | 3096 | 532 | 86.5 | globlastp |
| LNU787_H14 | switchgrass\|12v1\|GD010772_P1 | 1001 | 3097 | 532 | 86.2 | globlastp |
| LNU787_H7 | cenchrus\|gb166\|EB661125_P1 | 1002 | 3098 | 532 | 86.2 | globlastp |
| LNU787_H10 | millet\|10v1\|EVO454PM055809_T1 | 1003 | — | 532 | 84.97 | glotblastn |
| LNU787_H3 | leymus\|gb166\|EG384638_P1 | 1004 | 3099 | 532 | 84.7 | globlastp |
| LNU787_H11 | maize\|10v1\|AI670300_P1 | 1005 | 3100 | 532 | 83.7 | globlastp |
| LNU788_H1 | rye\|12v1\|DRR001012.407094 | 1006 | 3101 | 533 | 91.4 | globlastp |
| LNU788_H2 | rye\|12v1\|DRR001012.189907 | 1007 | 3102 | 533 | 91.1 | globlastp |
| LNU788_H3 | wheat\|12v3\|BE606973 | 1008 | 3103 | 533 | 90.7 | globlastp |
| LNU788_H5 | sorghum\|12v1\|SB10G003000 | 1009 | 3104 | 533 | 83.3 | globlastp |
| LNU789_H1 | wheat\|12v3\|BJ312717 | 1010 | 3105 | 534 | 93.65 | glotblastn |
| LNU789_H2 | wheat\|12v3\|CD898702 | 1011 | 3106 | 534 | 91.8 | globlastp |
| LNU789_H3 | rye\|12v1\|DRR001012.152256 | 1012 | 3107 | 534 | 91.7 | globlastp |
| LNU789_H4 | wheat\|12v3\|AL821622 | 1013 | 3108 | 534 | 91.1 | globlastp |
| LNU789_H5 | barley\|12v1\|BG344287_P1 | 1014 | 3109 | 534 | 90.2 | globlastp |
| LNU789_H6 | foxtail_millet\|11v3\|PHY7SI034969M_P1 | 1015 | 3110 | 534 | 89.2 | globlastp |
| LNU789_H7 | switchgrass\|gb167\|FL695828 | 1016 | 3111 | 534 | 88.6 | globlastp |
| LNU789_H8 | millet\|10v1\|EVO454PM015227_P1 | 1017 | 3112 | 534 | 87 | globlastp |
| LNU789_H13 | switchgrass\|12v1\|FL695828_P1 | 1018 | 3113 | 534 | 86.8 | globlastp |
| LNU789_H9 | rice\|11v1\|C27096 | 1019 | 3114 | 534 | 86.8 | globlastp |
| LNU789_H10 | sorghum\|12v1\|SB01G037160 | 1020 | 3115 | 534 | 86.1 | globlastp |
| LNU789_H11 | maize\|10v1\|AI783213_P1 | 1021 | 3116 | 534 | 85.9 | globlastp |
| LNU789_H12 | sugarcane\|10v1\|CA066166 | 1022 | 3117 | 534 | 85.6 | globlastp |
| LNU790_H1 | rice\|11v1\|BI804641 | 1023 | 3118 | 535 | 90.8 | globlastp |
| LNU790_H2 | maize\|10v1\|AI461507_P1 | 1024 | 3119 | 535 | 90.4 | globlastp |
| LNU790_H3 | sorghum\|12v1\|SB01G038000 | 1025 | 3120 | 535 | 90.4 | globlastp |
| LNU790_H10 | switchgrass\|12v1\|FE603656_P1 | 1026 | 3121 | 535 | 90.2 | globlastp |
| LNU790_H4 | maize\|10v1\|BI096427_P1 | 1027 | 3122 | 535 | 90 | globlastp |
| LNU790_H5 | foxtail_millet\|11v3\|PHY7SI035653M_P1 | 1028 | 3123 | 535 | 89.6 | globlastp |
| LNU790_H6 | rye\|12v1\|DRR001012.151815 | 1029 | 3124 | 535 | 88.6 | globlastp |
| LNU790_H7 | switchgrass\|gb167\|DN142553 | 1030 | 3125 | 535 | 88.52 | glotblastn |
| LNU790_H8 | millet\|10v1\|EVO454PM083041_P1 | 1031 | 3126 | 535 | 86.5 | globlastp |
| LNU790_H9 | wheat\|12v3\|CA605241 | 1032 | 3127 | 535 | 82.3 | globlastp |
| LNU791_H1 | sorghum\|12v1\|SB01G041890 | 1033 | 3128 | 536 | 89.6 | globlastp |
| LNU791_H2 | wheat\|12v3\|ERR125558X24074D1 | 1034 | 3129 | 536 | 89.6 | globlastp |
| LNU791_H3 | rye\|12v1\|DRR001012.416966 | 1035 | 3130 | 536 | 88.7 | globlastp |
| LNU791_H4 | foxtail_millet\|11v3\|PHY7SI038156M_P1 | 1036 | 3131 | 536 | 85.8 | globlastp |
| LNU791_H5 | rice\|11v1\|CA752611 | 1037 | 3132 | 536 | 85.8 | globlastp |
| LNU791_H6 | switchgrass\|gb167\|FL973644 | 1038 | 3133 | 536 | 85.8 | globlastp |
| LNU791_H7 | millet\|10v1\|PMSLX0872180D1_P1 | 1039 | 3134 | 536 | 84.9 | globlastp |
| LNU792_H1 | rye\|12v1\|GFXFJ374582X1 | 1040 | 3135 | 537 | 94 | globlastp |
| LNU792_H2 | barley\|12v1\|AV833692_P1 | 1041 | 3136 | 537 | 93.6 | globlastp |
| LNU792_H3 | rice\|11v1\|AU056540 | 1042 | 3137 | 537 | 89.9 | globlastp |
| LNU792_H4 | foxtail_millet\|11v3\|PHY7SI000485M_P1 | 1043 | 3138 | 537 | 88.7 | globlastp |
| LNU792_H10 | switchgrass\|12v1\|FE640305_P1 | 1044 | 3139 | 537 | 88.3 | globlastp |
| LNU792_H5 | maize\|10v1\|AW600616_P1 | 1045 | 3140 | 537 | 87.7 | globlastp |
| LNU792_H6 | maize\|10v1\|CD439418_P1 | 1046 | 3141 | 537 | 84.7 | globlastp |
| LNU792_H7 | wheat\|12v3\|BE412277 | 1047 | 3142 | 537 | 82.4 | globlastp |
| LNU792_H8 | sorghum\|12v1\|SB03G036050 | 1048 | 3143 | 537 | 82.3 | globlastp |
| LNU792_H9 | wheat\|12v3\|CA614780 | 1049 | 3144 | 537 | 80 | globlastp |
| LNU794_H1 | wheat\|12v3\|BF201200 | 1050 | 3145 | 539 | 96.7 | globlastp |
| LNU794_H2 | pseudoroegneria\|gb167\|FF344480 | 1051 | 3146 | 539 | 96.3 | globlastp |
| LNU794_H3 | rye\|12v1\|DRR001012.108384 | 1052 | 3147 | 539 | 96.3 | globlastp |
| LNU794_H4 | oat\|11v1\|GO588032_P1 | 1053 | 3148 | 539 | 95.5 | globlastp |
| LNU794_H5 | rice\|11v1\|AF074750 | 1054 | 3149 | 539 | 89.8 | globlastp |
| LNU794_H13 | switchgrass\|12v1\|FE601825_P1 | 1055 | 3150 | 539 | 88.5 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU794_H6 | switchgrass\|gb167\|FE601825 | 1056 | 3150 | 539 | 88.5 | globlastp |
| LNU794_H7 | switchgrass\|gb167\|FE644897 | 1057 | 3151 | 539 | 88.1 | globlastp |
| LNU794_H8 | sugarcane\|10v1\|CA102960 | 1058 | 3152 | 539 | 87.7 | globlastp |
| LNU794_H9 | millet\|10v1\|EVO454PM002886_P1 | 1059 | 3153 | 539 | 87.3 | globlastp |
| LNU794_H10 | foxtail_millet\|11v3\|PHY7SI014266M_P1 | 1060 | 3154 | 539 | 86.5 | globlastp |
| LNU794_H11 | sorghum\|12v1\|SB07G003760 | 1061 | 3155 | 539 | 86.5 | globlastp |
| LNU794_H12 | maize\|10v1\|AI944207_P1 | 1062 | 3156 | 539 | 84.8 | globlastp |
| LNU794_H14 | switchgrass\|12v1\|FL968985_T1 | 1063 | 3157 | 539 | 80 | glotblastn |
| LNU797_H1 | leymus\|gb166\|EG376487_P1 | 1064 | 3158 | 542 | 99.6 | globlastp |
| LNU797_H2 | wheat\|12v3\|BE400744 | 1065 | 3159 | 542 | 99.2 | globlastp |
| LNU797_H3 | wheat\|12v3\|BE406331 | 1066 | 3160 | 542 | 99.2 | globlastp |
| LNU797_H4 | wheat\|12v3\|CA730405 | 1067 | 3159 | 542 | 99.2 | globlastp |
| LNU797_H5 | rye\|12v1\|BF429235 | 1068 | 3161 | 542 | 98.7 | globlastp |
| LNU797_H6 | fescue\|gb161\|CK801981_P1 | 1069 | 3162 | 542 | 98.3 | globlastp |
| LNU797_H7 | oat\|11v1\|CN816314_P1 | 1070 | 3163 | 542 | 98.3 | globlastp |
| LNU797_H8 | oat\|11v1\|GO589763_P1 | 1071 | 3164 | 542 | 97.9 | globlastp |
| LNU797_H9 | rice\|11v1\|BE039235 | 1072 | 3165 | 542 | 97.9 | globlastp |
| LGP52 | sorghum\|12v1\|SB05G024560 | 1073 | 3166 | 542 | 97.5 | globlastp |
| LNU797_H10 | brachypodium\|12v1\|BRADI4G13740T2_P1 | 1074 | 3167 | 542 | 97.5 | globlastp |
| LNU797_H11 | maize\|10v1\|AI395988_P1 | 1075 | 3166 | 542 | 97.5 | globlastp |
| LNU797_H12 | sugarcane\|10v1\|BQ536939 | 1076 | 3166 | 542 | 97.5 | globlastp |
| LNU797_H13 | cenchrus\|gb166\|BM084421_P1 | 1077 | 3168 | 542 | 97 | globlastp |
| LNU797_H14 | foxtail_millet\|11v3\|PHY7SI026806M_P1 | 1078 | 3168 | 542 | 97 | globlastp |
| LNU797_H15 | onion\|12v1\|CF439938_P1 | 1079 | 3169 | 542 | 97 | globlastp |
| LNU797_H16 | onion\|12v1\|CF441222_P1 | 1080 | 3170 | 542 | 97 | globlastp |
| LNU797_H17 | sorghum\|12v1\|SB01G046910 | 1081 | 3171 | 542 | 97 | globlastp |
| LGP52_H1 | switchgrass\|12v1\|FE602145_P1 | 1082 | 3172 | 542 | 96.6 | globlastp |
| LNU797_H18 | euonymus\|11v1\|SRR070038X135997_P1 | 1083 | 3173 | 542 | 96.6 | globlastp |
| LNU797_H19 | fescue\|gb161\|DT675202_P1 | 1084 | 3174 | 542 | 96.6 | globlastp |
| LNU797_H20 | maize\|10v1\|AI714766_P1 | 1085 | 3175 | 542 | 96.6 | globlastp |
| LNU797_H21 | millet\|10v1\|EVO454PM001587_P1 | 1086 | 3176 | 542 | 96.6 | globlastp |
| LNU797_H22 | millet\|10v1\|EVO454PM005709_P1 | 1087 | 3177 | 542 | 96.6 | globlastp |
| LNU797_H23 | pseudoroegneria\|gb167\|FF343070 | 1088 | 3178 | 542 | 96.6 | globlastp |
| LNU797_H24 | rye\|12v1\|DRR001012.101136 | 1089 | 3178 | 542 | 96.6 | globlastp |
| LNU797_H25 | rye\|12v1\|DRR001012.112514 | 1090 | 3178 | 542 | 96.6 | globlastp |
| LNU797_H26 | rye\|12v1\|DRR001012.193069 | 1091 | 3178 | 542 | 96.6 | globlastp |
| LNU797_H27 | switchgrass\|gb167\|FE602145 | 1092 | 3172 | 542 | 96.6 | globlastp |
| LNU797_H28 | switchgrass\|gb167\|FE619094 | 1093 | 3172 | 542 | 96.6 | globlastp |
| LNU797_H29 | switchgrass\|gb167\|FE624039 | 1094 | 3172 | 542 | 96.6 | globlastp |
| LNU797_H30 | arnica\|11v1\|SRR099034X109165_P1 | 1095 | 3179 | 542 | 96.2 | globlastp |
| LNU797_H31 | artemisia\|10v1\|EY043858_P1 | 1096 | 3180 | 542 | 96.2 | globlastp |
| LNU797_H32 | euonymus\|11v1\|SRR070038X195269_P1 | 1097 | 3181 | 542 | 96.2 | globlastp |
| LNU797_H33 | grape\|11v1\|GSVIVT01016670001_P1 | 1098 | 3182 | 542 | 96.2 | globlastp |
| LNU797_H34 | soybean\|11v1\|GLYMA02G01700 | 1099 | 3183 | 542 | 96.2 | globlastp |
| LNU797_H34 | soybean\|12v1\|GLYMA02G01700_P1 | 1100 | 3183 | 542 | 96.2 | globlastp |
| LNU797_H35 | sunflower\|12v1\|CD848350 | 1101 | 3179 | 542 | 96.2 | globlastp |
| LNU797_H36 | sunflower\|12v1\|DY926327 | 1102 | 3179 | 542 | 96.2 | globlastp |
| LNU797_H37 | wheat\|12v3\|BE398301 | 1103 | 3184 | 542 | 96.2 | globlastp |
| LNU797_H38 | wheat\|12v3\|BE638088 | 1104 | 3185 | 542 | 96.2 | globlastp |
| LNU797_H39 | wheat\|12v3\|CA616043 | 1105 | 3185 | 542 | 96.2 | globlastp |
| LGP52_H3 | bean\|12v2\|CA898157_P1 | 1106 | 3186 | 542 | 95.8 | globlastp |
| LNU797_H40 | amsonia\|11v1\|SRR098688X100584_P1 | 1107 | 3187 | 542 | 95.8 | globlastp |
| LNU797_H41 | barley\|12v1\|BE420554_P1 | 1108 | 3188 | 542 | 95.8 | globlastp |
| LNU797_H42 | bean\|12v2\|CA898157 | 1109 | 3186 | 542 | 95.8 | globlastp |
| LNU797_H43 | chestnut\|gb170\|SRR006295S0000440_P1 | 1110 | 3189 | 542 | 95.8 | globlastp |
| LNU797_H44 | cichorium\|gb171\|EH695394_P1 | 1111 | 3190 | 542 | 95.8 | globlastp |
| LNU797_H45 | coffea\|10v1\|DV681794_P1 | 1112 | 3191 | 542 | 95.8 | globlastp |
| LNU797_H46 | cotton\|11v1\|CO098301_P1 | 1113 | 3192 | 542 | 95.8 | globlastp |
| LNU797_H47 | cowpea\|12v1\|FF391241_P1 | 1114 | 3186 | 542 | 95.8 | globlastp |
| LNU797_H48 | dandelion\|10v1\|DR398974_P1 | 1115 | 3190 | 542 | 95.8 | globlastp |
| LNU797_H49 | eschscholzia\|11v1\|CK745182_P1 | 1116 | 3193 | 542 | 95.8 | globlastp |
| LNU797_H50 | euonymus\|11v1\|SRR070038X148521_P1 | 1117 | 3194 | 542 | 95.8 | globlastp |
| LNU797_H51 | gossypium_raimondii\|12v1\|DR460270_P1 | 1118 | 3195 | 542 | 95.8 | globlastp |
| LNU797_H52 | heritiera\|10v1\|SRR005794S0001293_P1 | 1119 | 3196 | 542 | 95.8 | globlastp |
| LNU797_H53 | lettuce\|12v1\|DW046332_P1 | 1120 | 3190 | 542 | 95.8 | globlastp |
| LNU797_H54 | lotus\|09v1\|AW720222_P1 | 1121 | 3197 | 542 | 95.8 | globlastp |
| LNU797_H55 | oak\|10v1\|FP043285_P1 | 1122 | 3189 | 542 | 95.8 | globlastp |
| LNU797_H56 | sunflower\|12v1\|CD849067 | 1123 | 3198 | 542 | 95.8 | globlastp |
| LNU797_H57 | tabernaemontana\|11v1\|SRR098689X106530 | 1124 | 3199 | 542 | 95.8 | globlastp |
| LNU797_H58 | tragopogon\|10v1\|SRR020205S0002302 | 1125 | 3190 | 542 | 95.8 | globlastp |
| LNU797_H59 | vinca\|11v1\|SRR098690X108966 | 1126 | 3200 | 542 | 95.8 | globlastp |
| LNU797_H60 | vinca\|11v1\|SRR098690X131739 | 1127 | 3201 | 542 | 95.8 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LGP52_H2 | prunus_mume\|13v1\|BU045923_P1 | 1128 | 3202 | 542 | 95.4 | globlastp |
| LNU797_H61 | ambrosia\|11v1\|SRR346935.111437_P1 | 1129 | 3203 | 542 | 95.4 | globlastp |
| LNU797_H62 | ambrosia\|11v1\|SRR346943.182031_P1 | 1130 | 3203 | 542 | 95.4 | globlastp |
| LNU797_H63 | arnica\|11v1\|SRR099034X103642_P1 | 1131 | 3204 | 542 | 95.4 | globlastp |
| LNU797_H64 | banana\|12v1\|BBS104T3_P1 | 1132 | 3205 | 542 | 95.4 | globlastp |
| LNU797_H65 | cacao\|10v1\|CU484574_P1 | 1133 | 3206 | 542 | 95.4 | globlastp |
| LNU797_H66 | catharanthus\|11v1\|SRR098691X100536_P1 | 1134 | 3207 | 542 | 95.4 | globlastp |
| LNU797_H67 | cotton\|11v1\|BE052796_P1 | 1135 | 3208 | 542 | 95.4 | globlastp |
| LNU797_H68 | cotton\|11v1\|BF272890_P1 | 1136 | 3209 | 542 | 95.4 | globlastp |
| LNU797_H69 | gossypium_raimondii\|12v1\|BE052796_P1 | 1137 | 3208 | 542 | 95.4 | globlastp |
| LNU797_H70 | gossypium_raimondii\|12v1\|BG440472_P1 | 1138 | 3209 | 542 | 95.4 | globlastp |
| LNU797_H71 | humulus\|11v1\|ES653444_P1 | 1139 | 3210 | 542 | 95.4 | globlastp |
| LNU797_H72 | medicago\|12v1\|BE205283_P1 | 1140 | 3211 | 542 | 95.4 | globlastp |
| LNU797_H73 | momordica\|10v1\|SRR071315S0000877_P1 | 1141 | 3212 | 542 | 95.4 | globlastp |
| LNU797_H74 | nasturtium\|11v1\|SRR032558.130953_P1 | 1142 | 3213 | 542 | 95.4 | globlastp |
| LNU797_H75 | poppy\|11v1\|SRR030261.67760_P1 | 1143 | 3214 | 542 | 95.4 | globlastp |
| LNU797_H76 | prunus\|10v1\|BU045923 | 1144 | 3202 | 542 | 95.4 | globlastp |
| LNU797_H77 | soybean\|11v1\|GLYMA10G01760 | 1145 | 3215 | 542 | 95.4 | globlastp |
| LNU797_H77 | soybean\|12v1\|GLYMA10G01760_P1 | 1146 | 3215 | 542 | 95.4 | globlastp |
| LNU797_H78 | soybean\|11v1\|GLYMA10G42650 | 1147 | 3213 | 542 | 95.4 | globlastp |
| LNU797_H78 | soybean\|12v1\|GLYMA10G42650_P1 | 1148 | 3213 | 542 | 95.4 | globlastp |
| LNU797_H79 | soybean\|11v1\|GLYMA20G24380 | 1149 | 3213 | 542 | 95.4 | globlastp |
| LNU797_H79 | soybean\|12v1\|GLYMA20G24380_P1 | 1150 | 3213 | 542 | 95.4 | globlastp |
| LNU797_H80 | trigonella\|11v1\|SRR066194X100358 | 1151 | 3211 | 542 | 95.4 | globlastp |
| LNU797_H81 | wheat\|12v3\|BE516233 | 1152 | 3216 | 542 | 95.4 | globlastp |
| LNU797_H82 | clover\|gb162\|BB904539_T1 | 1153 | 3217 | 542 | 95.36 | glotblastn |
| LNU797_H83 | tripterygium\|11v1\|SRR098677X108743 | 1154 | 3218 | 542 | 95.36 | glotblastn |
| LNU797_H84 | ambrosia\|11v1\|SRR346935.162287_T1 | 1155 | 3219 | 542 | 94.94 | glotblastn |
| LNU797_H85 | arabidopsis_lyrata\|09v1\|JGIAL004906_P1 | 1156 | 3220 | 542 | 94.9 | globlastp |
| LNU797_H86 | arabidopsis\|10v1\|AT1G53850_P1 | 1157 | 3220 | 542 | 94.9 | globlastp |
| LNU797_H87 | arabidopsis\|10v1\|AT3G14290_P1 | 1158 | 3221 | 542 | 94.9 | globlastp |
| LNU797_H88 | aristolochia\|10v1\|FD753041_P1 | 1159 | 3222 | 542 | 94.9 | globlastp |
| LNU797_H89 | centaurea\|gb166\|EH720898_P1 | 1160 | 3223 | 542 | 94.9 | globlastp |
| LNU797_H90 | chelidonium\|11v1\|SRR084752X101469_P1 | 1161 | 3224 | 542 | 94.9 | globlastp |
| LNU797_H91 | chickpea\|11v1\|GR406082 | 1162 | 3225 | 542 | 94.9 | globlastp |
| LNU797_H91 | chickpea\|13v2\|GR406082_P1 | 1163 | 3225 | 542 | 94.9 | globlastp |
| LNU797_H92 | cirsium\|11v1\|SRR346952.1003064_P1 | 1164 | 3223 | 542 | 94.9 | globlastp |
| LNU797_H93 | cirsium\|11v1\|SRR346952.101704_P1 | 1165 | 3223 | 542 | 94.9 | globlastp |
| LNU797_H94 | clementine\|11v1\|CF418418_P1 | 1166 | 3226 | 542 | 94.9 | globlastp |
| LNU797_H95 | cowpea\|12v1\|FF400036_P1 | 1167 | 3227 | 542 | 94.9 | globlastp |
| LNU797_H96 | cynara\|gb167\|GE586707_P1 | 1168 | 3223 | 542 | 94.9 | globlastp |
| LNU797_H97 | flaveria\|11v1\|SRR149229.124001_P1 | 1169 | 3228 | 542 | 94.9 | globlastp |
| LNU797_H98 | flaveria\|11v1\|SRR149229.164802_P1 | 1170 | 3228 | 542 | 94.9 | globlastp |
| LNU797_H99 | flaveria\|11v1\|SRR149229.187551_P1 | 1171 | 3228 | 542 | 94.9 | globlastp |
| LNU797_H100 | flaveria\|11v1\|SRR149232.124521_P1 | 1172 | 3228 | 542 | 94.9 | globlastp |
| LNU797_H101 | kiwi\|gb166\|FG416367_P1 | 1173 | 3229 | 542 | 94.9 | globlastp |
| LNU797_H102 | oil_palm\|11v1\|GH636084_P1 | 1174 | 3230 | 542 | 94.9 | globlastp |
| LNU797_H103 | orange\|11v1\|CB322089_P1 | 1175 | 3226 | 542 | 94.9 | globlastp |
| LNU797_H104 | pea\|11v1\|AM161973_P1 | 1176 | 3231 | 542 | 94.9 | globlastp |
| LNU797_H105 | pigeonpea\|11v1\|SRR054580X103301_P1 | 1177 | 3232 | 542 | 94.9 | globlastp |
| LNU797_H106 | poppy\|11v1\|FG610932_P1 | 1178 | 3233 | 542 | 94.9 | globlastp |
| LNU797_H107 | safflower\|gb162\|EL375904 | 1179 | 3223 | 542 | 94.9 | globlastp |
| LNU797_H108 | scabiosa\|11v1\|SRR063723X104505 | 1180 | 3234 | 542 | 94.9 | globlastp |
| LNU797_H109 | valeriana\|11v1\|SRR099039X102707 | 1181 | 3235 | 542 | 94.9 | globlastp |
| LNU797_H110 | watermelon\|11v1\|CK756307 | 1182 | 3236 | 542 | 94.9 | globlastp |
| LNU797_H111 | antirrhinum\|gb166\|AJ793100_T1 | 1183 | 3237 | 542 | 94.51 | glotblastn |
| LNU797_H112 | sarracenia\|11v1\|SRR192669.135220 | 1184 | 3238 | 542 | 94.51 | glotblastn |
| LGP52_H4 | bean\|12v2\|CA905741_P1 | 1185 | 3239 | 542 | 94.5 | globlastp |
| LNU797_H113 | arabidopsis_lyrata\|09v1\|JGIAL009899_P1 | 1186 | 3240 | 542 | 94.5 | globlastp |
| LNU797_H114 | bean\|12v1\|CA905741 | 1187 | 3239 | 542 | 94.5 | globlastp |
| LNU797_H115 | beech\|11v1\|SRR006293.26585_P1 | 1188 | 3241 | 542 | 94.5 | globlastp |
| LNU797_H116 | beech\|11v1\|SRR006293.26859_P1 | 1189 | 3241 | 542 | 94.5 | globlastp |
| LNU797_H117 | blueberry\|12v1\|CV090936_P1 | 1190 | 3242 | 542 | 94.5 | globlastp |
| LNU797_H118 | blueberry\|12v1\|SRR353282X53162D1_P1 | 1191 | 3243 | 542 | 94.5 | globlastp |
| LNU797_H119 | cleome_spinosa\|10v1\|GR932132_P1 | 1192 | 3244 | 542 | 94.5 | globlastp |
| LNU797_H120 | eschscholzia\|11v1\|SRR014116.104453_P1 | 1193 | 3245 | 542 | 94.5 | globlastp |
| LNU797_H121 | euphorbia\|11v1\|DV112478_P1 | 1194 | 3246 | 542 | 94.5 | globlastp |
| LNU797_H122 | oil_palm\|11v1\|EL688733_P1 | 1195 | 3247 | 542 | 94.5 | globlastp |
| LNU797_H123 | peanut\|10v1\|CX128176_P1 | 1196 | 3248 | 542 | 94.5 | globlastp |
| LNU797_H124 | salvia\|10v1\|SRR014553S0016175 | 1197 | 3249 | 542 | 94.5 | globlastp |
| LNU797_H125 | sesame\|12v1\|SESI12V1222326 | 1198 | 3250 | 542 | 94.5 | globlastp |
| LNU797_H126 | thellungiella_parvulum\|11v1\|BY811542 | 1199 | 3251 | 542 | 94.5 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
| --- | --- | --- | --- | --- | --- | --- |
| LNU797_H127 | apple\|11v1\|CN544917_P1 | 1200 | 3252 | 542 | 94.1 | globlastp |
| LNU797_H128 | b_juncea\|12v1\|E6ANDIZ01A5869_P1 | 1201 | 3253 | 542 | 94.1 | globlastp |
| LNU797_H129 | b_juncea\|12v1\|E6ANDIZ01AGQ24_P1 | 1202 | 3254 | 542 | 94.1 | globlastp |
| LNU797_H130 | b_juncea\|12v1\|E6ANDIZ01B06M7_P1 | 1203 | 3255 | 542 | 94.1 | globlastp |
| LNU797_H131 | b_juncea\|12v1\|E6ANDIZ01BBFFF_P1 | 1204 | 3256 | 542 | 94.1 | globlastp |
| LNU797_H132 | b_rapa\|11v1\|CD821133_P1 | 1205 | 3257 | 542 | 94.1 | globlastp |
| LNU797_H133 | b_rapa\|11v1\|CD824786_P1 | 1206 | 3255 | 542 | 94.1 | globlastp |
| LNU797_H134 | canola\|11v1\|CN734250_P1 | 1207 | 3257 | 542 | 94.1 | globlastp |
| LNU797_H135 | canola\|11v1\|CN736323_P1 | 1208 | 3255 | 542 | 94.1 | globlastp |
| LNU797_H136 | canola\|11v1\|EE457068_P1 | 1209 | 3255 | 542 | 94.1 | globlastp |
| LNU797_H137 | cleome_spinosa\|10v1\|GR931830_P1 | 1210 | 3258 | 542 | 94.1 | globlastp |
| LNU797_H138 | cucurbita\|11v1\|FG227107_P1 | 1211 | 3259 | 542 | 94.1 | globlastp |
| LNU797_H139 | eucalyptus\|11v2\|CD669666_P1 | 1212 | 3260 | 542 | 94.1 | globlastp |
| LNU797_H140 | euphorbia\|11v1\|SRR098678X123510_P1 | 1213 | 3261 | 542 | 94.1 | globlastp |
| LNU797_H141 | fagopyrum\|11v1\|SRR063703X104315_P1 | 1214 | 3262 | 542 | 94.1 | globlastp |
| LNU797_H142 | flaveria\|11v1\|SRR149229.113631_P1 | 1215 | 3263 | 542 | 94.1 | globlastp |
| LNU797_H143 | orobanche\|10v1\|SRR023189S0023437_P1 | 1216 | 3264 | 542 | 94.1 | globlastp |
| LNU797_H144 | phalaenopsis\|11v1\|CB033196_P1 | 1217 | 3265 | 542 | 94.1 | globlastp |
| LNU797_H145 | platanus\|11v1\|SRR096786X100928_P1 | 1218 | 3266 | 542 | 94.1 | globlastp |
| LNU797_H146 | poppy\|11v1\|FE964610_P1 | 1219 | 3267 | 542 | 94.1 | globlastp |
| LNU797_H147 | radish\|gb164\|EV528186 | 1220 | 3255 | 542 | 94.1 | globlastp |
| LNU797_H148 | spurge\|gb161\|DV112478 | 1221 | 3268 | 542 | 94.1 | globlastp |
| LNU797_H149 | tobacco\|gb162\|AB001552 | 1222 | 3269 | 542 | 94.1 | globlastp |
| LNU797_H150 | triphysaria\|10v1\|EX999501 | 1223 | 3270 | 542 | 94.1 | globlastp |
| LNU797_H151 | triphysaria\|10v1\|EY014414 | 1224 | 3271 | 542 | 94.1 | globlastp |
| LNU797_H216 | olea\|13v1\|SRR014463X18338D1_P1 | 1225 | 3272 | 542 | 94.1 | globlastp |
| LNU797_H152 | ginseng\|10v1\|CN845666_T1 | 1226 | 3273 | 542 | 94.09 | glotblastn |
| LNU797_H153 | sarracenia\|11v1\|SRR192669.105817 | 1227 | 3274 | 542 | 94.09 | glotblastn |
| LGP52_H5 | castorbean\|12v1\|EE260427_P1 | 1228 | 3275 | 542 | 93.7 | globlastp |
| LGP52_H7 | monkeyflower\|12v1\|DV206269_P1 | 1229 | 3276 | 542 | 93.7 | globlastp |
| LNU797_H154 | b_oleracea\|gb161\|DY026308_P1 | 1230 | 3277 | 542 | 93.7 | globlastp |
| LNU797_H155 | b_rapa\|11v1\|BG543962_P1 | 1231 | 3277 | 542 | 93.7 | globlastp |
| LNU797_H156 | canola\|11v1\|DY006413_P1 | 1232 | 3277 | 542 | 93.7 | globlastp |
| LNU797_H157 | canola\|11v1\|EE454294_P1 | 1233 | 3278 | 542 | 93.7 | globlastp |
| LNU797_H158 | canola\|11v1\|EE454622_P1 | 1234 | 3277 | 542 | 93.7 | globlastp |
| LNU797_H160 | cleome_gynandra\|10v1\|SRR015532S0002255_P1 | 1235 | 3279 | 542 | 93.7 | globlastp |
| LNU797_H161 | cucumber\|09v1\|CK756307_P1 | 1236 | 3280 | 542 | 93.7 | globlastp |
| LNU797_H162 | cucurbita\|11v1\|SRR091276X151710_P1 | 1237 | 3281 | 542 | 93.7 | globlastp |
| LNU797_H163 | hornbeam\|12v1\|SRR364455.122361_P1 | 1238 | 3282 | 542 | 93.7 | globlastp |
| LNU797_H164 | ipomoea_nil\|10v1\|BJ559450_P1 | 1239 | 3283 | 542 | 93.7 | globlastp |
| LNU797_H165 | melon\|10v1\|DV633226_P1 | 1240 | 3280 | 542 | 93.7 | globlastp |
| LNU797_H167 | phyla\|11v2\|SRR099035X105603_P1 | 1241 | 3284 | 542 | 93.7 | globlastp |
| LNU797_H168 | poppy\|11v1\|SRR030259.236762_P1 | 1242 | 3285 | 542 | 93.7 | globlastp |
| LNU797_H169 | radish\|gb164\|EV532244 | 1243 | 3277 | 542 | 93.7 | globlastp |
| LNU797_H170 | radish\|gb164\|EV544576 | 1244 | 3286 | 542 | 93.7 | globlastp |
| LNU797_H171 | radish\|gb164\|EW724310 | 1245 | 3287 | 542 | 93.7 | globlastp |
| LNU797_H172 | radish\|gb164\|EX895850 | 1246 | 3277 | 542 | 93.7 | globlastp |
| LNU797_H173 | solanum_phureja\|09v1\|SPHAJ487384 | 1247 | 3288 | 542 | 93.7 | globlastp |
| LNU797_H174 | tomato\|11v1\|AB001552 | 1248 | 3289 | 542 | 93.7 | globlastp |
| LNU797_H175 | tomato\|11v1\|AJ487384 | 1249 | 3288 | 542 | 93.7 | globlastp |
| LNU797_H188 | poplar\|13v1\|BU823181_P1 | 1250 | 3290 | 542 | 93.7 | globlastp |
| LNU797_H176 | cassava\|09v1\|JGICASSAVA42237VALIDM1_T1 | 1251 | 3291 | 542 | 93.67 | glotblastn |
| LNU797_H177 | fagopyrum\|11v1\|SRR063689X100469_T1 | 1252 | 3292 | 542 | 93.67 | glotblastn |
| LNU797_H178 | fraxinus\|11v1\|SRR058827.113356_T1 | 1253 | 3293 | 542 | 93.67 | glotblastn |
| LNU797_H179 | fraxinus\|11v1\|SRR058827.100546_T1 | 1254 | 3293 | 542 | 93.25 | glotblastn |
| LNU797_H180 | platanus\|11v1\|SRR096786X125700_T1 | 1255 | 3294 | 542 | 93.25 | glotblastn |
| LGP52_H6 | monkeyflower\|12v1\|DV206044_P1 | 1256 | 3295 | 542 | 93.2 | globlastp |
| LGP52_H8 | nicotiana_benthamiana\|12v1\|BP748670_P1 | 1257 | 3296 | 542 | 93.2 | globlastp |
| LGP52_H10 | nicotiana_benthamiana\|12v1\|CN747657_P1 | 1258 | 3297 | 542 | 93.2 | globlastp |
| LNU797_H181 | fraxinus\|11v1\|SRR058827.105716_P1 | 1259 | 3298 | 542 | 93.2 | globlastp |
| LNU797_H182 | ginger\|gb164\|DY345083_P1 | 1260 | 3299 | 542 | 93.2 | globlastp |
| LNU797_H183 | jatropha\|09v1\|FM889898_P1 | 1261 | 3300 | 542 | 93.2 | globlastp |
| LNU797_H184 | monkeyflower\|12v1\|DV206044 | 1262 | 3295 | 542 | 93.2 | globlastp |
| LNU797_H185 | orobanche\|10v1\|SRR023189S0003752_P1 | 1263 | 3301 | 542 | 93.2 | globlastp |
| LNU797_H186 | pepper\|12v1\|BM067274_P1 | 1264 | 3302 | 542 | 93.2 | globlastp |
| LNU797_H187 | phyla\|11v2\|SRR099035X28578_P1 | 1265 | 3303 | 542 | 93.2 | globlastp |
| LNU797_H188 | poplar\|10v1\|BU823181 | 1266 | 3304 | 542 | 93.2 | globlastp |
| LNU797_H189 | poplar\|10v1\|BU887035 | 1267 | 3305 | 542 | 93.2 | globlastp |
| LNU797_H189 | poplar\|13v1\|BU887035_P1 | 1268 | 3305 | 542 | 93.2 | globlastp |
| LNU797_H190 | rose\|12v1\|EC589334 | 1269 | 3306 | 542 | 93.2 | globlastp |
| LNU797_H191 | salvia\|10v1\|FE536702 | 1270 | 3307 | 542 | 93.2 | globlastp |
| LNU797_H192 | strawberry\|11v1\|DV439642 | 1271 | 3308 | 542 | 93.2 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU797_H193 | tobacco\|gb162\|CV018545 | 1272 | 3309 | 542 | 93.2 | globlastp |
| LNU797_H194 | thellungiella_halophilum\|11v1\|BY811542 | 1273 | 3310 | 542 | 92.83 | glotblastn |
| LNU797_H262 | nicotiana_benthamiana\|12v1\|EB425542_P1 | 1274 | 3311 | 542 | 92.8 | globlastp |
| LGP52_H9 | zostera\|12v1\|AM766202_P1 | 1275 | 3312 | 542 | 92.8 | globlastp |
| LNU797_H195 | eggplant\|10v1\|FS014765_P1 | 1276 | 3313 | 542 | 92.8 | globlastp |
| LNU797_H196 | nuphar\|gb166\|CK746396_P1 | 1277 | 3314 | 542 | 92.8 | globlastp |
| LNU797_H197 | parthenium\|10v1\|GW780462_P1 | 1278 | 3315 | 542 | 92.8 | globlastp |
| LNU797_H198 | phalaenopsis\|11v1\|CB032504_P1 | 1279 | 3316 | 542 | 92.8 | globlastp |
| LNU797_H199 | zostera\|10v1\|AM766202 | 1280 | 3312 | 542 | 92.8 | globlastp |
| LNU797_H200 | banana\|12v1\|DN239316_P1 | 1281 | 3317 | 542 | 92.6 | globlastp |
| LNU797_H201 | rye\|12v1\|DRR001012.220584 | 1282 | 3318 | 542 | 92.41 | glotblastn |
| LNU797_H263 | olea\|13v1\|SRR014464X10873D1_P1 | 1283 | 3319 | 542 | 92.4 | globlastp |
| LGP52_H11 | olea\|13v1\|SRR014463X25018D1_P1 | 1284 | 3320 | 542 | 92.4 | globlastp |
| LNU797_H202 | amorphophallus\|11v2\|SRR089351X147361_P1 | 1285 | 3321 | 542 | 92.4 | globlastp |
| LNU797_H203 | antirrhinum\|gb166\|AJ798448_P1 | 1286 | 3322 | 542 | 92.4 | globlastp |
| LNU797_H204 | silene\|11v1\|GH294688 | 1287 | 3323 | 542 | 92.4 | globlastp |
| LNU797_H205 | cycas\|gb166\|DR061950_P1 | 1288 | 3324 | 542 | 92 | globlastp |
| LNU797_H206 | tobacco\|gb162\|EB425542 | 1289 | 3325 | 542 | 92 | globlastp |
| LNU797_H207 | euphorbia\|11v1\|BP961521_T1 | 1290 | 3326 | 542 | 91.98 | glotblastn |
| LNU797_H208 | zamia\|gb166\|FD773811 | 1291 | 3327 | 542 | 91.6 | globlastp |
| LNU797_H209 | lovegrass\|gb167\|EH183763_T1 | 1292 | 3328 | 542 | 91.14 | glotblastn |
| LNU797_H210 | tripterygium\|11v1\|SRR098677X101097 | 1293 | 3329 | 542 | 91.1 | globlastp |
| LNU797_H211 | vinca\|11v1\|SRR098690X109756 | 1294 | 3330 | 542 | 91.1 | globlastp |
| LNU797_H212 | banana\|12v1\|MAGEN2012011862_P1 | 1295 | 3331 | 542 | 90.7 | globlastp |
| LNU797_H213 | clementine\|11v1\|EY827323_T1 | 1296 | 3332 | 542 | 90.3 | glotblastn |
| LNU797_H214 | orange\|11v1\|CF835946_T1 | 1297 | 3333 | 542 | 90.3 | glotblastn |
| LGP52_H12 | nicotiana_benthamiana\|12v1\|FG198486_P1 | 1298 | 3334 | 542 | 90.1 | globlastp |
| LNU797_H215 | aquilegia\|10v2\|DR919315_P1 | 1299 | 3335 | 542 | 90 | globlastp |
| LNU797_H216 | olea\|11v1\|SRR014463.18338 | 1300 | 3336 | 542 | 89.8 | globlastp |
| LNU797_H217 | petunia\|gb171\|FN002916_P1 | 1301 | 3337 | 542 | 89.8 | globlastp |
| LNU797_H218 | guizotia\|10v1\|GE558856_P1 | 1302 | 3338 | 542 | 89.5 | globlastp |
| LNU797_H219 | parthenium\|10v1\|GW785978_P1 | 1303 | 3339 | 542 | 89.5 | globlastp |
| LNU797_H220 | liriodendron\|gb166\|CK757590_T1 | 1304 | 3340 | 542 | 89.03 | glotblastn |
| LNU797_H221 | rye\|12v1\|DRR001012.749006 | 1305 | 3341 | 542 | 88.43 | glotblastn |
| LNU797_H222 | ceratodon\|10v1\|SRR074890S0022447_P1 | 1306 | 3342 | 542 | 88.2 | globlastp |
| LGP52_H13 | nicotiana_benthamiana\|12v1\|EH620293_T1 | 1307 | 3343 | 542 | 88.19 | glotblastn |
| LNU797_H223 | ambrosia\|11v1\|SRR346943.100828_T1 | 1308 | 3344 | 542 | 87.76 | glotblastn |
| LNU797_H224 | fraxinus\|11v1\|SRR058827.123528_T1 | 1309 | 3345 | 542 | 87.76 | glotblastn |
| LNU797_H225 | physcomitrella\|10v1\|AJ225438_P1 | 1310 | 3346 | 542 | 87.3 | globlastp |
| LNU797_H226 | physcomitrella\|10v1\|AW699661_P1 | 1311 | 3347 | 542 | 87.3 | globlastp |
| LNU797_H227 | spikemoss\|gb165\|FE508399 | 1312 | 3348 | 542 | 87.3 | globlastp |
| LNU797_H228 | cephalotaxus\|11v1\|SRR064395X105137_P1 | 1313 | 3349 | 542 | 86.9 | globlastp |
| LNU797_H229 | cryptomeria\|gb166\|BP174342_P1 | 1314 | 3350 | 542 | 86.9 | globlastp |
| LNU797_H230 | maritime_pine\|10v1\|BX249273_P1 | 1315 | 3351 | 542 | 86.9 | globlastp |
| LNU797_H231 | pine\|10v2\|AW587810_P1 | 1316 | 3351 | 542 | 86.9 | globlastp |
| LNU797_H232 | podocarpus\|10v1\|SRR065014S0007113_P1 | 1317 | 3352 | 542 | 86.9 | globlastp |
| LNU797_H233 | potato\|10v1\|AJ487384_P1 | 1318 | 3353 | 542 | 86.9 | globlastp |
| LNU797_H234 | sequoia\|10v1\|SRR065044S0017123 | 1319 | 3354 | 542 | 86.9 | globlastp |
| LNU797_H235 | spruce\|11v1\|ES249872 | 1320 | 3355 | 542 | 86.9 | globlastp |
| LNU797_H236 | taxus\|10v1\|SRR032523S0013310 | 1321 | 3349 | 542 | 86.9 | globlastp |
| LNU797_H237 | flaveria\|11v1\|SRR149232.152816_P1 | 1322 | 3356 | 542 | 86.5 | globlastp |
| LNU797_H238 | pseudotsuga\|10v1\|SRR065119S0007920 | 1323 | 3357 | 542 | 86.5 | globlastp |
| LNU797_H239 | pteridium\|11v1\|SRR043594X10900 | 1324 | 3358 | 542 | 86.5 | glotblastn |
| LNU797_H240 | marchantia\|gb166\|BJ844657_P1 | 1325 | 3359 | 542 | 86.1 | globlastp |
| LNU797_H241 | sciadopitys\|10v1\|SRR065035S0004334 | 1326 | 3360 | 542 | 86.1 | globlastp |
| LNU797_H242 | abies\|11v2\|SRR098676X104726_P1 | 1327 | 3361 | 542 | 85.7 | globlastp |
| LNU797_H243 | cedrus\|11v1\|SRR065007X120238_P1 | 1328 | 3362 | 542 | 85.7 | globlastp |
| LNU797_H244 | radish\|gb164\|EV532879 | 1329 | 3363 | 542 | 85.2 | globlastp |
| LNU797_H245 | tea\|10v1\|GT087989 | 1330 | 3364 | 542 | 85.2 | globlastp |
| LNU797_H246 | nicotiana_benthamiana\|gb162\|CN747657 | 1331 | 3365 | 542 | 84.4 | globlastp |
| LNU797_H247 | gnetum\|10v1\|EX949788_P1 | 1332 | 3366 | 542 | 84 | globlastp |
| LNU797_H248 | sugarcane\|10v1\|BQ536868 | 1333 | 3367 | 542 | 83.9 | globlastp |
| LNU797_H249 | liquorice\|gb171\|FS266885_P1 | 1334 | 3368 | 542 | 83.1 | globlastp |
| LNU797_H250 | poppy\|11v1\|SRR096789.122184_P1 | 1335 | 3369 | 542 | 82.7 | globlastp |
| LNU797_H251 | radish\|gb164\|EV529042 | 1336 | 3370 | 542 | 82.7 | globlastp |
| LNU797_H252 | radish\|gb164\|EV539130 | 1337 | 3370 | 542 | 82.7 | globlastp |
| LNU797_H253 | radish\|gb164\|EV542996 | 1338 | 3371 | 542 | 82.7 | globlastp |
| LNU797_H254 | cyamopsis\|10v1\|EG989234_P1 | 1339 | 3372 | 542 | 82.3 | globlastp |
| LNU797_H255 | poppy\|11v1\|SRR030267.187266_P1 | 1340 | 3373 | 542 | 82.3 | globlastp |
| LNU797_H256 | flax\|11v1\|JG084720_T1 | 1341 | 3374 | 542 | 82.28 | glotblastn |
| LNU797_H257 | gerbera\|09v1\|AJ754027_P1 | 1342 | 3375 | 542 | 81.9 | globlastp |
| LNU797_H258 | distylium\|11v1\|SRR065077X153511_P1 | 1343 | 3376 | 542 | 81.4 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU797_H259 | lovegrass\|gb167\|EH185755_P1 | 1344 | 3377 | 542 | 81.4 | globlastp |
| LNU797_H260 | blueberry\|12v1\|SRR353285X11741D1_T1 | 1345 | 3378 | 542 | 81.01 | glotblastn |
| LNU797_H261 | poppy\|11v1\|SRR096789.253826_T1 | 1346 | 3379 | 542 | 81.01 | glotblastn |
| LNU798_H1 | barley\|12v1\|BE422159_P1 | 1347 | 3380 | 543 | 97 | globlastp |
| LNU798_H2 | sorghum\|12v1\|SB02G019500 | 1348 | 3381 | 543 | 93.8 | globlastp |
| LNU798_H3 | foxtail_millet\|11v3\|PHY7SI029445M_P1 | 1349 | 3382 | 543 | 93.7 | globlastp |
| LNU798_H4 | maize\|10v1\|AI629903_P1 | 1350 | 3383 | 543 | 93.5 | globlastp |
| LNU798_H5 | wheat\|12v3\|AL819672 | 1351 | 3384 | 543 | 91.4 | globlastp |
| LNU798_H6 | rice\|11v1\|AU174198 | 1352 | 3385 | 543 | 91.2 | globlastp |
| LNU798_H10 | switchgrass\|12v1\|FE609190_P1 | 1353 | 3386 | 543 | 91 | globlastp |
| LNU798_H7 | wheat\|12v3\|BQ245545 | 1354 | 3387 | 543 | 91 | globlastp |
| LNU798_H8 | millet\|10v1\|EVO454PM023052_P1 | 1355 | 3388 | 543 | 87.3 | globlastp |
| LNU798_H9 | wheat\|12v3\|BG606377 | 1356 | 3389 | 543 | 85.4 | globlastp |
| LNU799_H1 | oat\|11v1\|GR338611_P1 | 1357 | 3390 | 544 | 95.5 | globlastp |
| LNU799_H2 | leymus\|gb166\|EG397348_P1 | 1358 | 3391 | 544 | 93.9 | globlastp |
| LNU799_H3 | rye\|12v1\|DRR001012.356736 | 1359 | 3391 | 544 | 93.9 | globlastp |
| LNU799_H4 | rye\|12v1\|DRR001012.648999 | 1360 | 3391 | 544 | 93.9 | globlastp |
| LNU799_H5 | rye\|12v1\|DRR001012.761725 | 1361 | 3391 | 544 | 93.9 | globlastp |
| LNU799_H6 | wheat\|12v3\|BE403020 | 1362 | 3391 | 544 | 93.9 | globlastp |
| LNU799_H7 | barley\|12v1\|BI953338_P1 | 1363 | 3392 | 544 | 93.5 | globlastp |
| LNU799_H8 | rice\|11v1\|AU085931 | 1364 | 3393 | 544 | 91.1 | globlastp |
| LNU799_H9 | foxtail_millet\|11v3\|PHY7SI030913M_P1 | 1365 | 3394 | 544 | 84.4 | globlastp |
| LNU799_H10 | millet\|10v1\|PMSLX0021480_P1 | 1366 | 3395 | 544 | 84.1 | globlastp |
| LNU799_H11 | maize\|10v1\|FL234904_P1 | 1367 | 3396 | 544 | 84 | globlastp |
| LNU799_H12 | maize\|10v1\|AW076436_P1 | 1368 | 3397 | 544 | 83.3 | globlastp |
| LNU799_H13 | sorghum\|12v1\|SB02G024130 | 1369 | 3398 | 544 | 82.9 | globlastp |
| LNU799_H15 | switchgrass\|12v1\|FE619626_P1 | 1370 | 3399 | 544 | 82.5 | globlastp |
| LNU799_H14 | switchgrass\|gb167\|FE619626 | 1371 | 3400 | 544 | 81.7 | globlastp |
| LNU801_H9 | switchgrass\|12v1\|FL970980_P1 | 1372 | 3401 | 546 | 93.1 | globlastp |
| LNU801_H1 | millet\|10v1\|EVO454PM000992_P1 | 1373 | 3402 | 546 | 92.5 | globlastp |
| LNU801_H2 | sorghum\|12v1\|SB03G046360 | 1374 | 3403 | 546 | 90 | globlastp |
| LNU801_H3 | rice\|11v1\|BM420996 | 1375 | 3404 | 546 | 88.79 | glotblastn |
| LNU801_H4 | maize\|10v1\|AI734386_P1 | 1376 | 3405 | 546 | 87.9 | globlastp |
| LNU801_H5 | maize\|10v1\|BE552901_P1 | 1377 | 3406 | 546 | 87.2 | globlastp |
| LNU801_H6 | barley\|12v1\|BE412491_P1 | 1378 | 3407 | 546 | 82.9 | globlastp |
| LNU801_H7 | brachypodium\|12v1\|BRADI2G61240_P1 | 1379 | 3408 | 546 | 82 | globlastp |
| LNU801_H8 | rye\|12v1\|DRR001012.134722 | 1380 | 3409 | 546 | 81.6 | globlastp |
| LNU802_H1 | rice\|11v1\|C26804 | 1381 | 3410 | 547 | 91.3 | globlastp |
| LNU802_H2 | foxtail_millet\|11v3\|PHY7SI021421M_P1 | 1382 | 3411 | 547 | 89.1 | globlastp |
| LNU802_H3 | rice\|11v1\|BF475211 | 1383 | 3412 | 547 | 88.9 | globlastp |
| LNU802_H20 | switchgrass\|12v1\|FL702067_P1 | 1384 | 3413 | 547 | 88.5 | globlastp |
| LNU802_H4 | millet\|10v1\|EVO454PM003455_P1 | 1385 | 3414 | 547 | 88 | globlastp |
| LNU802_H5 | sorghum\|12v1\|SB09G029750 | 1386 | 3415 | 547 | 87.8 | globlastp |
| LNU802_H6 | brachypodium\|12v1\|BRADI2G15300T2_P1 | 1387 | 3416 | 547 | 87.2 | globlastp |
| LNU802_H7 | wheat\|12v3\|BJ257279 | 1388 | 3417 | 547 | 86.9 | globlastp |
| LNU802_H8 | wheat\|12v3\|SRR073321X559678D1 | 1389 | 3417 | 547 | 86.9 | globlastp |
| LNU802_H9 | barley\|12v1\|AV833654_P1 | 1390 | 3418 | 547 | 86.7 | globlastp |
| LNU802_H10 | rye\|12v1\|DRR001012.106866 | 1391 | 3419 | 547 | 86.5 | globlastp |
| LNU802_H11 | wheat\|12v3\|CA497108 | 1392 | 3420 | 547 | 86.5 | globlastp |
| LNU802_H12 | rye\|12v1\|DRR001012.119952 | 1393 | 3421 | 547 | 86.3 | globlastp |
| LNU802_H13 | rye\|12v1\|DRR001012.141039 | 1394 | 3422 | 547 | 86.3 | globlastp |
| LNU802_H14 | wheat\|12v3\|SRR043326X44117D1 | 1395 | 3423 | 547 | 85.7 | globlastp |
| LNU802_H15 | rye\|12v1\|DRR001012.724073 | 1396 | 3424 | 547 | 84.84 | glotblastn |
| LNU802_H16 | rye\|12v1\|DRR001012.794078 | 1397 | 3425 | 547 | 84.63 | glotblastn |
| LNU802_H17 | rye\|12v1\|DRR001012.762098 | 1398 | 3426 | 547 | 84.6 | globlastp |
| LNU802_H18 | oat\|11v1\|CN816181_P1 | 1399 | 3427 | 547 | 83.7 | globlastp |
| LNU802_H19 | wheat\|12v3\|SRR043323X82204D1 | 1400 | 3428 | 547 | 81.48 | glotblastn |
| LNU803_H7 | switchgrass\|12v1\|FL957205_P1 | 1401 | 3429 | 548 | 91.1 | globlastp |
| LNU803_H1 | millet\|10v1\|EVO454PM050490_P1 | 1402 | 3430 | 548 | 89.9 | globlastp |
| LNU803_H8 | switchgrass\|12v1\|JG811131_P1 | 1403 | 3431 | 548 | 88.6 | globlastp |
| LNU803_H2 | brachypodium\|12v1\|BRADI2G60317_P1 | 1404 | 3432 | 548 | 88.6 | globlastp |
| LNU803_H3 | switchgrass\|gb167\|FL957205 | 1405 | 3433 | 548 | 86.1 | globlastp |
| LNU803_H9 | switchgrass\|12v1\|SRR364496.92662_T1 | 1406 | 3434 | 548 | 83.54 | glotblastn |
| LNU803_H4 | wheat\|12v3\|SRR043323X35031D1 | 1407 | 3435 | 548 | 81.2 | globlastp |
| LNU803_H5 | maize\|10v1\|AI629617_P1 | 1408 | 3436 | 548 | 81 | globlastp |
| LNU803_H6 | maize\|10v1\|AW288544_P1 | 1409 | 3436 | 548 | 81 | globlastp |
| LNU805_H2 | switchgrass\|12v1\|DN145962_T1 | 1410 | 3437 | 550 | 80.05 | glotblastn |
| LNU805_H1 | switchgrass\|gb167\|DN145962 | 1411 | 3438 | 550 | 80 | glotblastn |
| LNU807_H1 | sorghum\|12v1\|SB09G006610 | 1412 | 3439 | 552 | 96.1 | globlastp |
| LNU807_H12 | switchgrass\|12v1\|FL935393_P1 | 1413 | 3440 | 552 | 94.6 | globlastp |
| LNU807_H2 | maize\|10v1\|CD950739_P1 | 1414 | 3441 | 552 | 93.8 | globlastp |
| LNU807_H3 | millet\|10v1\|EVO454PM000715_P1 | 1415 | 3442 | 552 | 88 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU807_H4 | wheat\|12v3\|BG605330 | 1416 | 3443 | 552 | 85.2 | globlastp |
| LNU807_H5 | wheat\|12v3\|CA627721 | 1417 | 3444 | 552 | 85 | globlastp |
| LNU807_H6 | wheat\|12v3\|SRR043323X42120D1 | 1418 | 3444 | 552 | 85 | globlastp |
| LNU807_H7 | rye\|12v1\|DRR001012.103250 | 1419 | 3445 | 552 | 84.9 | globlastp |
| LNU807_H8 | wheat\|12v3\|CD917464 | 1420 | 3446 | 552 | 84.7 | globlastp |
| LNU807_H9 | brachypodium\|12v1\|BRADI4G26810_P1 | 1421 | 3447 | 552 | 84.3 | globlastp |
| LNU807_H10 | rice\|11v1\|AA753940 | 1422 | 3448 | 552 | 84.3 | globlastp |
| LNU807_H11 | rice\|11v1\|BI807965 | 1423 | 3449 | 552 | 84.3 | globlastp |
| LNU808_H1 | millet\|10v1\|EVO454PM012822_P1 | 1424 | 3450 | 553 | 95 | globlastp |
| LNU808_H5 | switchgrass\|12v1\|DN145950_P1 | 1425 | 3451 | 553 | 94.5 | globlastp |
| LNU808_H2 | switchgrass\|gb167\|DN145950 | 1426 | 3451 | 553 | 94.5 | globlastp |
| LNU808_H6 | switchgrass\|12v1\|FL698385_P1 | 1427 | 3452 | 553 | 93.1 | globlastp |
| LNU808_H3 | sorghum\|12v1\|SB06G033120 | 1428 | 3453 | 553 | 90 | globlastp |
| LNU808_H4 | maize\|10v1\|CF636626_P1 | 1429 | 3454 | 553 | 89 | globlastp |
| LNU809_H1 | switchgrass\|gb167\|DN142820 | 1430 | 3455 | 554 | 93.9 | globlastp |
| LNU809_H2 | maize\|10v1\|BE344743_P1 | 1431 | 3456 | 554 | 87.9 | globlastp |
| LNU809_H3 | sorghum\|12v1\|SB01G001260 | 1432 | 3457 | 554 | 87.3 | globlastp |
| LNU809_H4 | sugarcane\|10v1\|CA110374 | 1433 | 3458 | 554 | 84.7 | globlastp |
| LNU809_H5 | rice\|11v1\|BI306268 | 1434 | 3459 | 554 | 82.4 | globlastp |
| LNU810_H1 | foxtail_millet\|11v3\|SICRP020917_P1 | 1435 | 3460 | 555 | 95.8 | globlastp |
| LNU810_H2 | foxtail_millet\|11v3\|PHY7SI012527M_T1 | 1436 | 3461 | 555 | 94.17 | glotblastn |
| LNU810_H3 | foxtail_millet\|11v3\|SICRP100316_P1 | 1437 | 3462 | 555 | 89.2 | globlastp |
| LNU810_H4 | millet\|10v1\|EVO454PM110704_T1 | 1438 | 3463 | 555 | 86.67 | glotblastn |
| LNU811_H1 | sugarcane\|10v1\|BU103402 | 1439 | 3464 | 556 | 81.9 | globlastp |
| LNU811_H2 | sorghum\|12v1\|SB09G001370 | 1440 | 3465 | 556 | 80.5 | globlastp |
| LNU813_H1 | sorghum\|12v1\|SB01G011930 | 1441 | 3466 | 557 | 89 | globlastp |
| LNU815_H1 | sorghum\|12v1\|SB03G031180 | 1442 | 3467 | 559 | 94 | globlastp |
| LNU815_H2 | sugarcane\|10v1\|CA123143 | 1443 | 3468 | 559 | 93.4 | globlastp |
| LNU815_H11 | switchgrass\|12v1\|SRR187765.104957_P1 | 1444 | 3469 | 559 | 91 | globlastp |
| LNU815_H12 | switchgrass\|12v1\|FL826760_P1 | 1445 | 3470 | 559 | 89.3 | globlastp |
| LNU815_H3 | foxtail_millet\|11v3\|PHY7SI003141M_P1 | 1446 | 3471 | 559 | 89.2 | globlastp |
| LNU815_H4 | switchgrass\|gb167\|FL826760 | 1447 | 3472 | 559 | 88.7 | globlastp |
| LNU815_H5 | rice\|11v1\|AU174360 | 1448 | 3473 | 559 | 88.6 | globlastp |
| LNU815_H6 | millet\|10v1\|PMSLX0006943_P1 | 1449 | 3474 | 559 | 85.6 | globlastp |
| LNU815_H7 | rye\|12v1\|DRR001012.175289 | 1450 | 3475 | 559 | 85 | globlastp |
| LNU815_H8 | rye\|12v1\|DRR001012.458810 | 1451 | 3475 | 559 | 85 | globlastp |
| LNU815_H9 | brachypodium\|12v1\|BRADI2G46560_T1 | 1452 | 3476 | 559 | 83.23 | glotblastn |
| LNU815_H10 | wheat\|12v3\|BE442626 | 1453 | 3477 | 559 | 82.6 | globlastp |
| LNU816_H5 | brachypodium\|12v1\|BRADI3G53550_P1 | 1454 | 3478 | 560 | 91.5 | globlastp |
| LNU816_H6 | rice\|11v1\|CA759966 | 1455 | 3479 | 560 | 91.1 | globlastp |
| LNU816_H10 | rye\|12v1\|DRR001014.10485 | 1456 | 3480 | 560 | 82.1 | globlastp |
| LNU817_H1 | sorghum\|12v1\|SB06G032840 | 1457 | 3481 | 561 | 91.6 | globlastp |
| LNU817_H2 | maize\|10v1\|AI714648_P1 | 1458 | 3482 | 561 | 88.9 | globlastp |
| LNU817_H3 | foxtail_millet\|11v3\|PHY7SI018613M_P1 | 1459 | 3483 | 561 | 85.5 | globlastp |
| LNU817_H7 | switchgrass\|12v1\|FL735544_P1 | 1460 | 3484 | 561 | 84.7 | globlastp |
| LNU817_H4 | cenchrus\|gb166\|EB660297_P1 | 1461 | 3485 | 561 | 84.1 | globlastp |
| LNU817_H5 | switchgrass\|gb167\|FL735544 | 1462 | 3486 | 561 | 82.9 | globlastp |
| LNU817_H6 | millet\|10v1\|EVO454PM108926_P1 | 1463 | 3487 | 561 | 80.1 | globlastp |
| LNU819_H5 | switchgrass\|12v1\|SRR187765.390310_P1 | 1464 | 3488 | 563 | 86.8 | globlastp |
| LNU819_H1 | maize\|10v1\|EU946864_P1 | 1465 | 3489 | 563 | 86.3 | globlastp |
| LNU819_H6 | switchgrass\|12v1\|FL841069_P1 | 1466 | 3490 | 563 | 85.7 | globlastp |
| LNU819_H2 | switchgrass\|gb167\|FL841069 | 1467 | 3491 | 563 | 84.6 | globlastp |
| LNU819_H3 | sorghum\|12v1\|CF759244 | 1468 | 3492 | 563 | 82.42 | glotblastn |
| LNU819_H4 | foxtail_millet\|11v3\|PHY7SI031669M_P1 | 1469 | 3493 | 563 | 80.2 | globlastp |
| LNU820_H1 | sorghum\|12v1\|SB07G028630 | 1470 | 3494 | 564 | 91.3 | globlastp |
| LNU820_H2 | millet\|10v1\|EVO454PM458338_P1 | 1471 | 3495 | 564 | 87 | globlastp |
| LNU820_H7 | switchgrass\|12v1\|FE655496_P1 | 1472 | 3496 | 564 | 86.4 | globlastp |
| LNU820_H8 | switchgrass\|12v1\|FE619575_P1 | 1473 | 3497 | 564 | 86.1 | globlastp |
| LNU820_H3 | foxtail_millet\|11v3\|PHY7SI014065M_P1 | 1474 | 3498 | 564 | 86.1 | globlastp |
| LNU820_H4 | switchgrass\|gb167\|FE619575 | 1475 | 3499 | 564 | 86.1 | globlastp |
| LNU820_H5 | switchgrass\|gb167\|FE655496 | 1476 | 3500 | 564 | 81.6 | globlastp |
| LNU820_H6 | brachypodium\|12v1\|BRADI3G39210_P1 | 1477 | 3501 | 564 | 80.7 | globlastp |
| LNU822_H1 | foxtail_millet\|11v3\|PHY7SI011544M_P1 | 1478 | 3502 | 566 | 94.3 | globlastp |
| LNU822_H2 | sorghum\|12v1\|SB06G001560 | 1479 | 3503 | 566 | 94.3 | globlastp |
| LNU822_H3 | sugarcane\|10v1\|CA087712 | 1480 | 3503 | 566 | 94.3 | globlastp |
| LNU822_H4 | wheat\|12v3\|CA484262 | 1481 | 3503 | 566 | 94.3 | globlastp |
| LNU822_H17 | switchgrass\|12v1\|FL830389_P1 | 1482 | 3504 | 566 | 92.9 | globlastp |
| LNU822_H5 | switchgrass\|gb167\|FL830388 | 1483 | 3504 | 566 | 92.9 | globlastp |
| LNU822_H6 | cynodon\|10v1\|ES301162_P1 | 1484 | 3505 | 566 | 91.4 | globlastp |
| LNU822_H7 | millet\|10v1\|EVO454PM225827_P1 | 1485 | 3506 | 566 | 91.4 | globlastp |
| LNU822_H18 | switchgrass\|12v1\|FL830388_P1 | 1486 | 3507 | 566 | 90 | globlastp |
| LNU822_H8 | brachypodium\|12v1\|BRADI5G00560_P1 | 1487 | 3508 | 566 | 90 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU822_H9 | barley\|12v1\|BI949537_P1 | 1488 | 3509 | 566 | 88.6 | globlastp |
| LNU822_H10 | rice\|11v1\|AA750203 | 1489 | 3510 | 566 | 88.6 | globlastp |
| LNU822_H11 | cynodon\|10v1\|ES294723_T1 | 1490 | 3511 | 566 | 87.14 | glotblastn |
| LNU822_H12 | oat\|11v1\|GO594699_P1 | 1491 | 3512 | 566 | 85.7 | globlastp |
| LNU822_H13 | wheat\|12v3\|BE490468 | 1492 | 3513 | 566 | 85.7 | globlastp |
| LNU822_H14 | wheat\|12v3\|BI751481 | 1493 | 3513 | 566 | 85.7 | globlastp |
| LNU822_H15 | oil_palm\|11v1\|SRR190699.168391_P1 | 1494 | 3514 | 566 | 81.4 | globlastp |
| LNU822_H16 | zostera\|10v1\|SRR057351S0024697 | 1495 | 3515 | 566 | 80 | globlastp |
| LNU823_H1 | sorghum\|12v1\|SB10G008020 | 1496 | 3516 | 567 | 96.4 | globlastp |
| LNU823_H2 | maize\|10v1\|AI861542_P1 | 1497 | 3517 | 567 | 92.7 | globlastp |
| LNU823_H20 | switchgrass\|12v1\|FE618890_P1 | 1498 | 3518 | 567 | 90.6 | globlastp |
| LNU823_H21 | switchgrass\|12v1\|FE626264_P1 | 1499 | 3518 | 567 | 90.6 | globlastp |
| LNU823_H3 | switchgrass\|gb167\|FE618890 | 1500 | 3518 | 567 | 90.6 | globlastp |
| LNU823_H4 | cynodon\|10v1\|ES300242_P1 | 1501 | 3519 | 567 | 89.6 | globlastp |
| LNU823_H5 | foxtail_millet\|11v3\|PHY7SI007340M_P1 | 1502 | 3520 | 567 | 89.1 | globlastp |
| LNU823_H6 | lovegrass\|gb167\|EH186334_P1 | 1503 | 3521 | 567 | 87 | globlastp |
| LNU823_H7 | millet\|10v1\|EVO454PM084286_P1 | 1504 | 3522 | 567 | 86.5 | globlastp |
| LNU823_H8 | rice\|11v1\|BE230397 | 1505 | 3523 | 567 | 86 | globlastp |
| LNU823_H9 | sugarcane\|10v1\|CA098201 | 1506 | 3524 | 567 | 84.9 | globlastp |
| LNU823_H10 | leymus\|gb166\|CD808583_P1 | 1507 | 3525 | 567 | 83.5 | globlastp |
| LNU823_H11 | wheat\|12v3\|BE416640 | 1508 | 3526 | 567 | 83.5 | globlastp |
| LNU823_H12 | pseudoroegneria\|gb167\|FF347817 | 1509 | 3527 | 567 | 83 | globlastp |
| LNU823_H13 | cenchrus\|gb166\|EB656741_P1 | 1510 | 3528 | 567 | 82.8 | globlastp |
| LNU823_H14 | barley\|12v1\|BE603265_P1 | 1511 | 3529 | 567 | 82.5 | globlastp |
| LNU823_H15 | oat\|11v1\|GO588574_P1 | 1512 | 3530 | 567 | 81.9 | globlastp |
| LNU823_H16 | brachypodium\|12v1\|BRADI1G45240_P1 | 1513 | 3531 | 567 | 81.8 | globlastp |
| LNU823_H17 | rye\|12v1\|BE495527 | 1514 | 3532 | 567 | 81.6 | globlastp |
| LNU823_H18 | rye\|12v1\|BE587517 | 1515 | 3532 | 567 | 81.6 | globlastp |
| LNU823_H19 | lolium\|10v1\|ES700436_P1 | 1516 | 3533 | 567 | 80.3 | globlastp |
| LNU824_H1 | maize\|10v1\|BE575106_P1 | 1517 | 3534 | 568 | 97.8 | globlastp |
| LNU824_H5 | millet\|10v1\|EVO454PM005683_P1 | 1518 | 3535 | 568 | 95.2 | globlastp |
| LNU824_H21 | maize\|10v1\|BE056872_P1 | 1519 | 3536 | 568 | 89.4 | globlastp |
| LNU824_H27 | wheat\|12v3\|BE400910 | 1520 | 3537 | 568 | 88 | globlastp |
| LNU824_H28 | wheat\|12v3\|SRR073322X587000D1 | 1521 | 3538 | 568 | 88 | globlastp |
| LNU824_H29 | rye\|12v1\|DRR001012.606957 | 1522 | 3539 | 568 | 87.96 | glotblastn |
| LNU824_H30 | wheat\|12v3\|BQ483480 | 1523 | 3540 | 568 | 87.7 | globlastp |
| LNU824_H37 | poplar\|10v1\|BI139016 | 1524 | 3541 | 568 | 81.3 | globlastp |
| LNU824_H37 | poplar\|13v1\|BI139016_P1 | 1525 | 3541 | 568 | 81.3 | globlastp |
| LNU824_H42 | tripterygium\|11v1\|SRR098677X102165 | 1526 | 3542 | 568 | 80.78 | glotblastn |
| LNU824_H47 | banana\|12v1\|MAGEN2012015228_P1 | 1527 | 3543 | 568 | 80.5 | globlastp |
| LNU824_H49 | platanus\|11v1\|SRR096786X106999_T1 | 1528 | 3544 | 568 | 80.45 | glotblastn |
| LNU828_H1 | sorghum\|12v1\|SB01G037440 | 1529 | 3545 | 570 | 93.9 | globlastp |
| LNU828_H2 | sugarcane\|10v1\|CA069736 | 1530 | 3546 | 570 | 93.3 | globlastp |
| LNU828_H3 | maize\|10v1\|BI991815_P1 | 1531 | 3547 | 570 | 88.2 | globlastp |
| LNU828_H4 | foxtail_millet\|11v3\|EC613572_P1 | 1532 | 3548 | 570 | 87.5 | globlastp |
| LNU828_H10 | switchgrass\|12v1\|FE628831_P1 | 1533 | 3549 | 570 | 86.9 | globlastp |
| LNU828_H5 | switchgrass\|gb167\|FE628831 | 1534 | 3549 | 570 | 86.9 | globlastp |
| LNU828_H11 | switchgrass\|12v1\|FE635562_P1 | 1535 | 3550 | 570 | 86.6 | globlastp |
| LNU828_H6 | switchgrass\|gb167\|FE635562 | 1536 | 3550 | 570 | 86.6 | globlastp |
| LNU828_H7 | millet\|10v1\|EVO454PM010680_P1 | 1537 | 3551 | 570 | 84.3 | globlastp |
| LNU828_H8 | rice\|11v1\|BF430629 | 1538 | 3552 | 570 | 80.9 | globlastp |
| LNU828_H9 | cenchrus\|gb166\|BM084141_P1 | 1539 | 3553 | 570 | 80.8 | globlastp |
| LNU829_H1 | sorghum\|12v1\|SB10G002790 | 1540 | 3554 | 571 | 94.5 | globlastp |
| LNU829_H4 | foxtail_millet\|11v3\|PHY7SI007445M_P1 | 1541 | 3555 | 571 | 93.8 | globlastp |
| LNU700_H2 | switchgrass\|12v1\|FE646787_T1 | 1542 | 3556 | 571 | 92.47 | glotblastn |
| LNU829_H5 | switchgrass\|gb167\|FL894055 | 1543 | — | 571 | 91.1 | glotblastn |
| LNU830_H1 | sorghum\|12v1\|SB05G022780 | 1544 | 3557 | 572 | 96.9 | globlastp |
| LNU830_H2 | foxtail_millet\|11v3\|PHY7SI025963M_P1 | 1545 | 3558 | 572 | 96.2 | globlastp |
| LNU830_H3 | maize\|10v1\|CD942361_P1 | 1546 | 3559 | 572 | 95.8 | globlastp |
| LNU830_H13 | switchgrass\|12v1\|FL692292_T1 | 1547 | 3560 | 572 | 94.72 | glotblastn |
| LNU830_H14 | switchgrass\|12v1\|FL694591_P1 | 1548 | 3561 | 572 | 94.5 | globlastp |
| LNU830_H4 | rice\|11v1\|BE039844 | 1549 | 3562 | 572 | 91.9 | globlastp |
| LNU830_H5 | brachypodium\|12v1\|BRADI4G15130_P1 | 1550 | 3563 | 572 | 90.5 | globlastp |
| LNU830_H6 | rye\|12v1\|DRR001012.122402 | 1551 | 3564 | 572 | 89.7 | globlastp |
| LNU830_H7 | wheat\|12v3\|BJ292957 | 1552 | 3565 | 572 | 89.6 | globlastp |
| LNU830_H8 | millet\|10v1\|EVO454PM046481_P1 | 1553 | 3566 | 572 | 88.7 | globlastp |
| LNU830_H9 | wheat\|12v3\|SRR400820X1166902D1 | 1554 | 3567 | 572 | 88.31 | glotblastn |
| LNU830_H10 | wheat\|12v3\|CA640921 | 1555 | 3568 | 572 | 86.1 | globlastp |
| LNU830_H11 | rye\|12v1\|DRR001013.178186 | 1556 | 3569 | 572 | 85.62 | glotblastn |
| LNU830_H12 | wheat\|12v3\|BJ299341 | 1557 | 3570 | 572 | 80.7 | globlastp |
| LNU832_H3 | switchgrass\|12v1\|FL740797_T1 | 1558 | 3571 | 574 | 83.82 | glotblastn |
| LNU832_H1 | foxtail_millet\|11v3\|PHY7SI005129M_T1 | 1559 | 3572 | 574 | 83.82 | glotblastn |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU833_H2 | switchgrass\|gb167\|FE608977 | 1560 | 3573 | 575 | 87.3 | globlastp |
| LNU833_H4 | switchgrass\|12v1\|FL864642_P1 | 1561 | 3574 | 575 | 87.1 | globlastp |
| LNU834_H3 | switchgrass\|12v1\|FE628655_P1 | 1562 | 3575 | 576 | 88.5 | globlastp |
| LNU834_H4 | switchgrass\|12v1\|FL721897_P1 | 1563 | 3576 | 576 | 87.1 | globlastp |
| LNU834_H2 | foxtail_millet\|11v3\|PHY7SI032419M_P1 | 1564 | 3577 | 576 | 84.2 | globlastp |
| LNU835_H1 | sorghum\|12v1\|SB03G036980 | 1565 | 3578 | 577 | 92.7 | globlastp |
| LNU835_H2 | foxtail_millet\|11v3\|PHY7SI001322M_P1 | 1566 | 3579 | 577 | 87.8 | globlastp |
| LNU835_H3 | switchgrass\|12v1\|FL816691_P1 | 1567 | 3580 | 577 | 86 | globlastp |
| LNU835_H4 | switchgrass\|12v1\|DN148836_T1 | 1568 | 3581 | 577 | 82.43 | glotblastn |
| LNU837_H1 | sugarcane\|10v1\|CA099580 | 1569 | 3582 | 578 | 93.6 | globlastp |
| LNU837_H3 | sorghum\|12v1\|SB01G044830 | 1570 | 3583 | 578 | 89.7 | globlastp |
| LNU837_H2 | foxtail_millet\|11v3\|PHY7SI036841M_P1 | 1571 | 3584 | 578 | 81.3 | globlastp |
| LNU838_H1 | sorghum\|12v1\|SB08G016060 | 1572 | 3585 | 579 | 81.4 | globlastp |
| LNU838_H2 | foxtail_millet\|11v3\|PHY7SI022177M_P1 | 1573 | 3586 | 579 | 80 | globlastp |
| LNU839_H1 | sorghum\|12v1\|SB01G035480 | 1574 | 3587 | 580 | 94.7 | globlastp |
| LNU839_H6 | switchgrass\|12v1\|FL711007_P1 | 1575 | 3588 | 580 | 92.7 | globlastp |
| LNU839_H2 | foxtail_millet\|11v3\|PHY7SI034579M_P1 | 1576 | 3589 | 580 | 90.9 | globlastp |
| LNU839_H3 | switchgrass\|gb167\|FL711007 | 1577 | 3590 | 580 | 90.26 | glotblastn |
| LNU839_H7 | switchgrass\|12v1\|FL913070_P1 | 1578 | 3591 | 580 | 88.6 | globlastp |
| LNU839_H4 | barley\|12v1\|AK365006_P1 | 1579 | 3592 | 580 | 83.1 | globlastp |
| LNU839_H5 | rice\|11v1\|CI197575 | 1580 | 3593 | 580 | 82.7 | globlastp |
| LNU840_H1 | maize\|10v1\|GRMZM2G126856T01_T1 | 1581 | 3594 | 581 | 89.53 | glotblastn |
| LNU840_H2 | sorghum\|12v1\|SB01G012580 | 1582 | 3595 | 581 | 83.58 | glotblastn |
| LNU840_H3 | switchgrass\|12v1\|SRR187767.717986_P1 | 1583 | 3596 | 581 | 82.2 | globlastp |
| LNU841_H1 | sorghum\|12v1\|SB08G017100 | 1584 | 3597 | 582 | 94.3 | globlastp |
| LNU841_H2 | sorghum\|12v1\|XM_002442210 | 1585 | 3597 | 582 | 94.3 | globlastp |
| LNU841_H3 | foxtail_millet\|11v3\|PHY7SI023738M_P1 | 1586 | 3598 | 582 | 93.3 | globlastp |
| LNU841_H4 | foxtail_millet\|11v3\|PHY7SI023743M_P1 | 1587 | 3599 | 582 | 93.3 | globlastp |
| LNU841_H17 | switchgrass\|12v1\|SRR187766.726682_P1 | 1588 | 3600 | 582 | 92.3 | globlastp |
| LNU841_H5 | sorghum\|12v1\|SB08G017170 | 1589 | 3601 | 582 | 90.6 | globlastp |
| LNU841_H18 | switchgrass\|12v1\|SRR187768.166352_P1 | 1590 | 3602 | 582 | 90.4 | globlastp |
| LNU841_H19 | switchgrass\|12v1\|FL882657_P1 | 1591 | 3603 | 582 | 89.4 | globlastp |
| LNU841_H20 | switchgrass\|12v1\|SRR187769.1407427_P1 | 1592 | 3604 | 582 | 86.7 | globlastp |
| LNU841_H6 | maize\|10v1\|GRMZM2G303536T01_P1 | 1593 | 3605 | 582 | 84.9 | globlastp |
| LNU841_H7 | cynodon\|10v1\|ES306830_P1 | 1594 | 3606 | 582 | 84.6 | globlastp |
| LNU841_H8 | wheat\|12v3\|CA658370 | 1595 | 3607 | 582 | 83.8 | globlastp |
| LNU841_H9 | barley\|12v1\|HV12v1CRP170116_P1 | 1596 | 3608 | 582 | 82.9 | globlastp |
| LNU841_H10 | rice\|11v1\|BI118730 | 1597 | 3609 | 582 | 82.9 | globlastp |
| LNU841_H11 | rye\|12v1\|DRR001012.239987 | 1598 | 3608 | 582 | 82.9 | globlastp |
| LNU841_H12 | brachypodium\|12v1\|BRADI4G05620_P1 | 1599 | 3610 | 582 | 81.9 | globlastp |
| LNU841_H13 | cynodon\|10v1\|ES298100_P1 | 1600 | 3611 | 582 | 81.7 | globlastp |
| LNU841_H14 | rye\|12v1\|DRR001012.383938 | 1601 | 3612 | 582 | 81.7 | globlastp |
| LNU841_H21 | switchgrass\|12v1\|SRR187771.1169651_P1 | 1602 | 3613 | 582 | 81.2 | globlastp |
| LNU841_H15 | brachypodium\|12v1\|BRADI4G05650_P1 | 1603 | 3614 | 582 | 81 | globlastp |
| LNU841_H22 | switchgrass\|12v1\|SRR187769.117822_P1 | 1604 | 3615 | 582 | 80.8 | globlastp |
| LNU841_H16 | pseudoroegneria\|gb167\|FF355748 | 1605 | 3616 | 582 | 80.8 | globlastp |
| LNU843_H2 | foxtail_millet\|11v3\|PHY7SI005850M_P1 | 1606 | 3617 | 583 | 83.6 | globlastp |
| LNU843_H1 | sorghum\|12v1\|SB10G014220 | 1607 | 3618 | 583 | 83.4 | globlastp |
| LNU843_H3 | barley\|12v1\|BJ449862_P1 | 1608 | 3619 | 583 | 80.1 | globlastp |
| LNU844_H1 | sorghum\|12v1\|SB06G023170 | 1609 | 3620 | 584 | 86.7 | globlastp |
| LNU844_H7 | switchgrass\|12v1\|FE634672_P1 | 1610 | 3621 | 584 | 84 | globlastp |
| LNU844_H8 | switchgrass\|12v1\|FL828787_P1 | 1611 | 3622 | 584 | 83.7 | globlastp |
| LNU844_H2 | switchgrass\|gb167\|FE634672 | 1612 | 3623 | 584 | 83.6 | globlastp |
| LNU844_H3 | foxtail_millet\|11v3\|PHY7SI010995M_P1 | 1613 | 3624 | 584 | 81.3 | globlastp |
| LNU844_H4 | millet\|10v1\|EVO454PM170895_P1 | 1614 | 3625 | 584 | 81 | globlastp |
| LNU844_H5 | brachypodium\|12v1\|BRADI5G16300_T1 | 1615 | 3626 | 584 | 80.59 | glotblastn |
| LNU844_H6 | maize\|10v1\|CF632136_P1 | 1616 | 3627 | 584 | 80 | globlastp |
| LNU845_H1 | sorghum\|12v1\|SB02G039730 | 1617 | 3628 | 585 | 91 | globlastp |
| LNU890_H1 | sugarcane\|10v1\|CA092661 | 1618 | 3629 | 586 | 80.5 | globlastp |
| LNU890_H1 | sugarcane\|10v1\|CA092661 | 1618 | 3629 | 625 | 88.1 | globlastp |
| LNU849_H1 | rice\|11v1\|AF140491 | 1619 | 3630 | 589 | 98.67 | glotblastn |
| LNU849_H2 | barley\|12v1\|BM443537_P1 | 1620 | 3631 | 589 | 87.5 | globlastp |
| LNU849_H3 | leymus\|gb166\|EG396571_P1 | 1621 | 3632 | 589 | 87.5 | globlastp |
| LNU849_H4 | maize\|10v1\|AI746262_P1 | 1622 | 3633 | 589 | 86.7 | globlastp |
| LNU849_H5 | foxtail_millet\|11v3\|PHY7SI002848M_P1 | 1623 | 3634 | 589 | 86.6 | globlastp |
| LNU849_H6 | pseudoroegneria\|gb167\|FF366817 | 1624 | 3635 | 589 | 86.6 | globlastp |
| LNU849_H7 | rye\|12v1\|BE587488 | 1625 | 3636 | 589 | 86.6 | globlastp |
| LNU849_H8 | rye\|12v1\|DRR001012.10525 | 1626 | 3636 | 589 | 86.6 | globlastp |
| LNU849_H9 | sugarcane\|10v1\|CA065802 | 1627 | 3637 | 589 | 86.6 | globlastp |
| LNU849_H10 | wheat\|12v3\|BQ483162 | 1628 | 3638 | 589 | 86.6 | globlastp |
| LNU849_H17 | switchgrass\|12v1\|FE636162_P1 | 1629 | 3639 | 589 | 86.2 | globlastp |
| LNU849_H11 | sorghum\|12v1\|SB03G030650 | 1630 | 3640 | 589 | 86.2 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU849_H18 | switchgrass\|12v1\|FE625302_P1 | 1631 | 3641 | 589 | 85.7 | globlastp |
| LNU849_H12 | switchgrass\|gb167\|FE625301 | 1632 | 3642 | 589 | 85.7 | globlastp |
| LNU849_H13 | brachypodium\|12v1\|BRADI2G46060_P1 | 1633 | 3643 | 589 | 85.3 | globlastp |
| LNU849_H14 | oat\|11v1\|GR357640_T1 | 1634 | 3644 | 589 | 82.59 | glotblastn |
| LNU849_H15 | millet\|10v1\|EVO454PM504671_P1 | 1635 | 3645 | 589 | 80.8 | globlastp |
| LNU849_H19 | switchgrass\|12v1\|FL757304_T1 | 1636 | 3646 | 589 | 80.36 | glotblastn |
| LNU849_H16 | switchgrass\|gb167\|FL757304 | 1637 | 3646 | 589 | 80.36 | glotblastn |
| LNU850_H1 | maize\|10v1\|AI677001_P1 | 1638 | 3647 | 590 | 80.2 | globlastp |
| LNU852_H1 | brachypodium\|12v1\|BRADI5G21580_P1 | 1639 | 3648 | 592 | 82 | globlastp |
| LNU852_H2 | oat\|11v1\|GR321105_P1 | 1640 | 3649 | 592 | 81.8 | globlastp |
| LNU852_H3 | barley\|12v1\|BF630808_P1 | 1641 | 3650 | 592 | 81.7 | globlastp |
| LNU852_H4 | pseudoroegneria\|gb167\|FF354586 | 1642 | 3651 | 592 | 80.9 | globlastp |
| LNU852_H5 | wheat\|12v3\|BE403524 | 1643 | 3652 | 592 | 80.7 | globlastp |
| LNU854_H1 | rice\|11v1\|AA752561 | 1644 | 3653 | 594 | 95.94 | glotblastn |
| LNU854_H2 | maize\|10v1\|AW330902_P1 | 1645 | 3654 | 594 | 90.8 | globlastp |
| LNU854_H3 | sorghum\|12v1\|SB01G007880 | 1646 | 3655 | 594 | 90.8 | globlastp |
| LNU854_H22 | switchgrass\|12v1\|FE619859_P1 | 1647 | 3656 | 594 | 90.1 | globlastp |
| LNU854_H4 | wheat\|12v3\|BG604569 | 1648 | 3657 | 594 | 90 | globlastp |
| LNU854_H5 | rye\|12v1\|DRR001012.108381 | 1649 | 3658 | 594 | 87.99 | glotblastn |
| LNU854_H6 | switchgrass\|gb167\|FE619859 | 1650 | 3659 | 594 | 87.8 | globlastp |
| LNU854_H7 | foxtail_millet\|11v3\|PHY7SI034415M_P1 | 1651 | 3660 | 594 | 86.4 | globlastp |
| LNU854_H8 | banana\|12v1\|GFXAC186756X17_P1 | 1652 | 3661 | 594 | 82.9 | globlastp |
| LNU854_H9 | banana\|12v1\|BBS110T3_P1 | 1653 | 3662 | 594 | 82.7 | globlastp |
| LNU854_H10 | banana\|12v1\|MAGEN2012031765_T1 | 1654 | 3663 | 594 | 81.24 | glotblastn |
| LNU854_H11 | oak\|10v1\|CU640269_P1 | 1655 | 3664 | 594 | 80.3 | globlastp |
| LNU854_H12 | arabidopsis_lyrata\|09v1\|JGIAL026584_P1 | 1656 | 3665 | 594 | 80.2 | globlastp |
| LNU854_H13 | b_juncea\|12v1\|E6ANDIZ01BGQGU_P1 | 1657 | 3666 | 594 | 80.2 | globlastp |
| LNU854_H14 | b_rapa\|11v1\|CD832802_P1 | 1658 | 3666 | 594 | 80.2 | globlastp |
| LNU854_H15 | canola\|11v1\|EE459921_P1 | 1659 | 3666 | 594 | 80.2 | globlastp |
| LNU854_H16 | eucalyptus\|11v2\|SRR001659X91383_P1 | 1660 | 3667 | 594 | 80.2 | globlastp |
| LNU854_H17 | b_juncea\|12v1\|AJ561120_P1 | 1661 | 3668 | 594 | 80.1 | globlastp |
| LNU854_H18 | phalaenopsis\|11v1\|SRR125771.100605_P1 | 1662 | 3669 | 594 | 80.1 | globlastp |
| LNU854_H19 | arabidopsis\|10v1\|AT4G16370_T1 | 1663 | 3670 | 594 | 80.05 | glotblastn |
| LNU854_H20 | solanum_phureja\|09v1\|SPHAI774365 | 1664 | 3671 | 594 | 80.05 | glotblastn |
| LNU854_H21 | thellungiella_parvulum\|11v1\|BY803192 | 1665 | 3672 | 594 | 80 | glotblastn |
| LNU856_H2 | switchgrass\|gb167\|FE644937 | 1666 | 3673 | 595 | 91.45 | glotblastn |
| LNU856_H7 | maize\|10v1\|BM896061_P1 | 1667 | 3674 | 595 | 87.9 | globlastp |
| LNU861_H1 | foxtail_millet\|11v3\|PHY7SI013407M_T1 | 1668 | 3675 | 598 | 97.26 | glotblastn |
| LNU861_H2 | maize\|10v1\|CD438306_T1 | 1669 | 3676 | 598 | 94.32 | glotblastn |
| LNU861_H4 | rice\|11v1\|CK071575 | 1670 | 3677 | 598 | 89.82 | glotblastn |
| LNU861_H5 | rice\|11v1\|SOLX00081332 | 1671 | 3677 | 598 | 89.82 | glotblastn |
| LNU861_H6 | brachypodium\|12v1\|BRADI3G37580_T1 | 1672 | 3678 | 598 | 89.67 | glotblastn |
| LNU861_H7 | rye\|12v1\|DRR001012.202554 | 1673 | 3679 | 598 | 89.28 | glotblastn |
| LNU861_H8 | barley\|12v1\|CA028638_T1 | 1674 | 3680 | 598 | 89.24 | glotblastn |
| LNU861_H9 | rice\|11v1\|CA756830 | 1675 | 3681 | 598 | 82.97 | glotblastn |
| LNU861_H10 | rice\|11v1\|CK008076 | 1676 | 3682 | 598 | 82.97 | glotblastn |
| LNU861_H11 | foxtail_millet\|11v3\|PHY7SI031891M_T1 | 1677 | 3683 | 598 | 82.36 | glotblastn |
| LNU861_H12 | wheat\|12v3\|SRR073321X296640D1 | 1678 | 3684 | 598 | 81.5 | globlastp |
| LNU861_H13 | barley\|12v1\|CA008529_T1 | 1679 | 3685 | 598 | 81.41 | glotblastn |
| LNU861_H14 | maize\|10v1\|DN222557_T1 | 1680 | 3686 | 598 | 80.93 | glotblastn |
| LNU861_H15 | brachypodium\|12v1\|BRADI4G31270_T1 | 1681 | 3687 | 598 | 80.58 | glotblastn |
| LNU861_H16 | sorghum\|12v1\|SB02G025750 | 1682 | 3688 | 598 | 80.5 | globlastp |
| LNU861_H17 | maize\|10v1\|EE160122_T1 | 1683 | 3689 | 598 | 80.15 | glotblastn |
| LNU862_H1 | sorghum\|12v1\|SB08G001030 | 1684 | 3690 | 599 | 94.5 | globlastp |
| LNU862_H3 | foxtail_millet\|11v3\|PHY7SI009715M_P1 | 1685 | 3691 | 599 | 93.8 | globlastp |
| LNU862_H2 | switchgrass\|gb167\|FL705388 | 1686 | 3692 | 599 | 93.7 | globlastp |
| LNU862_H16 | switchgrass\|12v1\|FE626506_P1 | 1687 | 3693 | 599 | 93.3 | globlastp |
| LNU862_H6 | foxtail_millet\|11v3\|PHY7SI026163M_P1 | 1688 | 3694 | 599 | 92.8 | globlastp |
| LNU862_H7 | millet\|10v1\|EVO454PM031355_P1 | 1689 | 3695 | 599 | 91.9 | globlastp |
| LNU862_H5 | millet\|10v1\|EVO454PM017321_P1 | 1690 | 3696 | 599 | 90.2 | globlastp |
| LNU862_H4 | maize\|10v1\|CO449955_P1 | 1691 | 3697 | 599 | 89.5 | globlastp |
| LNU862_H8 | rice\|11v1\|BI806647 | 1692 | 3698 | 599 | 87.7 | globlastp |
| LNU862_H9 | rice\|11v1\|CK041467 | 1693 | 3699 | 599 | 86.82 | glotblastn |
| LNU862_H12 | wheat\|12v3\|BE424023 | 1694 | 3700 | 599 | 82.5 | globlastp |
| LNU862_H11 | brachypodium\|12v1\|BRADI4G26590_P1 | 1695 | 3701 | 599 | 82.3 | globlastp |
| LNU862_H14 | rye\|12v1\|DRR001012.223104 | 1696 | 3702 | 599 | 82 | globlastp |
| LNU864_H1 | sugarcane\|10v1\|CA284192 | 1697 | 3703 | 600 | 88.1 | globlastp |
| LNU864_H2 | maize\|10v1\|BG841837_P1 | 1698 | 3704 | 600 | 83.3 | globlastp |
| LNU864_H3 | maize\|10v1\|BM074912_P1 | 1699 | 3705 | 600 | 82 | globlastp |
| LNU864_H4 | switchgrass\|gb167\|FL763699 | 1700 | 3706 | 600 | 82 | globlastp |
| LNU864_H7 | switchgrass\|12v1\|FL763699_T1 | 1701 | 3707 | 600 | 81.97 | glotblastn |
| LNU864_H5 | foxtail_millet\|11v3\|PHY7SI003614M_T1 | 1702 | 3708 | 600 | 80 | glotblastn |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU864_H6 | foxtail_millet\|11v3\|SOLX00021347_T1 | 1703 | — | 600 | 80 | glotblastn |
| LNU865_H4 | switchgrass\|12v1\|FL867036_P1 | 1704 | 3709 | 601 | 90.7 | globlastp |
| LNU865_H5 | switchgrass\|12v1\|FL693600_P1 | 1705 | 3710 | 601 | 90.1 | globlastp |
| LNU865_H1 | foxtail_millet\|11v3\|PHY7SI019927M_P1 | 1706 | 3711 | 601 | 89.6 | globlastp |
| LNU865_H2 | maize\|10v1\|AW056335_P1 | 1707 | 3712 | 601 | 87 | globlastp |
| LNU865_H3 | brachypodium\|12v1\|BRADI3G55730_P1 | 1708 | 3713 | 601 | 80.6 | globlastp |
| LNU867_H1 | maize\|10v1\|AI622284_P1 | 1709 | 3714 | 603 | 95.4 | globlastp |
| LNU867_H2 | foxtail_millet\|11v3\|PHY7SI034422M_P1 | 1710 | 3715 | 603 | 91.4 | globlastp |
| LNU867_H6 | switchgrass\|12v1\|FE639293_P1 | 1711 | 3716 | 603 | 88.8 | globlastp |
| LNU867_H3 | rice\|11v1\|AU065908 | 1712 | 3717 | 603 | 85.1 | globlastp |
| LNU867_H4 | brachypodium\|12v1\|BRADI1G04830_P1 | 1713 | 3718 | 603 | 84.5 | globlastp |
| LNU867_H5 | rye\|12v1\|DRR001012.163223 | 1714 | 3719 | 603 | 83.4 | globlastp |
| LNU867_H7 | switchgrass\|12v1\|DN143060_T1 | 1715 | 3720 | 603 | 80.57 | glotblastn |
| LNU868_H1 | sugarcane\|10v1\|CA093083 | 1716 | 3721 | 604 | 89.96 | glotblastn |
| LNU868_H2 | maize\|10v1\|AI947616_P1 | 1717 | 3722 | 604 | 89.2 | globlastp |
| LNU868_H9 | switchgrass\|12v1\|FL739389_P1 | 1718 | 3723 | 604 | 88.8 | globlastp |
| LNU868_H3 | foxtail_millet\|11v3\|PHY7SI037194M_P1 | 1719 | 3724 | 604 | 88.8 | globlastp |
| LNU868_H4 | switchgrass\|gb167\|FL739389 | 1720 | 3723 | 604 | 88.8 | globlastp |
| LNU868_H5 | cenchrus\|gb166\|BM084505_P1 | 1721 | 3725 | 604 | 88 | globlastp |
| LNU868_H6 | switchgrass\|gb167\|FL693838 | 1722 | 3726 | 604 | 88 | globlastp |
| LNU868_H10 | switchgrass\|12v1\|FL693838_T1 | 1723 | 3727 | 604 | 87.95 | glotblastn |
| LNU868_H7 | millet\|10v1\|PMSLX0030911D1_P1 | 1724 | 3728 | 604 | 86.7 | globlastp |
| LNU868_H8 | rice\|11v1\|OSU16747 | 1725 | 3729 | 604 | 80.6 | globlastp |
| LNU869_H1 | maize\|10v1\|BM266786_T1 | 1726 | 3730 | 605 | 84.71 | glotblastn |
| LNU870_H1 | maize\|10v1\|CB616889_P1 | 1727 | 3731 | 606 | 93.7 | globlastp |
| LNU870_H5 | switchgrass\|12v1\|FL933190_P1 | 1728 | 3732 | 606 | 89.8 | globlastp |
| LNU870_H6 | switchgrass\|12v1\|FL689654_P1 | 1729 | 3733 | 606 | 89 | globlastp |
| LNU870_H3 | maize\|10v1\|DR811947_P1 | 1730 | 3734 | 606 | 87.3 | globlastp |
| LNU870_H4 | brachypodium\|12v1\|BRADI1G07390_P1 | 1731 | 3735 | 606 | 83.6 | globlastp |
| LNU870_H7 | rice\|11v1\|GFXAC107207X23_P1 | 1732 | 3736 | 606 | 80.8 | globlastp |
| LNU871_H1 | sugarcane\|10v1\|CA073953 | 1733 | 3737 | 607 | 97.59 | glotblastn |
| LNU871_H2 | maize\|10v1\|H35900_P1 | 1734 | 3738 | 607 | 97 | globlastp |
| LNU871_H3 | foxtail_millet\|11v3\|PHY7SI035239M_P1 | 1735 | 3739 | 607 | 92.2 | globlastp |
| LNU871_H4 | millet\|10v1\|EVO454PM012409_P1 | 1736 | 3740 | 607 | 90.8 | globlastp |
| LNU871_H5 | brachypodium\|12v1\|BRADI3G38220_P1 | 1737 | 3741 | 607 | 88.8 | globlastp |
| LNU871_H6 | switchgrass\|gb167\|DN150454 | 1738 | 3742 | 607 | 88.2 | globlastp |
| LNU871_H10 | switchgrass\|12v1\|DN150454_P1 | 1739 | 3743 | 607 | 88 | globlastp |
| LNU871_H7 | wheat\|12v3\|CA663733 | 1740 | 3744 | 607 | 84.8 | globlastp |
| LNU871_H8 | wheat\|12v3\|BQ240433 | 1741 | 3745 | 607 | 84.6 | globlastp |
| LNU871_H9 | rye\|12v1\|DRR001012.137460 | 1742 | 3746 | 607 | 84.34 | glotblastn |
| LNU872_H1 | sugarcane\|10v1\|CA074015 | 1743 | 3747 | 608 | 99 | globlastp |
| LNU872_H2 | wheat\|12v3\|CA486412 | 1744 | 3748 | 608 | 99 | globlastp |
| LNU872_H3 | maize\|10v1\|T70637_P1 | 1745 | 3749 | 608 | 96.7 | globlastp |
| LNU872_H4 | maize\|10v1\|AI714486_P1 | 1746 | 3750 | 608 | 95.7 | globlastp |
| LNU872_H5 | switchgrass\|gb167\|FL766492 | 1747 | 3751 | 608 | 94.4 | globlastp |
| LNU872_H6 | cenchrus\|gb166\|BM083980_P1 | 1748 | 3752 | 608 | 93.9 | globlastp |
| LNU872_H7 | millet\|10v1\|CD724561_P1 | 1749 | 3753 | 608 | 93.9 | globlastp |
| LNU872_H8 | foxtail_millet\|11v3\|PHY7SI037482M_P1 | 1750 | 3754 | 608 | 92.9 | globlastp |
| LNU872_H9 | switchgrass\|gb167\|FE626012 | 1751 | 3755 | 608 | 91.6 | globlastp |
| LNU872_H10 | oat\|11v1\|GO591754_P1 | 1752 | 3756 | 608 | 88.7 | globlastp |
| LNU872_H11 | rye\|12v1\|DRR001012.107218XX1 | 1753 | 3757 | 608 | 88.7 | globlastp |
| LNU872_H12 | rye\|12v1\|DRR001012.112003 | 1754 | 3757 | 608 | 88.7 | globlastp |
| LNU872_H13 | cynodon\|10v1\|ES292020_P1 | 1755 | 3758 | 608 | 88.6 | globlastp |
| LNU872_H14 | rice\|11v1\|BI806552 | 1756 | 3759 | 608 | 88.3 | globlastp |
| LNU872_H15 | barley\|12v1\|BE412496_P1 | 1757 | 3760 | 608 | 87.8 | globlastp |
| LNU872_H16 | wheat\|12v3\|BE430362 | 1758 | 3761 | 608 | 87.8 | globlastp |
| LNU872_H17 | pseudoroegneria\|gb167\|FF346564 | 1759 | 3762 | 608 | 87.3 | globlastp |
| LNU872_H18 | brachypodium\|12v1\|BRADI1G11830_P1 | 1760 | 3763 | 608 | 87.1 | globlastp |
| LNU872_H19 | lovegrass\|gb167\|EH183935_T1 | 1761 | 3764 | 608 | 85.51 | glotblastn |
| LNU873_H1 | maize\|10v1\|CD969989_P1 | 1762 | 3765 | 609 | 88.7 | globlastp |
| LNU873_H2 | foxtail_millet\|11v3\|PHY7SI038649M_P1 | 1763 | 3766 | 609 | 83.1 | globlastp |
| LNU873_H4 | switchgrass\|12v1\|FL842367_T1 | 1764 | 3767 | 609 | 82.55 | glotblastn |
| LNU873_H5 | switchgrass\|12v1\|FL842366_P1 | 1765 | 3768 | 609 | 82.1 | globlastp |
| LNU873_H3 | foxtail_millet\|11v3\|SIPRD087917_T1 | 1766 | 3769 | 609 | 81.03 | glotblastn |
| LNU874_H1 | maize\|10v1\|AW308694_P1 | 1767 | 3770 | 610 | 97 | globlastp |
| LNU874_H2 | foxtail_millet\|11v3\|PHY7SI033940M_P1 | 1768 | 3771 | 610 | 93.6 | globlastp |
| LNU874_H3 | brachypodium\|12v1\|BRADI1G15377_P1 | 1769 | 3772 | 610 | 88.1 | globlastp |
| LNU874_H4 | wheat\|12v3\|BM137286 | 1770 | 3773 | 610 | 87.6 | globlastp |
| LNU874_H5 | rice\|11v1\|BI797720 | 1771 | 3774 | 610 | 86.3 | globlastp |
| LNU874_H6 | wheat\|12v3\|SRR043326X71705D1 | 1772 | 3775 | 610 | 80.7 | globlastp |
| LNU875_H1 | maize\|10v1\|AI600310_P1 | 1773 | 3776 | 611 | 96.3 | globlastp |
| LNU875_H2 | foxtail_millet\|11v3\|PHY7SI034375M_P1 | 1774 | 3777 | 611 | 92.2 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU875_H9 | switchgrass\|12v1\|FL692975_P1 | 1775 | 3778 | 611 | 91.7 | globlastp |
| LNU875_H3 | rice\|11v1\|GFXAC025296X19 | 1776 | 3779 | 611 | 86.9 | globlastp |
| LNU875_H4 | rye\|12v1\|DRR001012.181409 | 1777 | 3780 | 611 | 86.3 | globlastp |
| LNU875_H5 | wheat\|12v3\|CA609528 | 1778 | 3781 | 611 | 86.2 | globlastp |
| LNU875_H6 | wheat\|12v3\|CJ953973 | 1779 | 3782 | 611 | 86.2 | globlastp |
| LNU875_H7 | wheat\|12v3\|BE417057 | 1780 | 3783 | 611 | 85.8 | globlastp |
| LNU875_H8 | brachypodium\|12v1\|BRADI3G30830_P1 | 1781 | 3784 | 611 | 84.5 | globlastp |
| LNU878_H1 | foxtail_millet\|11v3\|PHY7SI038002M_P1 | 1782 | 3785 | 613 | 96.2 | globlastp |
| LNU878_H2 | maize\|10v1\|BE511455_P1 | 1783 | 3786 | 613 | 95.5 | globlastp |
| LNU878_H16 | switchgrass\|12v1\|DN141295_P1 | 1784 | 3787 | 613 | 94.7 | globlastp |
| LNU878_H3 | maize\|10v1\|AI947516_P1 | 1785 | 3788 | 613 | 94.7 | globlastp |
| LNU878_H4 | millet\|10v1\|EVO454PM069646_P1 | 1786 | 3789 | 613 | 94.7 | globlastp |
| LNU878_H5 | switchgrass\|gb167\|DN141295 | 1787 | 3787 | 613 | 94.7 | globlastp |
| LNU878_H6 | sugarcane\|10v1\|CA084602 | 1788 | 3790 | 613 | 94 | globlastp |
| LNU878_H7 | switchgrass\|gb167\|FE658531 | 1789 | 3791 | 613 | 94 | globlastp |
| LNU878_H8 | cenchrus\|gb166\|EB665787_T1 | 1790 | 3792 | 613 | 90.98 | glotblastn |
| LNU878_H9 | rice\|11v1\|BE040893 | 1791 | 3793 | 613 | 84.4 | globlastp |
| LNU878_H10 | pseudoroegneria\|gb167\|FF366886 | 1792 | 3794 | 613 | 82.2 | globlastp |
| LNU878_H11 | brachypodium\|12v1\|BRADI1G62860_P1 | 1793 | 3795 | 613 | 81.6 | globlastp |
| LNU878_H12 | barley\|12v1\|BE455249_P1 | 1794 | 3796 | 613 | 80.9 | globlastp |
| LNU878_H13 | pseudoroegneria\|gb167\|FF349713 | 1795 | 3797 | 613 | 80.9 | globlastp |
| LNU878_H14 | rye\|12v1\|BE636984 | 1796 | 3798 | 613 | 80.7 | globlastp |
| LNU878_H15 | wheat\|12v3\|CA655678 | 1797 | 3799 | 613 | 80.7 | globlastp |
| LNU879_H1 | sugarcane\|10v1\|CA112170 | 1798 | 3800 | 614 | 96.8 | globlastp |
| LNU879_H2 | maize\|10v1\|BG517175_P1 | 1799 | 3801 | 614 | 95.5 | globlastp |
| LNU879_H3 | cynodon\|10v1\|ES301377_P1 | 1800 | 3802 | 614 | 89 | globlastp |
| LNU879_H4 | wheat\|12v3\|BE426554 | 1801 | 3803 | 614 | 84 | globlastp |
| LNU879_H8 | switchgrass\|12v1\|HO253185_T1 | 1802 | 3804 | 614 | 83.18 | glotblastn |
| LNU879_H5 | rice\|11v1\|BI306445 | 1803 | 3805 | 614 | 83 | globlastp |
| LNU879_H6 | barley\|12v1\|BJ454262_P1 | 1804 | 3806 | 614 | 82.2 | globlastp |
| LNU879_H7 | brachypodium\|12v1\|BRADI1G67110_P1 | 1805 | 3807 | 614 | 81.7 | globlastp |
| LNU880_H1 | sugarcane\|10v1\|CA065186 | 1806 | 3808 | 615 | 96.5 | globlastp |
| LNU880_H2 | maize\|10v1\|AI600362_P1 | 1807 | 3809 | 615 | 95.1 | globlastp |
| LNU880_H3 | foxtail_millet\|11v3\|PHY7SI035863M_P1 | 1808 | 3810 | 615 | 94.3 | globlastp |
| LNU880_H10 | switchgrass\|12v1\|FE601297_P1 | 1809 | 3811 | 615 | 93.6 | globlastp |
| LNU880_H4 | switchgrass\|gb167\|FE601297 | 1810 | 3812 | 615 | 92.9 | globlastp |
| LNU880_H11 | switchgrass\|12v1\|FL761681_P1 | 1811 | 3813 | 615 | 91.7 | globlastp |
| LNU880_H5 | brachypodium\|12v1\|BRADI1G74650_P1 | 1812 | 3814 | 615 | 82.6 | globlastp |
| LNU880_H6 | rice\|11v1\|BM037902 | 1813 | 3815 | 615 | 82.6 | globlastp |
| LNU880_H7 | wheat\|12v3\|BF483896 | 1814 | 3816 | 615 | 81.9 | globlastp |
| LNU880_H8 | rye\|12v1\|DRR001012.109304 | 1815 | 3817 | 615 | 81.4 | globlastp |
| LNU880_H9 | rye\|12v1\|DRR001012.101331 | 1816 | 3818 | 615 | 81.2 | globlastp |
| LNU881_H1 | maize\|10v1\|AI622122_P1 | 1817 | 3819 | 616 | 88.2 | globlastp |
| LNU881_H2 | foxtail_millet\|11v3\|PHY7SI034179M_P1 | 1818 | 3820 | 616 | 83 | globlastp |
| LNU881_H3 | switchgrass\|12v1\|FE597492_P1 | 1819 | 3821 | 616 | 80.5 | globlastp |
| LNU882_H1 | maize\|10v1\|BM072852_P1 | 1820 | 3822 | 617 | 93.7 | globlastp |
| LNU882_H2 | foxtail_millet\|11v3\|EC612475_P1 | 1821 | 3823 | 617 | 91.9 | globlastp |
| LNU882_H3 | millet\|10v1\|EVO454PM047888_P1 | 1822 | 3824 | 617 | 91.5 | globlastp |
| LNU882_H4 | rice\|11v1\|BI796737 | 1823 | 3825 | 617 | 89.4 | globlastp |
| LNU882_H5 | barley\|12v1\|BF064865_P1 | 1824 | 3826 | 617 | 88.1 | globlastp |
| LNU882_H6 | rye\|12v1\|DRR001012.119640 | 1825 | 3827 | 617 | 87.6 | globlastp |
| LNU882_H7 | brachypodium\|12v1\|BRADI1G76280_P1 | 1826 | 3828 | 617 | 86.5 | globlastp |
| LNU883_H1 | foxtail_millet\|11v3\|PHY7SI034726M_P1 | 1827 | 3829 | 618 | 95.2 | globlastp |
| LNU883_H2 | maize\|10v1\|CO529769_P1 | 1828 | 3830 | 618 | 94.7 | globlastp |
| LNU883_H3 | rice\|11v1\|BI803402 | 1829 | 3831 | 618 | 91 | globlastp |
| LNU883_H4 | brachypodium\|12v1\|BRADI1G76640_T1 | 1830 | 3832 | 618 | 84.29 | glotblastn |
| LNU883_H5 | wheat\|12v3\|CJ904265 | 1831 | 3833 | 618 | 82.1 | globlastp |
| LNU884_H1 | maize\|10v1\|AI666123_P1 | 1832 | 3834 | 619 | 91.8 | globlastp |
| LNU884_H4 | switchgrass\|12v1\|FL810399_P1 | 1833 | 3835 | 619 | 87.6 | globlastp |
| LNU884_H2 | switchgrass\|gb167\|FL692715 | 1834 | 3836 | 619 | 87.6 | globlastp |
| LNU884_H5 | switchgrass\|12v1\|FL692715_P1 | 1835 | 3837 | 619 | 86.6 | globlastp |
| LNU884_H3 | foxtail_millet\|11v3\|EC613926_P1 | 1836 | 3838 | 619 | 85.9 | globlastp |
| LNU885_H1 | maize\|10v1\|AA979999_P1 | 1837 | 3839 | 620 | 98.9 | globlastp |
| LNU885_H2 | maize\|10v1\|AI932058_P1 | 1838 | 3840 | 620 | 98.3 | globlastp |
| LNU885_H3 | switchgrass\|gb167\|FE598943 | 1839 | 3841 | 620 | 98.1 | globlastp |
| LNU885_H156 | switchgrass\|12v1\|FE598943_P1 | 1840 | 3842 | 620 | 97.9 | globlastp |
| LNU885_H4 | cenchrus\|gb166\|EB653919_P1 | 1841 | 3843 | 620 | 97.9 | globlastp |
| LNU885_H5 | sorghum\|12v1\|SB10G022220 | 1842 | 3844 | 620 | 97.9 | globlastp |
| LNU885_H6 | foxtail_millet\|11v3\|PHY7SI006215M_P1 | 1843 | 3845 | 620 | 97.8 | globlastp |
| LNU885_H157 | switchgrass\|12v1\|FE604237_P1 | 1844 | 3846 | 620 | 97.6 | globlastp |
| LNU885_H7 | foxtail_millet\|11v3\|PHY7SI029447M_P1 | 1845 | 3847 | 620 | 97.6 | globlastp |
| LNU885_H8 | millet\|10v1\|EVO454PM002715_P1 | 1846 | 3848 | 620 | 97.6 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU885_H158 | switchgrass\|12v1\|FE617027_P1 | 1847 | 3849 | 620 | 97.2 | globlastp |
| LNU885_H9 | switchgrass\|gb167\|FE617027 | 1848 | 3849 | 620 | 97.2 | globlastp |
| LNU885_H10 | rice\|11v1\|AA753506 | 1849 | 3850 | 620 | 95.7 | globlastp |
| LNU885_H11 | brachypodium\|12v1\|BRADI1G37790_P1 | 1850 | 3851 | 620 | 94.6 | globlastp |
| LNU885_H12 | brachypodium\|12v1\|BRADI3G33860_P1 | 1851 | 3852 | 620 | 93.1 | globlastp |
| LNU885_H159 | switchgrass\|12v1\|FE603637_P1 | 1852 | 3853 | 620 | 92.3 | globlastp |
| LNU885_H13 | strawberry\|11v1\|CO381502 | 1853 | 3854 | 620 | 92.3 | globlastp |
| LNU885_H14 | oat\|11v1\|CN815217_P1 | 1854 | 3855 | 620 | 92.1 | globlastp |
| LNU885_H15 | potato\|10v1\|BG593674_P1 | 1855 | 3856 | 620 | 92.1 | globlastp |
| LNU885_H16 | tomato\|11v1\|BG129608 | 1856 | 3857 | 620 | 92.1 | globlastp |
| LNU885_H17 | liriodendron\|gb166\|CK755344_P1 | 1857 | 3858 | 620 | 92 | globlastp |
| LNU885_H18 | oat\|11v1\|CN817660_P1 | 1858 | 3859 | 620 | 92 | globlastp |
| LNU885_H19 | oil_palm\|11v1\|EL684287_P1 | 1859 | 3860 | 620 | 92 | globlastp |
| LNU885_H20 | tobacco\|gb162\|BQ842866 | 1860 | 3861 | 620 | 92 | globlastp |
| LNU885_H21 | watermelon\|11v1\|X85013 | 1861 | 3862 | 620 | 92 | globlastp |
| LNU885_H160 | nicotiana_benthamiana\|12v1\|EB446376_P1 | 1862 | 3863 | 620 | 91.8 | globlastp |
| LNU885_H22 | cucumber\|09v1\|X85013_P1 | 1863 | 3864 | 620 | 91.8 | globlastp |
| LNU885_H23 | rye\|12v1\|BG264101 | 1864 | 3865 | 620 | 91.8 | globlastp |
| LNU885_H24 | rye\|12v1\|DRR001012.133776 | 1865 | 3865 | 620 | 91.8 | globlastp |
| LNU885_H25 | solanum_phureja\|09v1\|SPHBG129608 | 1866 | 3866 | 620 | 91.6 | globlastp |
| LNU885_H26 | wheat\|12v3\|BE404507 | 1867 | 3867 | 620 | 91.6 | globlastp |
| LNU885_H27 | wheat\|12v3\|BE406710 | 1868 | 3867 | 620 | 91.6 | globlastp |
| LNU885_H161 | prunus_mume\|13v1\|BU044204_P1 | 1869 | 3868 | 620 | 91.4 | globlastp |
| LNU885_H28 | aristolochia\|10v1\|SRR039082S0002361_T1 | 1870 | 3869 | 620 | 91.4 | glotblastn |
| LNU885_H29 | eucalyptus\|11v2\|CD669053_P1 | 1871 | 3870 | 620 | 91.4 | globlastp |
| LNU885_H30 | oil_palm\|11v1\|EL681083_P1 | 1872 | 3871 | 620 | 91.4 | globlastp |
| LNU885_H31 | peanut\|10v1\|EE126045_P1 | 1873 | 3872 | 620 | 91.4 | globlastp |
| LNU885_H32 | phalaenopsis\|11v1\|CB032203XX1_P1 | 1874 | 3873 | 620 | 91.4 | globlastp |
| LNU885_H162 | monkeyflower\|12v1\|DV206835_P1 | 1875 | 3874 | 620 | 91.2 | globlastp |
| LNU885_H33 | amorphophallus\|11v2\|SRR089351X173078_P1 | 1876 | 3875 | 620 | 91.2 | globlastp |
| LNU885_H34 | catharanthus\|11v1\|SRR098691X112848_P1 | 1877 | 3876 | 620 | 91.2 | globlastp |
| LNU885_H35 | flaveria\|11v1\|SRR149229.103924_P1 | 1878 | 3877 | 620 | 91.2 | globlastp |
| LNU885_H36 | flaveria\|11v1\|SRR149229.114493_P1 | 1879 | 3877 | 620 | 91.2 | globlastp |
| LNU885_H37 | monkeyflower\|10v1\|DV206835 | 1880 | 3874 | 620 | 91.2 | globlastp |
| LNU885_H38 | oak\|10v1\|DN950673_P1 | 1881 | 3878 | 620 | 91.2 | globlastp |
| LNU885_H39 | plantago\|11v2\|SRR066373X102202_P1 | 1882 | 3879 | 620 | 91.2 | globlastp |
| LNU885_H40 | wheat\|12v3\|BE403876 | 1883 | 3880 | 620 | 91.2 | globlastp |
| LNU885_H41 | banana\|12v1\|BBS440T3_P1 | 1884 | 3881 | 620 | 91 | globlastp |
| LNU885_H42 | cacao\|10v1\|CA796831_P1 | 1885 | 3882 | 620 | 91 | globlastp |
| LNU885_H43 | cassava\|09v1\|CK643413_P1 | 1886 | 3883 | 620 | 91 | globlastp |
| LNU885_H44 | chestnut\|gb170\|SRR006295S0006601_P1 | 1887 | 3884 | 620 | 91 | globlastp |
| LNU885_H45 | cirsium\|11v1\|SRR346952.128271_P1 | 1888 | 3885 | 620 | 91 | globlastp |
| LNU885_H46 | lettuce\|12v1\|DW044389_P1 | 1889 | 3886 | 620 | 91 | globlastp |
| LNU885_H47 | prunus\|10v1\|BU044204 | 1890 | 3887 | 620 | 91 | globlastp |
| LNU885_H48 | switchgrass\|gb167\|FE604237 | 1891 | 3888 | 620 | 91 | globlastp |
| LNU885_H163 | castorbean\|12v1\|T15265_P1 | 1892 | 3889 | 620 | 90.8 | globlastp |
| LNU885_H49 | artemisia\|10v1\|EY033790_P1 | 1893 | 3890 | 620 | 90.8 | globlastp |
| LNU885_H50 | cassava\|09v1\|CK647990_P1 | 1894 | 3891 | 620 | 90.8 | globlastp |
| LNU885_H51 | castorbean\|11v1\|T15265 | 1895 | 3889 | 620 | 90.8 | globlastp |
| LNU885_H52 | euphorbia\|11v1\|AW990924_P1 | 1896 | 3892 | 620 | 90.8 | globlastp |
| LNU885_H53 | flaveria\|11v1\|SRR149232.246685_P1 | 1897 | 3893 | 620 | 90.8 | globlastp |
| LNU885_H54 | gossypium_raimondii\|12v1\|DT557120_P1 | 1898 | 3894 | 620 | 90.8 | globlastp |
| LNU885_H55 | grape\|11v1\|BM437210_P1 | 1899 | 3895 | 620 | 90.8 | globlastp |
| LNU885_H56 | soybean\|11v1\|GLYMA11G37630 | 1900 | 3896 | 620 | 90.8 | globlastp |
| LNU885_H56 | soybean\|12v1\|GLYMA11G37630_P1 | 1901 | 3896 | 620 | 90.8 | globlastp |
| LNU885_H164 | olea\|13v1\|SRR014463X51856D1_P1 | 1902 | 3897 | 620 | 90.7 | globlastp |
| LNU885_H57 | apple\|11v1\|CN490098_P1 | 1903 | 3898 | 620 | 90.7 | globlastp |
| LNU885_H58 | clementine\|11v1\|CF417075_P1 | 1904 | 3899 | 620 | 90.7 | globlastp |
| LNU885_H59 | cotton\|11v1\|AI054652_P1 | 1905 | 3900 | 620 | 90.7 | globlastp |
| LNU885_H60 | orange\|11v1\|CF417075_P1 | 1906 | 3899 | 620 | 90.7 | globlastp |
| LNU885_H61 | soybean\|11v1\|GLYMA18G01580 | 1907 | 3901 | 620 | 90.7 | globlastp |
| LNU885_H61 | soybean\|12v1\|GLYMA18G01580_P1 | 1908 | 3901 | 620 | 90.7 | globlastp |
| LNU885_H62 | amborella\|12v3\|FD432979_P1 | 1909 | 3902 | 620 | 90.5 | globlastp |
| LNU885_H63 | amsonia\|11v1\|SRR098688X101304_P1 | 1910 | 3903 | 620 | 90.5 | globlastp |
| LNU885_H64 | apple\|11v1\|CN489384_P1 | 1911 | 3904 | 620 | 90.5 | globlastp |
| LNU885_H65 | aquilegia\|10v2\|DR937313_P1 | 1912 | 3905 | 620 | 90.5 | globlastp |
| LNU885_H66 | centaurea\|gb166\|EH713231_P1 | 1913 | 3906 | 620 | 90.5 | globlastp |
| LNU885_H67 | cichorium\|gb171\|EH673881_P1 | 1914 | 3907 | 620 | 90.5 | globlastp |
| LNU885_H68 | cirsium\|11v1\|SRR346952.1001022_P1 | 1915 | 3906 | 620 | 90.5 | globlastp |
| LNU885_H69 | cowpea\|12v1\|FF387653_P1 | 1916 | 3908 | 620 | 90.5 | globlastp |
| LNU885_H70 | eschscholzia\|11v1\|CD476599_P1 | 1917 | 3909 | 620 | 90.5 | globlastp |
| LNU885_H71 | eschscholzia\|11v1\|CD478545_P1 | 1918 | 3910 | 620 | 90.5 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU885_H72 | pigeonpea\|11v1\|SRR054580X107320_P1 | 1919 | 3911 | 620 | 90.5 | globlastp |
| LNU885_H73 | rye\|12v1\|DRR001012.135185 | 1920 | 3912 | 620 | 90.5 | globlastp |
| LNU885_H74 | triphysaria\|10v1\|DR174094 | 1921 | 3913 | 620 | 90.5 | globlastp |
| LNU885_H165 | monkeyflower\|12v1\|DV209559_P1 | 1922 | 3914 | 620 | 90.3 | globlastp |
| LNU885_H75 | ambrosia\|11v1\|SRR346935.112544_P1 | 1923 | 3915 | 620 | 90.3 | globlastp |
| LNU885_H76 | ambrosia\|11v1\|SRR346935.130001_P1 | 1924 | 3916 | 620 | 90.3 | globlastp |
| LNU885_H77 | arnica\|11v1\|SRR099034X108499_P1 | 1925 | 3917 | 620 | 90.3 | globlastp |
| LNU885_H78 | banana\|12v1\|FF558852_P1 | 1926 | 3918 | 620 | 90.3 | globlastp |
| LNU885_H79 | blueberry\|12v1\|CV090498_P1 | 1927 | 3919 | 620 | 90.3 | globlastp |
| LNU885_H80 | monkeyflower\|10v1\|DV209559 | 1928 | 3914 | 620 | 90.3 | globlastp |
| LNU885_H81 | trigonella\|11v1\|SRR066194X112617 | 1929 | 3920 | 620 | 90.3 | globlastp |
| LNU885_H82 | triphysaria\|10v1\|BM357149 | 1930 | 3921 | 620 | 90.3 | globlastp |
| LNU885_H83 | arnica\|11v1\|SRR099034X107278_T1 | 1931 | 3922 | 620 | 90.28 | glotblastn |
| LNU885_H84 | orobanche\|10v1\|SRR023189S0002711_T1 | 1932 | 3923 | 620 | 90.28 | glotblastn |
| LNU885_H85 | ambrosia\|11v1\|SRR346935.225484_P1 | 1933 | 3924 | 620 | 90.1 | globlastp |
| LNU885_H86 | euonymus\|11v1\|SRR070038X106031_P1 | 1934 | 3925 | 620 | 90.1 | globlastp |
| LNU885_H87 | gossypium_raimondii\|12v1\|AI725994_P1 | 1935 | 3926 | 620 | 90.1 | globlastp |
| LNU885_H88 | medicago\|12v1\|AW256519_P1 | 1936 | 3927 | 620 | 90.1 | globlastp |
| LNU885_H89 | spruce\|11v1\|EF678303 | 1937 | 3928 | 620 | 90.1 | globlastp |
| LNU885_H90 | spruce\|11v1\|ES226997 | 1938 | 3929 | 620 | 90.1 | globlastp |
| LNU885_H91 | spruce\|11v1\|EX358693 | 1939 | 3930 | 620 | 90.1 | globlastp |
| LNU885_H166 | bean\|12v2\|CA898352_P1 | 1940 | 3931 | 620 | 89.9 | globlastp |
| LNU885_H92 | bean\|12v1\|CA898352 | 1941 | 3931 | 620 | 89.9 | globlastp |
| LNU885_H93 | beech\|11v1\|SRR006293.13457_P1 | 1942 | 3932 | 620 | 89.9 | globlastp |
| LNU885_H94 | chelidonium\|11v1\|SRR084752X103249_P1 | 1943 | 3933 | 620 | 89.9 | globlastp |
| LNU885_H95 | cotton\|11v1\|AI725994_P1 | 1944 | 3934 | 620 | 89.9 | globlastp |
| LNU885_H96 | lettuce\|12v1\|DW066578_P1 | 1945 | 3935 | 620 | 89.9 | globlastp |
| LNU885_H97 | poppy\|11v1\|SRR030259.334416_P1 | 1946 | 3936 | 620 | 89.9 | globlastp |
| LNU885_H98 | tripterygium\|11v1\|SRR098677X103558 | 1947 | 3937 | 620 | 89.9 | globlastp |
| LNU885_H167 | chickpea\|13v2\|ES560343_P1 | 1948 | 3938 | 620 | 89.7 | globlastp |
| LNU885_H99 | abies\|11v2\|SRR098676X100633_P1 | 1949 | 3939 | 620 | 89.7 | globlastp |
| LNU885_H100 | grape\|11v1\|GSVIVT01000590001_P1 | 1950 | 3940 | 620 | 89.7 | globlastp |
| LNU885_H101 | pine\|10v2\|AW011601_P1 | 1951 | 3941 | 620 | 89.7 | globlastp |
| LNU885_H102 | pseudotsuga\|10v1\|SRR065119S0006094 | 1952 | 3942 | 620 | 89.7 | globlastp |
| LNU885_H103 | safflower\|gb162\|EL375744 | 1953 | 3943 | 620 | 89.7 | globlastp |
| LNU885_H104 | sunflower\|12v1\|CD851729 | 1954 | 3944 | 620 | 89.7 | globlastp |
| LNU885_H105 | vinca\|11v1\|SRR098690X103497 | 1955 | 3945 | 620 | 89.7 | globlastp |
| LNU885_H106 | solanum_phureja\|09v1\|SPHBE920118 | 1956 | 3946 | 620 | 89.6 | globlastp |
| LNU885_H107 | maritime_pine\|10v1\|BX251751_P1 | 1957 | 3947 | 620 | 89.5 | globlastp |
| LNU885_H108 | poppy\|11v1\|FE964991_P1 | 1958 | 3948 | 620 | 89.5 | globlastp |
| LNU885_H109 | radish\|gb164\|EV546967 | 1959 | 3949 | 620 | 89.5 | globlastp |
| LNU885_H110 | valeriana\|11v1\|SRR099039X104384 | 1960 | 3950 | 620 | 89.5 | globlastp |
| LNU885_H111 | cirsium\|11v1\|SRR346952.209008_P1 | 1961 | 3951 | 620 | 89.4 | globlastp |
| LNU885_H112 | b_rapa\|11v1\|CD827580_P1 | 1962 | 3952 | 620 | 89.3 | globlastp |
| LNU885_H113 | canola\|11v1\|CN735656_P1 | 1963 | 3953 | 620 | 89.3 | globlastp |
| LNU885_H114 | canola\|11v1\|DY011412_P1 | 1964 | 3954 | 620 | 89.3 | globlastp |
| LNU885_H115 | canola\|11v1\|EE444048_P1 | 1965 | 3955 | 620 | 89.3 | globlastp |
| LNU885_H116 | poplar\|10v1\|AI162097 | 1966 | 3956 | 620 | 89.3 | globlastp |
| LNU885_H116 | poplar\|13v1\|AI162097_P1 | 1967 | 3956 | 620 | 89.3 | globlastp |
| LNU885_H117 | thellungiella_halophilum\|11v1\|DN774318 | 1968 | 3957 | 620 | 89.3 | globlastp |
| LNU885_H118 | vinca\|11v1\|SRR098690X104249 | 1969 | 3958 | 620 | 89.3 | globlastp |
| LNU885_H119 | b_juncea\|12v1\|E6ANDIZ01AULG5_P1 | 1970 | 3959 | 620 | 89.2 | globlastp |
| LNU885_H120 | b_rapa\|11v1\|CD815423_P1 | 1971 | 3960 | 620 | 89.2 | globlastp |
| LNU885_H121 | canola\|11v1\|DY006806_P1 | 1972 | 3961 | 620 | 89.2 | globlastp |
| LNU885_H122 | radish\|gb164\|EW731499 | 1973 | 3962 | 620 | 89.2 | globlastp |
| LNU885_H123 | tabernaemontana\|11v1\|SRR098689X100123 | 1974 | 3963 | 620 | 89.2 | globlastp |
| LNU885_H124 | tripterygium\|11v1\|SRR098677X106478 | 1975 | 3964 | 620 | 89.2 | globlastp |
| LNU885_H125 | ambrosia\|11v1\|SRR346935.160786_T1 | 1976 | 3965 | 620 | 89.16 | glotblastn |
| LNU885_H126 | arabidopsis_lyrata\|09v1\|JGIAL002814_P1 | 1977 | 3966 | 620 | 89 | globlastp |
| LNU885_H127 | b_rapa\|11v1\|CX188616_P1 | 1978 | 3967 | 620 | 89 | globlastp |
| LNU885_H128 | canola\|11v1\|EE459861_T1 | 1979 | 3968 | 620 | 88.97 | glotblastn |
| LNU885_H129 | centaurea\|gb166\|EL934279_T1 | 1980 | 3969 | 620 | 88.97 | glotblastn |
| LNU885_H130 | zostera\|10v1\|AM769778 | 1981 | 3970 | 620 | 88.97 | glotblastn |
| LNU885_H131 | arabidopsis\|10v1\|AT1G24510_P1 | 1982 | 3971 | 620 | 88.8 | globlastp |
| LNU885_H132 | poplar\|10v1\|BU831685 | 1983 | 3972 | 620 | 88.8 | globlastp |
| LNU885_H132 | poplar\|13v1\|BU824523_P1 | 1984 | 3972 | 620 | 88.8 | globlastp |
| LNU885_H133 | sequoia\|10v1\|SRR065044S0007458 | 1985 | 3973 | 620 | 88.8 | globlastp |
| LNU885_H134 | thellungiella_parvulum\|11v1\|DN774318 | 1986 | 3974 | 620 | 88.8 | globlastp |
| LNU885_H135 | cephalotaxus\|11v1\|SRR064395X110135_P1 | 1987 | 3975 | 620 | 88.6 | globlastp |
| LNU885_H136 | aquilegia\|10v2\|DR928892_P1 | 1988 | 3976 | 620 | 88.2 | globlastp |
| LNU885_H137 | podocarpus\|10v1\|SRR065014S0010290_P1 | 1989 | 3977 | 620 | 88.2 | globlastp |
| LNU885_H138 | sciadopitys\|10v1\|SRR065035S0017103 | 1990 | 3978 | 620 | 88.2 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU885_H139 | barley\|12v1\|BQ762736_T1 | 1991 | 3979 | 620 | 88.1 | glotblastn |
| LNU885_H140 | pteridium\|11v1\|SRR043594X100385 | 1992 | 3980 | 620 | 88.04 | glotblastn |
| LNU885_H141 | beet\|12v1\|BI543248_P1 | 1993 | 3981 | 620 | 88 | globlastp |
| LNU885_H142 | gnetum\|10v1\|DN954800_T1 | 1994 | 3982 | 620 | 87.85 | glotblastn |
| LNU885_H143 | nasturtium\|11v1\|SRR032558.163106_P1 | 1995 | 3983 | 620 | 87.3 | globlastp |
| LNU885_H144 | physcomitrella\|10v1\|AW145268_P1 | 1996 | 3984 | 620 | 87.3 | globlastp |
| LNU885_H145 | onion\|12v1\|SRR073446X113522D1_P1 | 1997 | 3985 | 620 | 86.9 | globlastp |
| LNU885_H168 | zostera\|12v1\|SRR057351X10529D1_P1 | 1998 | 3986 | 620 | 86.7 | globlastp |
| LNU885_H146 | zostera\|10v1\|SRR057351S0000962 | 1999 | 3986 | 620 | 86.7 | globlastp |
| LNU885_H147 | spikemoss\|gb165\|FE443744 | 2000 | 3987 | 620 | 86.6 | globlastp |
| LNU885_H148 | silene\|11v1\|SRR096785X166572 | 2001 | 3988 | 620 | 86.5 | globlastp |
| LNU885_H149 | ceratodon\|10v1\|SRR074890S0022653_P1 | 2002 | 3989 | 620 | 86 | globlastp |
| LNU885_H150 | vinca\|11v1\|SRR098690X104840 | 2003 | 3990 | 620 | 85.6 | globlastp |
| LNU885_H151 | distylium\|11v1\|SRR065077X10363_T1 | 2004 | 3991 | 620 | 85.42 | glotblastn |
| LNU885_H169 | olea\|13v1\|SRR014463X11934D1_T1 | 2005 | 3992 | 620 | 85.23 | glotblastn |
| LNU885_H152 | flaveria\|11v1\|SRR149229.10823_P1 | 2006 | 3993 | 620 | 84.7 | globlastp |
| LNU885_H153 | taxus\|10v1\|SRR032523S0062074 | 2007 | 3994 | 620 | 84.1 | globlastp |
| LNU885_H154 | switchgrass\|gb167\|DN151949 | 2008 | 3995 | 620 | 83.9 | globlastp |
| LNU885_H155 | spikemoss\|gb165\|FE436590 | 2009 | 3996 | 620 | 83.6 | globlastp |
| LNU885_H170 | nicotiana_benthamiana\|12v1\|BP752014_P1 | 2010 | 3997 | 620 | 82.1 | globlastp |
| LNU887_H1 | maize\|10v1\|BG319820_P1 | 2011 | 3998 | 622 | 90.6 | globlastp |
| LNU887_H2 | foxtail_millet\|11v3\|EC612301_P1 | 2012 | 3999 | 622 | 84.6 | globlastp |
| LNU887_H4 | switchgrass\|12v1\|FL748385_P1 | 2013 | 4000 | 622 | 82.5 | globlastp |
| LNU887_H3 | switchgrass\|gb167\|FL748385 | 2014 | 4001 | 622 | 81.4 | glotblastn |
| LNU887_H5 | switchgrass\|12v1\|GD046086_P1 | 2015 | 4002 | 622 | 80.7 | globlastp |
| LNU888_H1 | wheat\|12v3\|CD491419 | 2016 | 623 | 623 | 100 | globlastp |
| LNU888_H2 | sugarcane\|10v1\|CA111963 | 2017 | 4003 | 623 | 92.3 | globlastp |
| LNU888_H6 | switchgrass\|12v1\|SRR187765.216058_P1 | 2018 | 4004 | 623 | 91.3 | globlastp |
| LNU888_H3 | foxtail_millet\|11v3\|EC613111_P1 | 2019 | 4005 | 623 | 91.3 | globlastp |
| LNU888_H4 | foxtail_millet\|11v3\|PHY7SI032010M_P1 | 2020 | 4006 | 623 | 91.3 | globlastp |
| LNU888_H5 | maize\|10v1\|BM379136_P1 | 2021 | 4007 | 623 | 91.3 | globlastp |
| LNU888_H7 | switchgrass\|12v1\|SRR187769.1154845_P1 | 2022 | 4008 | 623 | 89.4 | globlastp |
| LNU888_H8 | switchgrass\|12v1\|DN149585_T1 | 2023 | 4009 | 623 | 84.62 | glotblastn |
| LNU889_H1 | maize\|10v1\|AI966901_P1 | 2024 | 4010 | 624 | 87.1 | globlastp |
| LNU889_H3 | switchgrass\|12v1\|SRR187768.382752_P1 | 2025 | 4011 | 624 | 82 | globlastp |
| LNU889_H4 | switchgrass\|12v1\|SRR187766.665224_P1 | 2026 | 4012 | 624 | 80.9 | globlastp |
| LNU889_H2 | switchgrass\|gb167\|FE616994 | 2027 | 4013 | 624 | 80.9 | globlastp |
| LNU892_H1 | sorghum\|12v1\|SB02G033220 | 2028 | 4014 | 626 | 95.7 | globlastp |
| LNU892_H2 | maize\|10v1\|AI619171_P1 | 2029 | 4015 | 626 | 92.7 | globlastp |
| LNU892_H3 | sorghum\|12v1\|SB02G033200 | 2030 | 4016 | 626 | 90.4 | globlastp |
| LNU892_H4 | foxtail_millet\|11v3\|PHY7SI029552M_P1 | 2031 | 4017 | 626 | 86.5 | globlastp |
| LNU892_H7 | switchgrass\|12v1\|SRR187765.29978_P1 | 2032 | 4018 | 626 | 86.1 | globlastp |
| LNU892_H8 | switchgrass\|12v1\|GD022360_P1 | 2033 | 4019 | 626 | 85.5 | globlastp |
| LNU892_H5 | foxtail_millet\|11v3\|PHY7SI029584M_P1 | 2034 | 4020 | 626 | 85.3 | globlastp |
| LNU892_H6 | foxtail_millet\|11v3\|PHY7SI029578M_P1 | 2035 | 4021 | 626 | 81.8 | globlastp |
| LNU893_H13 | switchgrass\|12v1\|FL793626_P1 | 2036 | 4022 | 627 | 98.6 | globlastp |
| LNU893_H14 | switchgrass\|12v1\|SRR187771.339181_P1 | 2037 | 4022 | 627 | 98.6 | globlastp |
| LNU893_H1 | switchgrass\|gb167\|FL793626 | 2038 | 4022 | 627 | 98.6 | globlastp |
| LNU893_H2 | barley\|12v1\|AW982181_P1 | 2039 | 4023 | 627 | 97.3 | globlastp |
| LNU893_H3 | foxtail_millet\|11v3\|PHY7SI031280M_P1 | 2040 | 4024 | 627 | 97.3 | globlastp |
| LNU893_H4 | maize\|10v1\|BG517269_P1 | 2041 | 4025 | 627 | 97.3 | globlastp |
| LNU893_H5 | millet\|10v1\|EVO454PM670348_P1 | 2042 | 4024 | 627 | 97.3 | globlastp |
| LNU893_H6 | rye\|12v1\|BE495982 | 2043 | 4023 | 627 | 97.3 | globlastp |
| LNU893_H7 | wheat\|12v3\|CA728398 | 2044 | 4023 | 627 | 97.3 | globlastp |
| LNU893_H8 | fescue\|gb161\|DT686545_P1 | 2045 | 4026 | 627 | 95.9 | globlastp |
| LNU893_H9 | lolium\|10v1\|AU246324_P1 | 2046 | 4026 | 627 | 95.9 | globlastp |
| LNU893_H10 | rice\|11v1\|CF330515 | 2047 | 4027 | 627 | 94.7 | globlastp |
| LNU893_H11 | brachypodium\|12v1\|BRADI1G24640_P1 | 2048 | 4028 | 627 | 90.7 | globlastp |
| LNU893_H12 | oil_palm\|11v1\|SRR190701.565537_P1 | 2049 | 4029 | 627 | 82.4 | globlastp |
| LNU894_H1 | sorghum\|12v1\|SB02G039433 | 2050 | 4030 | 628 | 93.5 | globlastp |
| LNU894_H2 | wheat\|12v3\|CA502683 | 2051 | 4030 | 628 | 93.5 | globlastp |
| LNU894_H3 | sugarcane\|10v1\|CA147729 | 2052 | 4031 | 628 | 86.9 | globlastp |
| LNU895_H1 | maize\|10v1\|AW244938_P1 | 2053 | 4032 | 629 | 91.2 | globlastp |
| LNU895_H2 | switchgrass\|gb167\|FE641349 | 2054 | 4033 | 629 | 85.3 | globlastp |
| LNU895_H4 | switchgrass\|12v1\|FE641349_P1 | 2055 | 4034 | 629 | 84.3 | globlastp |
| LNU895_H3 | foxtail_millet\|11v3\|PHY7SI031608M_P1 | 2056 | 4035 | 629 | 82.4 | globlastp |
| LNU896_H1 | maize\|10v1\|AW497539_P1 | 2057 | 4036 | 630 | 81.1 | globlastp |
| LNU899_H1 | maize\|10v1\|AW288640_P1 | 2058 | 4037 | 633 | 91.6 | globlastp |
| LNU899_H2 | foxtail_millet\|11v3\|PHY7SI000435M_P1 | 2059 | 4038 | 633 | 87.3 | globlastp |
| LNU899_H3 | switchgrass\|gb167\|FL704161 | 2060 | 4039 | 633 | 86.64 | glotblastn |
| LNU899_H4 | switchgrass\|12v1\|FL748364_P1 | 2061 | 4040 | 633 | 84.4 | globlastp |
| LNU899_H5 | switchgrass\|12v1\|FL704161_P1 | 2062 | 4041 | 633 | 80.8 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU900_H1 | maize\|10v1\|AW052900_P1 | 2063 | 4042 | 634 | 93.6 | globlastp |
| LNU900_H2 | foxtail_millet\|11v3\|PHY7SI002469M_P1 | 2064 | 4043 | 634 | 90.3 | globlastp |
| LNU900_H8 | switchgrass\|12v1\|FL696960_P1 | 2065 | 4044 | 634 | 89.5 | globlastp |
| LNU900_H3 | rye\|12v1\|DRR001012.183573 | 2066 | 4045 | 634 | 88.24 | glotblastn |
| LNU900_H4 | barley\|12v1\|AJ466045_P1 | 2067 | 4046 | 634 | 87.5 | globlastp |
| LNU900_H5 | wheat\|12v3\|CA743258 | 2068 | 4047 | 634 | 87.5 | globlastp |
| LNU900_H6 | brachypodium\|12v1\|BRADI2G06440_P1 | 2069 | 4048 | 634 | 86.7 | globlastp |
| LNU901_H1 | maize\|10v1\|AI964628_P1 | 2070 | 4049 | 635 | 90.1 | globlastp |
| LNU901_H10 | switchgrass\|12v1\|FE638167_T1 | 2071 | 4050 | 635 | 83.6 | glotblastn |
| LNU902_H1 | maize\|10v1\|AI622490_P1 | 2072 | 4051 | 636 | 93.4 | globlastp |
| LNU902_H2 | foxtail_millet\|11v3\|PHY7SI002453M_P1 | 2073 | 4052 | 636 | 88.6 | globlastp |
| LNU902_H3 | millet\|10v1\|EVO454PM024444_T1 | 2074 | 4053 | 636 | 86.16 | glotblastn |
| LNU902_H4 | switchgrass\|gb167\|DN140927 | 2075 | 4054 | 636 | 84.08 | glotblastn |
| LNU902_H5 | switchgrass\|12v1\|GD033452_T1 | 2076 | 4055 | 636 | 83.74 | glotblastn |
| LNU903_H1 | maize\|10v1\|AI979716_P1 | 2077 | 4056 | 637 | 92.3 | globlastp |
| LNU903_H2 | maize\|10v1\|AW216295_P1 | 2078 | 4057 | 637 | 91.1 | globlastp |
| LNU903_H3 | foxtail_millet\|11v3\|EC612307_P1 | 2079 | 4058 | 637 | 89.9 | globlastp |
| LNU903_H5 | switchgrass\|12v1\|FL699073_P1 | 2080 | 4059 | 637 | 88.1 | globlastp |
| LNU903_H4 | switchgrass\|gb167\|DN150122 | 2081 | 4060 | 637 | 87.9 | globlastp |
| LNU904_H1 | maize\|10v1\|AI947568_P1 | 2082 | 4061 | 638 | 83.1 | globlastp |
| LNU905_H1 | maize\|10v1\|AW052874_P1 | 2083 | 4062 | 639 | 88.4 | globlastp |
| LNU908_H5 | switchgrass\|12v1\|HO266689_P1 | 2084 | 4063 | 642 | 88.7 | globlastp |
| LNU908_H1 | foxtail_millet\|11v3\|PHY7SI005411M_P1 | 2085 | 4064 | 642 | 88.6 | globlastp |
| LNU908_H6 | switchgrass\|12v1\|FL973257_P1 | 2086 | 4065 | 642 | 88.1 | globlastp |
| LNU908_H7 | switchgrass\|12v1\|SRR187765.276211_P1 | 2087 | 4065 | 642 | 88.1 | globlastp |
| LNU908_H2 | maize\|10v1\|DT641006_P1 | 2088 | 4066 | 642 | 87.4 | globlastp |
| LNU908_H3 | rice\|11v1\|CK056423 | 2089 | 4067 | 642 | 83.5 | globlastp |
| LNU908_H4 | rice\|11v1\|HS372695 | 2090 | 4068 | 642 | 83.46 | glotblastn |
| LNU908_H8 | wheat\|12v3\|SRR400820X635658D1_T1 | 2091 | 4069 | 642 | 80.12 | glotblastn |
| LNU908_H9 | brachypodium\|12v1\|BRADI2G46140_P1 | 2092 | 4070 | 642 | 80.1 | globlastp |
| LNU909_H1 | maize\|10v1\|BQ577951_P1 | 2093 | 4071 | 643 | 92.1 | globlastp |
| LNU910_H1 | maize\|10v1\|BG837207_P1 | 2094 | 4072 | 644 | 90.1 | globlastp |
| LNU910_H2 | sugarcane\|10v1\|CA242307 | 2095 | 4073 | 644 | 89.8 | globlastp |
| LNU910_H8 | switchgrass\|12v1\|FL945810_P1 | 2096 | 4074 | 644 | 88.9 | globlastp |
| LNU910_H3 | foxtail_millet\|11v3\|PHY7SI003477M_P1 | 2097 | 4075 | 644 | 88.9 | globlastp |
| LNU910_H4 | switchgrass\|gb167\|FL927878 | 2098 | 4076 | 644 | 87.88 | glotblastn |
| LNU910_H5 | millet\|10v1\|EVO454PM187011_P1 | 2099 | 4077 | 644 | 84.8 | globlastp |
| LNU910_H9 | brachypodium\|12v1\|BRADI2G50130_P1 | 2100 | 4078 | 644 | 83 | globlastp |
| LNU910_H7 | rice\|11v1\|BI795617 | 2101 | 4079 | 644 | 82 | glotblastn |
| LNU910_H6 | maize\|10v1\|CD946808_T1 | 2102 | 4080 | 644 | 81.63 | glotblastn |
| LNU910_H10 | brachypodium\|12v1\|BRADI2G50136_P1 | 2103 | 4081 | 644 | 80 | globlastp |
| LNU912_H9 | switchgrass\|12v1\|FL792538_P1 | 2104 | 4082 | 646 | 91 | globlastp |
| LNU912_H1 | foxtail_millet\|11v3\|PHY7SI001740M_P1 | 2105 | 4083 | 646 | 91 | globlastp |
| LNU912_H10 | switchgrass\|12v1\|FL751233_P1 | 2106 | 4084 | 646 | 90.5 | globlastp |
| LNU912_H2 | millet\|10v1\|EVO454PM056333_P1 | 2107 | 4085 | 646 | 89.8 | globlastp |
| LNU912_H3 | maize\|10v1\|AI948274_P1 | 2108 | 4086 | 646 | 87.7 | globlastp |
| LNU912_H4 | rice\|11v1\|BM420858 | 2109 | 4087 | 646 | 84.6 | globlastp |
| LNU912_H5 | brachypodium\|12v1\|BRADI2G52680_P1 | 2110 | 4088 | 646 | 83.1 | globlastp |
| LNU912_H6 | wheat\|12v3\|BU099391 | 2111 | 4089 | 646 | 80.9 | globlastp |
| LNU912_H7 | wheat\|12v3\|BM136936 | 2112 | 4090 | 646 | 80.4 | globlastp |
| LNU912_H8 | barley\|12v1\|AK371517_P1 | 2113 | 4091 | 646 | 80.3 | globlastp |
| LNU913_H1 | sugarcane\|10v1\|CA082310 | 2114 | 4092 | 647 | 97.9 | globlastp |
| LNU913_H2 | maize\|10v1\|W59840_P1 | 2115 | 4093 | 647 | 96.7 | globlastp |
| LNU913_H3 | foxtail_millet\|11v3\|EC612650_P1 | 2116 | 4094 | 647 | 93.8 | globlastp |
| LNU913_H11 | switchgrass\|12v1\|FE617311_P1 | 2117 | 4095 | 647 | 92.5 | globlastp |
| LNU913_H12 | switchgrass\|12v1\|FE616665_P1 | 2118 | 4096 | 647 | 91.5 | globlastp |
| LNU913_H4 | millet\|10v1\|EVO454PM018338_P1 | 2119 | 4097 | 647 | 86.1 | globlastp |
| LNU913_H5 | switchgrass\|gb167\|FE616665 | 2120 | 4098 | 647 | 85.33 | glotblastn |
| LNU913_H6 | rice\|11v1\|BI808261 | 2121 | 4099 | 647 | 83.3 | globlastp |
| LNU913_H7 | brachypodium\|12v1\|BRADI2G54580_P1 | 2122 | 4100 | 647 | 82.4 | globlastp |
| LNU913_H8 | rye\|12v1\|DRR001012.116346 | 2123 | 4101 | 647 | 82.2 | globlastp |
| LNU913_H9 | wheat\|12v3\|BU100850 | 2124 | 4102 | 647 | 81.7 | globlastp |
| LNU913_H10 | barley\|12v1\|AV834883_P1 | 2125 | 4103 | 647 | 81.6 | globlastp |
| LNU914_H1 | sorghum\|12v1\|SB04G000570 | 2126 | 4104 | 648 | 94.5 | globlastp |
| LNU914_H2 | maize\|10v1\|AI665003_P1 | 2127 | 4105 | 648 | 85.6 | globlastp |
| LNU914_H3 | maize\|10v1\|AI372104_P1 | 2128 | 4106 | 648 | 84.4 | globlastp |
| LNU915_H1 | foxtail_millet\|11v3\|PHY7SI016626M_P1 | 2129 | 4107 | 649 | 88.4 | globlastp |
| LNU915_H3 | switchgrass\|12v1\|FL695083_P1 | 2130 | 4108 | 649 | 87.8 | globlastp |
| LNU915_H2 | maize\|10v1\|BE453841_P1 | 2131 | 4109 | 649 | 86.3 | globlastp |
| LNU916_H1 | sorghum\|12v1\|AW284247 | 2132 | 4110 | 650 | 81.8 | globlastp |
| LNU917_H1 | sugarcane\|10v1\|BQ534456 | 2133 | 4111 | 651 | 96.8 | globlastp |
| LNU917_H2 | foxtail_millet\|11v3\|PHY7SI017544M_P1 | 2134 | 4112 | 651 | 91.2 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU917_H3 | maize\|10v1\|AI673988_P1 | 2135 | 4113 | 651 | 90.4 | globlastp |
| LNU917_H4 | switchgrass\|gb167\|DN142589 | 2136 | 4114 | 651 | 90.2 | globlastp |
| LNU917_H5 | millet\|10v1\|EVO454PM028850_P1 | 2137 | 4115 | 651 | 89.6 | globlastp |
| LNU917_H12 | switchgrass\|12v1\|FL813544_P1 | 2138 | 4116 | 651 | 88.1 | globlastp |
| LNU917_H6 | wheat\|12v3\|BE400183 | 2139 | 4117 | 651 | 85.1 | globlastp |
| LNU917_H7 | rye\|12v1\|DRR001012.113593 | 2140 | 4118 | 651 | 84.3 | globlastp |
| LNU917_H8 | leymus\|gb166\|EG375025_P1 | 2141 | 4119 | 651 | 84 | globlastp |
| LNU917_H9 | brachypodium\|12v1\|BRADI3G06290_P1 | 2142 | 4120 | 651 | 83.8 | globlastp |
| LNU917_H10 | fescue\|gb161\|DT701360_P1 | 2143 | 4121 | 651 | 82.4 | globlastp |
| LNU917_H11 | maize\|10v1\|BQ048402_P1 | 2144 | 4122 | 651 | 82.3 | globlastp |
| LNU918_H1 | maize\|10v1\|AJ006536_P1 | 2145 | 4123 | 652 | 85.6 | globlastp |
| LNU918_H2 | maize\|10v1\|EY960159_T1 | 2146 | 4124 | 652 | 83.73 | glotblastn |
| LNU918_H3 | switchgrass\|gb167\|DN149185 | 2147 | 4125 | 652 | 81.15 | glotblastn |
| LNU918_H4 | switchgrass\|12v1\|DN149185_P1 | 2148 | 4126 | 652 | 80.6 | globlastp |
| LNU920_H1 | sugarcane\|10v1\|CF576045 | 2149 | 4127 | 654 | 89.2 | globlastp |
| LNU920_H2 | maize\|10v1\|AI677118_P1 | 2150 | 4128 | 654 | 84.2 | globlastp |
| LNU920_H5 | switchgrass\|12v1\|FE646248_P1 | 2151 | 4129 | 654 | 81.5 | globlastp |
| LNU920_H3 | foxtail_millet\|11v3\|PHY7SI018467M_P1 | 2152 | 4130 | 654 | 80.9 | globlastp |
| LNU920_H4 | switchgrass\|gb167\|FE646248 | 2153 | 4131 | 654 | 80.9 | globlastp |
| LNU921_H1 | maize\|10v1\|CA400159_P1 | 2154 | 4132 | 655 | 82 | globlastp |
| LNU922_H16 | switchgrass\|12v1\|DN143068_P1 | 2155 | 4133 | 656 | 96.2 | globlastp |
| LNU922_H1 | switchgrass\|gb167\|FE620798 | 2156 | 4134 | 656 | 96.2 | globlastp |
| LNU922_H2 | foxtail_millet\|11v3\|PHY7SI017460M_P1 | 2157 | 4135 | 656 | 95.7 | globlastp |
| LNU922_H3 | maize\|10v1\|AI901428_P1 | 2158 | 4136 | 656 | 95.7 | globlastp |
| LNU922_H4 | switchgrass\|gb167\|DN143068 | 2159 | 4137 | 656 | 95.7 | globlastp |
| LNU922_H5 | millet\|10v1\|EVO454PM010006_P1 | 2160 | 4138 | 656 | 94.9 | globlastp |
| LNU922_H6 | maize\|10v1\|AA011883_P1 | 2161 | 4139 | 656 | 94.6 | globlastp |
| LNU922_H7 | rice\|11v1\|BI805551 | 2162 | 4140 | 656 | 92.1 | globlastp |
| LNU922_H8 | brachypodium\|12v1\|BRADI3G52340T2_P1 | 2163 | 4141 | 656 | 87 | globlastp |
| LNU922_H9 | oat\|11v1\|CN817149_P1 | 2164 | 4142 | 656 | 86.5 | globlastp |
| LNU922_H10 | wheat\|12v3\|BQ802727 | 2165 | 4143 | 656 | 86.5 | globlastp |
| LNU922_H11 | brachypodium\|12v1\|BRADI5G01350_P1 | 2166 | 4144 | 656 | 86.2 | globlastp |
| LNU922_H12 | barley\|12v1\|BE412861_P1 | 2167 | 4145 | 656 | 86 | globlastp |
| LNU922_H13 | cenchrus\|gb166\|EB660552_P1 | 2168 | 4146 | 656 | 86 | globlastp |
| LNU922_H14 | rye\|12v1\|BE586503 | 2169 | 4147 | 656 | 85.5 | globlastp |
| LNU922_H15 | rye\|12v1\|DRR001012.249546 | 2170 | 4148 | 656 | 80.7 | globlastp |
| LNU923_H1 | maize\|10v1\|BI273413_P1 | 2171 | 4149 | 657 | 81.5 | globlastp |
| LNU924_H1 | sugarcane\|10v1\|CA070317 | 2172 | 4150 | 658 | 83.8 | globlastp |
| LNU924_H3 | switchgrass\|12v1\|FL935940_P1 | 2173 | 4151 | 658 | 80.9 | globlastp |
| LNU924_H4 | switchgrass\|12v1\|DN145033_P1 | 2174 | 4152 | 658 | 80.4 | globlastp |
| LNU924_H2 | foxtail_millet\|11v3\|SOLX00022667_P1 | 2175 | 4153 | 658 | 80.4 | globlastp |
| LNU925_H1 | maize\|10v1\|FL010481_P1 | 2176 | 4154 | 659 | 94.2 | globlastp |
| LNU925_H2 | foxtail_millet\|11v3\|PHY7SI016794M_P1 | 2177 | 4155 | 659 | 89.5 | globlastp |
| LNU925_H9 | switchgrass\|12v1\|SRR187770.1008801_P1 | 2178 | 4156 | 659 | 86 | globlastp |
| LNU925_H10 | switchgrass\|12v1\|SRR187769.231821_P1 | 2179 | 4157 | 659 | 85.7 | globlastp |
| LNU925_H3 | brachypodium\|12v1\|BRADI3G51590_P1 | 2180 | 4158 | 659 | 85.4 | globlastp |
| LNU925_H4 | wheat\|12v3\|TA12V11729457 | 2181 | 4159 | 659 | 85.31 | glotblastn |
| LNU925_H5 | barley\|12v1\|HV12v1CRP055339_P1 | 2182 | 4160 | 659 | 85 | globlastp |
| LNU925_H6 | rice\|11v1\|CX104415 | 2183 | 4161 | 659 | 81.1 | globlastp |
| LNU925_H7 | wheat\|12v3\|CA731766 | 2184 | 4162 | 659 | 80.2 | globlastp |
| LNU925_H8 | barley\|12v1\|BI777343_P1 | 2185 | 4163 | 659 | 80.1 | globlastp |
| LNU926_H1 | sugarcane\|10v1\|CA088361 | 2186 | 4164 | 660 | 96.4 | globlastp |
| LNU926_H2 | foxtail_millet\|11v3\|PHY7SI017439M_P1 | 2187 | 4165 | 660 | 94.3 | globlastp |
| LNU926_H3 | maize\|10v1\|BI389475_P1 | 2188 | 4166 | 660 | 93.7 | globlastp |
| LNU926_H4 | maize\|10v1\|BM078145_P1 | 2189 | 4167 | 660 | 93.7 | globlastp |
| LNU926_H7 | switchgrass\|12v1\|FL896622_P1 | 2190 | 4168 | 660 | 91.9 | globlastp |
| LNU926_H5 | millet\|10v1\|EVO454PM001369_P1 | 2191 | 4169 | 660 | 91.9 | globlastp |
| LNU926_H6 | switchgrass\|gb167\|FL736268 | 2192 | 4170 | 660 | 91.3 | globlastp |
| LNU926_H8 | switchgrass\|12v1\|FL736268_P1 | 2193 | 4171 | 660 | 91 | globlastp |
| LNU928_H1 | maize\|10v1\|AI666263_P1 | 2194 | 4172 | 661 | 96.9 | globlastp |
| LNU928_H5 | switchgrass\|12v1\|FL703064_P1 | 2195 | 4173 | 661 | 90.2 | globlastp |
| LNU928_H6 | switchgrass\|12v1\|FL827336_P1 | 2196 | 4174 | 661 | 89.9 | globlastp |
| LNU928_H2 | foxtail_millet\|11v3\|PHY7SI016502M_P1 | 2197 | 4175 | 661 | 89.6 | globlastp |
| LNU928_H3 | rice\|11v1\|BI812770 | 2198 | 4176 | 661 | 80.26 | glotblastn |
| LNU928_H4 | rye\|12v1\|DRR001012.253036 | 2199 | 4177 | 661 | 80.14 | glotblastn |
| LNU929_H1 | sorghum\|12v1\|SB04G036770 | 2200 | 4178 | 662 | 85.4 | globlastp |
| LNU929_H2 | maize\|10v1\|BG836023_P1 | 2201 | 4179 | 662 | 83.4 | globlastp |
| LNU929_H3 | foxtail_millet\|11v3\|PHY7SI017734M_P1 | 2202 | 4180 | 662 | 83.1 | globlastp |
| LNU929_H5 | switchgrass\|12v1\|FL792661_P1 | 2203 | 4181 | 662 | 82.8 | globlastp |
| LNU929_H6 | switchgrass\|12v1\|SRR187772.1076529_P1 | 2204 | 4182 | 662 | 82.2 | globlastp |
| LNU929_H4 | millet\|10v1\|EVO454PM007685_T1 | 2205 | 4183 | 662 | 80.76 | glotblastn |
| LNU931_H1 | sugarcane\|10v1\|CA085385 | 2206 | 4184 | 664 | 95.3 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU931_H2 | foxtail_millet|11v3|PHY7SI026372M_P1 | 2207 | 4185 | 664 | 91.7 | globlastp |
| LNU931_H3 | maize|10v1|AW052904_P1 | 2208 | 4186 | 664 | 90.9 | globlastp |
| LNU931_H4 | foxtail_millet|11v3|PHY7SI010145M_P1 | 2209 | 4187 | 664 | 89.7 | globlastp |
| LNU931_H5 | switchgrass|gb167|FL690712 | 2210 | 4188 | 664 | 89.51 | glotblastn |
| LNU931_H13 | switchgrass|12v1|FL690712_P1 | 2211 | 4189 | 664 | 88.8 | globlastp |
| LNU931_H6 | sorghum|12v1|SB05G000560 | 2212 | 4190 | 664 | 88.8 | globlastp |
| LNU931_H7 | sugarcane|10v1|CA183007 | 2213 | 4191 | 664 | 87.5 | globlastp |
| LNU931_H8 | sorghum|12v1|SB08G000580 | 2214 | 4192 | 664 | 87.1 | globlastp |
| LNU931_H9 | millet|10v1|CD725261_P1 | 2215 | 4193 | 664 | 86.9 | globlastp |
| LNU931_H10 | foxtail_millet|11v3|PHY7SI006320M_P1 | 2216 | 4194 | 664 | 82.6 | globlastp |
| LNU931_H11 | maize|10v1|AI795587_P1 | 2217 | 4195 | 664 | 82 | globlastp |
| LNU931_H14 | switchgrass|12v1|FE652169_P1 | 2218 | 4196 | 664 | 81.2 | globlastp |
| LNU931_H12 | switchgrass|gb167|FE652169 | 2219 | 4196 | 664 | 81.2 | globlastp |
| LNU934_H1 | sorghum|12v1|SB05G006960 | 2220 | 4197 | 667 | 97.7 | globlastp |
| LNU934_H2 | maize|10v1|AI920383_P1 | 2221 | 4198 | 667 | 91.1 | globlastp |
| LNU934_H3 | maize|10v1|AI601020_P1 | 2222 | 4199 | 667 | 90.1 | globlastp |
| LNU934_H4 | foxtail_millet|11v3|EC612232_P1 | 2223 | 4200 | 667 | 88.5 | globlastp |
| LNU934_H5 | switchgrass|gb167|DN146252 | 2224 | 4201 | 667 | 88.1 | globlastp |
| LNU934_H6 | switchgrass|gb167|FE626199 | 2225 | 4202 | 667 | 86.5 | globlastp |
| LNU934_H7 | rice|11v1|BI801587 | 2226 | 4203 | 667 | 83.2 | globlastp |
| LNU936_H1 | maize|10v1|AW120427_P1 | 2227 | 4204 | 669 | 81.4 | globlastp |
| LNU940_H1 | sorghum|12v1|SB01G006570 | 2228 | 4205 | 672 | 92.4 | globlastp |
| LNU940_H16 | switchgrass|12v1|GD019934_P1 | 2229 | 4206 | 672 | 89.1 | globlastp |
| LNU940_H2 | maize|10v1|BM080112_P1 | 2230 | 4207 | 672 | 89.1 | globlastp |
| LNU940_H3 | switchgrass|gb167|FL987004 | 2231 | 4206 | 672 | 89.1 | globlastp |
| LNU940_H4 | foxtail_millet|11v3|PHY7SI039636M_P1 | 2232 | 4208 | 672 | 88 | globlastp |
| LNU940_H5 | millet|10v1|EVO454PM050387_P1 | 2233 | 4209 | 672 | 88 | globlastp |
| LNU940_H17 | switchgrass|12v1|FL987004_P1 | 2234 | 4210 | 672 | 87 | globlastp |
| LNU940_H18 | switchgrass|12v1|SRR187766.558595_P1 | 2235 | 4211 | 672 | 87 | globlastp |
| LNU940_H6 | brachypodium|12v1|BRADI4G35010_P1 | 2236 | 4212 | 672 | 87 | globlastp |
| LNU940_H7 | rice|11v1|AU172742 | 2237 | 4213 | 672 | 85.9 | globlastp |
| LNU940_H8 | cenchrus|gb166|EB672242_P1 | 2238 | 4214 | 672 | 84.8 | globlastp |
| LNU940_H9 | barley|12v1|BG415270_P1 | 2239 | 4215 | 672 | 83.7 | globlastp |
| LNU940_H10 | pseudoroegneria|gb167|FF361949 | 2240 | 4216 | 672 | 83.7 | globlastp |
| LNU940_H11 | fescue|gb161|DT690522_P1 | 2241 | 4217 | 672 | 82.6 | globlastp |
| LNU940_H12 | rye|12v1|DRR001012.205554 | 2242 | 4218 | 672 | 82.6 | globlastp |
| LNU940_H13 | rye|12v1|DRR001012.443974 | 2243 | 4218 | 672 | 82.6 | globlastp |
| LNU940_H14 | wheat|12v3|BF474839 | 2244 | 4218 | 672 | 82.6 | globlastp |
| LNU940_H15 | wheat|12v3|SRX035157S105600 | 2245 | 4219 | 672 | 80.4 | globlastp |
| LNU941_H1 | sugarcane|10v1|DV636549 | 2246 | 4220 | 673 | 82.8 | globlastp |
| LNU942_H15 | switchgrass|12v1|DN143194_P1 | 2247 | 4221 | 674 | 93 | globlastp |
| LNU942_H16 | switchgrass|12v1|FE600191_P1 | 2248 | 4222 | 674 | 93 | globlastp |
| LNU942_H1 | switchgrass|gb167|DN143194 | 2249 | 4221 | 674 | 93 | globlastp |
| LNU942_H2 | maize|10v1|AI948177_P1 | 2250 | 4223 | 674 | 92.7 | globlastp |
| LNU942_H3 | sugarcane|10v1|BU103195 | 2251 | 4224 | 674 | 92.6 | globlastp |
| LNU942_H4 | sorghum|12v1|SB04G019760 | 2252 | 4225 | 674 | 92 | globlastp |
| LNU942_H5 | maize|10v1|DV523108_P1 | 2253 | 4226 | 674 | 90.6 | globlastp |
| LNU942_H17 | switchgrass|12v1|FE600082_P1 | 2254 | 4227 | 674 | 88.6 | globlastp |
| LNU942_H6 | switchgrass|gb167|FE600082 | 2255 | 4228 | 674 | 88.3 | globlastp |
| LNU942_H7 | foxtail_millet|11v3|PHY7SI010700M_P1 | 2256 | 4229 | 674 | 87.4 | globlastp |
| LNU942_H8 | millet|10v1|PMSLX0006862D1_P1 | 2257 | 4230 | 674 | 87.3 | globlastp |
| LNU942_H9 | foxtail_millet|11v3|PHY7SI020925M_P1 | 2258 | 4231 | 674 | 85.7 | globlastp |
| LNU942_H10 | leymus|gb166|EG376656_P1 | 2259 | 4232 | 674 | 85.2 | globlastp |
| LNU942_H11 | wheat|12v3|BE516147 | 2260 | 4233 | 674 | 85.2 | globlastp |
| LNU942_H12 | rye|12v1|DRR001012.268452 | 2261 | 4234 | 674 | 84.23 | glotblastn |
| LNU942_H13 | brachypodium|12v1|BRADI5G13320_P1 | 2262 | 4235 | 674 | 84.2 | globlastp |
| LNU942_H14 | rice|11v1|BI798333 | 2263 | 4236 | 674 | 83 | globlastp |
| LNU942_H18 | switchgrass|12v1|SRR187765.620238_T1 | 2264 | 4237 | 674 | 81.76 | glotblastn |
| LNU943_H1 | maize|10v1|AW165435_P1 | 2265 | 4238 | 675 | 93.5 | globlastp |
| LNU943_H2 | maize|10v1|BU582245_P1 | 2266 | 4239 | 675 | 92.1 | globlastp |
| LNU943_H3 | sorghum|12v1|SB01G018160 | 2267 | 4240 | 675 | 91.5 | globlastp |
| LNU943_H4 | foxtail_millet|11v3|PHY7SI022488M_P1 | 2268 | 4241 | 675 | 88.4 | globlastp |
| LNU943_H5 | switchgrass|gb167|FL700923 | 2269 | 4242 | 675 | 87.5 | globlastp |
| LNU943_H9 | switchgrass|12v1|FL946368_P1 | 2270 | 4243 | 675 | 86.7 | globlastp |
| LNU943_H6 | foxtail_millet|11v3|PHY7SI010535M_P1 | 2271 | 4244 | 675 | 86.4 | globlastp |
| LNU943_H7 | rice|11v1|CA762359 | 2272 | 4245 | 675 | 85 | globlastp |
| LNU943_H8 | rye|12v1|DRR001012.256371 | 2273 | 4246 | 675 | 80.45 | glotblastn |
| LNU944_H1 | maize|10v1|BE519358_P1 | 2274 | 4247 | 676 | 94.5 | globlastp |
| LNU944_H2 | foxtail_millet|11v3|PHY7SI013344M_P1 | 2275 | 4248 | 676 | 90.2 | globlastp |
| LNU944_H14 | switchgrass|12v1|FE605775_P1 | 2276 | 4249 | 676 | 89.6 | globlastp |
| LNU944_H3 | switchgrass|gb167|FL691662 | 2277 | 4250 | 676 | 88.75 | glotblastn |
| LNU944_H15 | switchgrass|12v1|FL693381_P1 | 2278 | 4251 | 676 | 87.4 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU944_H4 | rice\|11v1\|AU065195 | 2279 | 4252 | 676 | 85.1 | globlastp |
| LNU944_H5 | rice\|11v1\|AA752897 | 2280 | 4253 | 676 | 84.5 | globlastp |
| LNU944_H6 | brachypodium\|12v1\|BRADI5G26450_P1 | 2281 | 4254 | 676 | 83.4 | globlastp |
| LNU944_H16 | switchgrass\|12v1\|FL693806_P1 | 2282 | 4255 | 676 | 82.9 | globlastp |
| LNU944_H7 | brachypodium\|12v1\|BRADI3G12950_P1 | 2283 | 4256 | 676 | 82.5 | globlastp |
| LNU944_H8 | foxtail_millet\|11v3\|EC612109_P1 | 2284 | 4257 | 676 | 82.2 | globlastp |
| LNU944_H9 | sorghum\|12v1\|SB06G033190 | 2285 | 4258 | 676 | 82.1 | globlastp |
| LNU944_H10 | rye\|12v1\|BE588044 | 2286 | 4259 | 676 | 81.9 | globlastp |
| LNU944_H11 | barley\|12v1\|BE231241_P1 | 2287 | 4260 | 676 | 81.7 | globlastp |
| LNU944_H12 | wheat\|12v3\|BE416410 | 2288 | 4261 | 676 | 81.5 | globlastp |
| LNU944_H13 | maize\|10v1\|AW119989_P1 | 2289 | 4262 | 676 | 81.2 | globlastp |
| LNU945_H1 | sugarcane\|10v1\|CA102004 | 2290 | 4263 | 677 | 95.7 | globlastp |
| LNU945_H2 | maize\|10v1\|CF630693_P1 | 2291 | 4264 | 677 | 92.4 | globlastp |
| LNU945_H12 | switchgrass\|12v1\|FE610584_P1 | 2292 | 4265 | 677 | 90.2 | globlastp |
| LNU945_H13 | switchgrass\|12v1\|FL736798_P1 | 2293 | 4266 | 677 | 90.2 | globlastp |
| LNU945_H3 | foxtail_millet\|11v3\|PHY7SI014236M_P1 | 2294 | 4267 | 677 | 89.6 | globlastp |
| LNU945_H4 | switchgrass\|gb167\|FE610584 | 2295 | 4268 | 677 | 88.21 | glotblastn |
| LNU945_H5 | brachypodium\|12v1\|BRADI3G16410_P1 | 2296 | 4269 | 677 | 86.1 | globlastp |
| LNU945_H6 | wheat\|12v3\|BE399236 | 2297 | 4270 | 677 | 84.8 | globlastp |
| LNU945_H7 | wheat\|12v3\|BF483870 | 2298 | 4271 | 677 | 84.8 | globlastp |
| LNU945_H8 | rice\|11v1\|BI796904 | 2299 | 4272 | 677 | 84.3 | globlastp |
| LNU945_H9 | oat\|11v1\|GO589349_P1 | 2300 | 4273 | 677 | 83.3 | globlastp |
| LNU945_H10 | barley\|12v1\|AV835214_P1 | 2301 | 4274 | 677 | 83 | globlastp |
| LNU945_H11 | rye\|12v1\|DRR001012.115501 | 2302 | 4275 | 677 | 81.5 | globlastp |
| LNU946_H3 | switchgrass\|12v1\|FE622311_P1 | 2303 | 4276 | 678 | 88.1 | globlastp |
| LNU946_H1 | foxtail_millet\|11v3\|PHY7SI013314M_P1 | 2304 | 4277 | 678 | 86.8 | globlastp |
| LNU946_H4 | switchgrass\|12v1\|FE631618_P1 | 2305 | 4278 | 678 | 86.3 | globlastp |
| LNU946_H2 | maize\|10v1\|CO517747_P1 | 2306 | 4279 | 678 | 85.3 | globlastp |
| LNU947_H1 | maize\|10v1\|AW400079_T1 | 2307 | 4280 | 679 | 80.67 | glotblastn |
| LNU948_H1 | maize\|10v1\|CF244014_T1 | 2308 | 4281 | 680 | 85.13 | glotblastn |
| LNU949_H1 | sugarcane\|10v1\|CA070316 | 2309 | 4282 | 681 | 91.6 | globlastp |
| LNU949_H2 | millet\|10v1\|CD725957_P1 | 2310 | 4283 | 681 | 80.3 | globlastp |
| LNU950_H1 | sugarcane\|10v1\|CA117340 | 2311 | 4284 | 682 | 93.5 | globlastp |
| LNU950_H2 | sorghum\|12v1\|SB05G001050 | 2312 | 4285 | 682 | 88.5 | globlastp |
| LNU950_H3 | foxtail_millet\|11v3\|PHY7SI026369M_P1 | 2313 | 4286 | 682 | 86.5 | globlastp |
| LNU950_H4 | foxtail_millet\|11v3\|EC611923_P1 | 2314 | 4287 | 682 | 86.1 | globlastp |
| LNU950_H5 | switchgrass\|gb167\|DN142564 | 2315 | 4288 | 682 | 85.8 | globlastp |
| LNU950_H21 | switchgrass\|12v1\|FE601370_P1 | 2316 | 4289 | 682 | 85.6 | globlastp |
| LNU950_H22 | switchgrass\|12v1\|DN142564_P1 | 2317 | 4290 | 682 | 84.9 | globlastp |
| LNU950_H6 | maize\|10v1\|AI665950_P1 | 2318 | 4291 | 682 | 84.5 | globlastp |
| LNU950_H7 | millet\|10v1\|EVO454PM003253_P1 | 2319 | 4292 | 682 | 84 | globlastp |
| LNU950_H8 | millet\|10v1\|EVO454PM002572_P1 | 2320 | 4293 | 682 | 82.7 | globlastp |
| LNU950_H9 | rice\|11v1\|BI808891 | 2321 | 4294 | 682 | 82.7 | glotblastn |
| LNU950_H10 | rice\|11v1\|AF004947 | 2322 | 4295 | 682 | 82 | globlastp |
| LNU950_H11 | wheat\|12v3\|BE412095 | 2323 | 4296 | 682 | 81.3 | globlastp |
| LNU950_H12 | wheat\|12v3\|CA664401 | 2324 | 4297 | 682 | 81.3 | globlastp |
| LNU950_H13 | wheat\|12v3\|SRR043323X26334D1 | 2325 | 4297 | 682 | 81.3 | globlastp |
| LNU950_H14 | rice\|11v1\|AU174185 | 2326 | 4298 | 682 | 81.1 | globlastp |
| LNU950_H15 | barley\|12v1\|AV910430_P1 | 2327 | 4299 | 682 | 80.9 | globlastp |
| LNU950_H16 | rye\|12v1\|DRR001012.134503 | 2328 | 4300 | 682 | 80.9 | globlastp |
| LNU950_H17 | maize\|10v1\|DR804998_P1 | 2329 | 4301 | 682 | 80.7 | globlastp |
| LNU950_H18 | maize\|10v1\|EG041994_P1 | 2330 | 4302 | 682 | 80.7 | globlastp |
| LNU950_H19 | wheat\|12v3\|CA719005 | 2331 | 4303 | 682 | 80.7 | globlastp |
| LNU950_H20 | maize\|10v1\|CF064453_P1 | 2332 | 4304 | 682 | 80.3 | globlastp |
| LNU953_H1 | foxtail_millet\|11v3\|PHY7SI021031M_P1 | 2333 | 4305 | 685 | 98.5 | globlastp |
| LNU953_H2 | maize\|10v1\|AI947816_P1 | 2334 | 4306 | 685 | 98 | globlastp |
| LNU953_H3 | rice\|11v1\|BI810241 | 2335 | 4307 | 685 | 94.8 | globlastp |
| LNU953_H4 | brachypodium\|12v1\|BRADI4G07167_P1 | 2336 | 4308 | 685 | 93.3 | globlastp |
| LNU953_H5 | rye\|12v1\|BE587487 | 2337 | 4309 | 685 | 92.8 | globlastp |
| LNU953_H6 | rice\|11v1\|AA752560 | 2338 | 4310 | 685 | 91.8 | globlastp |
| LNU953_H7 | wheat\|12v3\|BE606922 | 2339 | 4311 | 685 | 89.93 | glotblastn |
| LNU953_H8 | brachypodium\|12v1\|BRADI4G15710_P1 | 2340 | 4312 | 685 | 89.8 | globlastp |
| LNU953_H9 | sorghum\|12v1\|SB05G022390 | 2341 | 4313 | 685 | 88.9 | globlastp |
| LNU953_H10 | oil_palm\|11v1\|EY408711XX1_T1 | 2342 | 4314 | 685 | 88.62 | glotblastn |
| LNU953_H11 | oil_palm\|11v1\|ES323990_P1 | 2343 | 4315 | 685 | 87.5 | globlastp |
| LNU953_H12 | banana\|12v1\|BBS995T3_P1 | 2344 | 4316 | 685 | 87.4 | globlastp |
| LNU953_H13 | foxtail_millet\|11v3\|PHY7SI025878M_P1 | 2345 | 4317 | 685 | 87.4 | globlastp |
| LNU953_H14 | aristolochia\|10v1\|FD752686_P1 | 2346 | 4318 | 685 | 87.1 | globlastp |
| LNU953_H15 | amborella\|12v3\|FD433166_P1 | 2347 | 4319 | 685 | 86.8 | globlastp |
| LNU953_H16 | banana\|12v1\|ES434911_P1 | 2348 | 4320 | 685 | 86.3 | globlastp |
| LNU953_H18 | soybean\|12v1\|GLYMA02G43930_P1 | 2349 | 4321 | 685 | 86.1 | globlastp |
| LNU953_H17 | pigeonpea\|11v1\|SRR054580X101829_P1 | 2350 | 4322 | 685 | 85.8 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU953_H18 | soybean\|11v1\|GLYMA14G04890 | 2351 | 4323 | 685 | 85.8 | globlastp |
| LNU953_H19 | strawberry\|11v1\|CO379742 | 2352 | 4324 | 685 | 85.7 | globlastp |
| LNU953_H20 | lotus\|09v1\|GFXAP006535X8_P1 | 2353 | 4325 | 685 | 85.5 | globlastp |
| LNU953_H21 | medicago\|12v1\|BE204582_P1 | 2354 | 4326 | 685 | 85.5 | globlastp |
| LNU953_H22 | poppy\|11v1\|SRR030259.226807_T1 | 2355 | 4327 | 685 | 85.49 | glotblastn |
| LNU953_H126 | castorbean\|12v1\|XM_002514388_T1 | 2356 | 4328 | 685 | 85.47 | glotblastn |
| LNU953_H24 | cotton\|11v1\|AI725579_P1 | 2357 | 4329 | 685 | 85.4 | globlastp |
| LNU953_H25 | gossypium_raimondii\|12v1\|AI725579_P1 | 2358 | 4330 | 685 | 85.3 | globlastp |
| LNU953_H26 | soybean\|11v1\|GLYMA02G43930 | 2359 | 4331 | 685 | 85.3 | globlastp |
| LNU953_H27 | watermelon\|11v1\|AM738852 | 2360 | 4332 | 685 | 85.3 | globlastp |
| LNU953_H28 | prunus\|10v1\|BU575191 | 2361 | 4333 | 685 | 85.2 | globlastp |
| LNU953_H127 | soybean\|12v1\|GLYMA14G04890_P1 | 2362 | 4334 | 685 | 85.1 | globlastp |
| LNU953_H29 | trigonella\|11v1\|SRR066194X104042 | 2363 | 4335 | 685 | 85.1 | globlastp |
| LNU953_H128 | bean\|12v2\|CA899898_P1 | 2364 | 4336 | 685 | 85 | globlastp |
| LNU953_H129 | bean\|12v2\|CB542475_P1 | 2365 | 4337 | 685 | 85 | globlastp |
| LNU953_H130 | poplar\|13v1\|AI162526_P1 | 2366 | 4338 | 685 | 85 | globlastp |
| LNU953_H30 | bean\|12v1\|CB542475 | 2367 | 4339 | 685 | 85 | globlastp |
| LNU953_H31 | cassava\|09v1\|CK650982_P1 | 2368 | 4340 | 685 | 85 | globlastp |
| LNU953_H35 | poplar\|13v1\|AI162784_P1 | 2369 | 4341 | 685 | 85 | globlastp |
| LNU953_H32 | wheat\|12v3\|BE403992 | 2370 | 4342 | 685 | 84.94 | glotblastn |
| LNU953_H33 | banana\|12v1\|ES435104_P1 | 2371 | 4343 | 685 | 84.9 | globlastp |
| LNU953_H34 | euphorbia\|11v1\|BG467380_P1 | 2372 | 4344 | 685 | 84.9 | globlastp |
| LNU953_H35 | poplar\|10v1\|AI162784 | 2373 | 4345 | 685 | 84.9 | globlastp |
| LNU953_H37 | chickpea\|13v2\|GR396199_P1 | 2374 | 4346 | 685 | 84.9 | globlastp |
| LNU953_H64 | poplar\|13v1\|BU815471_P1 | 2375 | 4347 | 685 | 84.9 | globlastp |
| LNU953_H36 | medicago\|12v1\|AW684864_P1 | 2376 | 4348 | 685 | 84.8 | globlastp |
| LNU953_H37 | chickpea\|11v1\|GR396199 | 2377 | 4349 | 685 | 84.77 | glotblastn |
| LNU953_H38 | soybean\|11v1\|GLYMA20G11300 | 2378 | 4350 | 685 | 84.7 | globlastp |
| LNU953_H39 | wheat\|12v3\|BE606346 | 2379 | 4351 | 685 | 84.7 | globlastp |
| LNU953_H131 | poplar\|13v1\|BU820987_P1 | 2380 | 4352 | 685 | 84.6 | globlastp |
| LNU953_H40 | aquilegia\|10v2\|DR913332_P1 | 2381 | 4353 | 685 | 84.6 | globlastp |
| LNU953_H41 | flaveria\|11v1\|SRR149229.10069_P1 | 2382 | 4354 | 685 | 84.6 | globlastp |
| LNU953_H42 | trigonella\|11v1\|SRR066194X163258 | 2383 | 4355 | 685 | 84.59 | glotblastn |
| LNU953_H43 | abies\|11v2\|SRR098676X111217_P1 | 2384 | 4356 | 685 | 84.5 | globlastp |
| LNU953_H44 | eucalyptus\|11v2\|CD668448_P1 | 2385 | 4357 | 685 | 84.5 | globlastp |
| LNU953_H45 | flaveria\|11v1\|SRR149229.216232_P1 | 2386 | 4358 | 685 | 84.5 | globlastp |
| LNU953_H46 | grape\|11v1\|GSVIVT01034603001_P1 | 2387 | 4359 | 685 | 84.5 | globlastp |
| LNU953_H47 | euphorbia\|11v1\|DV127429_T1 | 2388 | 4360 | 685 | 84.49 | glotblastn |
| LNU953_H48 | sunflower\|12v1\|CX947317 | 2389 | 4361 | 685 | 84.4 | globlastp |
| LNU953_H49 | beech\|11v1\|SRR006293.655_T1 | 2390 | 4362 | 685 | 84.33 | glotblastn |
| LNU953_H132 | prunus_mume\|13v1\|BU575191_P1 | 2391 | 4363 | 685 | 84.3 | globlastp |
| LNU953_H50 | apple\|11v1\|CN444562_P1 | 2392 | 4364 | 685 | 84.3 | globlastp |
| LNU953_H51 | cassava\|09v1\|CK645234_P1 | 2393 | 4365 | 685 | 84.3 | globlastp |
| LNU953_H52 | clementine\|11v1\|BQ623766_P1 | 2394 | 4366 | 685 | 84.3 | globlastp |
| LNU953_H53 | pine\|10v2\|BF220411_P1 | 2395 | 4367 | 685 | 84.3 | globlastp |
| LNU953_H54 | clementine\|11v1\|CB292767_P1 | 2396 | 4368 | 685 | 84.2 | globlastp |
| LNU953_H55 | cucumber\|09v1\|AM731249_P1 | 2397 | 4369 | 685 | 84.2 | globlastp |
| LNU953_H56 | orange\|11v1\|BQ623766_P1 | 2398 | 4370 | 685 | 84.2 | globlastp |
| LNU953_H57 | aquilegia\|10v2\|DR925985_P1 | 2399 | 4371 | 685 | 84.1 | globlastp |
| LNU953_H58 | banana\|12v1\|ES431466_P1 | 2400 | 4372 | 685 | 84.1 | globlastp |
| LNU953_H133 | castorbean\|12v1\|XM_002524074_P1 | 2401 | 4373 | 685 | 84 | globlastp |
| LNU953_H60 | strawberry\|11v1\|DY674421 | 2402 | 4374 | 685 | 84 | globlastp |
| LNU953_H61 | valeriana\|11v1\|SRR099039X12407 | 2403 | 4375 | 685 | 84 | globlastp |
| LNU953_H62 | ambrosia\|11v1\|SRR346935.108676_T1 | 2404 | 4376 | 685 | 83.96 | glotblastn |
| LNU953_H63 | cotton\|11v1\|BE052039XX1_T1 | 2405 | 4377 | 685 | 83.7 | glotblastn |
| LNU953_H64 | poplar\|10v1\|BU815471 | 2406 | 4378 | 685 | 83.7 | globlastp |
| LNU953_H65 | sunflower\|12v1\|DY931792 | 2407 | 4379 | 685 | 83.7 | globlastp |
| LNU953_H66 | vinca\|11v1\|SRR098690X103474 | 2408 | 4380 | 685 | 83.7 | globlastp |
| LNU953_H134 | prunus_mume\|13v1\|BU041590_P1 | 2409 | 4381 | 685 | 83.2 | globlastp |
| LNU953_H67 | cephalotaxus\|11v1\|SRR064395X106034_P1 | 2410 | 4382 | 685 | 83.2 | globlastp |
| LNU953_H68 | prunus\|10v1\|BU041590 | 2411 | 4383 | 685 | 83.2 | globlastp |
| LNU953_H69 | cacao\|10v1\|CU471848_T1 | 2412 | 4384 | 685 | 82.93 | glotblastn |
| LNU953_H70 | thellungiella_halophilum\|11v1\|BY808976 | 2413 | 4385 | 685 | 82.9 | globlastp |
| LNU953_H135 | prunus_mume\|13v1\|BU573002_P1 | 2414 | 4386 | 685 | 82.7 | globlastp |
| LNU953_H71 | cotton\|11v1\|DT049082_P1 | 2415 | 4387 | 685 | 82.6 | globlastp |
| LNU953_H72 | arabidopsis_lyrata\|09v1\|JGIAL020339_P1 | 2416 | 4388 | 685 | 82.5 | globlastp |
| LNU953_H73 | b_rapa\|11v1\|CX189281_P1 | 2417 | 4389 | 685 | 82.5 | globlastp |
| LNU953_H74 | canola\|11v1\|EE456851_T1 | 2418 | 4390 | 685 | 82.47 | glotblastn |
| LNU953_H75 | eucalyptus\|11v2\|CU402999_P1 | 2419 | 4391 | 685 | 82.4 | globlastp |
| LNU953_H76 | gossypium_raimondii\|12v1\|BF268450_P1 | 2420 | 4392 | 685 | 82.4 | globlastp |
| LNU953_H77 | vinca\|11v1\|SRR098690X106748 | 2421 | 4393 | 685 | 82.33 | glotblastn |
| LNU953_H78 | b_rapa\|11v1\|CD814501_P1 | 2422 | 4394 | 685 | 82.3 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU953_H79 | chelidonium\|11v1\|SRR084752X101848_P1 | 2423 | 4395 | 685 | 82.3 | globlastp |
| LNU953_H80 | grape\|11v1\|GSVIVT01022498001_T1 | 2424 | 4396 | 685 | 82.27 | globlastn |
| LNU953_H81 | b_rapa\|11v1\|CD818738_P1 | 2425 | 4397 | 685 | 82.2 | globlastp |
| LNU953_H82 | canola\|11v1\|EE553419_P1 | 2426 | 4398 | 685 | 82.2 | globlastp |
| LNU953_H83 | flaveria\|11v1\|SRR149229.106289_P1 | 2427 | 4399 | 685 | 82.2 | globlastp |
| LNU953_H84 | arnica\|11v1\|SRR099034X101325_T1 | 2428 | 4400 | 685 | 82.17 | globlastn |
| LNU953_H85 | arabidopsis\|10v1\|AT5G06600_P1 | 2429 | 4401 | 685 | 82.1 | globlastp |
| LNU953_H86 | orange\|11v1\|CB292767_P1 | 2430 | 4402 | 685 | 82.1 | globlastp |
| LNU953_H87 | cucumber\|09v1\|DV737928_T1 | 2431 | 4403 | 685 | 82.05 | globlastn |
| LNU953_H88 | prunus\|10v1\|BU573002 | 2432 | 4404 | 685 | 81.94 | globlastn |
| LNU953_H89 | amorphophallus\|11v2\|SRR089351X103224_T1 | 2433 | 4405 | 685 | 81.91 | globlastn |
| LNU953_H90 | millet\|10v1\|EVO454PM000321_P1 | 2434 | 4406 | 685 | 81.9 | globlastp |
| LNU953_H91 | solanum_phureja\|09v1\|SPHBG123815 | 2435 | 4407 | 685 | 81.9 | globlastp |
| LNU953_H92 | apple\|11v1\|CN495483_T1 | 2436 | 4408 | 685 | 81.72 | globlastn |
| LNU953_H93 | distylium\|11v1\|SRR065077X101856_T1 | 2437 | 4409 | 685 | 81.72 | globlastn |
| LNU953_H136 | monkeyflower\|12v1\|CV519760_P1 | 2438 | 4410 | 685 | 81.7 | globlastp |
| LNU953_H94 | gossypium_raimondii\|12v1\|AI726752_P1 | 2439 | 4411 | 685 | 81.7 | globlastp |
| LNU953_H95 | monkeyflower\|10v1\|GO978886 | 2440 | 4410 | 685 | 81.7 | globlastp |
| LNU953_H96 | silene\|11v1\|SRR096785X10574 | 2441 | 4412 | 685 | 81.7 | globlastp |
| LNU953_H97 | tomato\|11v1\|BG123815 | 2442 | 4413 | 685 | 81.7 | globlastp |
| LNU953_H98 | silene\|11v1\|SRR096785X100325 | 2443 | 4414 | 685 | 81.69 | globlastn |
| LNU953_H99 | poppy\|11v1\|SRR030259.101122_P1 | 2444 | 4415 | 685 | 81.6 | globlastp |
| LNU953_H100 | arabidopsis_lyrata\|09v1\|JGIAL009620_P1 | 2445 | 4416 | 685 | 81.5 | globlastp |
| LNU953_H101 | solanum_phureja\|09v1\|SPHBG626752 | 2446 | 4417 | 685 | 81.5 | globlastp |
| LNU953_H102 | thellungiella_halophilum\|11v1\|BY815359 | 2447 | 4418 | 685 | 81.5 | globlastp |
| LNU953_H103 | poplar\|10v1\|BU820987 | 2448 | 4419 | 685 | 81.41 | globlastn |
| LNU953_H104 | arabidopsis\|10v1\|AT3G11910_P1 | 2449 | 4420 | 685 | 81.4 | globlastp |
| LNU953_H105 | ambrosia\|11v1\|SRR346935.136915_T1 | 2450 | 4421 | 685 | 81.34 | globlastn |
| LNU953_H106 | tomato\|11v1\|AW030110 | 2451 | 4422 | 685 | 81.3 | globlastp |
| LNU953_H107 | tomato\|11v1\|BG626752 | 2452 | 4423 | 685 | 81.3 | globlastp |
| LNU953_H108 | valeriana\|11v1\|SRR099039X102728 | 2453 | 4424 | 685 | 81.21 | globlastn |
| LNU953_H137 | olea\|13v1\|SRR014463X11603D1_P1 | 2454 | 4425 | 685 | 81.2 | globlastp |
| LNU953_H109 | thellungiella_parvulum\|11v1\|BY815359 | 2455 | 4426 | 685 | 81.2 | globlastp |
| LNU953_H138 | nicotiana_benthamiana\|12v1\|AM816011_P1 | 2456 | 4427 | 685 | 81.1 | globlastp |
| LNU953_H110 | eucalyptus\|11v2\|SRR001659X101826_P1 | 2457 | 4428 | 685 | 81.1 | globlastp |
| LNU953_H111 | thellungiella_parvulum\|11v1\|BY808976 | 2458 | 4429 | 685 | 81.1 | globlastp |
| LNU953_H112 | poppy\|11v1\|SRR030259.122982_P1 | 2459 | 4430 | 685 | 81 | globlastp |
| LNU953_H113 | ambrosia\|11v1\|SRR346935.109483_T1 | 2460 | 4431 | 685 | 80.99 | globlastn |
| LNU953_H114 | cacao\|10v1\|CU631250_T1 | 2461 | 4432 | 685 | 80.94 | globlastn |
| LNU953_H139 | chickpea\|13v2\|GR398757_P1 | 2462 | 4433 | 685 | 80.9 | globlastp |
| LNU953_H140 | nicotiana_benthamiana\|12v1\|BP749195_P1 | 2463 | 4434 | 685 | 80.9 | globlastp |
| LNU953_H115 | spruce\|11v1\|EX356361 | 2464 | 4435 | 685 | 80.87 | globlastn |
| LNU953_H116 | taxus\|10v1\|SRR032523S0002905 | 2465 | 4436 | 685 | 80.84 | globlastn |
| LNU953_H117 | cannabis\|12v1\|GR221441_P1 | 2466 | 4437 | 685 | 80.8 | globlastp |
| LNU953_H118 | valeriana\|11v1\|SRR099039X102263 | 2467 | 4438 | 685 | 80.62 | globlastn |
| LNU953_H119 | canola\|11v1\|EE446069_P1 | 2468 | 4439 | 685 | 80.5 | globlastp |
| LNU953_H120 | rice\|11v1\|BE230378 | 2469 | 4440 | 685 | 80.5 | globlastp |
| LNU953_H141 | nicotiana_benthamiana\|12v1\|BP748980_P1 | 2470 | 4441 | 685 | 80.4 | globlastp |
| LNU953_H142 | nicotiana_benthamiana\|12v1\|EG649585_P1 | 2471 | 4442 | 685 | 80.4 | globlastp |
| LNU953_H143 | olea\|13v1\|SRR014463X13706D1_P1 | 2472 | 4443 | 685 | 80.4 | globlastp |
| LNU953_H144 | switchgrass\|12v1\|FE629023_P1 | 2473 | 4444 | 685 | 80.3 | globlastp |
| LNU953_H145 | nicotiana_benthamiana\|12v1\|EB682588_T1 | 2474 | 4445 | 685 | 80.28 | globlastn |
| LNU953_H121 | brachypodium\|12v1\|BRADI1G56780_P1 | 2475 | 4446 | 685 | 80.2 | globlastp |
| LNU953_H122 | rye\|12v1\|DRR001012.10357 | 2476 | 4447 | 685 | 80.2 | globlastp |
| LNU953_H123 | amorphophallus\|11v2\|SRR089351X111618_T1 | 2477 | 4448 | 685 | 80.14 | globlastn |
| LNU953_H124 | pine\|10v2\|AW043162_P1 | 2478 | 4449 | 685 | 80.1 | globlastp |
| LNU953_H125 | pseudotsuga\|10v1\|SRR065119S0024421 | 2479 | 4450 | 685 | 80.05 | globlastn |
| LNU955_H12 | switchgrass\|12v1\|DN142337_P1 | 2480 | 4451 | 687 | 92 | globlastp |
| LNU955_H1 | maize\|10v1\|CO522570_P1 | 2481 | 4452 | 687 | 91.5 | globlastp |
| LNU955_H2 | foxtail_millet\|11v3\|PHY7SI021896M_P1 | 2482 | 4453 | 687 | 90.5 | globlastp |
| LNU955_H3 | switchgrass\|gb167\|FL785019 | 2483 | 4454 | 687 | 86.7 | globlastp |
| LNU955_H13 | switchgrass\|12v1\|FL785019_P1 | 2484 | 4455 | 687 | 86.3 | globlastp |
| LNU955_H4 | rice\|11v1\|CB665557 | 2485 | 4456 | 687 | 85.1 | globlastp |
| LNU955_H5 | oat\|11v1\|GR314727_P1 | 2486 | 4457 | 687 | 84.3 | globlastp |
| LNU955_H14 | switchgrass\|12v1\|SRR187771.727771_T1 | 2487 | 4458 | 687 | 83.85 | globlastn |
| LNU955_H6 | wheat\|12v3\|CA625652 | 2488 | 4459 | 687 | 83.8 | globlastp |
| LNU955_H7 | barley\|12v1\|BQ659205 | 2489 | 4460 | 687 | 83.2 | globlastp |
| LNU955_H8 | brachypodium\|12v1\|BRADI4G06410_P1 | 2490 | 4461 | 687 | 83 | globlastp |
| LNU955_H9 | rye\|12v1\|DRR001012.117807 | 2491 | 4462 | 687 | 82.8 | globlastp |
| LNU955_H10 | millet\|10v1\|PMSLX0023357D2_P1 | 2492 | 4463 | 687 | 81.8 | globlastp |
| LNU955_H15 | switchgrass\|12v1\|FL853651_P1 | 2493 | 4464 | 687 | 81.7 | globlastp |
| LNU955_H11 | foxtail_millet\|11v3\|PHY7SI021894M_P1 | 2494 | 4465 | 687 | 81.1 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU955_H16 | switchgrass\|12v1\|FL758990_P1 | 2495 | 4466 | 687 | 80.4 | globlastp |
| LNU957_H1 | maize\|10v1\|BI388870_P1 | 2496 | 4467 | 689 | 85.6 | globlastp |
| LNU957_H2 | foxtail_millet\|11v3\|EC613819_T1 | 2497 | 4468 | 689 | 82.08 | glotblastn |
| LNU958_H1 | maize\|10v1\|DR801342_P1 | 2498 | 4469 | 690 | 91 | globlastp |
| LNU958_H8 | switchgrass\|12v1\|FL952819_P1 | 2499 | 4470 | 690 | 88.1 | globlastp |
| LNU958_H2 | foxtail_millet\|11v3\|PHY7SI022391M_P1 | 2500 | 4471 | 690 | 86.6 | globlastp |
| LNU958_H3 | barley\|12v1\|BF623458_P1 | 2501 | 4472 | 690 | 82.1 | globlastp |
| LNU958_H4 | rye\|12v1\|DRR001012.18630 | 2502 | 4473 | 690 | 81.8 | globlastp |
| LNU958_H5 | brachypodium\|12v1\|BRADI4G01370_P1 | 2503 | 4474 | 690 | 81.7 | globlastp |
| LNU958_H6 | oat\|11v1\|GR331570_P1 | 2504 | 4475 | 690 | 81.7 | globlastp |
| LNU958_H9 | switchgrass\|12v1\|SRR187769.180209_P1 | 2505 | 4476 | 690 | 81.2 | globlastp |
| LNU958_H7 | rice\|11v1\|C73705 | 2506 | 4477 | 690 | 80.9 | globlastp |
| LNU959_H1 | foxtail_millet\|11v3\|SOLX00016974_P1 | 2507 | 4478 | 691 | 80.6 | globlastp |
| LNU959_H2 | sugarcane\|10v1\|CA183011 | 2508 | 4479 | 691 | 80.1 | globlastp |
| LNU961_H1 | maize\|10v1\|CF631183_P1 | 2509 | 4480 | 693 | 92.2 | globlastp |
| LNU961_H8 | switchgrass\|12v1\|FE655607_T1 | 2510 | 4481 | 693 | 91.32 | glotblastn |
| LNU961_H2 | foxtail_millet\|11v3\|PHY7SI022987M_P1 | 2511 | 4482 | 693 | 89.4 | globlastp |
| LNU961_H3 | switchgrass\|gb167\|FE655607 | 2512 | 4483 | 693 | 88.1 | globlastp |
| LNU961_H4 | wheat\|12v3\|CA662505 | 2513 | 4484 | 693 | 81.7 | globlastp |
| LNU961_H5 | oat\|11v1\|GR320475_P1 | 2514 | 4485 | 693 | 81.3 | globlastp |
| LNU961_H6 | brachypodium\|12v1\|BRADI2G18310_P1 | 2515 | 4486 | 693 | 81.1 | globlastp |
| LNU961_H7 | rice\|11v1\|C24906 | 2516 | 4487 | 693 | 80.8 | globlastp |
| LNU963_H1 | maize\|10v1\|BE238751_P1 | 2517 | 4488 | 695 | 96.4 | globlastp |
| LNU963_H2 | foxtail_millet\|11v3\|EC613777_P1 | 2518 | 4489 | 695 | 95.4 | globlastp |
| LNU963_H4 | switchgrass\|12v1\|FE650575_P1 | 2519 | 4490 | 695 | 90.1 | globlastp |
| LNU963_H3 | rice\|11v1\|AA752580 | 2520 | 4491 | 695 | 86 | globlastp |
| LNU964_H1 | maize\|10v1\|BE051847_P1 | 2521 | 4492 | 696 | 95 | globlastp |
| LNU964_H12 | switchgrass\|12v1\|FL715928_P1 | 2522 | 4493 | 696 | 94.6 | globlastp |
| LNU964_H2 | foxtail_millet\|11v3\|PHY7SI008583M_P1 | 2523 | 4494 | 696 | 93.5 | globlastp |
| LNU964_H3 | rice\|11v1\|CA753376 | 2524 | 4495 | 696 | 91.9 | globlastp |
| LNU964_H4 | brachypodium\|12v1\|BRADI1G36570_P1 | 2525 | 4496 | 696 | 90.6 | globlastp |
| LNU964_H5 | wheat\|12v3\|CA593860 | 2526 | 4497 | 696 | 90 | globlastp |
| LNU964_H6 | switchgrass\|gb167\|FL715928 | 2527 | 4498 | 696 | 88.91 | glotblastn |
| LNU964_H7 | millet\|10v1\|EVO454PM024076_P1 | 2528 | 4499 | 696 | 84.1 | globlastp |
| LNU964_H8 | rye\|12v1\|DRR001012.11081 | 2529 | 4500 | 696 | 83.98 | glotblastn |
| LNU964_H9 | sorghum\|12v1\|SB04G006930 | 2530 | 4501 | 696 | 81.2 | globlastp |
| LNU964_H10 | rice\|11v1\|CB096675 | 2531 | 4502 | 696 | 80.87 | glotblastn |
| LNU964_H13 | switchgrass\|12v1\|FL988009_T1 | 2532 | 4503 | 696 | 80.64 | glotblastn |
| LNU964_H11 | foxtail_millet\|11v3\|PHY7SI017454M_P1 | 2533 | 4504 | 696 | 80.4 | globlastp |
| LNU965_H1 | sugarcane\|10v1\|BQ533054 | 2534 | 4505 | 697 | 91.8 | globlastp |
| LNU965_H2 | maize\|10v1\|T12687_P1 | 2535 | 4506 | 697 | 86.8 | globlastp |
| LNU965_H5 | switchgrass\|12v1\|FE648444_P1 | 2536 | 4507 | 697 | 82.3 | globlastp |
| LNU965_H3 | switchgrass\|gb167\|FE648444 | 2537 | 4507 | 697 | 82.3 | globlastp |
| LNU965_H4 | foxtail_millet\|11v3\|EC612769_P1 | 2538 | 4508 | 697 | 81.6 | globlastp |
| LNU965_H6 | switchgrass\|12v1\|FL899717_T1 | 2539 | 4509 | 697 | 80.07 | glotblastn |
| LNU966_H1 | foxtail_millet\|11v3\|EC612437_P1 | 2540 | 4510 | 698 | 90 | globlastp |
| LNU966_H7 | switchgrass\|12v1\|FL704069_P1 | 2541 | 4511 | 698 | 88 | globlastp |
| LNU966_H2 | brachypodium\|12v1\|BRADI1G32350_P1 | 2542 | 4512 | 698 | 82.4 | globlastp |
| LNU966_H3 | rye\|12v1\|DRR001012.705384 | 2543 | 4513 | 698 | 80.82 | glotblastn |
| LNU966_H4 | rye\|12v1\|DRR001012.277281 | 2544 | 4514 | 698 | 80.46 | glotblastn |
| LNU966_H5 | wheat\|12v3\|CD934973 | 2545 | 4515 | 698 | 80.46 | glotblastn |
| LNU966_H6 | rice\|11v1\|BI808003 | 2546 | 4516 | 698 | 80.4 | globlastp |
| LNU967_H1 | maize\|10v1\|CD001313_P1 | 2547 | 4517 | 699 | 90.5 | globlastp |
| LNU967_H2 | foxtail_millet\|11v3\|PHY7SI005990M_P1 | 2548 | 4518 | 699 | 83.3 | globlastp |
| LNU970_H1 | soybean\|11v1\|GLYMA10G05870 | 2549 | 4519 | 702 | 98.2 | globlastp |
| LNU970_H64 | soybean\|12v1\|GLYMA10G05870_P1 | 2550 | 4520 | 702 | 95.6 | globlastp |
| LNU970_H2 | cowpea\|12v1\|FF384004_P1 | 2551 | 4521 | 702 | 92.3 | globlastp |
| LNU970_H3 | pigeonpea\|11v1\|GW351178_P1 | 2552 | 4522 | 702 | 92 | globlastp |
| LNU970_H65 | bean\|12v2\|CA911706_P1 | 2553 | 4523 | 702 | 91.2 | globlastp |
| LNU970_H4 | bean\|12v1\|CA911706 | 2554 | 4523 | 702 | 91.2 | globlastp |
| LNU970_H5 | peanut\|10v1\|EE126306_P1 | 2555 | 4524 | 702 | 89.1 | globlastp |
| LNU970_H6 | chickpea\|11v1\|SRR133517.113773 | 2556 | 4525 | 702 | 88.3 | globlastp |
| LNU970_H6 | chickpea\|13v2\|SRR133517.113773_P1 | 2557 | 4525 | 702 | 88.3 | globlastp |
| LNU970_H8 | soybean\|12v1\|GLYMA19G36410_P1 | 2558 | 4526 | 702 | 88 | globlastp |
| LNU970_H7 | pigeonpea\|11v1\|SRR054580X124449_P1 | 2559 | 4527 | 702 | 87.2 | globlastp |
| LNU970_H8 | soybean\|11v1\|GLYMA19G36410 | 2560 | 4528 | 702 | 87.2 | globlastp |
| LNU970_H9 | medicago\|12v1\|AW692607_P1 | 2561 | 4529 | 702 | 86.9 | globlastp |
| LNU970_H10 | trigonella\|11v1\|SRR066194X103697 | 2562 | 4530 | 702 | 86.5 | globlastp |
| LNU970_H11 | soybean\|11v1\|GLYMA03G33680 | 2563 | 4531 | 702 | 85.8 | globlastp |
| LNU970_H11 | soybean\|12v1\|GLYMA03G33680_P1 | 2564 | 4531 | 702 | 85.8 | globlastp |
| LNU970_H12 | lotus\|09v1\|AW428709_P1 | 2565 | 4532 | 702 | 85.4 | globlastp |
| LNU970_H13 | poplar\|10v1\|CA927561 | 2566 | 4533 | 702 | 85 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU970_H66 | nicotiana_benthamiana\|12v1\|CK284221_P1 | 2567 | 4534 | 702 | 84.3 | globlastp |
| LNU970_H14 | cacao\|10v1\|CU479946_P1 | 2568 | 4535 | 702 | 84.3 | globlastp |
| LNU970_H15 | grape\|11v1\|GSVIVT01025656001_P1 | 2569 | 4536 | 702 | 84.3 | globlastp |
| LNU970_H16 | nicotiana_benthamiana\|gb162\|CK284221 | 2570 | 4534 | 702 | 84.3 | globlastp |
| LNU970_H67 | poplar\|13v1\|CA927561_P1 | 2571 | 4537 | 702 | 83.9 | globlastp |
| LNU970_H17 | catharanthus\|11v1\|EG556643_P1 | 2572 | 4538 | 702 | 83.9 | globlastp |
| LNU970_H18 | apple\|11v1\|CN580810_P1 | 2573 | 4539 | 702 | 83.6 | globlastp |
| LNU970_H19 | chestnut\|gb170\|SRR006295S0024406_P1 | 2574 | 4540 | 702 | 83.6 | globlastp |
| LNU970_H68 | castorbean\|12v1\|EG692405_P1 | 2575 | 4541 | 702 | 83.3 | globlastp |
| LNU970_H21 | clementine\|11v1\|CF504408_P1 | 2576 | 4542 | 702 | 83.2 | globlastp |
| LNU970_H22 | oak\|10v1\|FP025429_P1 | 2577 | 4543 | 702 | 83.2 | globlastp |
| LNU970_H23 | orange\|11v1\|CF504408_P1 | 2578 | 4542 | 702 | 83.2 | globlastp |
| LNU970_H24 | scabiosa\|11v1\|SRR063723X10102 | 2579 | 4544 | 702 | 83.2 | globlastp |
| LNU970_H25 | beech\|11v1\|SRR006293.15215_T1 | 2580 | 4545 | 702 | 82.91 | glotblastn |
| LNU970_H69 | prunus_mume\|13v1\|DN553660_P1 | 2581 | 4546 | 702 | 82.9 | globlastp |
| LNU970_H70 | nicotiana_benthamiana\|12v1\|EH664749_P1 | 2582 | 4547 | 702 | 82.8 | globlastp |
| LNU970_H71 | olea\|13v1\|SRR014463X18544D1_P1 | 2583 | 4548 | 702 | 82.8 | globlastp |
| LNU970_H26 | amsonia\|11v1\|SRR098688X105338_P1 | 2584 | 4549 | 702 | 82.8 | globlastp |
| LNU970_H27 | liquorice\|gb171\|FS241348_P1 | 2585 | 4550 | 702 | 82.8 | globlastp |
| LNU970_H28 | poplar\|10v1\|AI163995 | 2586 | 4551 | 702 | 82.8 | globlastp |
| LNU970_H28 | poplar\|13v1\|AI163995_P1 | 2587 | 4552 | 702 | 82.8 | globlastp |
| LNU970_H29 | tabernaemontana\|11v1\|SRR098689X105363 | 2588 | 4553 | 702 | 82.8 | globlastp |
| LNU970_H30 | strawberry\|11v1\|CO380524 | 2589 | 4554 | 702 | 82.6 | globlastp |
| LNU970_H72 | nicotiana_benthamiana\|12v1\|EB425526_P1 | 2590 | 4555 | 702 | 82.5 | globlastp |
| LNU970_H31 | blueberry\|12v1\|SRR353282X4041D1_P1 | 2591 | 4556 | 702 | 82.5 | globlastp |
| LNU970_H32 | eucalyptus\|11v2\|CT980284_P1 | 2592 | 4557 | 702 | 82.5 | globlastp |
| LNU970_H33 | lotus\|09v1\|DC596145_P1 | 2593 | 4558 | 702 | 82.5 | globlastp |
| LNU970_H34 | prunus\|10v1\|CN580810 | 2594 | 4559 | 702 | 82.2 | globlastp |
| LNU970_H35 | tobacco\|gb162\|EB425526 | 2595 | 4560 | 702 | 82.1 | globlastp |
| LNU970_H36 | tripterygium\|11v1\|SRR098677X12467 | 2596 | 4561 | 702 | 82.1 | globlastp |
| LNU970_H37 | momordica\|10v1\|SRR071315S0003149_P1 | 2597 | 4562 | 702 | 81.8 | globlastp |
| LNU970_H38 | nasturtium\|11v1\|SRR032558.101335_P1 | 2598 | 4563 | 702 | 81.8 | globlastp |
| LNU970_H39 | cleome_spinosa\|10v1\|GR933144_T1 | 2599 | 4564 | 702 | 81.75 | glotblastn |
| LNU970_H40 | cotton\|11v1\|AW186771_P1 | 2600 | 4565 | 702 | 81.6 | globlastp |
| LNU970_H73 | olea\|13v1\|SRR014463X10063D1_P1 | 2601 | 4566 | 702 | 81.4 | globlastp |
| LNU970_H41 | valeriana\|11v1\|SRR099039X116523 | 2602 | 4567 | 702 | 81.4 | globlastp |
| LNU970_H42 | watermelon\|11v1\|AM726470 | 2603 | 4568 | 702 | 81.4 | globlastp |
| LNU970_H43 | gossypium_raimondii\|12v1\|AW186771_P1 | 2604 | 4569 | 702 | 81.2 | globlastp |
| LNU970_H44 | euonymus\|11v1\|SRR070038X13639_P1 | 2605 | 4570 | 702 | 81.1 | globlastp |
| LNU970_H45 | euonymus\|11v1\|SRR070038X296196_P1 | 2606 | 4571 | 702 | 81.1 | globlastp |
| LNU970_H46 | triphysaria\|10v1\|DR170439 | 2607 | 4572 | 702 | 81.1 | globlastp |
| LNU970_H47 | cassava\|09v1\|JGICASSAVA23572VALIDM1_P1 | 2608 | 4573 | 702 | 81 | globlastp |
| LNU970_H48 | kiwi\|gb166\|FG404513_P1 | 2609 | 4574 | 702 | 81 | globlastp |
| LNU970_H49 | solanum_phureja\|09v1\|SPHBG135560 | 2610 | 4575 | 702 | 81 | globlastp |
| LNU970_H50 | cotton\|11v1\|CO081144_P1 | 2611 | 4576 | 702 | 80.9 | globlastp |
| LNU970_H51 | gossypium_raimondii\|12v1\|AI728093_P1 | 2612 | 4577 | 702 | 80.9 | globlastp |
| LNU970_H52 | medicago\|12v1\|CA990040_P1 | 2613 | 4578 | 702 | 80.7 | globlastp |
| LNU970_H53 | tomato\|11v1\|BG135560 | 2614 | 4579 | 702 | 80.7 | globlastp |
| LNU970_H54 | vinca\|11v1\|SRR098690X104684 | 2615 | 4580 | 702 | 80.7 | globlastp |
| LNU970_H55 | ambrosia\|11v1\|SRR346935.110771_P1 | 2616 | 4581 | 702 | 80.4 | globlastp |
| LNU970_H56 | cotton\|11v1\|AI728093_P1 | 2617 | 4582 | 702 | 80.4 | globlastp |
| LNU970_H57 | guizotia\|10v1\|GE557045_P1 | 2618 | 4583 | 702 | 80.4 | globlastp |
| LNU970_H58 | sunflower\|12v1\|DY912319 | 2619 | 4584 | 702 | 80.4 | globlastp |
| LNU970_H59 | coffea\|10v1\|DV663991_P1 | 2620 | 4585 | 702 | 80.3 | globlastp |
| LNU970_H60 | cucurbita\|11v1\|SRR091276X125648_P1 | 2621 | 4586 | 702 | 80.3 | globlastp |
| LNU970_H61 | cucumber\|09v1\|AM726470_T1 | 2622 | 4587 | 702 | 80.29 | glotblastn |
| LNU970_H62 | sunflower\|12v1\|CD856036 | 2623 | 4588 | 702 | 80.1 | globlastp |
| LNU970_H63 | cynara\|gb167\|GE590124_P1 | 2624 | 4589 | 702 | 80 | globlastp |
| LNU971_H1 | tomato\|11v1\|AI487766 | 2625 | 4590 | 703 | 91.9 | globlastp |
| LNU971_H2 | tomato\|11v1\|BG132158 | 2626 | 4591 | 703 | 91.7 | globlastp |
| LNU971_H3 | tomato\|11v1\|BG589613 | 2627 | 4591 | 703 | 91.7 | globlastp |
| LNU971_H4 | solanum_phureja\|09v1\|SPHAI487915 | 2628 | 4592 | 703 | 89.5 | glotblastn |
| LNU971_H5 | tomato\|11v1\|AW218573 | 2629 | 4593 | 703 | 89.41 | glotblastn |
| LNU971_H6 | solanum_phureja\|09v1\|SPHAI777070 | 2630 | 4594 | 703 | 87.66 | globlastp |
| LNU971_H7 | solanum_phureja\|09v1\|SPHDN168697 | 2631 | 4594 | 703 | 87.66 | globlastp |
| LNU971_H8 | solanum_phureja\|09v1\|SPHBG125614 | 2632 | 4595 | 703 | 87.5 | globlastp |
| LNU971_H9 | tomato\|11v1\|AI777070 | 2633 | 4596 | 703 | 86.8 | globlastp |
| LNU971_H10 | potato\|10v1\|BQ514990_T1 | 2634 | 4597 | 703 | 86.36 | glotblastn |
| LNU971_H11 | solanum_phureja\|09v1\|SPHAI772789 | 2635 | 4598 | 703 | 86.31 | glotblastn |
| LNU971_H12 | solanum_phureja\|09v1\|SPHBI431905 | 2636 | 4599 | 703 | 85.71 | glotblastn |
| LNU971_H13 | potato\|10v1\|BI431905_P1 | 2637 | 4600 | 703 | 85.5 | globlastp |
| LNU971_H14 | potato\|10v1\|CV475926_T1 | 2638 | 4601 | 703 | 85.47 | glotblastn |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU971_H15 | solanum_phureja\|09v1\|SPHBG132158 | 2639 | 4602 | 703 | 85.4 | globlastp |
| LNU971_H16 | solanum_phureja\|09v1\|SPHAI776714 | 2640 | 4603 | 703 | 85.3 | globlastp |
| LNU971_H17 | eggplant\|10v1\|FS009193_P1 | 2641 | 4604 | 703 | 84 | globlastp |
| LNU971_H18 | potato\|10v1\|BG589613_P1 | 2642 | 4605 | 703 | 83.8 | globlastp |
| LNU971_H19 | tomato\|11v1\|SRR027939S0232941 | 2643 | 4606 | 703 | 82.9 | globlastp |
| LNU971_H22 | nicotiana_benthamiana\|12v1\|AM836977_T1 | 2644 | 4607 | 703 | 82.13 | glotblastn |
| LNU971_H20 | tomato\|11v1\|BG125614 | 2645 | 4608 | 703 | 81.5 | globlastp |
| LNU971_H21 | pepper\|12v1\|BM061037_P1 | 2646 | 4609 | 703 | 80.9 | globlastp |
| LNU972_H2 | nicotiana_benthamiana\|12v1\|EB699638_P1 | 2647 | 4610 | 704 | 91.4 | globlastp |
| LNU975_H1 | solanum_phureja\|09v1\|SPHBI422101 | 2648 | 4611 | 705 | 85.2 | glotblastn |
| LNU975_H2 | solanum_phureja\|09v1\|SPHAI896166_T1 | 2649 | 4612 | 705 | 80.17 | glotblastn |
| LNU976_H1 | pseudoroegneria\|gb167\|FF347407 | 2650 | 4613 | 706 | 93.2 | globlastp |
| LNU976_H2 | rye\|12v1\|DRR001012.364991 | 2651 | 4614 | 706 | 91.47 | glotblastn |
| LNU976_H3 | leymus\|gb166\|CD808542_P1 | 2652 | 4615 | 706 | 89.9 | globlastp |
| LNU977_H2 | wheat\|12v3\|BM137333 | 2653 | 4616 | 707 | 86.1 | globlastp |
| LNU977_H10 | rice\|11v1\|C91689_P1 | 2654 | 4617 | 707 | 81.5 | globlastp |
| LNU977_H11 | sorghum\|12v1\|SB01G048800_P1 | 2655 | 4618 | 707 | 80.7 | globlastp |
| LNU977_H12 | maize\|10v1\|CO519634_T1 | 2656 | 4619 | 707 | 80.23 | glotblastn |
| LNU750_H1 | wheat\|12v3\|BQ744292 | 2657 | 4620 | 713 | 89.2 | globlastp |
| LNU750_H2 | rye\|12v1\|DRR001012.14416 | 2658 | 4621 | 713 | 88.8 | globlastp |
| LNU771_H1 | wheat\|12v3\|BM068568 | 2659 | 4622 | 715 | 96.7 | globlastp |
| LNU771_H2 | rye\|12v1\|DRR001013.372156 | 2660 | 4623 | 715 | 87.38 | glotblastn |
| LNU771_H3 | wheat\|12v3\|BE426855 | 2661 | 4624 | 715 | 84.3 | globlastp |
| LNU771_H4 | fescue\|gb161\|DT701171_P1 | 2662 | 4625 | 715 | 84 | globlastp |
| LNU771_H5 | rye\|12v1\|DRR001012.320596 | 2663 | 4626 | 715 | 82.4 | globlastp |
| LNU771_H6 | rye\|12v1\|DRR001017.1352396 | 2664 | 4627 | 715 | 81.6 | globlastp |
| LNU772_H7 | lolium\|10v1\|EY457993_T1 | 2665 | 4628 | 716 | 91.41 | glotblastn |
| LNU772_H12 | sorghum\|12v1\|CD209835 | 2666 | 4629 | 716 | 87.5 | glotblastn |
| LNU785_H1 | rye\|12v1\|DRR001012.10208 | 2667 | 4630 | 717 | 95.63 | glotblastn |
| LNU785_H2 | wheat\|12v3\|CA653207 | 2668 | 4631 | 717 | 89.2 | globlastp |
| LNU786_H1 | wheat\|12v3\|BJ222677 | 2669 | 4632 | 718 | 94.89 | glotblastn |
| LNU786_H2 | rye\|12v1\|DRR001012.114677 | 2670 | 4633 | 718 | 93.69 | glotblastn |
| LNU786_H4 | brachypodium\|12v1\|BRADI3G52470_T1 | 2671 | 4634 | 718 | 86.3 | glotblastn |
| LNU786_H5 | wheat\|12v3\|SRR400820X100908D1 | 2672 | 4635 | 718 | 84.9 | glotblastn |
| LNU786_H6 | wheat\|12v3\|CA500094 | 2673 | 4636 | 718 | 83.88 | glotblastn |
| LNU786_H7 | rice\|11v1\|AU062764 | 2674 | 4637 | 718 | 81.85 | glotblastn |
| LNU786_H8 | maize\|10v1\|AW076421_T1 | 2675 | 4638 | 718 | 81.29 | glotblastn |
| LNU786_H9 | foxtail_millet\|11v3\|PHY7SI016091M_T1 | 2676 | 4639 | 718 | 81.18 | glotblastn |
| LNU786_H10 | sorghum\|12v1\|SB04G030880 | 2677 | 4640 | 718 | 80.7 | glotblastn |
| LNU786_H11 | switchgrass\|12v1\|FL710092_T1 | 2678 | 4641 | 718 | 80.05 | glotblastn |
| LNU787_H5 | sorghum\|12v1\|SB10G022920 | 2679 | 4642 | 719 | 85.9 | globlastp |
| LNU787_H15 | switchgrass\|12v1\|GD039082_T1 | 2680 | 4643 | 719 | 83.45 | glotblastn |
| LNU806_H3 | rice\|11v1\|CI312268 | 2681 | 4644 | 721 | 84.1 | glotblastn |
| LNU806_H4 | brachypodium\|12v1\|BRADI3G14530_T1 | 2682 | 4645 | 721 | 83.18 | glotblastn |
| LNU806_H5 | rye\|12v1\|DRR001012.245949 | 2683 | 4646 | 721 | 80.43 | glotblastn |
| LNU806_H6 | wheat\|12v3\|CA745011 | 2684 | 4647 | 721 | 80.43 | glotblastn |
| LNU837_H8 | switchgrass\|12v1\|FL706711_T1 | 2685 | 4648 | 722 | 87.5 | glotblastn |
| LNU837_H4 | foxtail_millet\|11v3\|PHY7SI036733M_T1 | 2686 | 4649 | 722 | 83.33 | glotblastn |
| LNU837_H9 | switchgrass\|12v1\|FL875810_T1 | 2687 | 4650 | 722 | 82.29 | glotblastn |
| LNU837_H5 | switchgrass\|gb167\|FL706712 | 2688 | 4651 | 722 | 82.29 | glotblastn |
| LNU837_H10 | switchgrass\|12v1\|FL893419_T1 | 2689 | 4652 | 722 | 81.25 | glotblastn |
| LNU837_H6 | switchgrass\|gb167\|FL696926 | 2690 | 4653 | 722 | 81.25 | glotblastn |
| LNU837_H11 | switchgrass\|12v1\|FL696926_T1 | 2691 | 4654 | 722 | 80.21 | glotblastn |
| LNU837_H7 | millet\|10v1\|EVO454PM106715_T1 | 2692 | 4655 | 722 | 80.21 | glotblastn |
| LNU856_H1 | foxtail_millet\|11v3\|PHY7SI006280M_P1 | 2693 | 4656 | 726 | 91.5 | globlastp |
| LNU856_H3 | millet\|10v1\|CD725559_P1 | 2694 | 4657 | 726 | 90.5 | globlastp |
| LNU856_H4 | sorghum\|12v1\|SB05G003390 | 2695 | 4658 | 726 | 90.3 | globlastp |
| LNU856_H5 | foxtail_millet\|11v3\|PHY7SI017030M_P1 | 2696 | 4659 | 726 | 89.1 | globlastp |
| LNU856_H12 | switchgrass\|12v1\|FL749250_P1 | 2697 | 4660 | 726 | 88.9 | globlastp |
| LNU856_H6 | maize\|10v1\|BM895627_P1 | 2698 | 4661 | 726 | 87.9 | globlastp |
| LNU856_H8 | rice\|11v1\|BI811616 | 2699 | 4662 | 726 | 84.2 | globlastp |
| LNU856_H9 | brachypodium\|12v1\|BRADI1G43000_P1 | 2700 | 4663 | 726 | 82.4 | globlastp |
| LNU856_H10 | brachypodium\|12v1\|BRADI2G09570_P1 | 2701 | 4664 | 726 | 80.7 | globlastp |
| LNU856_H11 | barley\|12v1\|BI949641_T1 | 2702 | 4665 | 726 | 80.08 | glotblastn |
| LNU862_H10 | sugarcane\|10v1\|CA147410 | 2703 | 4666 | 728 | 84.3 | globlastp |
| LNU862_H13 | maize\|10v1\|BU037296_P1 | 2704 | 4667 | 728 | 81.9 | globlastp |
| LNU862_H15 | barley\|12v1\|AV921382_T1 | 2705 | 4668 | 728 | 80.84 | glotblastn |
| LNU866_H1 | sorghum\|12v1\|SB12V1CUFF392T1P3 | 2706 | 4669 | 729 | 95 | globlastp |
| LNU866_H2 | maize\|10v1\|AI854982_P1 | 2707 | 4670 | 729 | 88.9 | globlastp |
| LNU866_H3 | foxtail_millet\|11v3\|PHY7SI034627M_P1 | 2708 | 4671 | 729 | 83.2 | globlastp |
| LNU866_H4 | millet\|10v1\|EVO454PM024441_T1 | 2709 | 4672 | 729 | 80.82 | glotblastn |
| LNU870_H1 | foxtail_millet\|11v3\|PHY7SI034640M_P1 | 2710 | 4673 | 730 | 91.1 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU910_H11 | switchgrass\|12v1\|FL927878_T1 | 2711 | 4674 | 736 | 93.48 | glotblastn |
| LNU911_H1 | maize\|10v1\|AI622711_P1 | 2712 | 4675 | 737 | 83.6 | globlastp |
| LNU951_H1 | foxtail_millet\|11v3\|PHY7SI009880M_P1 | 2713 | 4676 | 739 | 82.4 | globlastp |
| LNU951_H2 | switchgrass\|12v1\|FL765313_P1 | 2714 | 4677 | 739 | 80.3 | globlastp |
| LNU956_H1 | sugarcane\|10v1\|BQ533901 | 2715 | 4678 | 741 | 93.94 | glotblastn |
| LNU956_H3 | maize\|10v1\|AW191064_T1 | 2716 | 4679 | 741 | 87.59 | glotblastn |
| LNU956_H9 | switchgrass\|12v1\|FL728285_T1 | 2717 | 4680 | 741 | 82.79 | glotblastn |
| LNU956_H6 | millet\|10v1\|EVO454PM000846_T1 | 2718 | 4681 | 741 | 82.04 | glotblastn |
| LNU956_H7 | rice\|11v1\|AA749599 | 2719 | 4682 | 741 | 81.25 | glotblastn |
| LNU956_H8 | brachypodium\|12v1\|BRADI4G04270_T1 | 2720 | 4683 | 741 | 80 | glotblastn |
| LNU972_H1 | solanum_phureja\|09v1\|SPHAI775263 | 2721 | 4684 | 743 | 96.6 | globlastp |
| LNU977_H8 | wheat\|12v3\|SRR400820X1185207D1 | 2722 | 4685 | 745 | 87.8 | globlastp |
| LNU749_H1 | wheat\|12v3\|BQ905774 | 2723 | 4686 | 747 | 93.4 | globlastp |
| LNU749_H2 | rye\|12v1\|DRR001012.593230 | 2724 | 4687 | 747 | 90.9 | globlastp |
| LNU749_H3 | brachypodium\|12v1\|BRADI4G10110_P1 | 2725 | 4688 | 747 | 81.4 | globlastp |
| LNU752_H1 | rye\|12v1\|DRR001012.165407 | 2726 | 4689 | 748 | 96.9 | globlastp |
| LNU752_H2 | wheat\|12v3\|BE415379 | 2727 | 4690 | 748 | 96.7 | globlastp |
| LNU766_H4 | brachypodium\|12v1\|BRADI1G59210_P1 | 2728 | 4691 | 749 | 90 | globlastp |
| LNU769_H2 | wheat\|12v3\|BE427519 | 2729 | 4692 | 750 | 94.4 | globlastp |
| LNU769_H1 | wheat\|12v3\|BE402340 | 2730 | 4693 | 750 | 94.2 | globlastp |
| LNU769_H3 | wheat\|12v3\|BQ841839 | 2731 | 4694 | 750 | 93.7 | globlastp |
| LNU769_H4 | rye\|12v1\|BE705675 | 2732 | 4695 | 750 | 92.9 | globlastp |
| LNU769_H5 | wheat\|12v3\|CA692455 | 2733 | 4696 | 750 | 92.5 | globlastp |
| LNU769_H6 | rye\|12v1\|DRR001012.119684 | 2734 | 4697 | 750 | 91.9 | globlastp |
| LNU769_H7 | wheat\|12v3\|CD888102 | 2735 | 4698 | 750 | 86.9 | globlastp |
| LNU769_H11 | rice\|11v1\|AU030808 | 2736 | 4699 | 750 | 82.4 | globlastp |
| LNU769_H9 | sorghum\|12v1\|SB09G026980 | 2737 | 4700 | 750 | 82.3 | globlastp |
| LNU769_H10 | foxtail_millet\|11v3\|PHY7SI026215M_P1 | 2738 | 4701 | 750 | 82 | globlastp |
| LNU769_H12 | maize\|10v1\|CD445089_P1 | 2739 | 4702 | 750 | 81.9 | globlastp |
| LNU769_H15 | switchgrass\|12v1\|DN151230_P1 | 2740 | 4703 | 750 | 81.2 | globlastp |
| LNU769_H16 | switchgrass\|12v1\|GD008102_T1 | 2741 | 4704 | 750 | 81.03 | glotblastn |
| LNU773_H6 | sorghum\|12v1\|SB01G001980 | 2742 | 4705 | 751 | 80.6 | globlastp |
| LNU780_H1 | wheat\|12v3\|BM137500 | 2743 | 4706 | 753 | 81.2 | globlastp |
| LNU784_H1 | wheat\|12v3\|BE406457 | 2744 | 4707 | 754 | 84.1 | globlastp |
| LNU784_H2 | rye\|12v1\|DRR001012.297633 | 2745 | 4708 | 754 | 81.7 | globlastp |
| LNU786_H3 | rye\|12v1\|DRR001012.109215 | 2746 | 4709 | 755 | 90.1 | globlastp |
| LNU788_H4 | foxtail_millet\|11v3\|PHY7SI006617M_P1 | 2747 | 4710 | 756 | 83.8 | globlastp |
| LNU804_H1 | foxtail_millet\|11v3\|PHY7SI009871M_P1 | 2748 | 4711 | 758 | 82.5 | globlastp |
| LNU804_H2 | switchgrass\|gb167\|FE603029 | 2749 | 4712 | 758 | 82 | globlastp |
| LNU804_H3 | sorghum\|12v1\|SB06G022510 | 2750 | 4713 | 758 | 80.2 | globlastp |
| LNU804_H4 | sorghum\|12v1\|SB06G022500_P1 | 2751 | 4714 | 758 | 80 | globlastp |
| LNU806_H7 | switchgrass\|12v1\|SRR187768.79981_P1 | 2752 | 4715 | 759 | 88.3 | globlastp |
| LNU806_H8 | switchgrass\|12v1\|DN145288_P1 | 2753 | 4716 | 759 | 87.3 | globlastp |
| LNU806_H1 | sorghum\|12v1\|SB07G002850 | 2754 | 4717 | 759 | 81.3 | globlastp |
| LNU806_H2 | maize\|10v1\|CD966203_P1 | 2755 | 4718 | 759 | 80.6 | globlastp |
| LNU816_H1 | foxtail_millet\|11v3\|GT091139_P1 | 2756 | 4719 | 761 | 95.8 | globlastp |
| LNU816_H2 | sorghum\|12v1\|SB04G029730 | 2757 | 4720 | 761 | 95.7 | globlastp |
| LNU816_H3 | maize\|10v1\|BQ485722_P1 | 2758 | 4721 | 761 | 95.6 | globlastp |
| LNU816_H16 | switchgrass\|12v1\|FL715086_P1 | 2759 | 4722 | 761 | 94.6 | globlastp |
| LNU816_H4 | millet\|10v1\|EVO454PM008535_P1 | 2760 | 4723 | 761 | 94.5 | globlastp |
| LNU816_H7 | rye\|12v1\|BF145541 | 2761 | 4724 | 761 | 87.6 | globlastp |
| LNU816_H8 | barley\|12v1\|AV909829_P1 | 2762 | 4725 | 761 | 86.6 | globlastp |
| LNU816_H17 | switchgrass\|12v1\|FL746777_P1 | 2763 | 4726 | 761 | 83.3 | globlastp |
| LNU816_H9 | wheat\|12v3\|BE400688 | 2764 | 4727 | 761 | 82.5 | globlastp |
| LNU816_H11 | wheat\|12v3\|TAU67717 | 2765 | 4728 | 761 | 82 | globlastp |
| LNU816_H12 | barley\|12v1\|EX595315_P1 | 2766 | 4729 | 761 | 81.8 | globlastp |
| LNU816_H13 | wheat\|12v3\|SRR400820X1008111D1 | 2767 | 4730 | 761 | 80.88 | glotblastn |
| LNU816_H14 | wheat\|12v3\|SRR400820X1034615D1 | 2768 | 4731 | 761 | 80.88 | glotblastn |
| LNU816_H15 | brachypodium\|12v1\|BRADI1G42750_P1 | 2769 | 4732 | 761 | 80.7 | globlastp |
| LNU821_H1 | sorghum\|12v1\|SB02G033100 | 2770 | 4733 | 764 | 95.9 | globlastp |
| LNU821_H2 | foxtail_millet\|11v3\|PHY7SI029452M_P1 | 2771 | 4734 | 764 | 90.7 | globlastp |
| LNU821_H3 | rice\|11v1\|BI808865 | 2772 | 4735 | 764 | 82.3 | globlastp |
| LNU821_H4 | brachypodium\|12v1\|BRADI1G28110T2_P1 | 2773 | 4736 | 764 | 81.1 | globlastp |
| LNU824_H2 | sorghum\|12v1\|SB03G004750 | 2774 | 4737 | 765 | 96.9 | globlastp |
| LNU824_H3 | sugarcane\|10v1\|CA072104 | 2775 | 4737 | 765 | 96.9 | globlastp |
| LNU824_H4 | foxtail_millet\|11v3\|PHY7SI002015M_P1 | 2776 | 4738 | 765 | 95.8 | globlastp |
| LNU824_H6 | switchgrass\|gb167\|FL699463 | 2777 | 4739 | 765 | 95.2 | globlastp |
| LNU824_H52 | switchgrass\|12v1\|FE635824_P1 | 2778 | 4740 | 765 | 94.7 | globlastp |
| LNU824_H7 | rice\|11v1\|U37978 | 2779 | 4741 | 765 | 92.7 | globlastp |
| LNU824_H8 | brachypodium\|12v1\|BRADI2G04130_P1 | 2780 | 4742 | 765 | 91.6 | globlastp |
| LNU824_H9 | barley\|12v1\|BI954198_P1 | 2781 | 4743 | 765 | 91.3 | globlastp |
| LNU824_H10 | fescue\|gb161\|DT698307_P1 | 2782 | 4744 | 765 | 91.3 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU824_H11 | oat\|11v1\|GO582430XX1_P1 | 2783 | 4745 | 765 | 91.3 | globlastp |
| LNU824_H12 | rye\|12v1\|DRR001012.148971 | 2784 | 4743 | 765 | 91.3 | globlastp |
| LNU824_H13 | rye\|12v1\|DRR001012.252020 | 2785 | 4743 | 765 | 91.3 | globlastp |
| LNU824_H14 | rice\|11v1\|AB060277 | 2786 | 4746 | 765 | 91 | globlastp |
| LNU824_H15 | wheat\|12v3\|BE444676 | 2787 | 4747 | 765 | 91 | globlastp |
| LNU824_H16 | rye\|12v1\|DRR001012.21112 | 2788 | 4748 | 765 | 90.73 | glotblastn |
| LNU824_H17 | sorghum\|12v1\|SB09G005010 | 2789 | 4749 | 765 | 89.9 | globlastp |
| LNU824_H53 | switchgrass\|12v1\|DN141584_P1 | 2790 | 4750 | 765 | 89.9 | globlastp |
| LNU824_H18 | foxtail_millet\|11v3\|PHY7SI022491M_P1 | 2791 | 4751 | 765 | 89.6 | globlastp |
| LNU824_H19 | maize\|10v1\|AI783320_P1 | 2792 | 4752 | 765 | 89.6 | globlastp |
| LNU824_H20 | switchgrass\|gb167\|DN141584 | 2793 | 4753 | 765 | 89.6 | globlastp |
| LNU824_H54 | switchgrass\|12v1\|FE599982_P1 | 2794 | 4753 | 765 | 89.6 | globlastp |
| LNU824_H22 | millet\|10v1\|CD725074_P1 | 2795 | 4754 | 765 | 89.3 | globlastp |
| LNU824_H23 | barley\|12v1\|BI959386_P1 | 2796 | 4755 | 765 | 88.8 | globlastp |
| LNU824_H24 | brachypodium\|12v1\|BRADI2G34470_P1 | 2797 | 4756 | 765 | 88.8 | globlastp |
| LNU824_H25 | oat\|11v1\|CN816246_P1 | 2798 | 4757 | 765 | 88.5 | globlastp |
| LNU824_H26 | rye\|12v1\|DRR001012.242642 | 2799 | 4758 | 765 | 88.2 | globlastp |
| LNU824_H31 | rye\|12v1\|DRR001012.153481 | 2800 | 4759 | 765 | 85.7 | globlastp |
| LNU824_H55 | switchgrass\|12v1\|DN145318_P1 | 2801 | 4760 | 765 | 83.7 | globlastp |
| LNU824_H32 | cacao\|10v1\|CU505404_P1 | 2802 | 4761 | 765 | 82.5 | globlastp |
| LNU824_H34 | sugarcane\|10v1\|CA084205 | 2803 | 4762 | 765 | 82.3 | globlastp |
| LNU824_H33 | euonymus\|11v1\|SRR070038X188424_P1 | 2804 | 4763 | 765 | 82.1 | globlastp |
| LNU824_H35 | grape\|11v1\|GSVIVT01024573001_P1 | 2805 | 4764 | 765 | 81.8 | globlastp |
| LNU824_H36 | orange\|11v1\|CF418875_P1 | 2806 | 4765 | 765 | 81.6 | globlastp |
| LNU824_H43 | tripterygium\|11v1\|SRR098677X105610 | 2807 | 4766 | 765 | 81.01 | glotblastn |
| LNU824_H38 | euphorbia\|11v1\|DV129031_P1 | 2808 | 4767 | 765 | 81 | globlastp |
| LNU824_H39 | papaya\|gb165\|EX228132_P1 | 2809 | 4768 | 765 | 81 | globlastp |
| LNU824_H40 | amborella\|12v3\|CK763625_P1 | 2810 | 4769 | 765 | 80.8 | globlastp |
| LNU824_H48 | grape\|11v1\|GSVIVT01032677001_P1 | 2811 | 4770 | 765 | 80.8 | globlastp |
| LNU824_H56 | castorbean\|12v1\|EE260514_P1 | 2812 | 4771 | 765 | 80.8 | globlastp |
| LNU824_H46 | ambrosia\|11v1\|SRR346935.200226_P1 | 2813 | 4772 | 765 | 80.7 | globlastp |
| LNU824_H44 | cotton\|11v1\|CO077706_P1 | 2814 | 4773 | 765 | 80.6 | globlastp |
| LNU824_H45 | gossypium_raimondii\|12v1\|BE054298_P1 | 2815 | 4773 | 765 | 80.6 | globlastp |
| LNU824_H51 | beech\|11v1\|SRR006293.9817_T1 | 2816 | 4774 | 765 | 80.39 | glotblastn |
| LNU824_H50 | cotton\|11v1\|BE054298_P1 | 2817 | 4775 | 765 | 80.3 | globlastp |
| LNU824_H57 | chestnut\|gb170\|SRR006295S0038807_P1 | 2818 | 4776 | 765 | 80.2 | globlastp |
| LNU824_H58 | eucalyptus\|11v2\|CB967757_P1 | 2819 | 4777 | 765 | 80.2 | globlastp |
| LNU824_H59 | amsonia\|11v1\|SRR098688X158094_T1 | 2820 | 4778 | 765 | 80.17 | globlastp |
| LNU829_H2 | maize\|10v1\|SRR014550S0010991_T1 | 2821 | 4779 | 767 | 94.63 | glotblastn |
| LNU829_H3 | sugarcane\|10v1\|CF572667 | 2822 | 4780 | 767 | 94.48 | glotblastn |
| LNU829_H8 | switchgrass\|12v1\|SRR187765.561639_P1 | 2823 | 4781 | 767 | 93.8 | globlastp |
| LNU829_H6 | sorghum\|12v1\|SB12V2PRD006827 | 2824 | 4782 | 767 | 90 | globlastp |
| LNU829_H7 | rice\|11v1\|AF171223 | 2825 | 4783 | 767 | 81.4 | globlastp |
| LNU831_H1 | sorghum\|12v1\|SB01G011000 | 2826 | 4784 | 768 | 84.92 | glotblastn |
| LNU831_H2 | foxtail_millet\|11v3\|PHY7SI036219M_P1 | 2827 | 4785 | 768 | 84.1 | globlastp |
| LNU833_H1 | sorghum\|12v1\|SB02G029650 | 2828 | 4786 | 769 | 91.9 | globlastp |
| LNU833_H3 | foxtail_millet\|11v3\|EC612621_P1 | 2829 | 4787 | 769 | 87 | globlastp |
| LNU847_H1 | trigonella\|11v1\|SRR066194X264388 | 2830 | 4788 | 772 | 94.4 | globlastp |
| LNU847_H2 | soybean\|12v1\|GLYMA17G02680_P1 | 2831 | 4789 | 772 | 83 | globlastp |
| LNU847_H3 | bean\|12v2\|SRR001334.102552_P1 | 2832 | 4790 | 772 | 82 | globlastp |
| LNU847_H4 | soybean\|12v1\|GLYMA07G38020_P1 | 2833 | 4791 | 772 | 80.4 | globlastp |
| LNU858_H3 | maize\|10v1\|BM266633_P1 | 2834 | 4792 | 774 | 93.5 | globlastp |
| LNU858_H4 | maize\|10v1\|AI834674_P1 | 2835 | 4793 | 774 | 90.3 | globlastp |
| LNU858_H1 | foxtail_millet\|11v3\|PHY7SI016470M_P1 | 2836 | 4794 | 774 | 86.9 | globlastp |
| LNU858_H2 | millet\|10v1\|EVO454PM002436_P1 | 2837 | 4795 | 774 | 86.6 | globlastp |
| LNU858_H5 | switchgrass\|12v1\|FE613408_P1 | 2838 | 4796 | 774 | 85.2 | globlastp |
| LNU858_H6 | switchgrass\|12v1\|FL693746_P1 | 2839 | 4797 | 774 | 81.8 | globlastp |
| LNU898_H1 | sorghum\|12v1\|SB04G003360 | 2840 | 4798 | 778 | 94.3 | globlastp |
| LNU898_H2 | foxtail_millet\|11v3\|PHY7SI017281M_P1 | 2841 | 4799 | 778 | 93.7 | globlastp |
| LNU898_H3 | millet\|10v1\|EVO454PM005287_P1 | 2842 | 4800 | 778 | 93.7 | globlastp |
| LNU898_H4 | maize\|10v1\|AI948259_T1 | 2843 | 4801 | 778 | 93.63 | glotblastn |
| LNU898_H5 | maize\|10v1\|BQ538526_P1 | 2844 | 4802 | 778 | 93.2 | globlastp |
| LNU898_H9 | switchgrass\|12v1\|FE615026_P1 | 2845 | 4803 | 778 | 92.5 | globlastp |
| LNU898_H6 | switchgrass\|gb167\|FL699057 | 2846 | 4804 | 778 | 91.84 | glotblastn |
| LNU898_H7 | rice\|11v1\|BE229038 | 2847 | 4805 | 778 | 86 | globlastp |
| LNU898_H8 | brachypodium\|12v1\|BRADI3G03680_P1 | 2848 | 4806 | 778 | 82.9 | globlastp |
| LNU900_H7 | rice\|11v1\|AU083413 | 2849 | 4807 | 779 | 83.4 | globlastp |
| LNU901_H2 | maize\|10v1\|AW244952_P1 | 2850 | 4808 | 780 | 90.1 | globlastp |
| LNU901_H3 | foxtail_millet\|11v3\|PHY7SI001444M_P1 | 2851 | 4809 | 780 | 88.8 | globlastp |
| LNU901_H4 | brachypodium\|12v1\|BRADI2G02560T2_P1 | 2852 | 4810 | 780 | 84.5 | globlastp |
| LNU901_H5 | wheat\|12v3\|BE606820 | 2853 | 4811 | 780 | 83.6 | globlastp |
| LNU901_H8 | rye\|12v1\|BE586835 | 2854 | 4812 | 780 | 82.47 | glotblastn |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/Cluster tag | Polyn. SEQ ID NO: | Polyp. SEQ ID NO: | Hom. To SEQ ID NO: | Global Ident. | Algor. |
|---|---|---|---|---|---|---|
| LNU901_H6 | rice\|11v1\|BI806473 | 2855 | 4813 | 780 | 82.4 | globlastp |
| LNU901_H7 | barley\|12v1\|BI952377_P1 | 2856 | 4814 | 780 | 82.4 | globlastp |
| LNU901_H9 | rye\|12v1\|DRR001012.187398 | 2857 | 4815 | 780 | 81.42 | glotblastn |
| LNU904_H2 | foxtail_millet\|11v3\|EC613499_P1 | 2858 | 4816 | 781 | 82.1 | globlastp |
| LNU906_H1 | maize\|10v1\|AW055628_P1 | 2859 | 4817 | 782 | 88.2 | globlastp |
| LNU906_H2 | maize\|10v1\|BQ703950_P1 | 2860 | 4818 | 782 | 88.2 | globlastp |
| LNU906_H3 | foxtail_millet\|11v3\|PHY7SI000363M_P1 | 2861 | 4819 | 782 | 84 | globlastp |
| LNU909_H2 | foxtail_millet\|11v3\|PHY7SI000744M_P1 | 2862 | 4820 | 784 | 84.6 | globlastp |
| LNU909_H3 | switchgrass\|gb167\|FL723049 | 2863 | 4821 | 784 | 82.21 | glotblastn |
| LNU909_H5 | switchgrass\|12v1\|FL977640_T1 | 2864 | 4822 | 784 | 82.1 | glotblastn |
| LNU909_H4 | millet\|10v1\|EVO454PM008179_P1 | 2865 | 4823 | 784 | 82.1 | globlastp |
| LNU911_H2 | foxtail_millet\|11v3\|PHY7SI000115M_P1 | 2866 | 4824 | 785 | 85.1 | globlastp |
| LNU930_H1 | maize\|10v1\|AW787241_P1 | 2867 | 4825 | 786 | 91.5 | globlastp |
| LNU930_H4 | switchgrass\|12v1\|FL706853_T1 | 2868 | 4826 | 786 | 83.49 | glotblastn |
| LNU930_H2 | switchgrass\|gb167\|FE618499 | 2869 | 4827 | 786 | 82.9 | globlastp |
| LNU930_H5 | switchgrass\|12v1\|FE618499_P1 | 2870 | 4828 | 786 | 82.4 | globlastp |
| LNU930_H3 | foxtail_millet\|11v3\|EC613524_P1 | 2871 | 4829 | 786 | 80.8 | globlastp |
| LNU932_H1 | maize\|10v1\|T27560_P1 | 2872 | 4830 | 787 | 85.1 | globlastp |
| LNU938_H1 | maize\|10v1\|DN222454_P1 | 2873 | 4831 | 789 | 87.6 | globlastp |
| LNU938_H2 | foxtail_millet\|11v3\|PHY7SI027048M_P1 | 2874 | 4832 | 789 | 83.9 | globlastp |
| LNU938_H4 | switchgrass\|12v1\|SRR187769.1104778_T1 | 2875 | 4833 | 789 | 83.33 | glotblastn |
| LNU938_H5 | switchgrass\|12v1\|FL787692_P1 | 2876 | 4834 | 789 | 82.6 | globlastp |
| LNU938_H3 | sorghum\|12v1\|SB05G025910 | 2877 | 4835 | 789 | 81.1 | globlastp |
| LNU938_H6 | foxtail_millet\|11v3\|PHY7SI027821M_P1 | 2878 | 4836 | 789 | 80.7 | globlastp |
| LNU954_H1 | sugarcane\|10v1\|BQ533017_P1 | 2879 | 4837 | 791 | 94.2 | globlastp |
| LNU954_H2 | foxtail_millet\|11v3\|PHY7SI022586M_P1 | 2880 | 4838 | 791 | 83 | globlastp |
| LNU954_H3 | cenchrus\|gb166\|EB653183_P1 | 2881 | 4839 | 791 | 81 | globlastp |
| LNU956_H2 | maize\|10v1\|AW520032_T1 | 2882 | 4840 | 792 | 89.58 | glotblastn |
| LNU956_H4 | switchgrass\|gb167\|FL701157 | 2883 | 4841 | 792 | 85.12 | glotblastn |
| LNU956_H10 | switchgrass\|12v1\|FL701157_P1 | 2884 | 4842 | 792 | 83.3 | globlastp |
| LNU956_H5 | foxtail_millet\|11v3\|PHY7SI021390M_P1 | 2885 | 4843 | 792 | 82.7 | globlastp |
| LNU968_H1 | maize\|10v1\|BI233953_P1 | 2886 | 4844 | 793 | 80.7 | globlastp |
| LNU977_H4 | rye\|12v1\|DRR001012.145037 | 2887 | 4845 | 794 | 97.3 | globlastp |
| LNU977_H5 | rye\|12v1\|DRR001012.173329 | 2888 | 4846 | 794 | 96.7 | globlastp |
| LNU977_H6 | rye\|12v1\|DRR001012.153346 | 2889 | 4847 | 794 | 96.7 | globlastp |
| LNU977_H7 | barley\|12v1\|BF254361_P1 | 2890 | 4848 | 794 | 96.3 | globlastp |
| LNU977_H3 | rye\|12v1\|DRR001012.735828 | 2891 | 4849 | 794 | 95.89 | glotblastn |
| LNU977_H1 | wheat\|12v3\|BE398977 | 2892 | 4850 | 794 | 93.7 | globlastp |
| LNU977_H9 | brachypodium\|12v1\|BRADI1G76830_P1 | 2893 | 4851 | 794 | 88.3 | globlastp |
| LNU977_H13 | millet\|10v1\|EVO454PM012399_T1 | 2894 | 4852 | 794 | 81.4 | glotblastn |
| LNU977_H14 | foxtail_millet\|11v3\|PHY7SI035189M_P1 | 2895 | 4853 | 794 | 80.7 | globlastp |
| LNU977_H15 | switchgrass\|12v1\|FL721232_P1 | 2896 | 4854 | 794 | 80.3 | globlastp |
| LNU977_H16 | switchgrass\|12v1\|FL901810_T1 | 2897 | 4855 | 794 | 80.04 | glotblastn |

Table 2: Provided are the homologous (e.g., orthologous) polypeptides and polynucleotides of the genes identified in Table 1 and of their cloned genes, which can increase nitrogen use efficiency, fertilizer use efficiency, yield, seed yield, growth rate, vigor, biomass, oil content, fiber yield, fiber quality, fiber length, abiotic stress tolerance and/or water use efficiency of a plant. Homology was calculated as % of identity over the aligned sequences. The query sequences were polypeptide sequences SEQ ID NOs: 496-794 and polynucleotide sequences SEQ ID NOs: 1-495, and the subject sequences are polypeptide sequences or polynucleotide sequences which were dynamically translated in all six reading frames identified in the database based on greater than 80% identity to the query polypeptide sequences.
"Polyp." = polypeptide; "Polyn."—Polynucleotide. Algor. = Algorithm. "globlastp"—global homology using blastp; "glotblastn"—global homology using tblastn. "Hom."—homologous. "ident" = identity.

The output of the functional genomics approach described herein is a set of genes highly predicted to improve nitrogen use efficiency, fertilizer use efficiency, yield, seed yield, growth rate, vigor, biomass, oil content, fiber yield, fiber length, fiber quality, abiotic stress tolerance and/or water use efficiency of a plant by increasing their expression.

Although each gene is predicted to have its own impact, modifying the mode of expression of more than one gene or gene product (RNA, polypeptide) is expected to provide an additive or synergistic effect on the desired trait (e.g., nitrogen use efficiency, fertilizer use efficiency, yield, growth rate, vigor, biomass, oil content, abiotic stress tolerance and/or water use efficiency of a plant). Altering the expression of each gene described here alone or of a set of genes together increases the overall yield and/or other agronomic important traits, hence expects to increase agricultural productivity.

Example 3

Production of Barley Transcriptom and High Throughput Correlation Analysis Using 44K Barley Oligonucleotide Micro-Array In order to produce a high throughput correlation analysis comparing between plant phenotype and gene expression level, the present inventors utilized a Barley oligonucleotide micro-array, produced by Agilent Technologies [chem. (dot) agilent (dot) com/Scripts/PDS (dot) asp?1Page=50879]. The array oligonucleotide represents about 47,500 Barley genes and transcripts. In order to define correlations between the levels of RNA expression and yield or vigor related parameters, various plant characteristics of 25 different Barley accessions were analyzed. Among them, 13 accessions encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

Analyzed Barley tissues—Five tissues at different developmental stages [meristem, flower, booting spike, stem, flag leaf], representing different plant characteristics, were sampled and RNA was extracted as described above. Each micro-array expression information tissue type has received a Set ID as summarized in Table 3 below.

TABLE 3

Barley transcriptom expression sets

| Expression Set | Set ID |
| --- | --- |
| booting spike | 1 |
| flowering spike | 2 |
| meristem | 3 |
| Stem | 4 |

Barley yield components and vigor related parameters assessment—25 Barley accessions in 4 repetitive blocks (named A, B, C, and D), each containing 4 plants per plot were grown at net house. Plants were phenotyped on a daily basis following the standard descriptor of barley (Table 4, below). Harvest was conducted while 50% of the spikes were dry to avoid spontaneous release of the seeds. Plants were separated to the vegetative part and spikes, of them, 5 spikes were threshed (grains were separated from the glumes) for additional grain analysis such as size measurement, grain count per spike and grain yield per spike. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

TABLE 4

Barley standard descriptors

| Trait | Parameter | Range | Description |
| --- | --- | --- | --- |
| Growth habit | Scoring | 1-9 | Prostrate (1) or Erect (9) |
| Hairiness of basal leaves | Scoring | P (Presence)/A (Absence) | Absence (1) or Presence (2) |
| Stem pigmentation | Scoring | 1-5 | Green (1), Basal only or Half or more (5) |
| Days to Flowering | Days | | Days from sowing to emergence of awns |
| Plant height | Centimeter (cm) | | Height from ground level to top of the longest spike excluding awns |
| Spikes per plant | Number | | Terminal Counting |
| Spike length | Centimeter (cm) | | Terminal Counting 5 spikes per plant |
| Grains per spike | Number | | Terminal Counting 5 spikes per plant |
| Vegetative dry weight | Gram | | Oven-dried for 48 hours at 70° C. |
| Spikes dry weight | Gram | | Oven-dried for 48 hours at 30° C. |

Grains per spike—At the end of the experiment (50% of the spikes were dry) all spikes from plots within blocks A-D were collected. The total number of grains from 5 spikes that were manually threshed was counted. The average grain per spike was calculated by dividing the total grain number by the number of spikes.

Grain average size (cm)—At the end of the experiment (50% of the spikes were dry) all spikes from plots within blocks A-D were collected. The total grains from 5 spikes that were manually threshed were scanned and images were analyzed using the digital imaging system. Grain scanning was done using Brother scanner (model DCP-135), at the 200 dpi resolution and analyzed with Image J software. The average grain size was calculated by dividing the total grain size by the total grain number.

Grain average weight (mgr)—At the end of the experiment (50% of the spikes were dry) all spikes from plots within blocks A-D were collected. The total grains from 5 spikes that were manually threshed were counted and weight. The average weight was calculated by dividing the total weight by the total grain number.

Grain yield per spike (gr)—At the end of the experiment (50% of the spikes were dry) all spikes from plots within blocks A-D were collected. The total grains from 5 spikes that were manually threshed were weight. The grain yield was calculated by dividing the total weight by the spike number.

Spike length analysis—At the end of the experiment (50% of the spikes were dry) all spikes from plots within blocks A-D were collected. The five chosen spikes per plant were measured using measuring tape excluding the awns.

Spike number analysis—At the end of the experiment (50% of the spikes were dry) all spikes from plots within blocks A-D were collected. The spikes per plant were counted.

Growth habit scoring—At the growth stage 10 (booting), each of the plants was scored for its growth habit nature. The scale that was used was 1 for prostate nature till 9 for erect.

Hairiness of basal leaves—At the growth stage 5 (leaf sheath strongly erect; end of tillering), each of the plants was scored for its hairiness nature of the leaf before the last. The scale that was used was 1 for prostate nature till 9 for erect.

Plant height—At the harvest stage (50% of spikes were dry) each of the plants was measured for its height using measuring tape. Height was measured from ground level to top of the longest spike excluding awns.

Days to flowering—Each of the plants was monitored for flowering date. Days of flowering was calculated from sowing date till flowering date.

Stem pigmentation—At the growth stage 10 (booting), each of the plants was scored for its stem color. The scale that was used was 1 for green till 5 for full purple.

Vegetative dry weight and spike yield—At the end of the experiment (50% of the spikes were dry) all spikes and vegetative material from plots within blocks A-D were collected. The biomass and spikes weight of each plot was separated, measured and divided by the number of plants.

Dry weight=total weight of the vegetative portion above ground (excluding roots) after drying at 70° C. in oven for 48 hours;

Spike yield per plant=total spike weight per plant (gr) after drying at 30° C. in oven for 48 hours.

Harvest Index (for barley)—The harvest index was calculated using Formula XVIII above.

TABLE 5

Barley correlated parameters (vectors)

| Correlated parameter with (units) | Correlation Id |
|---|---|
| Grain weight (miligrams) | 1 |
| Grains Size (mm$^2$) | 2 |
| Grains per spike (numbers) | 3 |
| Growth habit (scores 1-9) | 4 |
| Hairiness of basal leaves (scoring 1-2) | 5 |
| Plant height (cm) | 6 |
| Seed Yield of 5 Spikes (gram) | 7 |
| Spike length (cm) | 8 |
| Spikes per plant (numbers) | 9 |
| Stem pigmentation (scoring 1-5) | 10 |
| Vegetative dry weight (gram) | 11 |
| days to flowering (days) | 12 |

Experimental Results 13 different Barley accessions were grown and characterized for 13 parameters as described above. The average for each of the measured parameter was calculated using the JMP software and values are summarized in Tables 6 and 7 below. Subsequent correlation analysis between the various transcriptom sets (Table 3) and the average parameters, was conducted. Follow, results were integrated to the database.

TABLE 6

Measured parameters of correlation Ids in Barley accessions

| Accession | Parameter | | | | | |
|---|---|---|---|---|---|---|
| | 1 | 2 | 3 | 4 | 5 | 6 |
| Line-1 | 35.046 | 0.265 | 20.229 | 2.600 | 1.533 | 134.267 |
| Line-2 | 28.065 | 0.229 | 17.983 | 2.000 | 1.333 | 130.500 |
| Line-3 | 28.761 | 0.244 | 17.267 | 1.923 | 1.692 | 138.769 |
| Line-4 | 17.869 | 0.166 | 17.733 | 3.167 | 1.083 | 114.583 |
| Line-5 | 41.216 | 0.295 | 14.467 | 4.333 | 1.417 | 127.750 |
| Line-6 | 29.734 | 0.275 | 16.783 | 2.692 | 1.692 | 129.385 |
| Line-7 | 25.224 | 0.220 | 12.120 | 3.600 | 1.300 | 103.889 |
| Line-8 | 34.994 | 0.278 | 14.067 | 3.500 | 1.188 | 121.625 |
| Line-9 | 20.580 | 0.187 | 21.540 | 3.000 | 1.000 | 126.800 |
| Line-10 | 27.501 | 0.224 | 12.100 | 3.667 | 1.167 | 99.833 |
| Line-11 | 37.126 | 0.273 | 13.400 | 2.467 | 1.600 | 121.400 |
| Line-12 | 29.564 | 0.271 | 15.283 | 3.500 | 1.083 | 118.417 |
| Line-13 | 19.583 | 0.179 | 17.067 | 3.000 | 1.167 | 117.167 |

Table 6: Provided are the values of each of the parameters measured in Barley accessions according to the correlation identifications (Correlation IDs Table 5 above).

TABLE 7

| Accession/ Parameter | 7 | 8 | 9 | 10 | 11 | 12 |
|---|---|---|---|---|---|---|
| Line-1 | 3.559 | 12.036 | 48.846 | 1.133 | 78.871 | 62.400 |
| Line-2 | 2.538 | 10.932 | 48.273 | 2.500 | 66.141 | 64.083 |
| Line-3 | 2.583 | 11.825 | 37.417 | 1.692 | 68.491 | 65.154 |
| Line-4 | 1.574 | 9.900 | 61.917 | 1.750 | 53.389 | 58.917 |
| Line-5 | 3.030 | 11.682 | 33.273 | 2.333 | 68.300 | 63.000 |
| Line-6 | 2.517 | 11.532 | 41.692 | 2.308 | 74.173 | 70.538 |
| Line-7 | 1.549 | 8.863 | 40.000 | 1.700 | 35.354 | 52.800 |
| Line-8 | 2.624 | 11.216 | 40.625 | 2.188 | 58.334 | 60.875 |
| Line-9 | 2.300 | 11.108 | 62.000 | 2.300 | 62.230 | 58.100 |
| Line-10 | 1.678 | 8.583 | 49.333 | 1.833 | 38.322 | 53.000 |
| Line-11 | 2.677 | 10.179 | 50.600 | 3.067 | 68.306 | 60.400 |
| Line-12 | 2.353 | 10.505 | 43.091 | 1.583 | 56.148 | 64.583 |
| Line-13 | 1.673 | 9.803 | 51.400 | 2.167 | 42.682 | 56.000 |

Table 7. Provided are the values of each of the parameters measured in Barley accessions according to the correlation identifications (Correlation IDs Table 5 above).

TABLE 8

Correlation between the expression level of the selected polynucleotides of the invention and their homologues in specific tissues or developmental stages and the phenotypic performance across Barley accessions

| Gene Name | R | P value | Exp. set | Corr. Set ID | Gene Name | R | P value | Exp. set | Corr. Set ID |
|---|---|---|---|---|---|---|---|---|---|
| LNU750 | 0.80 | 5.15E-03 | 2 | 9 | LNU756 | 0.70 | 1.59E-02 | 3 | 2 |
| LNU756 | 0.73 | 1.05E-02 | 3 | 1 | LNU756 | 0.74 | 8.57E-03 | 3 | 5 |
| LNU757 | 0.75 | 7.80E-03 | 1 | 7 | LNU757 | 0.74 | 8.71E-03 | 1 | 11 |
| LNU761 | 0.74 | 9.03E-03 | 3 | 1 | LNU761 | 0.72 | 1.20E-02 | 3 | 6 |
| LNU761 | 0.85 | 9.78E-04 | 3 | 8 | LNU761 | 0.88 | 4.09E-04 | 3 | 7 |
| LNU761 | 0.76 | 6.14E-03 | 3 | 11 | LNU766 | 0.73 | 1.10E-02 | 1 | 5 |
| LNU767 | 0.82 | 2.06E-03 | 3 | 2 | LNU767 | 0.87 | 5.84E-04 | 3 | 1 |
| LNU767 | 0.77 | 6.08E-03 | 3 | 8 | LNU767 | 0.94 | 1.99E-05 | 3 | 7 |
| LNU767 | 0.85 | 9.09E-04 | 3 | 11 | LNU767 | 0.76 | 6.33E-03 | 3 | 12 |
| LNU768 | 0.79 | 3.98E-03 | 1 | 9 | LNU768 | 0.73 | 1.74E-02 | 2 | 4 |
| LNU768 | 0.75 | 7.84E-03 | 3 | 9 | LNU770 | 0.72 | 1.20E-02 | 1 | 9 |
| LNU771 | 0.70 | 2.32E-02 | 2 | 5 | LNU771 | 0.78 | 4.51E-03 | 3 | 2 |
| LNU771 | 0.74 | 9.02E-03 | 3 | 1 | LNU773 | 0.75 | 7.74E-03 | 3 | 9 |
| LNU774 | 0.81 | 2.78E-03 | 3 | 2 | LNU774 | 0.87 | 4.25E-04 | 3 | 1 |
| LNU774 | 0.71 | 1.36E-02 | 3 | 7 | LNU780 | 0.70 | 1.56E-02 | 1 | 2 |
| LNU780 | 0.77 | 6.07E-03 | 1 | 1 | LNU780 | 0.86 | 1.40E-03 | 2 | 4 |
| LNU782 | 0.74 | 8.54E-03 | 3 | 8 | LNU785 | 0.70 | 1.57E-02 | 1 | 8 |
| LNU834 | 0.75 | 7.95E-03 | 3 | 1 | LNU839 | 0.75 | 7.95E-03 | 3 | 1 |

Table 8. Provided are the correlations (R) and p-values (P) between the expression levels of selected genes of some embodiments of the invention in various tissues or developmental stages (Expression sets) and the phenotypic performance in various yield (seed yield, oil yield, oil content), biomass, growth rate and/or vigor components [Correlation (Corr.) vector (Vec.) Expression (Exp.)] Corr. Vector = correlation vector specified in Table 5; Exp. Set = expression set specified in Table 3.

Example 4

Production of Barley Transcriptom and High Throughput Correlation Analysis Using 60K Barley Oligonucleotide Micro-Array In order to produce a high throughput correlation analysis comparing between plant phenotype and gene expression level, the present inventors utilized a Barley oligonucleotide micro-array, produced by Agilent Technologies [chem. (dot) agilent (dot) com/Scripts/PDS (dot) asp?1Page=50879]. The array oligonucleotide represents about 60K Barley genes and transcripts. In order to define correlations between the levels of RNA expression and yield or vigor related parameters, various plant characteristics of 15 different Barley accessions were analyzed. Among them, 10 accessions encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

Analyzed Barley tissues—Tissues at different developmental stages representing different plant characteristics, were sampled and RNA was extracted as described above. Each micro-array expression information tissue type has received a Set ID as summarized in Tables 9-11 below.

TABLE 9

Barley transcriptom expression sets under normal and low N conditions (at vegetative stage)

| Expression Set | Set ID |
|---|---|
| Adv root/T3/low N | 1 |
| Adv root/T3/normal | 2 |
| Leaf/T3/low N | 3 |
| Leaf/T3/normal | 4 |
| Root tip/T3/low N | 5 |
| Root tip/T3/normal | 6 |

Table 9. Provided are the barley transcriptom expression sets under normal and low N (low nitrogen) conditions (at vegetative stage).

TABLE 10

Barley transcriptom expression sets under normal and low N conditions (at reproductive stage)

| Set ID | Expression Set |
|---|---|
| 1 | reproductive/booting spike/low N |
| 2 | reproductive/booting spike/normal |
| 3 | reproductive/leaf/low N |
| 4 | reproductive/leaf/normal: |
| 5 | reproductive/stem/low N |
| 6 | reproductive/stem/normal |

Table 10. Provided are the barley transcriptom expression sets under normal and low N conditions (at reproductive stage).

TABLE 11

Barley transcriptom expression sets under drought conditions (at vegetative stage)

| Set ID | Expression Set |
|---|---|
| 1 | Drought/booting spike/reproductive |
| 2 | Drought/leaf/reproductive |
| 3 | Drought/leaf/vegetative |
| 4 | Drought/meristems/vegetative |
| 5 | Drought/root tip/vegetative |
| 6 | Drought/root tip/vegetative |

Table 11. Provided are the barley transcriptom expression sets under drought conditions (at vegetative stage).

Barley yield components and vigor related parameters assessment—15 Barley accessions in 5 repetitive blocks, each containing 5 plants per pot were grown at net house. Three different treatments were applied: plants were regularly fertilized and watered during plant growth until harvesting (as recommended for commercial growth, plants were irrigated 2-3 times a week, and fertilization was given in the first 1.5 months of the growth period) or under low Nitrogen (80% percent less Nitrogen) or under drought stress (cycles of drought and re-irrigating were conducted throughout the whole experiment, overall 40% less water were given in the drought treatment). Plants were phenotyped on a daily basis following the parameters listed in Table 12 below. Harvest was conducted while all the spikes were dry. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

Grain yield (gr.)—At the end of the experiment all spikes of the pots were collected. The total grains from all spikes that were manually threshed were weighted. The grain yield was calculated by per plot or per plant.

Spike length and width analysis—At the end of the experiment the length and width of five chosen spikes per plant were measured using measuring tape excluding the awns.

Spike number analysis—The spikes per plant were counted.

Plant height—Each of the plants was measured for its height using measuring tape. Height was measured from ground level to top of the longest spike excluding awns at two time points at the Vegetative growth (30 days after sowing) and at harvest.

Spike weight—The biomass and spikes weight of each plot was separated, measured and divided by the number of plants.

Dry weight=total weight of the vegetative portion above ground (excluding roots) after drying at 70° C. in oven for 48 hours at two time points at the Vegetative growth (30 days after sowing) and at harvest.

Spikelet per spike=number of spikelets per spike was counted.

Root/Shoot Ratio—The Root/Shoot Ratio is calculated using Formula XXII above.

Total No. of tillers—all tillers were counted per plot at two time points at the Vegetative growth (30 days after sowing) and at harvest.

Percent of reproductive tillers—the number of reproductive tillers barring a spike at harvest was divided by the total numbers of tillers.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Root FW (gr.), root length (cm) and No. of lateral roots—3 plants per plot were selected for measurement of root weight, root length and for counting the number of lateral roots formed.

Shoot FW (fresh weight)—weight of 3 plants per plot were recorded at different time-points.

Average Grain Area (cm$^2$)—At the end of the growing period the grains were separated from the spike. A sample of ~200 grains was weighted, photographed and images were processed using the below described image processing system. The grain area was measured from those images and was divided by the number of grains.

Average Grain Length and width (cm)—At the end of the growing period the grains were separated from the spike. A sample of ~200 grains was weighted, photographed and images were processed using the below described image processing system. The sum of grain lengths or width (longest axis) was measured from those images and was divided by the number of grains.

Average Grain perimeter (cm)—At the end of the growing period the grains were separated from the spike. A sample of ~200 grains was weighted, photographed and images were processed using the below described image processing system. The sum of grain perimeter was measured from those images and was divided by the number of grains.

Heading date—the day in which booting stage was observed was recorded and number of days from sowing to heading was calculated.

Relative water content—Fresh weight (FW) of three leaves from three plants each from different seed ID was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) is calculated according to Formula I above.

Harvest Index (for barley)—The harvest index was calculated using Formula XVIII above.

Relative growth rate: the relative growth rate (RGR) of Plant Height (Formula III above), SPAD (Formula IV above) and number of tillers (Formula V above) were calculated using the indicated formulas.

Ratio Drought/Normal: Represents ratio for the specified parameter of Drought condition results divided by Normal conditions results (maintenance of phenotype under drought in comparison to normal conditions).

TABLE 12

Barley correlated parameters (vectors) under normal and low N conditions (at vegetative stage)

| Correlated parameter with | Correlation ID |
|---|---|
| Lateral roots per plant at TP3 [number] Normal | 1 |
| Leaf Area [cm$^2$] | 2 |
| Leaf Number-TP4-Low N [number] | 3 |
| Leaf maximal length at TP4 [mm] Normal | 4 |
| Leaf maximal width at TP4 [mm] Normal | 5 |
| Leaf maximal length at TP4 [mm] Low N | 6 |
| Leaf maximal width at TP4 [mm] Low N | 7 |
| Lateral roots per plant at TP3 [number] Low N | 8 |
| No of tillers-Low N-TP2 [number] | 9 |

TABLE 12-continued

Barley correlated parameters (vectors) under normal and low N conditions (at vegetative stage)

| Correlated parameter with | Correlation ID |
|---|---|
| Num Leaves[number] | 10 |
| Num Seeds [number] | 11 |
| Num Spikes [number] | 12 |
| Num Tillers [number] | 13 |
| Plant Height (cm)-Normal | 14 |
| Plant Height (cm)-Low N | 15 |
| Plant Height (cm)-Low N-TP2 | 16 |
| Root FW per plant at vegetative stage [gr.] Normal | 17 |
| Root length per plant at vegetative stage [cm] Normal | 18 |
| Root FW per plant at vegetative stage [gr.] Low N | 19 |
| Root length per plant at vegetative stage [cm] Low N | 20 |
| Chlorophyll level at vegetative stage [SPAD] Normal | 21 |
| Chlorophyll level at vegetative stage [SPAD] Low N | 22 |
| Seed Yield [gr.] | 23 |
| Seed Number (per plot)-Low N [number] | 24 |
| Seed Yield (gr)-Low N | 25 |
| Seed Yield (gr)-Normal | 26 |
| Shoot FW per plant at vegetative stage [gr.] Normal | 27 |
| Spike length [cm] Normal | 28 |
| Spike width [mm] Normal | 29 |
| Spike total weight (per plot)-normal [gr.] | 30 |
| Spike Length (cm)-Low N | 31 |
| Spike Width (cm)-Low N | 32 |
| Spike total weight (per plot)-Low N [gr.] | 33 |
| Total Tillers [number] | 34 |
| Total Leaf Area (mm2)-TP4-Low N | 35 |
| Total No of Spikes per plot-Low N [number] | 36 |
| Total No of tillers per plot-Low N [number] | 37 |
| shoot FW (gr)-Low N-TP2 | 38 |

Table 12. Provided are the barley correlated parameters.
"TP" = time point;
"DW" = dry weight;
"FW" = fresh weight;
"Low N" = Low Nitrogen.

TABLE 13

Barley correlated parameters (vectors) under normal and low N conditions (at reproductive stage)

| Correlation ID | Correlated parameter with |
|---|---|
| 1 | Grain Perimeter [mm] |
| 2 | Grain area [mm] |
| 3 | Grain length [mm] |
| 4 | Grain width [mm] |
| 5 | Grains DW/Shoots DW |
| 6 | Grains per plot [number] |
| 7 | Grains weight per plant [gr.] |
| 8 | Grains weight per plot [gr.] |
| 9 | Plant Height [cm] |
| 10 | Roots DW [gr.] |
| 11 | Row number [number] |
| 12 | Spikes FW (Harvest) [gr.] |
| 13 | Spikes num [number] |
| 14 | Tillering (Harvest) [number] |
| 15 | Vegetative DW (Harvest) [gr.] |
| 16 | percent of reproductive tillers [percent] |
| 17 | shoot/root ratio |

Table 13. Provided are the barley correlated parameters under normal and low N conditions (at reproductive stage).
"TP" = time point;
"DW" = dry weight;
"FW" = fresh weight;
"Low N" = Low Nitrogen;
"Relative water content [percent] Ratio Drought/Normal" – maintenance of phenotype under drought in comparison to normal conditions

TABLE 14

Barley correlated parameters (vectors) under drought conditions (at vegetative stage)

| Correlation ID | Correlated parameter with |
|---|---|
| 1 | Chlorophyll level vegetative stage [SPAD] Drought |
| 2 | Shoot DW at harvest [gr.] |
| 3 | Shoot DW at harvest per plant [gr.] Drought |
| 4 | Shoot FW per plant at harvest [gr.] Drought |
| 5 | Grains per plant [number] Drought |
| 6 | Grain yield per plant [gr.] Drought |
| 7 | Harvest index |
| 8 | Heading date [days] Drought |
| 9 | RGR by plant height Drought |
| 10 | Number of tillers Relative growth rate |
| 11 | Plant height per plot at harvest [cm] Drought |
| 12 | RBiH/BiH |
| 13 | Relative water content vegetative [percent] Drought |
| 14 | Root DW per plant vegetative stage [gr.] Drought |
| 15 | Root FW per plant vegetative stage [gr.] Drought |
| 16 | Root length per plant vegetative [cm] Drought |
| 17 | RGR by chlorophyll levels Drought |
| 18 | Spike length [cm] Drought |
| 19 | Spikes per plant [number] Drought |
| 20 | Spikes yield per plant [gr.] Drought |
| 21 | Spike width [mm] Drought |
| 22 | Tillers per plant at harvest [number] Drought |
| 23 | Lateral roots per plant vegetative [number] Drought |

Table 14. Provided are the barley correlated parameters under drought conditions (at vegetative stage). "RBiH/BiH" = root-shoot ratio Experimental Results 15 different Barley accessions were grown and characterized for different parameters as described above. Tables 12-14 describe the Barley correlated parameters. The average for each of the measured parameter was calculated using the JMP software and values are summarized in Tables 15-24 below. Subsequent correlation analysis between the various transcriptom sets and the average parameters was conducted. Follow, results were integrated to the database.

TABLE 15

Measured parameters of correlation IDs in Barley accessions under low N conditions (at vegetative stage)

| Corr. ID/Line | 3 | 6 | 7 | 8 | 9 | 15 | 16 | 19 | 20 | 22 |
|---|---|---|---|---|---|---|---|---|---|---|
| Line-1 | 8.0 | 102.9 | 5.3 | 5.0 | 0.0 | 41.0 | 16.3 | 0.4 | 24.7 | 24.0 |
| Line-2 | 8.0 | 107.8 | 5.2 | 6.0 | 0.0 | 82.0 | 18.8 | 0.2 | 21.7 | 23.3 |
| Line-3 | 7.5 | 111.6 | 5.1 | 4.3 | 0.0 | 61.4 | 17.3 | 0.1 | 22.0 | 26.5 |
| Line-4 | 8.5 | 142.4 | 5.3 | 6.0 | 0.0 | 59.4 | 26.0 | 0.4 | 21.7 | 23.9 |
| Line-5 | 10.0 | 152.4 | 5.2 | 6.3 | 0.0 | 65.8 | 22.5 | 0.9 | 22.2 | 26.6 |
| Line-6 | 11.5 | 149.3 | 5.3 | 6.0 | 0.0 | 47.8 | 18.2 | 0.5 | 23.0 | 23.2 |
| Line-7 | 8.6 | 124.1 | 5.3 | 6.7 | 0.0 | 53.8 | 19.7 | 0.4 | 30.5 | 25.4 |
| Line-8 | 6.3 | 95.0 | 5.1 | 4.7 | 0.0 | 56.4 | 19.8 | 0.3 | 22.8 | 24.2 |
| Line-9 | 7.5 | 124.1 | 5.2 | 5.7 | 0.0 | 81.8 | 19.2 | 0.3 | 23.8 | 25.0 |
| Line-10 | 10.0 | 135.2 | 5.1 | 7.3 | 0.0 | 44.6 | 19.2 | 0.6 | 24.5 | 26.1 |

Table 15: Provided are the values of each of the parameters (as described above) measured in Barley accessions (line) under low N conditions. Growth conditions are specified in the experimental procedure section.

TABLE 16

Measured parameters of correlation IDs in additional Barley accessions under low N conditions (at vegetative stage)

| Corr. ID/Line | 24 | 25 | 26 | 31 | 32 | 33 | 35 | 36 | 37 | 38 |
|---|---|---|---|---|---|---|---|---|---|---|
| Line-1 | 230.2 | 9.8 | 46.4 | 15.2 | 8.0 | 13.7 | 39.4 | 12.2 | 16.2 | 0.4 |
| Line-2 | 164.6 | 7.3 | 19.8 | 19.6 | 8.1 | 13.4 | 46.3 | 9.0 | 14.6 | 0.4 |

TABLE 16-continued

Measured parameters of correlation IDs in additional Barley accessions under low N conditions (at vegetative stage)

| Corr. ID/Line | 24 | 25 | 26 | 31 | 32 | 33 | 35 | 36 | 37 | 38 |
|---|---|---|---|---|---|---|---|---|---|---|
| Line-3 | 88.3 | 3.3 | 10.8 | 16.3 | 9.4 | 9.2 | 51.5 | 11.6 | 16.0 | 0.3 |
| Line-4 | 133.6 | 5.1 | 22.6 | 19.3 | 4.9 | 11.6 | 57.1 | 25.0 | 20.8 | 0.6 |
| Line-5 | 106.0 | 6.0 | 30.3 | 90.2 | 9.6 | 11.3 | 67.8 | 7.8 | 12.5 | 0.8 |
| Line-6 | 222.6 | 9.7 | 54.1 | 16.4 | 7.2 | 15.1 | 64.2 | 14.5 | 18.8 | 0.5 |
| Line-7 | 219.2 | 7.4 | 37.0 | 20.4 | 7.1 | 12.2 | 52.4 | 15.0 | 21.2 | 0.5 |
| Line-8 | 143.5 | 5.8 | 42.0 | 18.8 | 8.5 | 11.0 | 46.2 | 7.0 | 11.0 | 0.4 |
| Line-9 | 201.8 | 7.8 | 35.4 | 18.8 | 10.0 | 12.2 | 68.0 | 5.4 | 6.8 | 0.5 |
| Line-10 | 125.0 | 6.3 | 38.3 | 16.6 | 9.4 | 10.6 | 57.9 | 8.4 | 14.0 | 0.6 |

Table 16. Provided are the values of each of the parameters (as described above) measured in Barley accessions (line) under low N conditions. Growth conditions are specified in the experimental procedure section.

TABLE 17

Measured parameters of correlation IDs Barley accessions under normal conditions (at vegetative stage)

| Corr. ID/Line | 1 | 2 | 4 | 5 | 10 | 11 | 12 | 13 | 14 | 14 |
|---|---|---|---|---|---|---|---|---|---|---|
| Line-1 | 7.0 | 294.0 | 502.0 | 5.8 | 24.2 | 1090.0 | 41.5 | 2.0 | 64.7 | 64.7 |
| Line-2 | 8.7 | 199.0 | 348.0 | 5.5 | 18.2 | 510.0 | 32.0 | 2.0 | 84.0 | 84.0 |
| Line-3 | 8.3 | 273.0 | 499.0 | 5.8 | 22.7 | 242.0 | 36.0 | 1.0 | 67.4 | 67.4 |
| Line-4 | 9.7 | 276.0 | 594.0 | 6.0 | 25.5 | 582.0 | 71.4 | 2.3 | 82.0 | 82.0 |
| Line-5 | 10.7 | 313.0 | 535.0 | 4.6 | 23.2 | 621.0 | 34.2 | 2.3 | 72.0 | 72.0 |
| Line-6 | 9.7 | 309.0 | 551.0 | 5.3 | 28.3 | 1070.0 | 45.6 | 3.3 | 56.6 | 56.6 |
| Line-7 | 9.7 | 259.0 | 479.0 | 5.8 | 22.2 | 903.0 | 49.6 | 2.3 | 65.8 | 65.8 |
| Line-8 | 8.7 | 291.0 | 399.0 | 5.4 | 19.0 | 950.0 | 28.0 | 1.3 | 62.8 | 62.8 |
| Line-9 | 10.0 | 299.0 | 384.0 | 5.8 | 17.3 | 984.0 | 19.3 | 1.3 | 91.6 | 91.6 |
| Line-10 | 9.7 | 296.0 | 470.0 | 6.0 | 22.0 | 768.0 | 38.0 | 1.7 | 66.2 | 66.2 |

Table 17: Provided are the values of each of the parameters (as described above) measured in Barley accessions (line) under normal conditions. Growth conditions are specified in the experimental procedure section.

TABLE 18

Measured parameters of correlation IDs in additional Barley accessions under normal conditions (at vegetative stage)

| Corr. ID/Line | 17 | 18 | 21 | 23 | 27 | 28 | 29 | 30 | 34 |
|---|---|---|---|---|---|---|---|---|---|
| Line-1 | 0.27 | 21.30 | 39.10 | 46.40 | 2.17 | 16.50 | 9.54 | 69.40 | 46.70 |
| Line-2 | 0.27 | 15.00 | 41.40 | 19.80 | 1.90 | 19.20 | 9.05 | 39.40 | 41.60 |
| Line-3 | 0.25 | 21.80 | 35.20 | 10.80 | 1.25 | 18.30 | 8.25 | 34.90 | 40.00 |
| Line-4 | 0.35 | 20.30 | 33.70 | 22.60 | 3.00 | 20.40 | 6.55 | 50.30 | 48.80 |
| Line-5 | 0.62 | 27.20 | 34.20 | 30.30 | 15.60 | 17.20 | 10.50 | 60.80 | 34.60 |
| Line-6 | 0.27 | 16.00 | 42.80 | 54.10 | 3.02 | 19.10 | 8.83 | 79.10 | 48.60 |
| Line-7 | 0.35 | 24.00 | 37.00 | 37.00 | 2.58 | 20.30 | 7.38 | 62.70 | 49.20 |
| Line-8 | 0.32 | 13.50 | 36.90 | 42.00 | 1.75 | 21.70 | 10.40 | 60.00 | 29.00 |
| Line-9 | 0.23 | 21.50 | 35.00 | 35.40 | 2.18 | 16.50 | 10.20 | 55.90 | 27.50 |
| Line-10 | 0.27 | 15.20 | 36.80 | 38.30 | 1.82 | 16.10 | 10.30 | 59.70 | 38.80 |

Table 18. Provided are the values of each of the parameters (as described above) measured in Barley accessions (line) under normal conditions. Growth conditions are specified in the experimental procedure section.

TABLE 19

Measured parameters of correlation IDs in Barley accessions under low N conditions (at reproductive stage)

| Corr. ID/Line | 1 | 2 | 3 | 4 | 5 | 6 | 7 | 8 | 9 |
|---|---|---|---|---|---|---|---|---|---|
| Line-1 | 2.24 | 0.25 | 0.89 | 0.35 | 0.40 | 683.40 | 6.65 | 33.24 | 76.40 |
| Line-2 | 2.24 | 0.24 | 0.87 | 0.35 | 0.16 | 510.50 | 3.96 | 19.81 | 84.00 |
| Line-3 | 2.18 | 0.24 | 0.86 | 0.35 | 1.01 | 1093.50 | 9.27 | 46.37 | 64.67 |
| Line-4 | 2.05 | 0.23 | 0.80 | 0.37 | 0.79 | 767.60 | 7.65 | 38.25 | 66.20 |
| Line-5 | 2.08 | 0.24 | 0.83 | 0.37 | 0.41 | 621.00 | 6.06 | 30.30 | 72.00 |
| Line-6 | 2.03 | 0.25 | 0.78 | 0.41 | 0.99 | 1069.00 | 10.83 | 54.13 | 56.60 |
| Line-7 | 2.25 | 0.24 | 0.90 | 0.35 | 0.67 | 987.75 | 7.94 | 39.69 | 68.00 |
| Line-8 | 1.88 | 0.22 | 0.72 | 0.39 | 0.61 | 903.20 | 7.40 | 36.98 | 65.80 |
| Line-9 | 2.09 | 0.23 | 0.82 | 0.36 | 0.28 | 581.80 | 4.52 | 22.58 | 82.00 |
| Line-10 | 2.03 | 0.22 | 0.79 | 0.36 | 1.04 | 904.40 | 8.41 | 39.68 | 62.80 |
| Line-11 | 2.02 | 0.24 | 0.80 | 0.37 | 0.12 | 242.40 | 2.00 | 10.84 | 67.40 |
| Line-12 | 1.98 | 0.21 | 0.80 | 0.34 | 0.86 | 928.40 | 8.05 | 40.26 | 76.20 |
| Line-13 | 1.69 | 0.18 | 0.65 | 0.35 | 0.58 | 984.20 | 7.08 | 35.37 | 91.60 |
| Line-14 | 1.98 | 0.19 | 0.82 | 0.29 | 0.05 | 157.67 | 0.75 | 3.73 | 44.00 |
| Line-15 | 1.89 | 0.17 | 0.77 | 0.29 | 0.08 | 263.25 | 1.14 | 5.68 | 52.75 |

Table 19: Provided are the values of each of the parameters (as described above) measured in Barley accessions (line) under low N conditions (at reproductive stage). Growth conditions are specified in the experimental procedure section.

TABLE 20

Measured parameters of correlation IDs in additional Barley accessions under low N conditions (at reproductive stage)

| Corr. ID/Line | 10 | 11 | 12 | 13 | 14 | 15 | 16 | 17 |
|---|---|---|---|---|---|---|---|---|
| Line-1 | 118.30 | 6.00 | 69.84 | 38.60 | 44.25 | 89.20 | 82.30 | 1.48 |
| Line-2 | 150.68 | 6.00 | 39.86 | 32.00 | 41.60 | 99.65 | 77.75 | 0.64 |
| Line-3 | 86.28 | 6.00 | 69.40 | 41.50 | 46.67 | 45.79 | 86.69 | 0.84 |
| Line-4 | 85.19 | 6.00 | 59.72 | 38.00 | 38.80 | 49.39 | 94.23 | 0.82 |
| Line-5 | 120.31 | 6.00 | 60.83 | 34.20 | 34.60 | 74.32 | 89.74 | 1.15 |
| Line-6 | 90.70 | 2.80 | 79.12 | 45.60 | 48.60 | 55.11 | 93.73 | 0.69 |
| Line-7 | 40.58 | 6.00 | 63.50 | 30.00 | 32.40 | 47.29 | 89.49 | 1.26 |
| Line-8 | 90.51 | 2.00 | 62.74 | 49.80 | 55.20 | 60.32 | 90.28 | 0.72 |
| Line-9 | 92.59 | 2.00 | 50.30 | 71.40 | 50.60 | 88.01 | 91.21 | 1.17 |
| Line-10 | 63.95 | 5.20 | 59.95 | 28.00 | 29.00 | 38.89 | 92.50 | 0.71 |
| Line-11 | 286.63 | 6.00 | 34.92 | 36.00 | 40.00 | 97.71 | 91.73 | 0.38 |
| Line-12 | 95.79 | 6.00 | 60.08 | 27.60 | 28.50 | 48.33 | 85.31 | 0.51 |
| Line-13 | 34.04 | 6.00 | 55.88 | 23.60 | 27.50 | 62.52 |  | 2.16 |
| Line-14 | 121.27 | 4.67 | 16.93 | 54.67 | 26.00 | 57.97 |  | 0.67 |
| Line-15 | 206.75 | 4.00 | 21.70 | 48.00 |  | 72.78 |  | 0.40 |

Table 20. Provided are the values of each of the parameters (as described above) measured in Barley accessions (line) under low N conditions (at reproductive stage). Growth conditions are specified in the experimental procedure section.

TABLE 21

Measured parameters of correlation IDs Barley accessions under accessions under normal conditions (at reproductive stage)

| Corr. ID/Line | 1 | 2 | 3 | 4 | 5 | 6 | 7 | 8 | 9 |
|---|---|---|---|---|---|---|---|---|---|
| Line-1 | 2.29 | 0.25 | 0.90 | 0.35 | 0.39 | 153.20 | 1.34 | 6.68 | 75.20 |
| Line-2 | 2.33 | 0.25 | 0.92 | 0.35 | 0.42 | 164.60 | 1.46 | 7.31 | 82.00 |
| Line-3 | 2.28 | 0.26 | 0.93 | 0.35 | 1.25 | 230.20 | 1.95 | 9.76 | 41.00 |
| Line-4 | 2.08 | 0.24 | 0.82 | 0.36 | 0.69 | 125.00 | 1.26 | 6.29 | 44.60 |
| Line-5 | 2.13 | 0.25 | 0.86 | 0.37 | 0.43 | 100.00 | 1.13 | 5.67 | 65.80 |
| Line-6 | 1.96 | 0.23 | 0.76 | 0.38 | 0.87 | 222.60 | 1.95 | 9.74 | 47.80 |
| Line-7 | 2.09 | 0.23 | 0.83 | 0.35 | 0.77 | 159.40 | 1.28 | 6.40 | 60.60 |
| Line-8 | 1.88 | 0.21 | 0.74 | 0.36 | 0.53 | 219.20 | 1.47 | 7.35 | 53.80 |
| Line-9 | 2.19 | 0.24 | 0.86 | 0.35 | 0.34 | 133.60 | 0.98 | 5.06 | 59.40 |
| Line-10 | 1.88 | 0.20 | 0.73 | 0.35 | 0.87 | 134.40 | 1.16 | 5.43 | 56.40 |
| Line-11 | 2.03 | 0.22 | 0.81 | 0.35 | 0.15 | 88.25 | 0.92 | 4.62 | 61.40 |
| Line-12 | 2.11 | 0.23 | 0.85 | 0.35 | 0.58 | 174.25 | 1.34 | 6.67 | 65.60 |
| Line-13 | 1.77 | 0.19 | 0.68 | 0.36 | 0.76 | 201.80 | 1.57 | 7.83 | 81.80 |
| Line-14 | 2.00 | 0.19 | 0.81 | 0.30 | 0.05 | 86.67 | 0.29 | 1.44 | 69.00 |
| Line-15 | 1.90 | 0.17 | 0.79 | 0.28 | 0.07 | 61.60 | 0.22 | 1.12 | 57.40 |

Table 21: Provided are the values of each of the parameters (as described above) measured in Barley accessions (line) under normal conditions (at reproductive stage). Growth conditions are specified in the experimental procedure section.

TABLE 22

Measured parameters of correlation IDs in additional Barley accessions under accessions under normal conditions (at reproductive stage)

| Corr. ID/Line | 10 | 11 | 12 | 13 | 14 | 15 | 16 | 17 |
|---|---|---|---|---|---|---|---|---|
| Line-1 | 39.91 | 6.00 | 11.40 | 10.80 | 16.00 | 17.42 | 68.69 | 0.69 |
| Line-2 | 26.24 | 6.00 | 13.44 | 9.00 | 14.60 | 17.76 | 61.85 | 1.08 |
| Line-3 | 17.31 | 6.00 | 13.74 | 12.20 | 16.20 | 8.25 | 76.94 | 0.77 |
| Line-4 | 32.91 | 6.00 | 10.62 | 8.40 | 14.00 | 7.28 | 59.63 | 0.38 |
| Line-5 | 33.87 | 6.00 | 11.34 | 7.80 | 12.50 | 13.25 | 65.63 | 0.83 |
| Line-6 | 83.84 | 2.00 | 15.06 | 14.50 | 18.80 | 11.32 | 79.84 | 0.42 |
| Line-7 | 29.65 | 6.00 | 11.64 | 8.40 | 11.60 | 8.95 | 73.85 | 0.29 |
| Line-8 | 37.21 | 2.00 | 12.18 | 15.00 | 21.20 | 14.18 | 71.01 | 0.57 |
| Line-9 | 44.38 | 2.00 | 11.64 | 25.00 | 23.50 | 15.68 | 95.83 | 0.60 |
| Line-10 | 14.46 | 5.20 | 8.76 | 7.00 | 11.00 | 6.42 | 64.87 | 0.55 |
| Line-11 | 41.54 | 6.00 | 9.15 | 11.60 | 16.00 | 55.92 | 68.75 | 2.88 |
| Line-12 | 23.75 | 6.00 | 12.42 | 7.60 | 10.75 | 11.54 | 74.24 | 1.36 |
| Line-13 | 20.87 | 6.00 | 12.18 | 5.40 | 6.75 | 10.88 | 81.40 | 0.89 |
| Line-14 | 49.69 | 2.00 | 5.68 | 16.40 | 35.00 | 58.92 | 37.14 | 2.49 |
| Line-15 | 54.02 | 2.00 | 5.04 | 12.00 |  | 17.05 |  | 0.40 |

Table 22. Provided are the values of each of the parameters (as described above) measured in Barley accessions (line) under normal conditions (at reproductive stage). Growth conditions are specified in the experimental procedure section.

TABLE 23

Additional measured parameters of correlation IDs in Barley accessions under Drought conditions

| Corr. ID/Line | 1 | 2 | 3 | 4 | 5 | 6 | 7 | 8 | 9 | 10 | 11 |
|---|---|---|---|---|---|---|---|---|---|---|---|
| Line-1 | 41.33 | 6.15 | 0.22 | 1.90 | 170.00 | 5.55 | 0.47 | 75.00 | 0.27 | 0.07 | 46.00 |
| Line-2 | 33.57 | 5.05 | 0.21 | 1.52 | 267.50 | 9.80 | 0.66 | 71.00 | 0.86 | 0.10 | 52.86 |
| Line-3 | 36.57 | 3.20 |  | 1.17 | 111.00 | 3.55 | 0.53 | 65.00 | 0.73 | 0.06 | 35.00 |
| Line-4 | 40.50 | 3.28 |  | 1.95 | 205.33 | 7.20 | 0.69 |  | 0.88 | 0.07 | 38.00 |
| Line-5 | 45.07 | 4.76 |  | 1.90 | 153.60 | 5.28 | 0.53 | 66.75 | 0.40 | 0.16 | 45.20 |
| Line-6 | 39.73 | 3.55 | 0.17 | 1.22 | 252.50 | 7.75 | 0.69 | 90.00 | 0.94 | 0.06 | 48.00 |
| Line-7 | 38.33 | 4.52 |  | 1.75 | 288.40 | 9.92 | 0.69 | 90.00 | 0.70 | 0.10 | 37.67 |
| Line-8 | 36.17 | 3.38 |  | 1.58 | 274.50 | 10.25 | 0.75 |  | 0.71 | 0.05 | 41.20 |
| Line-9 | 42.13 | 5.67 | 0.25 | 1.88 | 348.50 | 8.50 | 0.60 | 90.00 | 0.77 | 0.10 | 40.80 |
| Line-10 | 31.77 | 3.31 |  | 1.73 | 358.00 | 14.03 | 0.81 |  | 0.80 | 0.06 | 49.86 |
| Line-11 | 33.47 | 2.65 |  | 1.00 | 521.39 | 17.52 | 0.87 |  | 0.92 | 0.06 | 43.00 |
| Line-12 | 42.37 | 5.12 | 0.13 | 0.90 | 71.50 | 2.05 | 0.29 | 90.00 | 0.39 | 0.18 | 47.40 |
| Line-13 | 42.27 | 6.86 | 0.19 | 0.90 | 160.13 | 5.38 | 0.44 | 81.60 | 0.88 | 0.15 | 64.80 |

TABLE 23-continued

Additional measured parameters of correlation IDs in Barley accessions under Drought conditions

| Corr. ID/ Line | 1 | 2 | 3 | 4 | 5 | 6 | 7 | 8 | 9 | 10 | 11 |
|---|---|---|---|---|---|---|---|---|---|---|---|
| Line-14 | 36.77 | 3.11 | 0.22 | 1.43 | 376.67 | 11.00 | 0.78 | 90.00 | −0.13 | 0.02 | 52.60 |
| Line-15 | 40.63 | 3.74 | | 0.83 | 105.00 | 2.56 | 0.41 | | 0.20 | 0.44 | 32.00 |

Table 23: Provided are the values of each of the parameters (as described above) measured in Barley accessions (line) under drought growth conditions. Growth conditions are specified in the experimental procedure section.

TABLE 24

Additional measured parameters of correlation IDs in additional Barley accessions under Drought conditions

| Corr. ID/ Line | 12 | 13 | 14 | 15 | 16 | 17 | 18 | 19 | 20 | 21 | 22 | 22 | 23 |
|---|---|---|---|---|---|---|---|---|---|---|---|---|---|
| Line-1 | 0.01 | 80.60 | 77.52 | 2.07 | 21.67 | 0.09 | 16.70 | 4.20 | 17.72 | 8.64 | 11.68 | 11.68 | 8.33 |
| Line-2 | 0.01 | 53.40 | 60.19 | 1.48 | 20.33 | −0.12 | 16.85 | 4.36 | 24.24 | 9.07 | 9.04 | 9.04 | 8.67 |
| Line-3 | 0.01 | 55.87 | 27.13 | 1.12 | 22.00 | 0.00 | 13.27 | 7.60 | 18.20 | 7.83 | 10.92 | 10.92 | 7.33 |
| Line-4 | 0.01 | | 18.62 | 1.87 | 24.00 | 0.01 | 13.55 | 8.44 | 18.00 | 7.32 | 10.16 | 10.16 | 7.67 |
| Line-5 | 0.03 | 43.22 | 117.42 | 1.67 | 20.67 | 0.04 | 14.19 | 4.92 | 19.50 | 8.74 | 10.32 | 10.32 | 6.67 |
| Line-6 | 0.02 | 69.78 | 70.72 | 1.68 | 18.33 | −0.07 | 15.64 | 3.43 | 15.00 | 7.62 | 8.78 | 8.78 | 6.67 |
| Line-7 | 0.01 | 45.49 | 37.34 | 1.62 | 21.00 | 0.01 | 15.66 | 6.90 | 23.40 | 6.98 | 13.00 | 13.00 | 7.67 |
| Line-8 | 0.01 | 76.51 | 25.56 | 0.85 | 20.33 | 0.00 | 17.49 | 5.80 | 28.16 | 8.05 | 7.44 | 7.44 | 6.67 |
| Line-9 | 0.01 | 87.41 | 66.18 | 1.45 | 21.67 | −0.06 | 16.00 | 8.55 | 21.96 | 6.06 | 13.92 | 13.92 | 6.00 |
| Line-10 | 0.01 | | 22.13 | 1.38 | 19.67 | 0.04 | 18.31 | 9.67 | 33.03 | 6.73 | 11.00 | 11.00 | 8.67 |
| Line-11 | 0.02 | | 41.12 | 0.82 | 16.67 | 0.05 | 17.42 | 5.42 | 34.80 | 9.55 | 6.78 | 6.78 | 7.67 |
| Line-12 | 0.02 | 58.32 | 116.95 | 0.58 | 17.00 | 0.00 | 14.23 | 3.05 | 11.73 | 7.84 | 8.45 | 8.45 | 6.33 |
| Line-13 | 0.01 | 80.58 | 84.10 | 0.63 | 15.17 | −0.07 | 14.81 | 4.07 | 18.78 | 7.81 | 9.15 | 9.15 | 7.00 |
| Line-14 | 0.01 | 73.09 | 37.46 | 1.07 | 27.00 | 0.03 | 16.54 | 3.72 | 21.00 | 8.35 | 5.12 | 5.12 | 7.00 |
| Line-15 | 0.03 | | 98.86 | 0.70 | 15.00 | −0.06 | 12.72 | 3.21 | 9.88 | 5.47 | 16.13 | 16.13 | 6.67 |

Table 24. Provided are the values of each of the parameters (as described above) measured in Barley accessions (line) under drought growth conditions. Growth conditions are specified in the experimental procedure section.

TABLE 25

Correlation between the expression level of selected genes of some embodiments of the invention in various tissues and the phenotypic performance under low nitrogen and normal conditions (at vegetative stage) across Barley accessions

| Gene Name | R | P value | Exp. set | Cor. Set ID | Gene Name | R | P value | Exp. set | Cor. Set ID |
|---|---|---|---|---|---|---|---|---|---|
| LNU749 | 0.76 | 1.75E−02 | 1 | 15 | LNU750 | 0.73 | 2.45E−02 | 2 | 27 |
| LNU750 | 0.77 | 1.54E−02 | 2 | 17 | LNU750 | 0.87 | 2.60E−03 | 3 | 35 |
| LNU751 | 0.89 | 1.30E−03 | 1 | 15 | LNU751 | 0.98 | 2.69E−06 | 2 | 27 |
| LNU751 | 0.93 | 2.74E−04 | 2 | 17 | LNU751 | 0.76 | 1.76E−02 | 3 | 15 |
| LNU752 | 0.72 | 2.74E−02 | 1 | 15 | LNU752 | 0.92 | 5.34E−04 | 2 | 27 |
| LNU752 | 0.86 | 2.91E−03 | 2 | 17 | LNU753 | 0.84 | 4.60E−03 | 3 | 31 |
| LNU753 | 0.74 | 2.15E−02 | 3 | 19 | LNU754 | 0.85 | 3.73E−03 | 1 | 19 |
| LNU7S4 | 0.78 | 1.29E−02 | 1 | 38 | LNU754 | 0.84 | 5.09E−03 | 2 | 21 |
| LNU754 | 0.71 | 3.26E−02 | 3 | 31 | LNU754 | 0.86 | 3.31E−03 | 3 | 19 |
| LNU754 | 0.80 | 8.98E−03 | 3 | 3 | LNU754 | 0.86 | 3.10E−03 | 3 | 38 |
| LNU756 | 0.94 | 4.00E−04 | 4 | 18 | LNU756 | 0.72 | 4.47E−02 | 4 | 27 |
| LNU756 | 0.74 | 3.76E−02 | 4 | 17 | LNU756 | 0.70 | 2.33E−02 | 5 | 35 |
| LNU756 | 0.87 | 9.76E−04 | 5 | 8 | LNU756 | 0.70 | 2.33E−02 | 5 | 38 |
| LNU756 | 0.74 | 1.40E−02 | 5 | 6 | LNU756 | 0.78 | 1.34E−02 | 3 | 31 |
| LNU756 | 0.72 | 2.94E−02 | 3 | 38 | LNU757 | 0.70 | 5.28E−02 | 6 | 28 |
| LNU757 | 0.77 | 9.44E−03 | 5 | 6 | LNU757 | 0.88 | 1.66E−03 | 3 | 20 |
| LNU758 | 0.79 | 2.06E−02 | 4 | 14 | LNU758 | 0.86 | 1.27E−03 | 5 | 20 |
| LNU758 | 0.77 | 1.60E−02 | 3 | 24 | LNU759 | 0.80 | 8.91E−03 | 3 | 3 |
| LNU759 | 0.72 | 2.87E−02 | 3 | 8 | LNU760 | 0.73 | 3.85E−02 | 4 | 18 |
| LNU760 | 0.74 | 2.15E−02 | 3 | 19 | LNU760 | 0.79 | 1.07E−02 | 3 | 3 |
| LNU760 | 0.85 | 4.06E−03 | 3 | 22 | LNU760 | 0.73 | 2.57E−02 | 3 | 38 |
| LNU760 | 0.70 | 3.50E−02 | 3 | 6 | LNU761 | 0.73 | 4.00E−02 | 6 | 10 |
| LNU761 | 0.81 | 1.47E−02 | 6 | 27 | LNU761 | 0.90 | 2.64E−03 | 6 | 13 |
| LNU761 | 0.74 | 2.34E−02 | 1 | 15 | LNU76I | 0.83 | 1.07E−02 | 4 | 14 |
| LNU761 | 0.83 | 6.15E−03 | 2 | 27 | LNU761 | 0.76 | 1.68E−02 | 2 | 17 |
| LNU761 | 0.86 | 3.06E−03 | 3 | 31 | LNU761 | 0.73 | 2.49E−02 | 3 | 19 |
| LNU762 | 0.71 | 4.71E−02 | 6 | 27 | LNU762 | 0.84 | 9.31E−03 | 6 | 13 |

TABLE 25-continued

Correlation between the expression level of selected genes of some embodiments of the invention in various tissues and the phenotypic performance under low nitrogen and normal conditions (at vegetative stage) across Barley accessions

| Gene Name | R | P value | Exp. set | Cor. Set ID | Gene Name | R | P value | Exp. set | Cor. Set ID |
|---|---|---|---|---|---|---|---|---|---|
| LNU762 | 0.84 | 4.92E−03 | 1 | 7 | LNU762 | 0.76 | 1.68E−02 | 1 | 37 |
| LNU763 | 0.81 | 1.58E−02 | 6 | 5 | LNU763 | 0.73 | 2.70E−02 | 2 | 18 |
| LNU763 | 0.74 | 2.30E−02 | 2 | 27 | LNU763 | 0.74 | 2.25E−02 | 2 | 17 |
| LNU764 | 0.73 | 3.83E−02 | 4 | 18 | LNU764 | 0.77 | 9.51E−03 | 5 | 26 |
| LNU764 | 0.77 | 8.83E−03 | 5 | 7 | LNU764 | 0.75 | 1.26E−02 | 5 | 25 |
| LNU764 | 0.74 | 1.50E−02 | 5 | 33 | LNU764 | 0.76 | 1.85E−02 | 3 | 7 |
| LNU764 | 0.76 | 1.68E−02 | 3 | 36 | LNU764 | 0.80 | 9.88E−03 | 3 | 16 |
| LNU766 | 0.71 | 4.88E−02 | 6 | 27 | LNU766 | 0.77 | 2.65E−02 | 6 | 13 |
| LNU766 | 0.71 | 3.21E−02 | 1 | 8 | LNU766 | 0.87 | 2.11E−03 | 1 | 20 |
| LNU766 | 0.73 | 4.02E−02 | 4 | 14 | LNU766 | 0.78 | 7.63E−03 | 5 | 19 |
| LNU766 | 0.83 | 2.85E−03 | 5 | 3 | LNU766 | 0.77 | 9.25E−03 | 5 | 8 |
| LNU766 | 0.83 | 6.19E−03 | 2 | 21 | LNU766 | 0.71 | 3.08E−02 | 3 | 15 |
| LNU767 | 0.76 | 1.02E−02 | 5 | 31 | LNU767 | 0.77 | 1.54E−02 | 3 | 31 |
| LNU768 | 0.84 | 8.81E−03 | 6 | 13 | LNU768 | 0.77 | 1.43E−02 | 1 | 35 |
| LNU768 | 0.72 | 2.93E−02 | 1 | 6 | LNU768 | 0.74 | 3.42E−02 | 4 | 10 |
| LNU768 | 0.85 | 3.32E−03 | 3 | 31 | LNU769 | 0.74 | 2.19E−02 | 1 | 24 |
| LNU769 | 0.77 | 9.46E−03 | 5 | 20 | LNU769 | 0.72 | 2.94E−02 | 2 | 11 |
| LNU770 | 0.79 | 6.40E−03 | 5 | 19 | LNU770 | 0.77 | 9.80E−03 | 5 | 35 |
| LNU770 | 0.94 | 4.58E−05 | 5 | 38 | LNU770 | 0.81 | 4.44E−03 | 5 | 6 |
| LNU770 | 0.73 | 2.54E−02 | 3 | 19 | LNU770 | 0.78 | 1.29E−02 | 3 | 3 |
| LNU770 | 0.83 | 6.19E−03 | 3 | 38 | LNU770 | 0.72 | 2.94E−02 | 3 | 6 |
| LNU771 | 0.74 | 3.66E−02 | 4 | 10 | LNU771 | 0.90 | 2.59E−03 | 4 | 18 |
| LNU771 | 0.76 | 1.64E−02 | 2 | 29 | LNU772 | 0.72 | 4.44E−02 | 6 | 5 |
| LNU772 | 0.73 | 4.12E−02 | 4 | 34 | LNU772 | 0.70 | 5.24E−02 | 4 | 18 |
| LNU772 | 0.77 | 1.60E−02 | 2 | 18 | LNU773 | 0.78 | 2.35E−02 | 6 | 12 |
| LNU773 | 0.75 | 3.21E−02 | 6 | 27 | LNU773 | 0.72 | 3.00E−02 | 1 | 20 |
| LNU773 | 0.88 | 7.99E−04 | 5 | 8 | LNU773 | 0.82 | 7.06E−03 | 3 | 31 |
| LNU773 | 0.93 | 3.04E−04 | 3 | 19 | LNU773 | 0.84 | 4.98E−03 | 3 | 3 |
| LNU773 | 0.94 | 2.08E−04 | 3 | 38 | LNU773 | 0.82 | 6.35E−03 | 3 | 6 |
| LNU774 | 0.92 | 1.27E−03 | 6 | 5 | LNU774 | 0.83 | 5.80E−03 | 1 | 31 |
| LNU774 | 0.73 | 2.53E−02 | 1 | 19 | LNU774 | 0.75 | 1.97E−02 | 1 | 38 |
| LNU774 | 0.73 | 3.92E−02 | 4 | 1 | LNU774 | 0.80 | 1.80E−02 | 4 | 27 |
| LNU774 | 0.80 | 1.70E−02 | 4 | 17 | LNU774 | 0.84 | 4.74E−03 | 2 | 18 |
| LNU774 | 0.85 | 3.61E−03 | 2 | 27 | LNU774 | 0.86 | 2.84E−03 | 2 | 17 |
| LNU774 | 0.93 | 3.07E−04 | 3 | 31 | LNU774 | 0.84 | 5.09E−03 | 3 | 19 |
| LNU774 | 0.74 | 2.28E−02 | 3 | 35 | LNU774 | 0.89 | 1.46E−03 | 3 | 38 |
| LNU774 | 0.77 | 1.45E−02 | 3 | 6 | LNU775 | 0.72 | 4.43E−02 | 6 | 21 |
| LNU775 | 0.73 | 4.07E−02 | 6 | 27 | LNU775 | 0.76 | 2.95E−02 | 6 | 13 |
| LNU775 | 0.70 | 3.53E−02 | 1 | 24 | LNU775 | 0.73 | 3.80E−02 | 4 | 2 |
| LNU775 | 0.78 | 1.28E−02 | 3 | 31 | LNU775 | 0.71 | 3.36E−02 | 3 | 38 |
| LNU776 | 0.82 | 1.33E−02 | 4 | 28 | LNU776 | 0.89 | 2.89E−03 | 4 | 13 |
| LNU776 | 0.80 | 9.89E−03 | 3 | 31 | LNU776 | 0.73 | 2.67E−02 | 3 | 19 |
| LNU776 | 0.79 | 1.15E−02 | 3 | 35 | LNU776 | 0.83 | 5.87E−03 | 3 | 38 |
| LNU776 | 0.88 | 1.76E−03 | 3 | 6 | LNU776 | 0.79 | 1.14E−02 | 3 | 16 |
| LNU777 | 0.94 | 4.33E−04 | 6 | 17 | LNU777 | 0.87 | 2.53E−03 | 1 | 19 |
| LNU777 | 0.96 | 4.74E−05 | 1 | 38 | LNU777 | 0.79 | 1.16E−02 | 1 | 6 |
| LNU777 | 0.83 | 5.49E−03 | 3 | 31 | LNU777 | 0.86 | 3.12E−03 | 3 | 19 |
| LNU777 | 0.80 | 9.73E−03 | 3 | 38 | LNU77S | 0.79 | 1.94E−02 | 6 | 13 |
| LNU778 | 0.87 | 4.98E−03 | 6 | 14 | LNU778 | 0.73 | 1.74E−02 | 5 | 25 |
| LNU778 | 0.70 | 2.30E−02 | 5 | 33 | LNU778 | 0.82 | 7.02E−03 | 2 | 2 |
| LNU778 | 0.74 | 2.19E−02 | 3 | 3 | LNU778 | 0.79 | 1.12E−02 | 3 | 38 |
| LNU778 | 0.82 | 7.05E−03 | 3 | 6 | LNU779 | 0.77 | 1.61E−02 | 3 | 19 |
| LNU779 | 0.91 | 7.64E−04 | 3 | 3 | LNU779 | 0.74 | 2.40E−02 | 3 | 8 |
| LNU779 | 0.82 | 7.27E−03 | 3 | 38 | LNU779 | 0.73 | 2.55E−02 | 3 | 6 |
| LNU780 | 0.74 | 3.59E−02 | 4 | 1 | LNU780 | 0.73 | 1.56E−02 | 5 | 8 |
| LNU780 | 0.77 | 8.82E−03 | 5 | 38 | LNU780 | 0.76 | 1.80E−02 | 2 | 27 |
| LNU780 | 0.75 | 2.06E−02 | 2 | 17 | LNU780 | 0.91 | 6.27E−04 | 3 | 31 |
| LNU780 | 0.86 | 2.62E−03 | 3 | 19 | LNU780 | 0.82 | 7.00E−03 | 3 | 38 |
| LNU781 | 0.73 | 4.00E−02 | 6 | 17 | LNU781 | 0.74 | 2.31E−02 | 1 | 31 |
| LNU781 | 0.70 | 2.29E−02 | 5 | 19 | LNU781 | 0.83 | 3.24E−02 | 5 | 38 |
| LNU781 | 0.88 | 1.93E−03 | 2 | 27 | LNU781 | 0.89 | 1.49E−03 | 2 | 17 |
| LNU781 | 0.73 | 2.64E−02 | 3 | 15 | LNU782 | 0.79 | 2.01E−02 | 4 | 34 |
| LNU782 | 0.72 | 4.27E−02 | 4 | 21 | LNU782 | 0.71 | 5.05E−02 | 4 | 13 |
| LNU783 | 0.79 | 1.92E−02 | 6 | 13 | LNU783 | 0.73 | 2.48E−02 | 3 | 7 |
| LNU783 | 0.74 | 2.19E−02 | 3 | 36 | LNU784 | 0.76 | 2.89E−02 | 6 | 5 |
| LNU784 | 0.96 | 5.76E−05 | 2 | 27 | LNU784 | 0.92 | 4.48E−04 | 2 | 17 |
| LNU784 | 0.78 | 1.26E−02 | 3 | 35 | LNU785 | 0.73 | 3.88E−02 | 6 | 34 |
| LNU785 | 0.82 | 1.24E−02 | 6 | 12 | LNU785 | 0.85 | 7.06E−03 | 6 | 10 |
| LNU785 | 0.73 | 4.02E−02 | 6 | 4 | LNU785 | 0.78 | 2.36E−02 | 6 | 27 |
| LNU785 | 0.80 | 1.77E−02 | 6 | 13 | LNU785 | 0.81 | 8.50E−03 | 1 | 20 |
| LNU785 | 0.70 | 2.42E−02 | 5 | 7 | LNU785 | 0.76 | 1.15E−02 | 5 | 24 |

TABLE 25-continued

Correlation between the expression level of selected genes of some embodiments of the invention in various tissues and the phenotypic performance under low nitrogen and normal conditions (at vegetative stage) across Barley accessions

| Gene Name | R | P value | Exp. set | Cor. Set ID | Gene Name | R | P value | Exp. set | Cor. Set ID |
|---|---|---|---|---|---|---|---|---|---|
| LNU785 | 0.80 | 5.77E−03 | 5 | 25 | LNU785 | 0.81 | 4.47E−03 | 5 | 33 |
| LNU785 | 0.94 | 1.75E−04 | 2 | 27 | LNU785 | 0.90 | 8.48E−04 | 2 | 17 |

Table 25. Provided are the correlations (R) between the expression levels yield improving genes and their homologs in various tissues [Expression (Exp) sets] and the phenotypic performance [yield, biomass, growth rate and/or vigor components (Correlation vector (Cor))] under normal and low nitrogen conditions across barley varieties. P = p value.

TABLE 26

Correlation between the expression level of selected genes of some embodiments of the invention in various tissues and the phenotypic performance under low nitrogen and normal conditions (at reproductive stage) across Barley accessions

| Gene Name | R | P value | Exp. set | Cor. Set ID | Gene Name | R | P value | Exp. set | Cor. Set ID |
|---|---|---|---|---|---|---|---|---|---|
| LNU749 | 0.701 | 2.39E−02 | 3 | 4 | LNU749 | 0.744 | 1.36E−02 | 3 | 10 |
| LNU749 | 0.715 | 2.00E−02 | 3 | 12 | LNU749 | 0.730 | 1.66E−02 | 6 | 15 |
| LNU749 | 0.801 | 5.32E−03 | 6 | 10 | LNU749 | 0.713 | 2.05E−02 | 5 | 14 |
| LNU749 | 0.736 | 1.52E−02 | 4 | 9 | LNU750 | 0.707 | 2.22E−02 | 1 | 9 |
| LNU751 | 0.854 | 1.67E−03 | 3 | 13 | LNU753 | 0.713 | 2.06E−02 | 2 | 6 |
| LNU753 | 0.781 | 7.69E−03 | 2 | 7 | LNU753 | 0.814 | 4.12E−03 | 2 | 8 |
| LNU753 | 0.752 | 1.22E−02 | 2 | 12 | LNU753 | 0.793 | 6.18E−03 | 3 | 17 |
| LNU754 | 0.707 | 2.23E−02 | 5 | 2 | LNU754 | 0.708 | 2.21E−02 | 5 | 1 |
| LNU754 | 0.734 | 1.56E−02 | 5 | 3 | LNU756 | 0.759 | 1.10E−02 | 4 | 17 |
| LNU757 | 0.886 | 6.40E−04 | 2 | 14 | LNU757 | 0.837 | 2.52E−03 | 2 | 13 |
| LNU757 | 0.761 | 1.05E−02 | 6 | 10 | LNU757 | 0.747 | 1.29E−02 | 1 | 13 |
| LNU758 | 0.765 | 9.99E−03 | 6 | 15 | LNU758 | 0.746 | 1.32E−02 | 1 | 9 |
| LNU759 | 0.720 | 1.88E−02 | 2 | 5 | LNU759 | 0.739 | 1.45E−02 | 2 | 7 |
| LNU759 | 0.715 | 2.01E−02 | 2 | 8 | LNU760 | 0.732 | 1.61E−02 | 2 | 13 |
| LNU761 | 0.784 | 7.28E−03 | 3 | 17 | LNU761 | 0.759 | 1.08E−02 | 6 | 6 |
| LNU761 | 0.720 | 1.89E−02 | 6 | 5 | LNU761 | 0.737 | 1.49E−02 | 6 | 7 |
| LNU761 | 0.731 | 1.62E−02 | 6 | 8 | LNU761 | 0.745 | 1.33E−02 | 5 | 17 |
| LNU762 | 0.745 | 1.34E−02 | 5 | 13 | LNU763 | 0.721 | 1.87E−02 | 2 | 13 |
| LNU763 | 0.838 | 2.46E−03 | 6 | 15 | LNU763 | 0.797 | 5.78E−03 | 5 | 14 |
| LNU763 | 0.719 | 1.91E−02 | 4 | 15 | LNU764 | 0.729 | 1.68E−02 | 3 | 13 |
| LNU764 | 0.719 | 1.91E−02 | 3 | 16 | LNU764 | 0.746 | 1.32E−02 | 5 | 4 |
| LNU764 | 0.709 | 2.17E−02 | 5 | 10 | LNU764 | 0.762 | 1.03E−02 | 1 | 9 |
| LNU766 | 0.766 | 9.84E−03 | 2 | 9 | LNU766 | 0.718 | 1.94E−02 | 3 | 9 |
| LNU766 | 0.763 | 1.03E−02 | 1 | 17 | LNU766 | 0.782 | 7.49E−03 | 1 | 9 |
| LNU767 | 0.822 | 3.53E−03 | 5 | 17 | LNU768 | 0.728 | 1.70E−02 | 5 | 14 |
| LNU769 | 0.705 | 2.28E−02 | 2 | 1 | LNU769 | 0.713 | 2.07E−02 | 2 | 3 |
| LNU769 | 0.819 | 3.79E−03 | 3 | 4 | LNU769 | 0.820 | 3.67E−03 | 3 | 10 |
| LNU769 | 0.723 | 1.81E−02 | 1 | 16 | LNU770 | 0.732 | 1.62E−02 | 2 | 13 |
| LNU770 | 0.848 | 1.93E−03 | 3 | 13 | LNU770 | 0.772 | 8.95E−03 | 3 | 16 |
| LNU771 | 0.714 | 2.04E−02 | 6 | 11 | LNU771 | 0.724 | 1.80E−02 | 5 | 4 |
| LNU771 | 0.855 | 1.61E−03 | 1 | 5 | LNU772 | 0.718 | 1.93E−02 | 3 | 2 |
| LNU772 | 0.789 | 6.71E−03 | 6 | 15 | LNU773 | 0.801 | 5.36E−03 | 3 | 14 |
| LNU773 | 0.797 | 5.81E−03 | 3 | 13 | LNU773 | 0.860 | 1.43E−03 | 5 | 4 |
| LNU773 | 0.836 | 2.56E−03 | 1 | 4 | LNU774 | 0.765 | 9.96E−03 | 3 | 4 |
| LNU774 | 0.710 | 3.21E−02 | 6 | 16 | LNU774 | 0.848 | 1.94E−03 | 1 | 4 |
| LNU774 | 0.722 | 1.84E−02 | 1 | 10 | LNU775 | 0.842 | 2.23E−03 | 5 | 16 |
| LNU775 | 0.753 | 1.19E−02 | 4 | 5 | LNU776 | 0.804 | 5.07E−03 | 2 | 4 |
| LNU776 | 0.786 | 7.03E−03 | 2 | 14 | LNU776 | 0.717 | 1.97E−02 | 2 | 13 |
| LNU776 | 0.708 | 2.21E−02 | 5 | 17 | LNU777 | 0.834 | 2.67E−03 | 2 | 13 |
| LNU777 | 0.769 | 9.38E−03 | 4 | 4 | LNU778 | 0.709 | 2.16E−02 | 3 | 7 |
| LNU778 | 0.805 | 4.95E−03 | 3 | 10 | LNU778 | 0.714 | 2.04E−02 | 3 | 8 |
| LNU778 | 0.712 | 2.10E−02 | 3 | 12 | LNU778 | 0.750 | 1.24E−02 | 6 | 2 |
| LNU778 | 0.759 | 1.09E−02 | 4 | 2 | LNU778 | 0.803 | 5.15E−03 | 4 | 1 |
| LNU778 | 0.803 | 5.20E−03 | 4 | 3 | LNU779 | 0.856 | 1.58E−03 | 3 | 14 |
| LNU779 | 0.873 | 9.80E−04 | 3 | 13 | LNU779 | 0.772 | 8.88E−03 | 5 | 10 |
| LNU781 | 0.715 | 2.01E−02 | 3 | 15 | LNU782 | 0.733 | 1.58E−02 | 3 | 13 |
| LNU782 | 0.776 | 8.33E−03 | 5 | 4 | LNU782 | 0.730 | 1.66E−02 | 4 | 17 |
| LNU782 | 0.784 | 7.30E−03 | 4 | 9 | LNU782 | 0.806 | 4.87E−03 | 1 | 4 |
| LNU782 | 0.858 | 1.48E−03 | 1 | 10 | LNU783 | 0.734 | 1.57E−02 | 2 | 6 |
| LNU783 | 0.829 | 3.01E−03 | 2 | 7 | LNU783 | 0.848 | 1.93E−03 | 2 | 8 |
| LNU783 | 0.800 | 5.45E−03 | 2 | 12 | LNU783 | 0.758 | 1.11E−02 | 3 | 4 |
| LNU783 | 0.734 | 1.57E−02 | 3 | 16 | LNU783 | 0.724 | 1.79E−02 | 5 | 15 |
| LNU783 | 0.885 | 6.72E−04 | 1 | 16 | LNU784 | 0.801 | 5.32E−03 | 3 | 14 |
| LNU784 | 0.763 | 1.03E−02 | 3 | 13 | LNU784 | 0.846 | 2.03E−03 | 5 | 10 |
| LNU784 | 0.744 | 1.37E−02 | 4 | 15 | LNU784 | 0.713 | 2.07E−02 | 4 | 10 |

TABLE 26-continued

Correlation between the expression level of selected genes of some embodiments of the invention in various tissues and the phenotypic performance under low nitrogen and normal conditions (at reproductive stage) across Barley accessions

| Gene Name | R | P value | Exp. set | Cor. Set ID | Gene Name | R | P value | Exp. set | Cor. Set ID |
|---|---|---|---|---|---|---|---|---|---|
| LNU784 | 0.779 | 7.88E−03 | 1 | 4 | LNU784 | 0.832 | 2.86E−03 | 1 | 10 |
| LNU785 | 0.740 | 1.43E−02 | 5 | 14 | | | | | |

Table 26. Provided are the correlations (R) between the expression levels yield improving genes and their homologs in various tissues [Expression (Exp) sets] and the phenotypic performance [yield, biomass, growth rate and/or vigor components (Correlation vector (Cor))] under normal and low nitrogen conditions across barley varieties. P = p value.

TABLE 27

Correlation between the expression level of selected genes of some embodiments of the invention in various tissues and the phenotypic performance under drought conditions across Barley accessions

| Gene Name | R | P value | Exp. set | Cor. Set ID | Gene Name | R | P value | Exp. set | Cor. Set ID |
|---|---|---|---|---|---|---|---|---|---|
| LNU749 | 0.859 | 2.82E−02 | 1 | 18 | LNU749 | 0.780 | 6.74E−02 | 1 | 11 |
| LNU749 | 0.818 | 4.66E−02 | 1 | 20 | LNU749 | 0.798 | 1.76E−02 | 3 | 10 |
| LNU749 | 0.759 | 2.90E−02 | 3 | 16 | LNU749 | 0.727 | 4.12E−02 | 3 | 11 |
| LNU749 | 0.735 | 3.79E−02 | 5 | 22 | LNU749 | 0.858 | 6.39E−03 | 5 | 4 |
| LNU749 | 0.763 | 2.77E−02 | 5 | 15 | LNU749 | 0.739 | 2.30E−02 | 4 | 19 |
| LNU749 | 0.844 | 1.69E−02 | 4 | 13 | LNU749 | 0.730 | 2.56E−02 | 4 | 12 |
| LNU749 | 0.717 | 2.96E−02 | 4 | 14 | LNU750 | 0.855 | 2.99E−02 | 1 | 12 |
| LNU750 | 0.820 | 4.59E−02 | 1 | 2 | LNU750 | 0.872 | 2.37E−02 | 1 | 14 |
| LNU750 | 0.912 | 4.21E−03 | 3 | 13 | LNU750 | 0.816 | 1.35E−02 | 3 | 14 |
| LNU750 | 0.787 | 2.05E−02 | 3 | 1 | LNU750 | 0.700 | 7.97E−02 | 2 | 6 |
| LNU751 | 0.754 | 8.34E−02 | 1 | 2 | LNU751 | 0.762 | 7.82E−02 | 1 | 14 |
| LNU751 | 0.743 | 9.09E−02 | 1 | 1 | LNU751 | 0.778 | 2.29E−02 | 3 | 10 |
| LNU751 | 0.887 | 3.28E−03 | 3 | 11 | LNU751 | 0.737 | 5.88E−02 | 2 | 1 |
| LNU751 | 0.700 | 3.56E−02 | 4 | 12 | LNU753 | 0.734 | 3.82E−02 | 3 | 21 |
| LNU753 | 0.843 | 1.73E−02 | 2 | 21 | LNU753 | 0.819 | 2.41E−02 | 2 | 12 |
| LNU753 | 0.777 | 2.33E−02 | 5 | 10 | LNU753 | 0.840 | 9.13E−03 | 5 | 11 |
| LNU753 | 0.749 | 3.24E−02 | 5 | 2 | LNU754 | 0.743 | 9.03E−02 | 1 | 21 |
| LNU754 | 0.711 | 4.80E−02 | 3 | 12 | LNU754 | 0.849 | 1.57E−02 | 6 | 13 |
| LNU754 | 0.747 | 2.08E−02 | 6 | 2 | LNU754 | 0.706 | 3.36E−02 | 6 | 14 |
| LNU754 | 0.970 | 6.62E−05 | 5 | 14 | LNU756 | 0.784 | 6.48E−02 | 1 | 19 |
| LNU756 | 0.797 | 5.77E−02 | 1 | 23 | LNU756 | 0.945 | 3.89E−04 | 3 | 19 |
| LNU756 | 0.767 | 2.64E−02 | 3 | 22 | LNU756 | 0.830 | 5.66E−03 | 6 | 16 |
| LNU756 | 0.825 | 2.23E−02 | 2 | 5 | LNU756 | 0.835 | 1.93E−02 | 2 | 6 |
| LNU756 | 0.744 | 5.51E−02 | 2 | 20 | LNU756 | 0.883 | 3.69E−03 | 5 | 19 |
| LNU756 | 0.886 | 1.45E−03 | 4 | 19 | LNU756 | 0.818 | 7.03E−03 | 4 | 22 |
| LNU756 | 0.758 | 1.79E−02 | 4 | 4 | LNU757 | 0.713 | 1.12E−01 | 1 | 10 |
| LNU757 | 0.857 | 2.94E−02 | 1 | 23 | LNU757 | 0.712 | 1.13E−01 | 1 | 6 |
| LNU757 | 0.798 | 5.73E−02 | 1 | 17 | LNU757 | 0.759 | 7.99E−02 | 1 | 20 |
| LNU757 | 0.754 | 5.01E−02 | 2 | 11 | LNU757 | 0.882 | 3.71E−03 | 5 | 19 |
| LNU758 | 0.842 | 8.67E−03 | 3 | 12 | LNU758 | 0.777 | 3.98E−02 | 2 | 16 |
| LNU758 | 0.768 | 1.56E−02 | 4 | 14 | LNU759 | 0.708 | 1.15E−01 | 1 | 16 |
| LNU759 | 0.855 | 6.85E−03 | 3 | 21 | LNU761 | 0.712 | 1.13E−01 | 1 | 18 |
| LNU761 | 0.804 | 1.62E−02 | 3 | 11 | LNU761 | 0.765 | 2.71E−02 | 5 | 17 |
| LNU762 | 0.774 | 7.09E−02 | 1 | 7 | LNU762 | 0.933 | 6.54E−03 | 1 | 18 |
| LNU762 | 0.755 | 8.26E−02 | 1 | 5 | LNU762 | 0.922 | 8.91E−03 | 1 | 6 |
| LNU762 | 0.914 | 1.08E−02 | 1 | 11 | LNU762 | 0.977 | 7.65E−04 | 1 | 20 |
| LNU762 | 0.934 | 6.70E−04 | 3 | 7 | LNU762 | 0.865 | 5.58E−03 | 3 | 5 |
| LNU762 | 0.840 | 9.05E−03 | 3 | 6 | LNU762 | 0.752 | 3.14E−02 | 5 | 4 |
| LNU762 | 0.731 | 3.94E−02 | 5 | 15 | LNU764 | 0.811 | 1.46E−02 | 3 | 22 |
| LNU764 | 0.838 | 9.40E−03 | 3 | 4 | LNU764 | 0.700 | 5.30E−02 | 3 | 15 |
| LNU764 | 0.812 | 7.89E−03 | 6 | 5 | LNU764 | 0.772 | 1.47E−02 | 6 | 6 |
| LNU764 | 0.798 | 3.13E−02 | 6 | 8 | LNU764 | 0.824 | 2.26E−02 | 2 | 10 |
| LNU764 | 0.794 | 3.31E−02 | 2 | 22 | LNU764 | 0.871 | 1.08E−02 | 2 | 2 |
| LNU764 | 0.904 | 5.15E−03 | 2 | 1 | LNU764 | 0.724 | 1.04E−01 | 5 | 13 |
| LNU764 | 0.858 | 6.46E−03 | 5 | 11 | LNU764 | 0.869 | 1.11E−02 | 4 | 13 |
| LNU764 | 0.725 | 2.72E−02 | 4 | 14 | LNU764 | 0.852 | 1.50E−02 | 4 | 8 |
| LNU766 | 0.845 | 3.41E−02 | 1 | 21 | LNU766 | 0.797 | 1.79E−02 | 3 | 22 |
| LNU766 | 0.838 | 9.35E−03 | 3 | 7 | LNU766 | 0.731 | 3.95E−02 | 3 | 16 |
| LNU766 | 0.787 | 2.03H−02 | 3 | 18 | LNU766 | 0.897 | 2.51E−03 | 3 | 5 |
| LNU766 | 0.939 | 5.37E−04 | 3 | 6 | LNU766 | 0.714 | 4.66E−02 | 3 | 4 |
| LNU766 | 0.832 | 1.04E−02 | 3 | 20 | LNU766 | 0.833 | 5.27E−03 | 4 | 19 |
| LNU766 | 0.864 | 2.69E−03 | 4 | 22 | LNU766 | 0.867 | 2.49E−03 | 4 | 4 |
| LNU767 | 0.782 | 6.60E−02 | 1 | 23 | LNU767 | 0.754 | 8.34E−02 | 1 | 11 |
| LNU767 | 0.764 | 7.73E−02 | 1 | 20 | LNU767 | 0.920 | 1.20E−03 | 3 | 17 |
| LNU767 | 0.737 | 2.34E−02 | 6 | 1 | LNU767 | 0.740 | 5.72E−02 | 2 | 23 |

TABLE 27-continued

Correlation between the expression level of selected genes of some embodiments of the invention in various tissues and the phenotypic performance under drought conditions across Barley accessions

| Gene Name | R | P value | Exp. set | Cor. Set ID | Gene Name | R | P value | Exp. set | Cor. Set ID |
|---|---|---|---|---|---|---|---|---|---|
| LNU767 | 0.876 | 9.67E-03 | 2 | 11 | LNU768 | 0.769 | 7.37E-02 | 1 | 12 |
| LNU768 | 0.774 | 2.43E-02 | 3 | 7 | LNU768 | 0.894 | 6.70E-03 | 2 | 16 |
| LNU768 | 0.766 | 4.48E-02 | 2 | 1 | LNU768 | 0.787 | 1.19E-02 | 4 | 14 |
| LNU770 | 0.854 | 3.03E-02 | 1 | 23 | LNU770 | 0.849 | 7.68E-03 | 3 | 19 |
| LNU770 | 0.861 | 6.00E-03 | 3 | 22 | LNU770 | 0.730 | 6.26E-02 | 6 | 8 |
| LNU770 | 0.728 | 6.37E-02 | 2 | 7 | LNU770 | 0.709 | 7.46E-02 | 2 | 5 |
| LNU770 | 0.769 | 4.31E-02 | 2 | 6 | LNU770 | 0.817 | 2.49E-02 | 2 | 9 |
| LNU770 | 0.708 | 7.53E-02 | 2 | 20 | LNU770 | 0.752 | 1.95E-02 | 4 | 19 |
| LNU771 | 0.735 | 9.61E-02 | 1 | 10 | LNU771 | 0.860 | 1.30E-02 | 3 | 13 |
| LNU771 | 0.806 | 1.58E-02 | 3 | 2 | LNU771 | 0.852 | 7.21E-03 | 3 | 14 |
| LNU771 | 0.779 | 2.26E-02 | 3 | 1 | LNU771 | 0.829 | 2.12E-02 | 3 | 8 |
| LNU771 | 0.725 | 2.70E-02 | 6 | 20 | LNU771 | 0.830 | 2.08E-02 | 2 | 21 |
| LNU771 | 0.766 | 4.46E-02 | 2 | 5 | LNU771 | 0.749 | 5.28E-02 | 2 | 6 |
| LNU771 | 0.858 | 1.34E-02 | 2 | 11 | LNU771 | 0.822 | 2.32E-02 | 2 | 12 |
| LNU771 | 0.958 | 2.60E-03 | 5 | 13 | LNU771 | 0.838 | 9.44E-03 | 5 | 14 |
| LNU771 | 0.921 | 1.18E-03 | 5 | 1 | LNU771 | 0.710 | 3.22E-02 | 4 | 7 |
| LNU771 | 0.701 | 3.55E-02 | 4 | 5 | LNU771 | 0.742 | 2.20E-02 | 4 | 6 |
| LNU771 | 0.745 | 2.13E-02 | 4 | 17 | LNU771 | 0.753 | 1.91E-02 | 4 | 20 |
| LNU772 | 0.738 | 9.40E-02 | 1 | 18 | LNU772 | 0.749 | 3.25E-02 | 3 | 2 |
| LNU772 | 0.708 | 3.29E-02 | 6 | 22 | LNU772 | 0.848 | 3.90E-03 | 6 | 4 |
| LNU772 | 0.754 | 3.05E-02 | 5 | 10 | LNU772 | 0.811 | 1.47E-02 | 5 | 2 |
| LNU772 | 0.790 | 1.14E-02 | 4 | 2 | LNU773 | 0.772 | 2.49E-02 | 3 | 22 |
| LNU773 | 0.802 | 1.66E-02 | 3 | 18 | LNU773 | 0.720 | 6.80E-02 | 3 | 8 |
| LNU773 | 0.899 | 5.87E-03 | 6 | 8 | LNU773 | 0.796 | 3.24E-02 | 2 | 16 |
| LNU774 | 0.713 | 1.12E-01 | 1 | 22 | LNU774 | 0.705 | 1.18E-01 | 1 | 2 |
| LNU774 | 0.739 | 2.28E-02 | 6 | 12 | LNU774 | 0.791 | 1.95E-02 | 5 | 17 |
| LNU775 | 0.747 | 3.30E-02 | 3 | 21 | LNU775 | 0.800 | 1.70E-02 | 3 | 11 |
| LNU775 | 0.729 | 4.03E-02 | 3 | 14 | LNU775 | 0.725 | 6.51E-02 | 6 | 8 |
| LNU775 | 0.822 | 2.33E-02 | 2 | 16 | LNU775 | 0.718 | 4.50E-02 | 5 | 9 |
| LNU775 | 0.731 | 3.92E-02 | 5 | 12 | LNU775 | 0.802 | 9.27E-03 | 4 | 21 |
| LNU776 | 0.811 | 5.04E-02 | 1 | 1 | LNU776 | 0.808 | 1.52E-02 | 3 | 10 |
| LNU776 | 0.777 | 2.33E-02 | 3 | 2 | LNU776 | 0.778 | 3.94E-02 | 2 | 2 |
| LNU776 | 0.734 | 6.04E-02 | 2 | 14 | LNU776 | 0.786 | 3.61E-02 | 2 | 1 |
| LNU776 | 0.904 | 8.21E-04 | 4 | 10 | LNU776 | 0.741 | 2.25E-02 | 4 | 2 |
| LNU777 | 0.947 | 3.54E-04 | 3 | 10 | LNU777 | 0.892 | 2.88E-03 | 3 | 2 |
| LNU778 | 0.712 | 4.75E-02 | 3 | 23 | LNU778 | 0.709 | 3.24E-02 | 6 | 7 |
| LNU778 | 0.789 | 1.16E-02 | 6 | 5 | LNU778 | 0.805 | 8.79E-03 | 6 | 6 |
| LNU778 | 0.784 | 3.71E-02 | 2 | 21 | LNU778 | 0.975 | 9.07E-04 | 5 | 8 |
| LNU778 | 0.703 | 3.45E-02 | 4 | 19 | LNU778 | 0.748 | 2.04E-02 | 4 | 22 |
| LNU780 | 0.778 | 6.87E-02 | 1 | 23 | LNU780 | 0.785 | 3.65E-02 | 6 | 8 |
| LNU781 | 0.807 | 5.20E-02 | 1 | 18 | LNU781 | 0.917 | 1.00E-02 | 1 | 5 |
| LNU781 | 0.837 | 3.79E-02 | 1 | 6 | LNU781 | 0.880 | 2.06E-02 | 1 | 11 |
| LNU781 | 0.765 | 7.63E-02 | 1 | 20 | LNU781 | 0.910 | 1.68E-03 | 3 | 22 |
| LNU782 | 0.818 | 4.67E-02 | 1 | 15 | LNU782 | 0.889 | 3.18E-03 | 3 | 11 |
| LNU782 | 0.715 | 3.04E-02 | 6 | 7 | LNU782 | 0.886 | 7.89E-03 | 2 | 12 |
| LNU782 | 0.908 | 4.65E-03 | 2 | 14 | LNU782 | 0.721 | 4.37E-02 | 5 | 9 |
| LNU782 | 0.856 | 3.21E-03 | 4 | 11 | LNU782 | 0.747 | 2.06E-02 | 4 | 14 |
| LNU783 | 0.762 | 2.81E-02 | 3 | 2 | LNU783 | 0.735 | 2.40E-02 | 6 | 10 |
| LNU783 | 0.820 | 2.39E-02 | 2 | 21 | LNU784 | 0.782 | 6.61E-02 | 1 | 18 |
| LNU784 | 0.897 | 1.54E-02 | 1 | 5 | LNU784 | 0.790 | 6.13E-02 | 1 | 6 |
| LNU784 | 0.746 | 8.83E-02 | 1 | 11 | LNU784 | 0.724 | 1.04E-01 | 1 | 20 |
| LNU784 | 0.701 | 5.29E-02 | 3 | 22 | LNU784 | 0.776 | 4.02E-02 | 3 | 8 |
| LNU784 | 0.748 | 2.04E-02 | 6 | 5 | LNU784 | 0.885 | 8.15E-03 | 6 | 8 |
| LNU784 | 0.710 | 3.20E-02 | 4 | 17 | LNU785 | 0.726 | 1.03E-01 | 1 | 23 |
| LNU785 | 0.706 | 1.17E-01 | 1 | 18 | LNU785 | 0.779 | 6.77E-02 | 1 | 6 |
| LNU785 | 0.845 | 3.43E-02 | 1 | 11 | LNU785 | 0.846 | 3.39E-02 | 1 | 20 |
| LNU785 | 0.708 | 4.96E-02 | 3 | 20 | LNU785 | 0.708 | 7.53E-02 | 2 | 23 |
| LNU785 | 0.738 | 5.81E-02 | 2 | 17 | LNU785 | 0.769 | 4.31E-02 | 4 | 13 |
| LNU785 | 0.813 | 7.74E-03 | 4 | 1 | LNU834 | 0.826 | 4.28E-02 | 1 | 10 |
| LNU834 | 0.866 | 2.56E-02 | 1 | 22 | LNU834 | 0.767 | 7.48E-02 | 1 | 2 |
| LNU834 | 0.765 | 7.64E-02 | 1 | 14 | LNU834 | 0.824 | 6.35E-03 | 6 | 11 |
| LNU834 | 0.782 | 3.78E-02 | 2 | 21 | LNU834 | 0.810 | 2.71E-02 | 2 | 5 |
| LNU834 | 0.792 | 3.36E-02 | 2 | 6 | LNU834 | 0.838 | 1.87E-02 | 2 | 12 |
| LNU834 | 0.708 | 7.50E-02 | 2 | 20 | LNU839 | 0.826 | 4.28E-02 | 1 | 10 |
| LNU839 | 0.866 | 2.56E-02 | 1 | 22 | LNU839 | 0.767 | 7.48E-02 | 1 | 2 |
| LNU839 | 0.765 | 7.64E-02 | 1 | 14 | LNU839 | 0.824 | 6.35E-03 | 6 | 11 |
| LNU839 | 0.782 | 3.78E-02 | 2 | 21 | LNU839 | 0.810 | 2.71E-02 | 2 | 5 |
| LNU839 | 0.792 | 3.36E-02 | 2 | 6 | LNU839 | 0.838 | 1.87E-02 | 2 | 12 |
| LNU839 | 0.708 | 7.50E-02 | 2 | 20 | | | | | |

Table 27. Provided are the correlations (R) between the expression levels yield improving genes and their homologs in various tissues [Expression (Exp) sets] and the phenotypic performance [yield, biomass, growth rate and/or vigor components (Correlation vector (Cor))] under drought conditions across barley varieties. P = p value.

Example 5

Production of *Sorghum* Transcriptom and High Throughput Correlation Analysis with Yield, NUE, and ABST Related Parameters Measured in Fields Using 44K Sorguhm Oligonucleotide Micro-Arrays In order to produce a high throughput correlation analysis between plant phenotype and gene expression level, the present inventors utilized a *sorghum* oligonucleotide microarray, produced by Agilent Technologies [chem. (dot) agilent (dot) com/Scripts/PDS (dot) asp?1Page=50879]. The array oligonucleotide represents about 44,000 *sorghum* genes and transcripts. In order to define correlations between the levels of RNA expression with ABST, yield and NUE components or vigor related parameters, various plant characteristics of 17 different *sorghum* hybrids were analyzed. Among them, 10 hybrids encompassing the observed variance were selected for RNA expression analysis. The correlation between the RNA levels and the characterized parameters was analyzed using Pearson correlation test [davidmlane (dot) com/hyperstat/A34739 (dot) html].

Correlation of *Sorghum* Varieties Across Ecotypes Grown under Regular Growth Conditions, Severe Drought Conditions and Low Nitrogen Conditions Experimental Procedures 17 *Sorghum* varieties were grown in 3 repetitive plots, in field. Briefly, the growing protocol was as follows:

1. Regular growth conditions: *sorghum* plants were grown in the field using commercial fertilization and irrigation protocols (370 liter per meter, fertilization of 14 units of 21% urea per entire growth period).

2. Drought conditions: *sorghum* seeds were sown in soil and grown under normal condition until around 35 days from sowing, around stage V8 (eight green leaves are fully expanded, booting not started yet). At this point, irrigation was stopped, and severe drought stress was developed.

3. Low Nitrogen fertilization conditions: *sorghum* plants were fertilized with 50% less amount of nitrogen in the field than the amount of nitrogen applied in the regular growth treatment. All the fertilizer was applied before flowering.

Analyzed *Sorghum* tissues—All 10 selected *Sorghum* hybrids were sample per each treatment. Tissues [Flag leaf, Flower meristem and Flower] from plants growing under normal conditions, severe drought stress and low nitrogen conditions were sampled and RNA was extracted as described above. Each micro-array expression information tissue type has received a Set ID as summarized in Table 28 below.

TABLE 28

Sorghum transcriptom expression sets in field experiments

| Expression Set | Set ID |
| --- | --- |
| Sorghum field/flag leaf/Drought | 1 |
| Sorghum field/flag leaf/Low N | 2 |
| Sorghum field/flag leaf/Normal | 3 |
| Sorghum field/flower meristem/Drought | 4 |
| Sorghum field/flower meristem/Low N | 5 |
| Sorghum field/flower meristem/Normal | 6 |
| Sorghum field/flower/Drought | 7 |
| Sorghum field/flower/Low N | 8 |
| Sorghum field/flower/Normal | 9 |

Table 28: Provided are the sorghum transcriptom expression sets.
Flag leaf = the leaf below the flower;
Flower meristem = Apical meristem following panicle initiation;
Flower = the flower at the anthesis day.

The following parameters were collected using digital imaging system:

Average Grain Area ($cm^2$)—At the end of the growing period the grains were separated from the Plant 'Head'. A sample of ~200 grains were weighted, photographed and images were processed using the below described image processing system. The grain area was measured from those images and was divided by the number of grains.

Average Grain Length (cm)—At the end of the growing period the grains were separated from the Plant 'Head'. A sample of ~200 grains were weighted, photographed and images were processed using the below described image processing system. The sum of grain lengths (longest axis) was measured from those images and was divided by the number of grains.

Head Average Area ($cm^2$)—At the end of the growing period 5 'Heads' were, photographed and images were processed using the below described image processing system. The 'Head' area was measured from those images and was divided by the number of 'Heads'.

Head Average Length (cm)—At the end of the growing period 5 'Heads' were, photographed and images were processed using the below described image processing system. The 'Head' length (longest axis) was measured from those images and was divided by the number of 'Heads'.

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total Seed Weight per Head (gr.)—At the end of the experiment (plant 'Heads') heads from plots within blocks A-C were collected. 5 heads were separately threshed and grains were weighted, all additional heads were threshed together and weighted as well. The average grain weight per head was calculated by dividing the total grain weight by number of total heads per plot (based on plot). In case of 5 heads, the total grains weight of 5 heads was divided by 5.

FW Head per Plant gram—At the end of the experiment (when heads were harvested) total heads and 5 selected heads per plots within blocks A-C were collected separately. The heads (total and 5) were weighted (gr.) separately, and the average fresh weight per plant was calculated for total (FW Head/Plant gr. based on plot) and for 5 (FW Head/Plant gr. based on 5 plants) heads.

Plant height—Plants were characterized for height during growing period at 5 time points. In each measure, plants were measured for their height using a measuring tape. Height was measured from ground level to top of the longest leaf.

Plant leaf number—Plants were characterized for leaf number during growing period at 5 time points. In each measure, plants were measured for their leaf number by counting all the leaves of 3 selected plants per plot.

Relative Growth Rate—was calculated using Formulas III (above) and VIII (above).

SPAD—Chlorophyll content was determined using a Minolta SPAD 502 chlorophyll meter and measurement was performed 64 days post sowing. SPAD meter readings were done on young fully developed leaf. Three measurements per leaf were taken per plot.

Vegetative dry weight and Heads—At the end of the experiment (when inflorescence were dry) all inflorescence and vegetative material from plots within blocks A-C were collected. The biomass and heads weight of each plot was separated, measured and divided by the number of heads.

Dry weight=total weight of the vegetative portion above ground (excluding roots) after drying at 70° C. in oven for 48 hours;

Harvest Index (HI) (*Sorghum*)—The harvest index was calculated using Formula XVI above.

FW Heads/(FW Heads+FW Plants)—The total fresh weight of heads and their respective plant biomass was measured at the harvest day. The heads weight was divided by the sum of weights of heads and plants.

Experimental Results 17 different *sorghum* hybrids were grown and characterized for different parameters (Table 29). The average for each of the measured parameter was calculated using the JMP software (Tables 30-35) and a subsequent correlation analysis was performed (Table 36). Results were then integrated to the database.

TABLE 29

Sorghum correlated parameters (vectors)

| Correlation ID | Correlated parameter with |
|---|---|
| 1 | Average Grain Area (cm²), Drought |
| 2 | Average Grain Area (cm²), Low N |
| 3 | Average Grain Area (cm²), Normal |
| 4 | FW-Head/Plant gr (based on plot), Drought |
| 5 | FW-Head/Plant gr (based on plot), Low N |
| 6 | FW-Head/Plant gr (based on plot), Normal |
| 7 | FW-Head/Plant gr (based on 5 plants), Low N |
| 8 | FW-Head/Plant gr (based on 5 plants), Normal |
| 9 | FW Heads/(FW Heads + FW Plants)(all plot), Drought |
| 10 | FW Heads/(FW Heads + FW Plants)(all plot), Low N |

TABLE 29-continued

Sorghum correlated parameters (vectors)

| Correlation ID | Correlated parameter with |
|---|---|
| 11 | FW Heads/(FW Heads + FW Plants)(all plot), Normal |
| 12 | FW/Plant gr (based on plot), Drought |
| 13 | FW/Plant gr (based on plot), Low N |
| 14 | FW/Plant gr (based on plot), Normal |
| 15 | Final Plant Height (cm), Drought |
| 16 | Final Plant Height (cm), Low N |
| 17 | Final Plant Height (cm), Normal |
| 18 | Head Average Area (cm²), Drought |
| 19 | Head Average Area (cm²), Low N |
| 20 | Head Average Area (cm²), Normal |
| 21 | Head Average Length (cm), Drought |
| 22 | Head Average Length (cm), Low N |
| 23 | Head Average Length (cm), Normal |
| 24 | Head Average Perimeter (cm), Drought |
| 25 | Head Average Perimeter (cm), Low N |
| 26 | Head Average Perimeter (cm), Normal |
| 27 | Head Average Width (cm), Drought |
| 28 | Head Average Width (cm), Low N |
| 29 | Head Average Width (cm), Normal |
| 30 | Leaf SPAD 64 DPS (Days Post Sowing), Drought |
| 31 | Leaf SPAD 64 DPS (Days Post Sowing), Low N |
| 32 | Leaf SPAD 64 DPS (Days Post Sowing), Normal |
| 33 | Lower Ratio Average Grain Area, Low N |
| 34 | Lower Ratio Average Grain Area, Normal |
| 35 | Lower Ratio Average Grain Length, Low N |
| 36 | Lower Ratio Average Grain Length, Normal |
| 37 | Lower Ratio Average Grain Perimeter, Low N |
| 38 | Lower Ratio Average Grain Perimeter, Normal |
| 39 | Lower Ratio Average Grain Width, Low N |
| 40 | Lower Ratio Average Grain Width, Normal |
| 41 | Total grain weight/Head (based on plot) gr, Low N |
| 42 | Total grain weight/Head gr (based on 5 heads), Low N |
| 43 | Total grain weight/Head gr (based on 5 heads), Normal |
| 44 | Total grain weight/Head gr (based on plot), Normal |
| 45 | Total grain weight/Head gr (based on plot) Drought |
| 46 | Upper Ratio Average Grain Area, Drought |
| 47 | Upper Ratio Average Grain Area, Low N |
| 48 | Upper Ratio Average Grain Area, Normal |
| 49 | [Grain Yield + plant biomass/SPAD 64 DPS], Normal |
| 50 | [Grain Yield + plant biomass/SPAD 64 DPS], Low N |
| 51 | [Grain yield/SPAD 64 DPS], Low N |
| 52 | [Grain yield/SPAD 64 DPS], Normal |
| 53 | [Plant biomass (FW)/SPAD 64 DPS], Drought |
| 54 | [Plant biomass (FW)/SPAD 64 DPS], Low N |
| 55 | [Plant biomass (FW)/SPAD 64 DPS], Normal |

Table 29. Provided are the Sorghum correlated parameters (vectors).
"gr." = grams;
"SPAD" = chlorophyll levels;
"FW" = Plant Fresh weight;
"DW" = Plant Dry weight;
"normal" = standard growth conditions;
"DPS" = days post-sowing;
"Low N" = Low Nitrogen.
FW-Head/Plant gr. (based on 5 plants), fresh weigh of the harvested heads was divided by the number of heads that were phenotyped, Low N-low nitrogen conditions; Lower Ratio Average Grain Area grain area of the lower fraction of grains.

TABLE 30

Measured parameters in Sorghum accessions under normal conditions

| Seed ID/Cor. ID | 3 | 6 | 8 | 11 | 14 | 17 | 20 | 23 | 26 | 29 |
|---|---|---|---|---|---|---|---|---|---|---|
| Line-1 | 0.11 | 175.15 | 406.50 | 0.51 | 162.56 | 95.25 | 120.14 | 25.58 | 61.22 | 5.97 |
| Line-2 | 0.11 | 223.49 | 518.00 | 0.51 | 212.59 | 79.20 | 167.60 | 26.84 | 67.90 | 7.92 |
| Line-3 | 0.13 | 56.40 | 148.00 | 0.12 | 334.83 | 197.85 | 85.14 | 21.02 | 56.26 | 4.87 |
| Line-4 | 0.13 | 111.62 | 423.00 | 0.26 | 313.46 | 234.20 | 157.26 | 26.84 | 65.38 | 7.43 |
| Line-5 | 0.14 | 67.34 | 92.00 | 0.12 | 462.28 | 189.40 | 104.00 | 23.14 | 67.46 | 5.59 |
| Line-6 | 0.14 | 66.90 | 101.33 | 0.18 | 318.26 | 194.67 | 102.48 | 21.82 | 67.46 | 5.88 |
| Line-7 | 0.11 | 126.18 | 423.50 | 0.46 | 151.14 | 117.25 | 168.54 | 31.33 | 74.35 | 6.78 |
| Line-8 | 0.11 | 107.74 | 386.50 | 0.43 | 137.60 | 92.80 | 109.32 | 23.18 | 56.16 | 5.99 |
| Line-9 | 0.10 | 123.86 | 409.50 | 0.43 | 167.98 | 112.65 | 135.13 | 25.70 | 61.64 | 6.62 |

TABLE 30-continued

Measured parameters in Sorghum accessions under normal conditions

| Seed ID/Cor. ID | 3 | 6 | 8 | 11 | 14 | 17 | 20 | 23 | 26 | 29 |
|---|---|---|---|---|---|---|---|---|---|---|
| Line-10 | 0.12 | 102.75 | 328.95 | 0.44 | 128.97 | 97.50 | 169.03 | 28.82 | 71.41 | 7.42 |
| Line-11 | 0.12 | 82.33 | 391.00 | 0.46 | 97.62 | 98.00 | 156.10 | 28.13 | 68.57 | 6.99 |
| Line-12 | 0.11 | 77.59 | 435.75 | 0.45 | 99.32 | 100.00 | 112.14 | 22.97 | 56.44 | 6.19 |
| Line-13 | 0.12 | 91.17 | 429.50 | 0.45 | 112.24 | 105.60 | 154.74 | 28.09 | 67.79 | 7.02 |
| Line-14 | 0.11 | 150.45 | 441.00 | 0.51 | 157.42 | 151.15 | 171.70 | 30.00 | 71.55 | 7.18 |
| Line-15 | 0.11 | 109.10 | 415.75 | 0.46 | 130.55 | 117.10 | 168.51 | 30.54 | 78.94 | 7.00 |
| Line-16 | 0.11 | 107.58 | 429.50 | 0.44 | 135.66 | 124.45 | 162.51 | 27.17 | 67.03 | 7.39 |

Table 30: Provided are the values of each of the parameters (as described above) measured in Sorghum accessions (line ID) under normal conditions. Growth conditions are specified in the experimental procedure section.

TABLE 31

Additional measured parameters in Sorghum accessions under normal conditions

| Seed ID/Cor. ID | 32 | 34 | 36 | 38 | 40 | 43 | 44 | 48 | 49 | 52 | 55 |
|---|---|---|---|---|---|---|---|---|---|---|---|
| Line-1 | 43.01 | 0.83 | 0.91 | 0.91 | 0.91 | 47.40 | 31.12 | 1.22 | 4.50 | 3.78 | 0.72 |
| Line-2 |  | 0.74 | 0.88 | 0.87 | 0.83 | 46.30 | 26.35 | 1.30 | 8.17 | 7.74 | 0.43 |
| Line-3 | 43.26 | 0.78 | 0.92 | 0.91 | 0.85 | 28.37 | 18.72 | 1.13 | 7.87 | 7.01 | 0.86 |
| Line-4 | 44.74 | 0.80 | 0.91 | 0.95 | 0.87 | 70.40 | 38.38 | 1.14 | 10.68 | 10.10 | 0.58 |
| Line-5 | 45.76 | 0.70 | 0.89 | 0.90 | 0.79 | 32.15 | 26.67 | 1.16 | 8.34 | 7.65 | 0.69 |
| Line-6 | 41.61 | 0.70 | 0.88 | 0.92 | 0.80 | 49.23 | 28.85 | 1.15 | 4.40 | 3.34 | 1.05 |
| Line-7 | 45.21 | 0.83 | 0.91 | 0.91 | 0.90 | 63.45 | 47.67 | 1.19 | 3.74 | 3.05 | 0.69 |
| Line-8 | 45.14 | 0.81 | 0.90 | 0.91 | 0.89 | 44.45 | 31.00 | 1.24 | 4.83 | 3.90 | 0.93 |
| Line-9 | 43.03 | 0.84 | 0.92 | 0.92 | 0.92 | 56.65 | 39.99 | 1.25 | 3.67 | 2.83 | 0.84 |
| Line-10 | 45.59 | 0.79 | 0.92 | 0.93 | 0.85 | 60.00 | 38.36 | 1.24 | 2.89 | 2.18 | 0.72 |
| Line-11 | 44.83 | 0.77 | 0.89 | 0.91 | 0.86 | 45.45 | 32.10 | 1.32 | 2.91 | 2.19 | 0.72 |
| Line-12 | 45.33 | 0.80 | 0.91 | 0.92 | 0.89 | 58.19 | 32.69 | 1.22 | 3.12 | 2.41 | 0.71 |
| Line-13 | 46.54 | 0.81 | 0.91 | 0.90 | 0.90 | 70.60 | 32.79 | 1.18 | 4.75 | 3.58 | 1.17 |
| Line-14 | 43.99 | 0.82 | 0.91 | 0.91 | 0.91 | 70.10 | 51.53 | 1.18 | 3.69 | 2.90 | 0.79 |
| Line-15 | 45.09 | 0.81 | 0.90 | 0.91 | 0.91 | 53.95 | 35.71 | 1.22 | 3.85 | 3.01 | 0.85 |
| Line-16 | 45.14 | 0.82 | 0.90 | 0.91 | 0.90 | 59.87 | 38.31 | 1.25 | 5.84 | 4.85 | 0.98 |

Table 31: Provided are the values of each of the parameters (as described above) measured in Sorghum accessions (line ID) under normal conditions. Growth conditions are specified in the experimental procedure section.

TABLE 32

Measured parameters in Sorghum accessions under Low nitrogen conditions

| Seed ID/Cor. ID | 2 | 5 | 7 | 10 | 13 | 16 | 19 | 22 | 25 | 28 | 31 |
|---|---|---|---|---|---|---|---|---|---|---|---|
| Line-1 | 0.11 | 214.78 | 388.00 | 0.51 | 204.78 | 104.00 | 96.24 | 23.22 | 56.32 | 5.26 | 38.33 |
| Line-2 | 0.11 | 205.05 | 428.67 | 0.51 | 199.64 | 80.93 | 214.72 | 25.58 | 79.20 | 10.41 | 38.98 |
| Line-3 | 0.14 | 73.49 | 297.67 | 0.17 | 340.51 | 204.73 | 98.59 | 20.93 | 53.25 | 5.93 | 42.33 |
| Line-4 | 0.12 | 122.96 | 280.00 | 0.39 | 240.60 | 125.40 | 182.83 | 28.43 | 76.21 | 8.25 | 40.90 |
| Line-5 | 0.14 | 153.07 | 208.33 | 0.21 | 537.78 | 225.40 | 119.64 | 24.32 | 67.27 | 6.19 | 43.15 |
| Line-6 | 0.13 | 93.23 | 303.67 | 0.19 | 359.40 | 208.07 | 110.19 | 22.64 | 59.49 | 6.12 | 39.85 |
| Line-7 | 0.12 | 134.11 | 436.00 | 0.48 | 149.20 | 121.40 | 172.36 | 32.11 | 79.28 | 6.81 | 42.68 |
| Line-8 | 0.12 | 77.44 | 376.33 | 0.38 | 129.06 | 100.27 | 84.81 | 20.38 | 51.52 | 5.25 | 43.31 |
| Line-9 | 0.12 | 129.63 | 474.67 | 0.42 | 178.71 | 121.13 | 156.25 | 26.69 | 69.89 | 7.52 | 39.01 |
| Line-10 | 0.13 | 99.83 | 437.67 | 0.44 | 124.27 | 94.53 | 136.71 | 26.31 | 66.18 | 6.59 | 42.71 |
| Line-11 | 0.13 | 76.95 | 383.00 | 0.43 | 101.33 | 110.00 | 137.70 | 25.43 | 67.37 | 6.85 | 40.08 |
| Line-12 | 0.12 | 84.25 | 375.00 | 0.39 | 132.12 | 115.07 | 96.54 | 23.11 | 57.90 | 5.32 | 43.98 |
| Line-13 | 0.12 | 92.24 | 425.00 | 0.44 | 117.90 | 104.73 | 158.19 | 27.87 | 70.61 | 7.25 | 45.44 |
| Line-14 | 0.12 | 138.83 | 434.00 | 0.44 | 176.99 | 173.67 | 163.95 | 28.88 | 73.76 | 7.19 | 44.75 |
| Line-15 | 0.11 | 113.32 | 408.67 | 0.44 | 143.67 | 115.60 | 138.39 | 27.64 | 66.87 | 6.28 | 42.85 |
| Line-16 | 0.12 | 95.50 | 378.50 | 0.43 | 126.98 | 138.80 | 135.46 | 25.52 | 65.40 | 6.57 | 43.81 |

Table 32: Provided are the values of each of the parameters (as described above) measured in Sorghum accessions (line ID) under low nitrogen conditions. Growth conditions are specified in the experimental procedure section.

TABLE 33

Additional measured parameters in Sorghum accessions under low nitrogen growth conditions

| Seed ID/Cor. ID | 33 | 35 | 37 | 39 | 41 | 42 | 47 | 50 | 51 | 54 |
|---|---|---|---|---|---|---|---|---|---|---|
| Line-1 | 0.82 | 0.91 | 0.90 | 0.90 | 25.95 | 50.27 | 1.19 | 6.02 | 0.68 | 5.34 |
| Line-2 | 0.77 | 0.90 | 0.88 | 0.85 | 30.57 | 50.93 | 1.31 | 5.91 | 0.78 | 5.12 |
| Line-3 | 0.81 | 0.92 | 0.92 | 0.89 | 19.37 | 36.13 | 1.11 | 8.50 | 0.46 | 8.05 |
| Line-4 | 0.79 | 0.90 | 0.90 | 0.88 | 35.62 | 73.10 | 1.22 | 6.75 | 0.87 | 5.88 |
| Line-5 | 0.78 | 0.91 | 0.92 | 0.86 | 25.18 | 37.87 | 1.19 | 13.05 | 0.58 | 12.46 |
| Line-6 | 0.80 | 0.93 | 0.92 | 0.87 | 22.18 | 36.40 | 1.18 | 9.58 | 0.56 | 9.02 |
| Line-7 | 0.83 | 0.92 | 0.92 | 0.91 | 49.96 | 71.67 | 1.16 | 4.67 | 1.17 | 3.50 |
| Line-8 | 0.79 | 0.89 | 0.89 | 0.89 | 27.48 | 35.00 | 1.23 | 3.61 | 0.63 | 2.98 |
| Line-9 | 0.81 | 0.90 | 0.90 | 0.90 | 51.12 | 76.73 | 1.17 | 5.89 | 1.31 | 4.58 |
| Line-10 | 0.77 | 0.91 | 0.91 | 0.86 | 36.84 | 57.58 | 1.22 | 3.77 | 0.86 | 2.91 |
| Line-11 | 0.74 | 0.89 | 0.90 | 0.84 | 29.45 | 42.93 | 1.24 | 3.26 | 0.74 | 2.53 |
| Line-12 | 0.80 | 0.90 | 0.90 | 0.90 | 26.70 | 36.47 | 1.19 | 3.61 | 0.61 | 3.00 |
| Line-13 | 0.79 | 0.89 | 0.90 | 0.89 | 29.43 | 68.60 | 1.23 | 3.24 | 0.65 | 2.60 |
| Line-14 | 0.82 | 0.91 | 0.91 | 0.91 | 51.12 | 71.80 | 1.16 | 5.10 | 1.14 | 3.96 |
| Line-15 | 0.80 | 0.89 | 0.89 | 0.90 | 37.04 | 49.27 | 1.34 | 4.25 | 0.87 | 3.38 |
| Line-16 | 0.81 | 0.89 | 0.90 | 0.90 | 39.85 | 43.87 | 1.21 | 3.81 | 0.91 | 2.90 |
| Line-17 | 0.81 | 0.90 | 0.90 | 0.90 | 41.78 | 52.07 | 1.21 | 4.76 | 0.89 | 3.86 |

Table 33: Provided are the values of each of the parameters (as described above) measured in Sorghum accessions (line ID) under low nitrogen conditions. Growth conditions are specified in the experimental procedure section.

TABLE 34

Measured parameters in Sorghum accessions under drought conditions

| Seed ID/Cor. ID | 1 | 4 | 9 | 12 | 15 | 18 | 21 | 24 | 27 | 30 |
|---|---|---|---|---|---|---|---|---|---|---|
| Line-1 | 0.10 | 154.90 | 0.42 | 207.99 | 89.40 | 83.14 | 21.63 | 52.78 | 4.83 | 40.58 |
| Line-2 | 0.12 | 122.02 | 0.47 | 138.02 | 75.73 | 107.79 | 21.94 | 64.49 | 6.31 | 40.88 |
| Line-3 | 0.11 | 130.51 | 0.42 | 255.41 | 92.10 | 88.68 | 21.75 | 56.59 | 5.16 | 45.01 |
| Line-4 | 0.09 | 241.11 | 0.37 | 402.22 | 94.30 | 135.91 | 22.01 | 64.37 | 7.78 | 42.30 |
| Line-5 | 0.09 | 69.03 | 0.23 | 233.55 | 150.08 | 90.77 | 20.99 | 53.21 | 5.28 | 45.24 |
| Line-6 | 0.11 | 186.41 | 0.31 | 391.75 | 110.73 | 123.95 | 28.60 | 71.66 | 5.49 | 40.56 |
| Line-7 |  | 62.11 | 0.41 | 89.31 | 99.20 | 86.06 | 21.35 | 55.61 | 5.04 | 44.80 |
| Line-8 |  | 39.02 | 0.44 | 50.61 | 84.00 | 85.20 | 20.81 | 52.96 | 5.07 | 45.07 |
| Line-9 |  | 58.94 | 0.40 | 87.02 | 99.00 | 113.10 | 24.69 | 69.83 | 5.77 | 40.65 |
| Line-10 |  | 76.37 | 0.44 | 120.43 | 92.20 | 100.79 | 24.82 | 65.15 | 5.37 | 45.43 |
| Line-11 |  | 33.47 | 0.47 | 37.21 | 81.93 | 80.41 | 21.95 | 55.27 | 4.66 | 42.58 |
| Line-12 |  | 42.20 | 0.47 | 48.18 | 98.80 | 126.89 | 24.98 | 69.06 | 6.35 | 44.18 |
| Line-13 |  | 41.53 | 0.48 | 44.20 | 86.47 | 86.41 | 19.49 | 53.32 | 5.58 | 44.60 |
| Line-14 |  | 131.67 | 0.35 | 231.60 | 99.60 | 92.29 | 20.42 | 56.29 | 5.76 | 42.41 |
| Line-15 |  | 60.84 | 0.35 | 116.01 | 83.00 | 77.89 | 16.81 | 49.12 | 5.86 | 43.25 |
| Line-16 |  | 44.33 | 0.23 | 123.09 | 83.53 | 76.93 | 18.88 | 51.88 | 5.10 | 40.30 |
| Line-17 |  | 185.44 | 0.33 | 342.50 | 92.30 |  |  |  |  | 40.75 |

Table 34: Provided are the values of each of the parameters (as described above) measured in Sorghum accessions (line ID) under drought conditions. Growth conditions are specified in the experimental procedure section.

TABLE 35

Additional Measured parameters in Sorghum accessions under drought conditions

| Seed ID/Correlation ID | 45 | 46 | 53 |
|---|---|---|---|
| Line-1 | 22.114 | 1.305 | 5.126 |
| Line-2 | 16.770 | 1.190 | 3.376 |
| Line-3 | 9.189 | 1.285 | 5.674 |
| Line-4 | 104.444 | 1.459 | 9.509 |
| Line-5 | 3.235 | 1.206 | 5.163 |
| Line-6 | 21.997 | 1.214 | 9.658 |
| Line-7 | 9.975 |  | 1.993 |
| Line-8 | 18.579 |  | 1.123 |
| Line-9 | 29.271 |  | 2.141 |
| Line-10 | 10.453 |  | 2.651 |
| Line-11 | 14.765 |  | 0.874 |
| Line-12 | 12.861 |  | 1.091 |
| Line-13 | 18.237 |  | 0.991 |
| Line-14 | 11.602 |  | 5.461 |
| Line-15 | 18.647 |  | 2.682 |
| Line-16 | 16.356 |  | 3.054 |
| Line-17 |  |  | 8.405 |

Table 35: Provided are the values of each of the parameters (as described above) measured in Sorghum accessions (line ID) under drought conditions. Growth conditions are specified in the experimental procedure section.

TABLE 36

Correlation between the expression level of selected genes of some embodiments of the invention in various tissues and the phenotypic performance under normal or abiotic stress conditions across Sorghum accessions

| Gene Name | R | P value | Exp.set | Cor. Set ID | Gene Name | R | P value | Exp.set | Cor. Set ID |
|---|---|---|---|---|---|---|---|---|---|
| LNU856 | 0.849 | 3.76E-03 | 1 | 18 | LNU856 | 0.827 | 5.96E-03 | 1 | 27 |
| LNU856 | 0.830 | 5.57E-03 | 1 | 24 | LNU857 | 0.748 | 2.04E-02 | 9 | 55 |
| LNU858 | 0.841 | 2.31E-03 | 6 | 36 | LNU858 | 0.781 | 7.71E-03 | 6 | 34 |
| LNU858 | 0.741 | 1.41E-02 | 2 | 41 | LNU858 | 0.721 | 1.85E-02 | 2 | 51 |
| LNU858 | 0.788 | 6.74E-03 | 2 | 16 | LNU858 | 0.736 | 1.53E-02 | 3 | 11 |
| LNU858 | 0.826 | 3.23E-03 | 3 | 6 | LNU858 | 0.711 | 2.10E-02 | 3 | 8 |
| LNU859 | 0.717 | 1.97E-02 | 6 | 55 | LNU859 | 0.829 | 3.04E-03 | 9 | 17 |
| LNU859 | 0.713 | 2.07E-02 | 9 | 40 | LNU859 | 0.736 | 1.52E-02 | 9 | 23 |
| LNU859 | 0.819 | 3.78E-03 | 9 | 44 | LNU859 | 0.785 | 7.10E-03 | 9 | 43 |
| LNU859 | 0.706 | 2.26E-02 | 9 | 34 | LNU859 | 0.764 | 1.00E-02 | 2 | 41 |
| LNU859 | 0.782 | 7.47E-03 | 2 | 16 | LNU859 | 0.717 | 1.97E-02 | 8 | 42 |
| LNU860 | 0.789 | 6.70E-03 | 6 | 17 | LNU860 | 0.706 | 2.24E-02 | 6 | 44 |
| LNU860 | 0.773 | 8.80E-03 | 2 | 41 | LNU860 | 0.711 | 2.11E-02 | 2 | 22 |
| LNU860 | 0.891 | 5.43E-04 | 2 | 42 | LNU860 | 0.757 | 1.13E-02 | 2 | 51 |
| LNU860 | 0.760 | 1.07E-02 | 2 | 37 | LNU860 | 0.877 | 8.51E-04 | 4 | 53 |
| LNU860 | 0.854 | 1.65E-03 | 4 | 4 | LNU860 | 0.878 | 8.41E-04 | 4 | 12 |
| LNU860 | 0.728 | 1.69E-02 | 5 | 41 | LNU860 | 0.845 | 2.10E-03 | 5 | 16 |
| LNU860 | 0.713 | 3.09E-02 | 7 | 18 | LNU860 | 0.723 | 1.81E-02 | 1 | 53 |
| LNU860 | 0.726 | 1.74E-02 | 1 | 12 | LNU861 | 0.835 | 2.63E-03 | 6 | 17 |
| LNU861 | 0.707 | 2.22E-02 | 6 | 44 | LNU861 | 0.794 | 6.15E-03 | 2 | 16 |
| LNU861 | 0.792 | 6.35E-03 | 4 | 53 | LNU861 | 0.802 | 5.22E-03 | 4 | 4 |
| LNU861 | 0.790 | 6.53E-03 | 4 | 12 | LNU861 | 0.871 | 2.26E-03 | 3 | 52 |
| LNU861 | 0.874 | 2.05E-03 | 3 | 49 | LNU861 | 0.892 | 5.26E-04 | 1 | 53 |
| LNU861 | 0.890 | 5.56E-04 | 1 | 4 | LNU861 | 0.879 | 8.08E-04 | 1 | 12 |
| LNU862 | 0.716 | 1.98E-02 | 6 | 40 | LNU862 | 0.767 | 9.63E-03 | 4 | 53 |
| LNU862 | 0.767 | 9.58E-03 | 4 | 12 | LNU862 | 0.726 | 2.69E-02 | 3 | 55 |
| LNU862 | 0.797 | 5.81E-03 | 3 | 43 | LNU862 | 0.753 | 1.20E-02 | 1 | 15 |
| LNU863 | 0.857 | 3.15E-03 | 9 | 55 | LNU863 | 0.758 | 1.11E-02 | 2 | 16 |
| LNU863 | 0.878 | 8.46E-04 | 5 | 31 | LNU863 | 0.776 | 8.30E-03 | 7 | 53 |
| LNU863 | 0.751 | 1.22E-02 | 7 | 4 | LNU863 | 0.770 | 9.20E-03 | 7 | 12 |
| LNU864 | 0.816 | 3.97E-03 | 2 | 16 | LNU864 | 0.700 | 2.42E-02 | 3 | 29 |
| LNU864 | 0.729 | 1.67E-02 | 3 | 14 | LNU864 | 0.736 | 1.53E-02 | 7 | 4 |
| LNU864 | 0.708 | 2.20E-02 | 7 | 12 | LNU865 | 0.719 | 1.90E-02 | 6 | 44 |
| LNU865 | 0.740 | 1.43E-02 | 9 | 11 | LNU865 | 0.754 | 1.17E-02 | 2 | 10 |
| LNU865 | 0.742 | 1.40E-02 | 5 | 13 | LNU865 | 0.774 | 8.53E-03 | 3 | 8 |
| LNU866 | 0.752 | 1.22E-02 | 2 | 41 | LNU866 | 0.844 | 2.13E-03 | 2 | 16 |
| LNU866 | 0.848 | 3.91E-03 | 3 | 52 | LNU866 | 0.746 | 1.32E-02 | 3 | 11 |
| LNU866 | 0.868 | 1.13E-03 | 3 | 6 | LNU866 | 0.805 | 8.85E-03 | 3 | 49 |
| LNU866 | 0.734 | 1.56E-02 | 1 | 4 | LNU867 | 0.719 | 1.92E-02 | 6 | 3 |
| LNU867 | 0.704 | 2.31E-02 | 3 | 6 | LNU868 | 0.916 | 2.00E-04 | 6 | 48 |
| LNU868 | 0.804 | 5.04E-03 | 2 | 16 | LNU868 | 0.821 | 3.59E-03 | 3 | 17 |
| LNU868 | 0.819 | 3.75E-03 | 3 | 44 | LNU869 | 0.719 | 1.90E-02 | 2 | 2 |
| LNU869 | 0.790 | 6.49E-03 | 5 | 2 | LNU870 | 0.906 | 3.04E-04 | 4 | 53 |
| LNU870 | 0.829 | 3.00E-03 | 4 | 4 | LNU870 | 0.912 | 2.33E-04 | 4 | 12 |
| LNU870 | 0.723 | 1.82E-02 | 1 | 53 | LNU870 | 0.733 | 1.58E-02 | 1 | 12 |
| LNU871 | 0.752 | 1.22E-02 | 6 | 17 | LNU871 | 0.720 | 1.89E-02 | 4 | 53 |
| LNU871 | 0.709 | 2.16E-02 | 4 | 4 | LNU871 | 0.735 | 1.53E-02 | 4 | 12 |
| LNU871 | 0.747 | 1.30E-02 | 7 | 9 | LNU871 | 0.717 | 2.98E-02 | 1 | 21 |
| LNU872 | 0.714 | 2.05E-02 | 4 | 53 | LNU872 | 0.710 | 2.13E-02 | 4 | 12 |
| LNU872 | 0.735 | 1.55E-02 | 5 | 41 | LNU872 | 0.743 | 2.19E-02 | 7 | 18 |
| LNU873 | 0.732 | 1.61E-02 | 9 | 44 | LNU873 | 0.848 | 1.95E-03 | 8 | 35 |
| LNU873 | 0.768 | 1.56E-02 | 3 | 55 | LNU874 | 0.715 | 2.02E-02 | 2 | 22 |
| LNU874 | 0.855 | 1.60E-03 | 2 | 42 | LNU874 | 0.727 | 1.72E-02 | 4 | 53 |
| LNU874 | 0.710 | 2.15E-02 | 4 | 4 | LNU874 | 0.736 | 1.53E-02 | 4 | 12 |
| LNU874 | 0.724 | 1.79E-02 | 5 | 54 | LNU874 | 0.777 | 8.13E-03 | 5 | 13 |
| LNU875 | 0.839 | 2.41E-03 | 6 | 3 | LNU876 | 0.793 | 6.15E-03 | 6 | 17 |
| LNU876 | 0.705 | 3.38E-02 | 4 | 27 | LNU876 | 0.867 | 1.17E-03 | 4 | 53 |
| LNU876 | 0.809 | 4.56E-03 | 4 | 4 | LNU876 | 0.866 | 1.21E-03 | 4 | 12 |
| LNU876 | 0.780 | 7.72E-03 | 5 | 5 | LNU876 | 0.731 | 1.62E-02 | 5 | 7 |
| LNU876 | 0.830 | 2.95E-03 | 5 | 50 | LNU876 | 0.776 | 8.26E-03 | 5 | 54 |
| LNU876 | 0.842 | 2.24E-03 | 5 | 13 | LNU876 | 0.793 | 1.07E-02 | 3 | 52 |
| LNU876 | 0.784 | 1.24E-02 | 3 | 49 | LNU876 | 0.894 | 4.83E-04 | 3 | 8 |
| LNU878 | 0.718 | 1.94E-02 | 6 | 11 | LNU878 | 0.725 | 1.76E-02 | 6 | 49 |
| LNU878 | 0.778 | 8.03E-03 | 2 | 16 | LNU878 | 0.756 | 1.15E-02 | 6 | 11 |
| LNU879 | 0.707 | 2.21E-02 | 6 | 6 | LNU879 | 0.704 | 2.32E-02 | 6 | 14 |
| LNU879 | 0.771 | 9.10E-03 | 2 | 28 | LNU879 | 0.913 | 2.22E-04 | 4 | 53 |
| LNU879 | 0.820 | 3.70E-03 | 4 | 4 | LNU879 | 0.916 | 1.99E-04 | 4 | 12 |
| LNU879 | 0.717 | 1.97E-02 | 5 | 5 | LNU879 | 0.773 | 8.76E-03 | 5 | 50 |
| LNU879 | 0.734 | 1.56E-02 | 5 | 54 | LNU879 | 0.849 | 1.89E-03 | 5 | 13 |
| LNU880 | 0.718 | 1.93E-02 | 2 | 47 | LNU881 | 0.789 | 6.64E-03 | 2 | 41 |
| LNU881 | 0.730 | 1.66E-02 | 2 | 51 | LNU881 | 0.755 | 1.17E-02 | 2 | 37 |
| LNU881 | 0.931 | 8.91E-05 | 2 | 16 | LNU882 | 0.785 | 1.22E-02 | 3 | 52 |
| LNU902 | 0.886 | 6.47E-04 | 6 | 17 | LNU902 | 0.856 | 1.59E-03 | 6 | 44 |

TABLE 36-continued

Correlation between the expression level of selected genes of some embodiments of the invention in various tissues and the phenotypic performance under normal or abiotic stress conditions across Sorghum accessions

| Gene Name | R | P value | Exp.set | Cor. Set ID | Gene Name | R | P value | Exp.set | Cor. Set ID |
|---|---|---|---|---|---|---|---|---|---|
| LNU903 | 0.714 | 2.04E−02 | 6 | 3 | LNU903 | 0.785 | 7.13E−03 | 2 | 7 |
| LNU903 | 0.738 | 1.48E−02 | 2 | 19 | LNU903 | 0.829 | 3.05E−03 | 2 | 22 |
| LNU903 | 0.786 | 7.04E−03 | 2 | 42 | LNU903 | 0.840 | 2.36E−03 | 2 | 25 |
| LNU904 | 0.738 | 1.48E−02 | 6 | 52 | LNU904 | 0.731 | 1.64E−02 | 6 | 14 |
| LNU904 | 0.751 | 1.24E−02 | 6 | 49 | LNU904 | 0.765 | 9.94E−03 | 4 | 53 |
| LNU904 | 0.718 | 1.94E−02 | 4 | 4 | LNU904 | 0.767 | 9.63E−03 | 4 | 12 |
| LNU904 | 0.732 | 1.61E−02 | 5 | 10 | LNU905 | 0.710 | 2.14E−02 | 2 | 47 |
| LNU905 | 0.872 | 2.17E−03 | 4 | 45 | LNU905 | 0.800 | 5.42E−03 | 4 | 53 |
| LNU905 | 0.854 | 1.65E−03 | 4 | 4 | LNU905 | 0.785 | 7.10E−03 | 4 | 12 |
| LNU905 | 0.714 | 2.04E−02 | 8 | 5 | LNU905 | 0.725 | 1.76E−02 | 5 | 54 |
| LNU905 | 0.761 | 1.06E−02 | 5 | 13 | LNU905 | 0.822 | 6.54E−03 | 7 | 45 |
| LNU905 | 0.720 | 2.86E−02 | 1 | 45 | LNU906 | 0.749 | 1.26E−02 | 6 | 17 |
| LNU906 | 0.778 | 8.04E−03 | 6 | 40 | LNU906 | 0.832 | 2.85E−03 | 6 | 44 |
| LNU906 | 0.805 | 4.95E−03 | 6 | 34 | LNU906 | 0.745 | 1.35E−02 | 2 | 41 |
| LNU906 | 0.855 | 1.63E−03 | 2 | 16 | LNU906 | 0.939 | 5.71E−05 | 4 | 53 |
| LNU906 | 0.868 | 1.12E−03 | 4 | 4 | LNU906 | 0.943 | 4.37E−05 | 4 | 12 |
| LNU907 | 0.700 | 2.42E−02 | 6 | 29 | LNU907 | 0.829 | 3.00E−03 | 6 | 52 |
| LNU907 | 0.825 | 3.28E−03 | 6 | 49 | LNU907 | 0.790 | 6.50E−03 | 6 | 8 |
| LNU907 | 0.791 | 6.44E−03 | 8 | 33 | LNU907 | 0.706 | 2.26E−02 | 8 | 39 |
| LNU907 | 0.836 | 2.59E−03 | 8 | 35 | LNU907 | 0.746 | 1.32E−02 | 8 | 37 |
| LNU908 | 0.701 | 2.41E−02 | 2 | 5 | LNU908 | 0.725 | 1.77E−02 | 1 | 4 |
| LNU909 | 0.805 | 4.99E−03 | 2 | 41 | LNU909 | 0.745 | 1.34E−02 | 2 | 51 |
| LNU909 | 0.920 | 1.66E−04 | 2 | 16 | LNU909 | 0.789 | 1.14E−02 | 4 | 45 |
| LNU909 | 0.822 | 3.51E−03 | 3 | 11 | LNU909 | 0.771 | 9.03E−03 | 3 | 6 |
| LNU910 | 0.761 | 1.05E−02 | 6 | 17 | LNU910 | 0.743 | 1.37E−02 | 6 | 44 |
| LNU910 | 0.743 | 1.38E−02 | 5 | 41 | LNU910 | 0.732 | 1.62E−02 | 5 | 51 |
| LNU910 | 0.767 | 9.66E−03 | 5 | 16 | LNU910 | 0.761 | 1.71E−02 | 3 | 52 |
| LNU910 | 0.781 | 1.30E−02 | 3 | 49 | LNU910 | 0.763 | 1.02E−02 | 1 | 53 |
| LNU910 | 0.761 | 1.05E−02 | 1 | 4 | LNU910 | 0.768 | 9.45E−03 | 1 | 12 |
| LNU911 | 0.716 | 1.99E−02 | 6 | 11 | LNU911 | 0.774 | 8.56E−03 | 8 | 10 |
| LNU911 | 0.708 | 2.18E−02 | 5 | 41 | LNU911 | 0.712 | 2.09E−02 | 5 | 51 |
| LNU911 | 0.733 | 1.59E−02 | 3 | 6 | LNU911 | 0.760 | 1.08E−02 | 7 | 30 |
| LNU912 | 0.773 | 8.74E−03 | 9 | 17 | LNU912 | 0.706 | 2.25E−02 | 9 | 44 |
| LNU912 | 0.710 | 2.15E−02 | 9 | 43 | LNU912 | 0.712 | 2.08E−02 | 2 | 47 |
| LNU912 | 0.702 | 3.48E−02 | 4 | 18 | LNU912 | 0.717 | 1.96E−02 | 7 | 15 |
| LNU912 | 0.902 | 3.58E−04 | 1 | 30 | LNU913 | 0.713 | 2.06E−02 | 2 | 31 |
| LNU913 | 0.705 | 2.29E−02 | 2 | 22 | LNU913 | 0.726 | 1.75E−02 | 2 | 37 |
| LNU913 | 0.760 | 1.08E−02 | 3 | 17 | LNU913 | 0.746 | 1.33E−02 | 3 | 40 |
| LNU913 | 0.821 | 3.63E−03 | 3 | 44 | LNU913 | 0.803 | 5.19E−03 | 3 | 36 |
| LNU913 | 0.777 | 8.20E−03 | 3 | 34 | LNU914 | 0.713 | 2.07E−02 | 6 | 40 |
| LNU914 | 0.759 | 1.09E−02 | 6 | 34 | LNU914 | 0.716 | 1.98E−02 | 9 | 8 |
| LNU914 | 0.707 | 2.22E−02 | 5 | 51 | LNU916 | 0.753 | 1.92E−02 | 1 | 21 |
| LNU917 | 0.750 | 1.25E−02 | 6 | 17 | LNU917 | 0.728 | 1.70E−02 | 6 | 44 |
| LNU917 | 0.900 | 3.94E−04 | 4 | 53 | LNU917 | 0.794 | 6.13E−03 | 4 | 4 |
| LNU917 | 0.904 | 3.29E−04 | 4 | 12 | LNU917 | 0.959 | 4.46E−05 | 3 | 52 |
| LNU917 | 0.830 | 2.97E−03 | 3 | 6 | LNU917 | 0.925 | 3.50E−04 | 3 | 49 |
| LNU917 | 0.804 | 5.09E−03 | 3 | 8 | LNU917 | 0.728 | 2.62E−02 | 1 | 18 |
| LNU918 | 0.837 | 2.54E−03 | 9 | 17 | LNU918 | 0.757 | 1.13E−02 | 8 | 16 |
| LNU918 | 0.748 | 1.29E−02 | 3 | 44 | LNU919 | 0.791 | 6.48E−03 | 9 | 17 |
| LNU919 | 0.756 | 1.14E−02 | 9 | 40 | LNU919 | 0.758 | 1.11E−02 | 9 | 44 |
| LNU919 | 0.758 | 1.10E−02 | 9 | 43 | LNU919 | 0.709 | 2.16E−02 | 9 | 34 |
| LNU919 | 0.896 | 4.55E−04 | 2 | 41 | LNU919 | 0.733 | 1.59E−02 | 2 | 22 |
| LNU919 | 0.736 | 1.52E−02 | 2 | 42 | LNU919 | 0.836 | 2.56E−03 | 2 | 51 |
| LNU919 | 0.780 | 7.74E−03 | 2 | 37 | LNU919 | 0.769 | 9.37E−03 | 2 | 16 |
| LNU919 | 0.870 | 1.05E−03 | 8 | 35 | LNU919 | 0.708 | 2.19E−02 | 3 | 17 |
| LNU920 | 0.728 | 1.71E−02 | 6 | 14 | LNU920 | 0.727 | 1.72E−02 | 6 | 49 |
| LNU920 | 0.790 | 1.12E−02 | 4 | 45 | LNU921 | 0.701 | 2.40E−02 | 6 | 17 |
| LNU921 | 0.876 | 8.95E−04 | 4 | 53 | LNU921 | 0.804 | 5.05E−03 | 4 | 4 |
| LNU921 | 0.867 | 1.16E−03 | 4 | 12 | LNU922 | 0.819 | 3.73E−03 | 6 | 3 |
| LNU922 | 0.740 | 1.44E−02 | 2 | 37 | LNU922 | 0.796 | 5.83E−03 | 2 | 16 |
| LNU922 | 0.779 | 7.87E−03 | 5 | 2 | LNU922 | 0.701 | 2.39E−02 | 3 | 20 |
| LNU922 | 0.820 | 6.77E−03 | 1 | 18 | LNU922 | 0.864 | 2.66E−03 | 1 | 24 |
| LNU922 | 0.886 | 1.47E−03 | 1 | 21 | LNU923 | 0.785 | 7.10E−03 | 6 | 48 |
| LNU923 | 0.734 | 1.56E−02 | 5 | 2 | LNU923 | 0.897 | 4.27E−04 | 3 | 17 |
| LNU923 | 0.714 | 2.03E−02 | 3 | 44 | LNU924 | 0.824 | 3.39E−03 | 9 | 17 |
| LNU924 | 0.746 | 1.32E−02 | 9 | 23 | LNU924 | 0.734 | 1.56E−02 | 9 | 44 |
| LNU924 | 0.803 | 5.20E−03 | 4 | 53 | LNU924 | 0.820 | 3.66E−03 | 4 | 4 |
| LNU924 | 0.808 | 4.66E−03 | 4 | 12 | LNU924 | 0.702 | 2.36E−02 | 8 | 33 |
| LNU924 | 0.723 | 1.81E−02 | 8 | 35 | LNU925 | 0.715 | 2.00E−02 | 6 | 11 |
| LNU925 | 0.737 | 1.49E−02 | 6 | 6 | LNU925 | 0.701 | 2.38E−02 | 6 | 14 |
| LNU925 | 0.782 | 7.53E−03 | 2 | 5 | LNU925 | 0.716 | 1.98E−02 | 2 | 50 |
| LNU925 | 0.737 | 1.51E−02 | 2 | 54 | LNU925 | 0.765 | 9.87E−03 | 2 | 41 |
| LNU925 | 0.710 | 2.14E−02 | 2 | 10 | LNU925 | 0.785 | 7.18E−03 | 2 | 28 |

TABLE 36-continued

Correlation between the expression level of selected genes of some embodiments of the invention in various tissues and the phenotypic performance under normal or abiotic stress conditions across Sorghum accessions

| Gene Name | R | P value | Exp.set | Cor. Set ID | Gene Name | R | P value | Exp.set | Cor. Set ID |
|---|---|---|---|---|---|---|---|---|---|
| LNU925 | 0.717 | 1.95E−02 | 2 | 13 | LNU925 | 0.752 | 1.22E−02 | 2 | 51 |
| LNU925 | 0.761 | 1.05E−02 | 2 | 37 | LNU925 | 0.734 | 1.56E−02 | 4 | 53 |
| LNU925 | 0.751 | 1.22E−02 | 4 | 12 | LNU925 | 0.824 | 3.40E−03 | 8 | 41 |
| LNU925 | 0.787 | 6.84E−03 | 8 | 51 | LNU925 | 0.770 | 9.16E−03 | 8 | 37 |
| LNU925 | 0.814 | 4.16E−03 | 8 | 16 | LNU925 | 0.825 | 6.15E−03 | 3 | 52 |
| LNU925 | 0.711 | 2.13E−02 | 3 | 6 | LNU925 | 0.762 | 1.71E−0 | 3 | 49 |
| LNU925 | 0.817 | 3.91E−03 | 3 | 8 | LNU926 | 0.823 | 3.43E−03 | 6 | 17 |
| LNU926 | 0.706 | 2.26E−02 | 6 | 43 | LNU926 | 0.778 | 8.05E−03 | 8 | 2 |
| LNU926 | 0.715 | 2.02E−02 | 7 | 30 | LNU928 | 0.840 | 4.57E−03 | 4 | 45 |
| LNU928 | 0.733 | 2.47E−02 | 3 | 52 | LNU928 | 0.793 | 1.08E−02 | 3 | 49 |
| LNU928 | 0.712 | 3.13E−02 | 7 | 45 | LNU928 | 0.855 | 1.60E−03 | 1 | 15 |
| LNU930 | 0.754 | 1.18E−02 | 9 | 11 | LNU930 | 0.748 | 1.28E−02 | 2 | 41 |
| LNU930 | 0.714 | 2.03E−02 | 2 | 35 | LNU930 | 0.757 | 1.13E−02 | 2 | 42 |
| LNU930 | 0.748 | 1.29E−02 | 2 | 51 | LNU930 | 0.733 | 1.60E−02 | 2 | 37 |
| LNU930 | 0.702 | 2.35E−02 | 2 | 16 | LNU930 | 0.774 | 1.45E−02 | 3 | 52 |
| LNU930 | 0.767 | 1.59E−02 | 3 | 49 | LNU931 | 0.834 | 2.72E−03 | 6 | 3 |
| LNU931 | 0.797 | 5.77E−03 | 8 | 41 | LNU931 | 0.795 | 5.99E−03 | 8 | 35 |
| LNU931 | 0.836 | 2.60E−03 | 8 | 42 | LNU931 | 0.836 | 2.60E−03 | 8 | 51 |
| LNU931 | 0.859 | 1.44E−03 | 8 | 37 | LNU931 | 0.709 | 2.16E−02 | 5 | 2 |
| LNU932 | 0.829 | 5.69E−03 | 3 | 55 | LNU932 | 0.703 | 3.47E−02 | 7 | 18 |
| LNU932 | 0.799 | 9.81E−03 | 7 | 27 | LNU932 | 0.729 | 2.58E−02 | 7 | 24 |
| LNU933 | 0.771 | 9.00E−03 | 5 | 2 | LNU933 | 0.778 | 8.03E−03 | 1 | 30 |
| LNU934 | 0.834 | 2.71E−03 | 6 | 48 | LNU934 | 0.868 | 1.13E−03 | 9 | 43 |
| LNU934 | 0.711 | 2.10E−02 | 2 | 41 | LNU934 | 0.755 | 1.16E−02 | 2 | 51 |
| LNU934 | 0.757 | 1.12E−02 | 2 | 37 | LNU934 | 0.716 | 1.98E−02 | 3 | 17 |
| LNU934 | 0.897 | 4.31E−04 | 3 | 44 | LNU935 | 0.739 | 1.46E−02 | 6 | 17 |
| LNU935 | 0.781 | 7.62E−03 | 9 | 17 | LNU935 | 0.765 | 1.62E−02 | 3 | 55 |
| LNU935 | 0.927 | 3.22E−04 | 1 | 18 | LNU935 | 0.815 | 7.47E−03 | 1 | 27 |
| LNU935 | 0.871 | 2.21E−03 | 1 | 24 | LNU935 | 0.735 | 2.42E−02 | 1 | 21 |
| LNU936 | 0.739 | 1.46E−02 | 6 | 36 | LNU936 | 0.735 | 1.55E−02 | 6 | 34 |
| LNU936 | 0.786 | 7.01E−03 | 2 | 42 | LNU936 | 0.734 | 1.56E−02 | 8 | 16 |
| LNU938 | 0.743 | 1.39E−02 | 9 | 17 | LNU938 | 0.847 | 2.00E−03 | 9 | 44 |
| LNU938 | 0.836 | 2.57E−03 | 4 | 30 | LNU939 | 0.830 | 2.95E−03 | 4 | 53 |
| LNU939 | 0.777 | 8.25E−03 | 4 | 4 | LNU939 | 0.830 | 2.98E−03 | 4 | 12 |
| LNU939 | 0.821 | 3.56E−03 | 5 | 5 | LNU939 | 0.821 | 3.60E−03 | 5 | 50 |
| LNU939 | 0.869 | 1.11E−03 | 5 | 54 | LNU939 | 0.900 | 3.91E−04 | 5 | 13 |
| LNU939 | 0.954 | 6.53E−05 | 7 | 18 | LNU939 | 0.894 | 1.15E−03 | 7 | 27 |
| LNU939 | 0.904 | 8.15E−04 | 7 | 24 | LNU940 | 0.784 | 7.31E−03 | 6 | 6 |
| LNU940 | 0.762 | 1.04E−02 | 6 | 40 | LNU940 | 0.748 | 1.29E−02 | 6 | 14 |
| LNU940 | 0.730 | 1.64E−02 | 6 | 34 | LNU940 | 0.718 | 2.95E−02 | 9 | 52 |
| LNU940 | 0.841 | 2.28E−03 | 9 | 6 | LNU940 | 0.715 | 2.02E−02 | 9 | 14 |
| LNU940 | 0.713 | 2.05E−02 | 5 | 5 | LNU940 | 0.721 | 1.86E−02 | 5 | 54 |
| LNU940 | 0.767 | 9.62E−03 | 5 | 13 | LNU941 | 0.893 | 5.02E−04 | 2 | 41 |
| LNU941 | 0.753 | 1.20E−02 | 2 | 22 | LNU941 | 0.741 | 1.42E−02 | 2 | 35 |
| LNU941 | 0.721 | 1.87E−02 | 2 | 42 | LNU941 | 0.891 | 5.44E−04 | 2 | 51 |
| LNU941 | 0.824 | 3.37E−03 | 2 | 37 | LNU941 | 0.857 | 1.52E−03 | 3 | 6 |
| LNU942 | 0.716 | 1.99E−02 | 9 | 17 | LNU942 | 0.786 | 6.97E−03 | 2 | 41 |
| LNU942 | 0.737 | 1.50E−02 | 2 | 22 | LNU942 | 0.740 | 1.43E−02 | 2 | 51 |
| LNU942 | 0.839 | 2.43E−03 | 4 | 53 | LNU942 | 0.829 | 3.01E−03 | 4 | 4 |
| LNU942 | 0.846 | 2.01E−03 | 4 | 12 | LNU942 | 0.895 | 4.67E−04 | 8 | 31 |
| LNU942 | 0.885 | 1.52E−03 | 3 | 52 | LNU942 | 0.884 | 1.56E−03 | 3 | 49 |
| LNU942 | 0.771 | 9.09E−03 | 1 | 53 | LNU942 | 0.792 | 6.32E−03 | 1 | 4 |
| LNU942 | 0.761 | 1.06E−02 | 1 | 12 | LNU943 | 0.720 | 1.88E−02 | 6 | 17 |
| LNU943 | 0.766 | 9.80E−03 | 5 | 19 | LNU943 | 0.773 | 8.75E−03 | 5 | 28 |
| LNU943 | 0.701 | 2.38E−02 | 5 | 13 | LNU944 | 0.803 | 5.12E−03 | 6 | 26 |
| LNU944 | 0.861 | 1.38E−03 | 6 | 20 | LNU944 | 0.805 | 4.92E−03 | 6 | 23 |
| LNU944 | 0.718 | 1.95E−02 | 6 | 44 | LNU944 | 0.804 | 5.03E−03 | 2 | 28 |
| LNU944 | 0.750 | 1.25E−02 | 8 | 47 | LNU944 | 0.795 | 1.05E−02 | 3 | 52 |
| LNU944 | 0.747 | 2.08E−02 | 3 | 49 | LNU944 | 0.752 | 1.22E−02 | 3 | 8 |
| LNU945 | 0.703 | 2.34E−02 | 6 | 14 | LNU945 | 0.813 | 4.27E−03 | 2 | 47 |
| LNU945 | 0.805 | 4.92E−03 | 8 | 35 | LNU946 | 0.791 | 6.43E−03 | 6 | 17 |
| LNU946 | 0.795 | 5.99E−03 | 6 | 44 | LNU946 | 0.898 | 4.26E−04 | 5 | 16 |
| LNU946 | 0.745 | 1.34E−02 | 3 | 23 | LNU946 | 0.867 | 2.49E−03 | 7 | 18 |
| LNU946 | 0.899 | 9.92E−04 | 7 | 27 | LNU946 | 0.796 | 1.02E−02 | 7 | 24 |
| LNU947 | 0.736 | 1.52E−02 | 9 | 40 | LNU947 | 0.741 | 1.41E−02 | 9 | 34 |
| LNU947 | 0.717 | 1.96E−02 | 1 | 53 | LNU947 | 0.847 | 1.98E−03 | 1 | 4 |
| LNU947 | 0.705 | 2.29E−02 | 1 | 12 | LNU948 | 0.780 | 7.76E−03 | 6 | 48 |
| LNU948 | 0.710 | 2.15E−02 | 6 | 3 | LNU948 | 0.705 | 2.27E−02 | 1 | 30 |
| LNU949 | 0.751 | 1.23E−02 | 6 | 52 | LNU949 | 0.800 | 5.48E−03 | 6 | 11 |
| LNU949 | 0.834 | 2.72E−03 | 6 | 6 | LNU949 | 0.736 | 1.52E−02 | 6 | 14 |
| LNU949 | 0.758 | 1.11E−02 | 6 | 49 | LNU949 | 0.730 | 1.66E−02 | 2 | 47 |
| LNU949 | 0.764 | 1.01E−02 | 4 | 53 | LNU949 | 0.843 | 2.17E−03 | 4 | 4 |
| LNU949 | 0.756 | 1.14E−02 | 4 | 12 | LNU949 | 0.795 | 6.00E−03 | 5 | 5 |

TABLE 36-continued

Correlation between the expression level of selected genes of some embodiments of the invention in various tissues and the phenotypic performance under normal or abiotic stress conditions across Sorghum accessions

| Gene Name | R | P value | Exp.set | Cor. Set ID | Gene Name | R | P value | Exp.set | Cor. Set ID |
|---|---|---|---|---|---|---|---|---|---|
| LNU949 | 0.805 | 4.96E−03 | 5 | 50 | LNU949 | 0.780 | 7.77E−03 | 5 | 54 |
| LNU949 | 0.799 | 5.56E−03 | 5 | 13 | LNU949 | 0.758 | 1.11E−02 | 3 | 8 |
| LNU950 | 0.739 | 1.47E−02 | 6 | 3 | LNU951 | 0.744 | 1.37E−02 | 2 | 13 |
| LNU952 | 0.838 | 4.78E−03 | 3 | 52 | LNU952 | 0.870 | 1.07E−03 | 3 | 6 |
| LNU952 | 0.776 | 1.39E−02 | 3 | 49 | LNU952 | 0.796 | 5.90E−03 | 3 | 8 |
| LNU952 | 0.785 | 1.21E−02 | 1 | 45 | LNU952 | 0.786 | 7.02E−03 | 1 | 53 |
| LNU952 | 0.728 | 1.70E−02 | 1 | 4 | LNU952 | 0.774 | 8.66E−03 | 1 | 12 |
| LNU953 | 0.774 | 1.44E−02 | 3 | 52 | LNU953 | 0.771 | 1.51E−02 | 3 | 49 |
| LNU953 | 0.726 | 1.74E−02 | 3 | 8 | LNU954 | 0.814 | 4.13E−03 | 6 | 52 |
| LNU954 | 0.715 | 2.02E−02 | 6 | 14 | LNU954 | 0.793 | 6.19E−03 | 6 | 49 |
| LNU954 | 0.726 | 2.69E−02 | 4 | 45 | LNU954 | 0.860 | 1.42E−03 | 8 | 5 |
| LNU954 | 0.861 | 1.36E−03 | 8 | 50 | LNU954 | 0.851 | 1.79E−03 | 8 | 54 |
| LNU954 | 0.739 | 1.46E−02 | 8 | 10 | LNU954 | 0.871 | 1.04E−03 | 8 | 35 |
| LNU954 | 0.782 | 7.52E−03 | 8 | 13 | LNU954 | 0.802 | 5.29E−03 | 5 | 5 |
| LNU954 | 0.774 | 8.55E−03 | 5 | 54 | LNU954 | 0.762 | 1.04E−02 | 5 | 10 |
| LNU954 | 0.750 | 2.00E−02 | 7 | 18 | LNU954 | 0.730 | 2.57E−02 | 7 | 24 |
| LNU955 | 0.732 | 1.61E−02 | 9 | 17 | LNU955 | 0.805 | 8.86E−03 | 4 | 18 |
| LNU955 | 0.812 | 7.90E−03 | 4 | 27 | LNU955 | 0.728 | 2.63E−02 | 4 | 24 |
| LNU955 | 0.824 | 3.40E−03 | 8 | 33 | LNU955 | 0.851 | 1.80E−03 | 8 | 39 |
| LNU955 | 0.705 | 2.27E−02 | 5 | 2 | LNU955 | 0.710 | 2.15E−02 | 1 | 30 |
| LNU956 | 0.786 | 1.21E−02 | 4 | 45 | LNU956 | 0.787 | 1.19E−02 | 1 | 45 |
| LNU957 | 0.749 | 1.27E−02 | 6 | 29 | LNU957 | 0.743 | 1.37E−02 | 6 | 20 |
| LNU957 | 0.782 | 1.27E−02 | 3 | 55 | LNU958 | 0.801 | 5.37E−03 | 9 | 17 |
| LNU958 | 0.773 | 8.77E−03 | 4 | 30 | LNU958 | 0.800 | 5.47E−03 | 8 | 33 |
| LNU958 | 0.799 | 5.53E−03 | 8 | 39 | LNU958 | 0.759 | 1.09E−02 | 8 | 16 |
| LNU958 | 0.720 | 1.88E−02 | 5 | 41 | LNU958 | 0.886 | 6.41E−04 | 5 | 16 |
| LNU959 | 0.827 | 3.13E−03 | 2 | 41 | LNU959 | 0.747 | 1.29E−02 | 2 | 22 |
| LNU959 | 0.757 | 1.13E−02 | 2 | 51 | LNU959 | 0.778 | 8.02E−03 | 2 | 16 |
| LNU959 | 0.727 | 1.72E−02 | 4 | 9 | LNU959 | 0.928 | 3.02E−04 | 3 | 52 |
| LNU959 | 0.871 | 1.03E−03 | 3 | 6 | LNU959 | 0.701 | 2.39E−02 | 3 | 14 |
| LNU959 | 0.893 | 1.17E−03 | 3 | 49 | LNU959 | 0.771 | 8.97E−03 | 3 | 8 |
| LNU960 | 0.865 | 1.23E−03 | 6 | 17 | LNU960 | 0.886 | 6.43E−04 | 6 | 44 |
| LNU960 | 0.771 | 9.08E−03 | 9 | 26 | LNU960 | 0.807 | 4.82E−03 | 9 | 23 |
| LNU960 | 0.722 | 1.83E−02 | 9 | 44 | LNU960 | 0.754 | 1.17E−02 | 2 | 42 |
| LNU960 | 0.759 | 1.10E−02 | 2 | 37 | LNU960 | 0.932 | 8.55E−05 | 4 | 53 |
| LNU960 | 0.870 | 1.05E−03 | 4 | 4 | LNU960 | 0.932 | 8.83E−05 | 4 | 12 |
| LNU960 | 0.738 | 1.49E−02 | 5 | 13 | LNU960 | 0.703 | 2.34E−02 | 5 | 51 |
| LNU961 | 0.738 | 1.47E−02 | 6 | 20 | LNU961 | 0.803 | 5.15E−03 | 9 | 17 |
| LNU961 | 0.836 | 2.56E−03 | 9 | 44 | LNU961 | 0.735 | 1.54E−02 | 9 | 43 |
| LNU961 | 0.745 | 1.35E−02 | 8 | 33 | LNU961 | 0.824 | 3.40E−03 | 8 | 35 |
| LNU961 | 0.781 | 7.62E−03 | 3 | 8 | LNU961 | 0.874 | 2.06E−03 | 7 | 18 |
| LNU961 | 0.954 | 6.50E−05 | 7 | 27 | LNU961 | 0.789 | 1.14E−02 | 7 | 24 |
| LNU962 | 0.808 | 4.66E−03 | 2 | 16 | LNU962 | 0.725 | 1.76E−02 | 5 | 28 |
| LNU962 | 0.897 | 1.06E−03 | 3 | 52 | LNU962 | 0.848 | 1.93E−03 | 3 | 6 |
| LNU962 | 0.892 | 1.22E−03 | 3 | 49 | LNU962 | 0.706 | 3.36E−02 | 1 | 45 |
| LNU964 | 0.706 | 2.24E−02 | 2 | 33 | LNU964 | 0.778 | 8.03E−03 | 2 | 41 |
| LNU964 | 0.756 | 1.14E−02 | 2 | 35 | LNU964 | 0.820 | 3.71E−03 | 2 | 51 |
| LNU964 | 0.820 | 3.71E−03 | 2 | 37 | LNU964 | 0.778 | 8.06E−03 | 3 | 44 |
| LNU964 | 0.713 | 2.06E−02 | 1 | 53 | LNU964 | 0.712 | 2.08E−02 | 1 | 12 |
| LNU965 | 0.828 | 3.08E−03 | 6 | 48 | LNU965 | 0.745 | 1.35E−02 | 6 | 3 |
| LNU965 | 0.779 | 7.92E−03 | 2 | 33 | LNU965 | 0.885 | 6.71E−04 | 2 | 41 |
| LNU965 | 0.767 | 9.59E−03 | 2 | 39 | LNU965 | 0.829 | 3.04E−03 | 2 | 51 |
| LNU965 | 0.861 | 1.39E−03 | 2 | 37 | LNU965 | 0.875 | 9.24E−04 | 2 | 16 |
| LNU966 | 0.709 | 2.17E−02 | 6 | 52 | LNU966 | 0.708 | 2.20E−02 | 6 | 3 |
| LNU966 | 0.748 | 1.29E−02 | 3 | 6 | LNU966 | 0.716 | 3.00E−02 | 7 | 45 |
| LNU967 | 0.800 | 5.48E−03 | 6 | 17 | LNU967 | 0.766 | 9.82E−03 | 4 | 53 |
| LNU967 | 0.707 | 2.22E−02 | 4 | 4 | LNU967 | 0.768 | 9.41E−03 | 4 | 12 |
| LNU968 | 0.771 | 9.02E−03 | 6 | 48 | LNU968 | 0.719 | 1.90E−02 | 2 | 33 |
| LNU968 | 0.919 | 1.71E−04 | 2 | 41 | LNU968 | 0.904 | 3.35E−04 | 2 | 51 |
| LNU968 | 0.781 | 7.72E−03 | 2 | 37 | LNU968 | 0.734 | 1.56E−02 | 2 | 16 |
| LNU968 | 0.788 | 6.83E−03 | 3 | 17 | LNU968 | 0.826 | 3.22E−03 | 3 | 43 |
| LNU969 | 0.805 | 4.95E−03 | 2 | 42 | | | | | |

Table 36: Provided are the correlations (R) between the expression levels of yield improving genes and their homologues in tissues [Flag leaf, Flower meristem, stem and Flower; Expression sets (Exp)] and the phenotypic performance in various yield, biomass, growth rate and/or vigor components [Correlation vector (cor.)] under stress conditions or normal conditions across Sorghum accessions. P = p value.

Example 6

Production of *Sorghum* Transcriptom and High Throughput Correlation Analysis with Biomass, NUE, and ABST Related Parameters Measured in Semi-Hydroponics Conditions Using 44K Sorguhm Oligonucleotide Micro-Arrays

*Sorghum* vigor related parameters under low nitrogen, 100 mM NaCl, low temperature (10±2° C.) and normal growth conditions—Ten *Sorghum* hybrids were grown in 3 repetitive plots, each containing 17 plants, at a net house under semi-hydroponics conditions. Briefly, the growing protocol was as follows: *Sorghum* seeds were sown in trays filled with a mix of vermiculite and peat in a 1:1 ratio. Following germination, the trays were transferred to the high salinity solution (100 mM NaCl in addition to the Full Hoagland solution), low temperature (10±2° C. in the presence of Full Hoagland solution), low nitrogen solution (the amount of total nitrogen was reduced in 90% from the full Hoagland solution (i.e., to a final concentration of 10% from full Hoagland solution, final amount of 1.2 mM N) or at Normal growth solution (Full Hoagland containing 16 mM N solution, at 28±2° C.). Plants were grown at 28±2° C.

Full Hoagland solution consists of: $KNO_3$—0.808 grams/liter, $MgSO_4$—0.12 grams/liter, $KH_2PO_4$—0.172 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8].

Analyzed *Sorghum* tissues—All 10 selected *Sorghum* hybrids were sampled per each treatment. Three tissues [leaves, meristems and roots] growing at 100 mM NaCl, low temperature (10±2° C.), low Nitrogen (1.2 mM N) or under Normal conditions were sampled and RNA was extracted as described above. Each micro-array expression information tissue type has received a Set ID as summarized in Table 37 below.

TABLE 37

Sorghum transcriptom expression sets under semi hydroponics conditions

| Set ID | Expression Set |
|---|---|
| 1 | Sorghum root under cold |
| 2 | Sorghum root under normal conditions |
| 3 | Sorghum root under low N conditions |
| 4 | Sorghum root under 100 mM NaCl conditions |
| 5 | Sorghum meristem under cold |
| 6 | Sorghum meristem under normal conditions |
| 7 | Sorghum meristem under low N conditions |
| 8 | Sorghum meristem under 100 mM NaCl conditions |

Table 37: Provided are the Sorghum transcriptom expression sets.
Cold conditions = 10 ± 2° C.;
NaCl = 100 mM NaCl;
low nitrogen = 1.2 mM Nitrogen;
Normal conditions = 16 mM Nitrogen.

Experimental Results 10 different *Sorghum* hybrids were grown and characterized for the following parameters: "Leaf No"=leaf number per plant (average of five plants); "Plant Height"=plant height [cm] (average of five plants); "DW Root/Plant"—root dry weight per plant (average of five plants); DW Shoot/Plant—shoot dry weight per plant (average of five plants) (Table 38). The average for each of the measured parameter was calculated using the JMP software and values are summarized in Tables 39-45 below. Subsequent correlation analysis was performed (Table 46). Results were then integrated to the database.

TABLE 38

Sorghum correlated parameters (vectors)

| Correlation ID | Correlated parameter with |
|---|---|
| 1 | DW Root/Plant-100 mM NaCl [gr.] |
| 2 | DW Root/Plant-Cold [gr.] |
| 3 | DW Root/Plant-Low Nitrogen [gr.] |
| 4 | DW Root/Plant-Normal [gr.] |
| 5 | DW Shoot/Plant-Low Nitrogen [gr.] |
| 6 | DW Shoot/Plant-100 mM NaCl [gr.] |
| 7 | DW Shoot/Plant-Cold [gr.] |
| 8 | DW Shoot/Plant-Normal [gr.] |
| 9 | Leaf TP1-100 mM NaCl [number] |
| 10 | Leaf TP1-Cold [number] |
| 11 | Leaf TP1-Low Nitrogen [number] |
| 12 | Leaf TP1-Normal [number] |
| 13 | Leaf TP2-100 mM NaCl [number] |
| 14 | Leaf TP2-Cold [number] |
| 15 | Leaf TP2-Low Nitrogen [number] |
| 16 | Leaf TP2-Normal [number] |
| 17 | Leaf TP3-100 mM NaCl [number] |
| 18 | Leaf TP3-Cold [number] |
| 19 | Leaf TP3-Low Nitrogen [number] |
| 20 | Leaf TP3-Normal [number] |
| 21 | Low N-NUE total biomass [gr.] |
| 22 | Low N-Shoot/Root |
| 23 | Low N-NUE roots |
| 24 | Low N-NUE shoots |
| 25 | Low N-percent-root biomass compared to normal |
| 26 | Low N-percent-shoot biomass compared to normal |
| 27 | Low N-percent-total biomass reduction compared to normal |
| 28 | N level/Leaf [Low Nitrogen] |
| 29 | N level/Leaf [100 mM NaCl] |
| 30 | N level/Leaf [Cold] |
| 31 | N level/Leaf [Normal] |
| 32 | Normal-Shoot/Root |
| 33 | Normal-NUE roots |
| 34 | Normal-NUE shoots |
| 35 | Normal-NUE total biomass |
| 36 | Plant Height TP1-100 mM NaCl [cm] |
| 37 | Plant Height TP1-Cold [cm] |
| 38 | Plant Height TP1-Low Nitrogen [cm] |
| 39 | Plant Height TP1-Normal [cm] |
| 40 | Plant Height TP2-Cold [cm] |
| 41 | Plant Height TP2-Low Nitrogen [cm] |
| 42 | Plant Height TP2-Normal [cm] |
| 43 | Plant Height TP2-100 mM NaCl [cm] |
| 44 | Plant Height TP3-100 mM NaCl [cm] |
| 45 | Plant Height TP3-Low Nitrogen [cm] |
| 46 | RGR Leaf Num Normal |
| 47 | Root Biomass [DW-gr.]/SPAD [100 mM NaCl] |
| 48 | Root Biomass [DW-gr.]/SPAD [Cold] |
| 49 | Root Biomass [DW-gr.]/SPAD [Low Nitrogen] |
| 50 | Root Biomass [DW-gr.]/SPAD [Normal] |
| 51 | SPAD-Cold |
| 52 | SPAD-Low Nitrogen |
| 53 | SPAD-Normal |
| 54 | SPAD 100-mM NaCl |
| 55 | Shoot Biomass [DW-gr.]/SPAD [100 mM NaCl] |
| 56 | Shoot Biomass [DW-gr.]/SPAD [Cold] |
| 57 | Shoot Biomass [DW-gr.]/SPAD [Low Nitrogen] |
| 58 | Shoot Biomass [DW-gr.]/SPAD [Normal] |
| 59 | Total Biomass-Root + Shoot [DW-gr.]/SPAD [100 mM NaCl] |
| 60 | Total Biomass-Root + Shoot [DW-gr.]/SPAD [Cold] |
| 61 | Total Biomass-Root + Shoot [DW-gr.]/SPAD [Low Nitrogen] |
| 62 | Total Biomass-Root + Shoot[DW-gr.]/SPAD [Normal] |

Table 38: Provided are the Sorghum correlated parameters.
Cold conditions = 10 ± 2 ° C.;
NaCl = 100 mM NaCl;
low nitrogen = 1.2 mM Nitrogen;
Normal conditions = 16 mM Nitrogen
* TP-1-2-3 refers to time points 1, 2 and 3.

TABLE 39

Sorghum accessions, measured parameters under low nitrogen growth conditions

| Cor. ID/line ID | 3 | 5 | 11 | 15 | 19 | 38 | 41 | 45 | 52 | 1 |
|---|---|---|---|---|---|---|---|---|---|---|
| Line-1 | 0.04 | 0.08 | 3.00 | 4.00 | 3.90 | 6.73 | 13.30 | 22.23 | 26.88 | 0.05 |
| Line-2 | 0.11 | 0.19 | 3.13 | 4.58 | 4.27 | 9.77 | 20.63 | 31.07 | 28.02 | 0.10 |
| Line-3 | 0.20 | 0.33 | 3.87 | 4.97 | 4.70 | 12.70 | 23.70 | 34.67 | 29.64 | 0.12 |
| Line-4 | 0.10 | 0.16 | 3.53 | 4.73 | 4.23 | 8.67 | 18.03 | 30.03 | 31.52 | 0.07 |
| Line-5 | 0.08 | 0.16 | 3.20 | 4.60 | 4.30 | 9.77 | 19.33 | 30.83 | 29.61 | 0.08 |
| Line-6 | 0.09 | 0.16 | 3.13 | 4.70 | 4.57 | 9.23 | 19.20 | 29.87 | 26.82 | 0.08 |
| Line-7 | 0.13 | 0.26 | 3.13 | 4.97 | 4.63 | 10.27 | 21.87 | 30.87 | 28.48 | 0.14 |
| Line-8 | 0.09 | 0.20 | 3.30 | 4.87 | 4.67 | 10.10 | 22.13 | 32.40 | 28.21 | 0.10 |
| Line-9 | 0.09 | 0.13 | 3.07 | 4.67 | 3.97 | 7.93 | 18.20 | 29.37 | 30.48 | 0.17 |
| Line-10 | 0.09 | 0.18 | 3.07 | 4.57 | 4.10 | 8.23 | 21.00 | 30.70 | 27.63 | 0.14 |

Table 39: Provided are the values of each of the parameters (as described above) measured in Sorghum accessions (line ID) under low nitrogen conditions. Growth conditions are specified in the experimental procedure section.

TABLE 40

Additional sorghum accessions, measured parameters under low nitrogen growth conditions

| Corr. ID/line ID | 21 | 22 | 23 | 24 | 25 | 26 | 27 | 28 | 49 | 57 | 61 |
|---|---|---|---|---|---|---|---|---|---|---|---|
| Line-1 | 27.528 | 1.875 | 9.647 | 17.881 | 84.528 | 81.573 | 82.585 | 6.892 | 0.002 | 0.003 | 0.005 |
| Line-2 | 64.124 | 1.707 | 23.538 | 40.586 | 80.954 | 79.164 | 79.812 | 6.568 | 0.004 | 0.007 | 0.011 |
| Line-3 | 115.231 | 1.731 | 43.877 | 71.354 | 117.004 | 104.754 | 109.104 | 6.307 | 0.007 | 0.011 | 0.018 |
| Line-4 | 58.017 | 1.568 | 22.580 | 35.436 | 100.519 | 103.497 | 102.317 | 7.446 | 0.003 | 0.005 | 0.008 |
| Line-5 | 52.219 | 2.096 | 16.886 | 35.333 | 72.538 | 83.707 | 79.737 | 6.886 | 0.003 | 0.005 | 0.008 |
| Line-6 | 35.103 | 1.815 | 12.440 | 22.663 | 71.777 | 83.215 | 78.767 | 5.873 | 0.003 | 0.006 | 0.009 |
| Line-7 | 84.575 | 2.062 | 28.194 | 56.381 | 93.472 | 107.689 | 102.492 | 6.146 | 0.005 | 0.009 | 0.014 |
| Line-8 | 63.728 | 2.097 | 20.528 | 43.200 | 76.051 | 81.368 | 79.588 | 6.046 | 0.003 | 0.007 | 0.010 |
| Line-9 | 47.029 | 1.504 | 18.756 | 28.273 | 86.820 | 70.300 | 76.073 | 7.683 | 0.003 | 0.004 | 0.007 |
| Line-10 | 59.998 | 1.999 | 20.086 | 39.912 | 80.511 | 75.859 | 77.355 | 6.740 | 0.003 | 0.007 | 0.010 |

Table 40: Provided are the values of each of the parameters (as described above) measured in Sorghum accessions (line ID) under low nitrogen conditions. Growth conditions are specified in the experimental procedure section.

TABLE 41

Sorghum accessions, measured parameters under salinity (100 mM NaCl) conditions

| Corr. ID/line ID | 1 | 6 | 9 | 13 | 17 | 36 |
|---|---|---|---|---|---|---|
| Line-1 | 0.050 | 0.094 | 3.000 | 4.000 | 4.000 | 7.900 |
| Line-2 | 0.104 | 0.186 | 3.133 | 4.367 | 4.133 | 9.500 |
| Line-3 | 0.124 | 0.202 | 3.400 | 4.867 | 4.567 | 10.933 |
| Line-4 | 0.069 | 0.137 | 3.067 | 4.600 | 4.433 | 7.933 |
| Line-5 | 0.076 | 0.130 | 3.333 | 4.500 | 4.067 | 9.700 |
| Line-6 | 0.075 | 0.133 | 3.067 | 4.533 | 4.333 | 8.533 |
| Line-7 | 0.135 | 0.154 | 3.067 | 4.500 | 4.133 | 8.900 |
| Line-8 | 0.095 | 0.189 | 3.267 | 4.767 | 4.500 | 10.367 |
| Line-9 | 0.165 | 0.099 | 3.000 | 4.320 | 3.780 | 7.000 |
| Line-10 | 0.139 | 0.124 | 3.067 | 4.200 | 4.200 | 7.833 |

Table 41: Provided are the values of each of the parameters (as described above) measured in Sorghum accessions (line ID) under 100 mM NaCl growth conditions. Growth conditions are specified in the experimental procedure section.

TABLE 42

Additional Sorghum accessions, measured parameters under salinity (100 mM NaCl) conditions

| Corr. ID/line ID | 29 | 47 | 55 | 59 | 43 | 44 | 54 |
|---|---|---|---|---|---|---|---|
| Line-1 | 8.183 | 0.002 | 0.003 | 0.004 | 14.200 | 21.800 | 32.733 |
| Line-2 | 8.503 | 0.003 | 0.005 | 0.008 | 16.267 | 23.167 | 35.144 |
| Line-3 | 6.124 | 0.004 | 0.007 | 0.012 | 20.367 | 30.367 | 27.967 |
| Line-4 | 6.977 | 0.002 | 0.004 | 0.007 | 13.333 | 22.833 | 30.933 |
| Line-5 | 8.492 | 0.002 | 0.004 | 0.006 | 15.900 | 23.700 | 34.533 |
| Line-6 | 6.921 | 0.003 | 0.004 | 0.007 | 16.533 | 23.300 | 29.989 |
| Line-7 | 7.763 | 0.004 | 0.005 | 0.009 | 15.467 | 22.467 | 32.089 |
| Line-8 | 7.079 | 0.003 | 0.006 | 0.009 | 18.933 | 26.833 | 31.856 |
| Line-9 | 8.601 | 0.005 | 0.003 | 0.008 | 13.680 | 20.280 | 32.513 |
| Line-10 | 8.172 | 0.004 | 0.004 | 0.008 | 15.767 | 23.567 | 34.322 |

Table 42: Provided are the values of each of the parameters (as described above) measured in Sorghum accessions (line ID) under 100 mM NaCl growth conditions. Growth conditions are specified in the experimental procedure section.

TABLE 43

Sorghum accessions, measured parameters under cold conditions

| Corr. ID/line ID | 2 | 7 | 10 | 14 | 18 | 37 | 40 | 51 | 30 | 48 | 56 | 60 |
|---|---|---|---|---|---|---|---|---|---|---|---|---|
| Line-1 | 0.068 | 0.078 | 3.000 | 3.900 | 4.733 | 6.500 | 11.167 | 28.622 | 6.047 | 0.002 | 0.003 | 0.005 |
| Line-2 | 0.108 | 0.154 | 3.000 | 4.133 | 5.333 | 8.767 | 15.867 | 30.311 | 5.683 | 0.004 | 0.005 | 0.009 |
| Line-3 | 0.163 | 0.189 | 3.500 | 4.633 | 5.433 | 10.400 | 18.433 | 27.044 | 4.978 | 0.006 | 0.007 | 0.013 |
| Line-4 | 0.093 | 0.112 | 3.167 | 4.167 | 5.500 | 6.800 | 12.200 | 32.278 | 5.869 | 0.003 | 0.003 | 0.006 |
| Line-5 | 0.084 | 0.130 | 3.400 | 4.267 | 5.333 | 9.033 | 16.033 | 28.278 | 5.302 | 0.003 | 0.005 | 0.008 |
| Line-6 | 0.114 | 0.165 | 3.200 | 4.233 | 5.067 | 9.000 | 14.633 | 29.889 | 5.899 | 0.004 | 0.006 | 0.009 |
| Line-7 | 0.137 | 0.152 | 3.133 | 4.200 | 4.500 | 7.967 | 14.600 | 32.467 | 7.215 | 0.004 | 0.005 | 0.009 |
| Line-8 | 0.127 | 0.150 | 3.067 | 4.300 | 5.400 | 9.167 | 17.267 | 28.633 | 5.302 | 0.004 | 0.005 | 0.010 |
| Line-9 | 0.108 | 0.112 | 3.067 | 4.167 | 5.367 | 6.500 | 13.433 | 31.711 | 5.909 | 0.003 | 0.004 | 0.007 |
| Line-10 | 0.139 | 0.141 | 3.000 | 4.000 | 5.182 | 7.227 | 13.909 | 29.557 | 5.704 | 0.005 | 0.005 | 0.009 |

Table 43: Provided are the values of each of the parameters (as described above) measured in Sorghum accessions (line ID) under cold growth conditions. Growth conditions are specified in the experimental procedure section.

TABLE 44

Sorghum accessions, measured parameters under regular growth conditions

| Corr. ID/line ID | 4 | 8 | 12 | 16 | 20 | 39 | 42 | 46 | 53 |
|---|---|---|---|---|---|---|---|---|---|
| Line-1 | 0.053 | 0.101 | 3.000 | 4.167 | 5.333 | 7.467 | 14.967 | 0.155 | 26.700 |
| Line-2 | 0.134 | 0.236 | 3.067 | 4.500 | 5.867 | 9.300 | 18.323 | 0.186 | 29.333 |
| Line-3 | 0.173 | 0.313 | 3.800 | 4.800 | 6.200 | 12.867 | 22.100 | 0.159 | 29.685 |
| Line-4 | 0.103 | 0.158 | 3.200 | 4.600 | 5.800 | 8.567 | 17.600 | 0.173 | 29.089 |
| Line-5 | 0.107 | 0.194 | 3.233 | 4.533 | 5.800 | 8.933 | 18.067 | 0.171 | 24.978 |
| Line-6 | 0.120 | 0.188 | 3.233 | 4.967 | 5.733 | 8.533 | 18.353 | 0.168 | 24.622 |
| Line-7 | 0.139 | 0.241 | 3.133 | 4.600 | 5.733 | 10.667 | 22.833 | 0 174 | 30.789 |
| Line-8 | 0.124 | 0.244 | 3.433 | 4.933 | 6.000 | 10.267 | 22.303 | 0.171 | 25.500 |
| Line-9 | 0.099 | 0.185 | 3.000 | 4.500 | 5.600 | 7.867 | 20.033 | 0.174 | 32.889 |
| Line-10 | 0.115 | 0.242 | 3.000 | 4.567 | 6.067 | 8.767 | 21.800 | 0.204 | 33.544 |

Table 44: Provided are the values of each of the parameters (as described above) measured in Sorghum accessions (line ID) under cold growth conditions. Growth conditions are specified in the experimental procedure section.

TABLE 45

Additional Sorghum accessions, measured parameters under regular growth conditions

| Corr. ID/line ID | 31 | 32 | 33 | 34 | 35 | 50 | 58 | 62 |
|---|---|---|---|---|---|---|---|---|
| Line-1 | 5.006 | 1.984 | 0.861 | 1.653 | 2.514 | 0.002 | 0.004 | 0.006 |
| Line-2 | 5.000 | 1.936 | 2.193 | 3.866 | 6.059 | 0.005 | 0.008 | 0.013 |
| Line-3 | 4.815 | 1.897 | 2.828 | 5.137 | 7.964 | 0.006 | 0.010 | 0.016 |
| Line-4 | 5.015 | 1.586 | 1.694 | 2.582 | 4.276 | 0.004 | 0.005 | 0.009 |
| Line-5 | 4.307 | 1.813 | 1.755 | 3.183 | 4.939 | 0.004 | 0.008 | 0.012 |
| Line-6 | 4.295 | 1.579 | 1.960 | 3.081 | 5.041 | 0.005 | 0.008 | 0.012 |
| Line-7 | 5.370 | 1.759 | 2.275 | 3.948 | 6.223 | 0.005 | 0.008 | 0.012 |
| Line-8 | 4.250 | 1.988 | 2.036 | 4.003 | 6.038 | 0.005 | 0.010 | 0.014 |
| Line-9 | 5.873 | 1.895 | 1.086 | 2.022 | 3.108 | 0.003 | 0.006 | 0.009 |
| Line-10 | 5.529 | 2.198 | 1.881 | 3.968 | 5.849 | 0.003 | 0.007 | 0.011 |

Table 45: Provided are the values of each of the parameters (as described above) measured in Sorghum accessions (line ID) under regular growth conditions. Growth conditions are specified in the experimental procedure section.

TABLE 46

Correlation between the expression level of selected genes of some embodiments of the invention in roots and the phenotypic performance under normal or abiotic stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LNU856 | 0.862 | 1.26E−02 | 3 | 49 | LNU856 | 0.860 | 1.31E−02 | 3 | 3 |
| LNU856 | 0.933 | 2.14E−03 | 3 | 5 | LNU856 | 0.812 | 2.67E−02 | 3 | 45 |
| LNU856 | 0.851 | 1.52E−02 | 3 | 23 | LNU856 | 0.896 | 6.34E−03 | 3 | 61 |
| LNU856 | 0.928 | 2.59E−03 | 3 | 24 | LNU856 | 0.921 | 3.24E−03 | 3 | 21 |
| LNU856 | 0.877 | 9.56E−03 | 3 | 57 | LNU856 | 0.855 | 1.42E−02 | 3 | 41 |
| LNU856 | 0.801 | 9.50E−03 | 2 | 20 | LNU856 | 0.840 | 2.37E−03 | 1 | 18 |
| LNU857 | 0.716 | 7.05E−02 | 3 | 22 | LNU857 | 0.812 | 7.87E−03 | 6 | 49 |
| LNU857 | 0.777 | 1.37E−02 | 6 | 3 | LNU857 | 0.778 | 1.36E−02 | 6 | 5 |
| LNU857 | 0.777 | 1.37E−02 | 6 | 23 | LNU857 | 0.811 | 7.92E−03 | 6 | 61 |
| LNU857 | 0.778 | 1.36E−02 | 6 | 24 | LNU857 | 0.787 | 1.19E−02 | 6 | 21 |

TABLE 46-continued

Correlation between the expression level of selected genes of some embodiments of the invention in roots and the phenotypic performance under normal or abiotic stress conditions across Sorghum accessions

| Gene Name | R | P value | Exp. set | Corr Set ID | Gene Name | R | P value | Exp. set | Corr. Set ID |
|---|---|---|---|---|---|---|---|---|---|
| LNU857 | 0.727 | 2.65E−02 | 6 | 38 | LNU857 | 0.795 | 1.04E−02 | 6 | 57 |
| LNU857 | 0.703 | 3.47E−02 | 2 | 34 | LNU857 | 0.757 | 1.82E−02 | 5 | 7 |
| LNU857 | 0.744 | 2.15E−02 | 5 | 48 | LNU857 | 0.701 | 3.52E−02 | 5 | 10 |
| LNU857 | 0.858 | 3.08E−03 | 5 | 56 | LNU857 | 0.827 | 5.94E−03 | 5 | 60 |
| LNU857 | 0.847 | 3.99E−03 | 5 | 37 | LNU857 | 0.871 | 2.26E−03 | 5 | 40 |
| LNU857 | 0.854 | 3.42E−03 | 5 | 14 | LNU859 | 0.899 | 3.96E−04 | 1 | 48 |
| LNU859 | 0.850 | 1.84E−03 | 1 | 2 | LNU859 | 0.712 | 2.10E−02 | 1 | 56 |
| LNU859 | 0.829 | 3.04E−03 | 1 | 60 | LNU860 | 0.848 | 1.59E−02 | 3 | 28 |
| LNU860 | 0.721 | 2.82E−02 | 6 | 45 | LNU861 | 0.756 | 1.85E−02 | 6 | 45 |
| LNU861 | 0.768 | 1.57E−02 | 6 | 41 | LNU861 | 0.700 | 3.57E−02 | 8 | 4 |
| LNU861 | 0.776 | 1.40E−02 | 8 | 42 | LNU862 | 0.705 | 7.70E−02 | 3 | 26 |
| LNU862 | 0.804 | 8.99E−03 | 5 | 30 | LNU863 | 0.792 | 1.09E−02 | 6 | 49 |
| LNU863 | 0.790 | 1.13E−02 | 6 | 3 | LNU863 | 0.734 | 2.43E−02 | 6 | 5 |
| LNU863 | 0.790 | 1.13E−02 | 6 | 23 | LNU863 | 0.756 | 1.84E−02 | 6 | 61 |
| LNU863 | 0.734 | 2.43E−02 | 6 | 24 | LNU863 | 0.764 | 1.65E−02 | 6 | 21 |
| LNU863 | 0.720 | 2.88E−02 | 6 | 57 | LNU863 | 0.738 | 2.32E−02 | 7 | 1 |
| LNU863 | 0.818 | 7.05E−03 | 7 | 59 | LNU863 | 0.838 | 4.83E−03 | 7 | 47 |
| LNU863 | 0.766 | 1.60E−02 | 2 | 8 | LNU863 | 0.781 | 1.29E−02 | 2 | 42 |
| LNU863 | 0.709 | 3.26E−02 | 8 | 20 | LNU863 | 0.838 | 4.76E−03 | 8 | 42 |
| LNU864 | 0.801 | 3.04E−02 | 3 | 28 | LNU864 | 0.897 | 1.05E−03 | 5 | 30 |
| LNU866 | 0.719 | 6.86E−02 | 3 | 5 | LNU866 | 0.720 | 6.82E−02 | 3 | 45 |
| LNU866 | 0.721 | 6.77E−02 | 3 | 24 | LNU866 | 0.705 | 7.71E−02 | 3 | 57 |
| LNU866 | 0.817 | 2.48E−02 | 3 | 41 | LNU870 | 0.840 | 1.80E−02 | 3 | 5 |
| LNU870 | 0.861 | 1.28E−02 | 3 | 45 | LNU870 | 0.766 | 4.45E−02 | 3 | 61 |
| LNU870 | 0.790 | 3.46E−02 | 3 | 38 | LNU870 | 0.829 | 2.11E−02 | 3 | 57 |
| LNU870 | 0.879 | 9.10E−03 | 3 | 41 | LNU870 | 0.705 | 3.39E−02 | 6 | 52 |
| LNU871 | 0.701 | 3.55E−02 | 5 | 10 | LNU872 | 0.739 | 5.75E−02 | 3 | 52 |
| LNU872 | 0.793 | 1.09E−02 | 6 | 49 | LNU872 | 0.780 | 1.32E−02 | 6 | 3 |
| LNU872 | 0.800 | 9.62E−03 | 6 | 5 | LNU872 | 0.739 | 2.29E−02 | 6 | 11 |
| LNU872 | 0.780 | 1.32E−02 | 6 | 23 | LNU872 | 0.802 | 9.38E−03 | 6 | 61 |
| LNU872 | 0.800 | 9.62E−03 | 6 | 24 | LNU872 | 0.802 | 9.33E−03 | 6 | 21 |
| LNU872 | 0.841 | 4.52E−03 | 6 | 38 | LNU872 | 0.791 | 1.11E−02 | 6 | 57 |
| LNU876 | 0.809 | 2.75E−02 | 3 | 5 | LNU876 | 0.792 | 3.39E−02 | 3 | 45 |
| LNU876 | 0.703 | 7.82E−02 | 3 | 61 | LNU876 | 0.705 | 7.70E−02 | 3 | 22 |
| LNU876 | 0.877 | 9.56E−03 | 3 | 38 | LNU876 | 0.713 | 7.21E−02 | 3 | 19 |
| LNU876 | 0.723 | 6.66E−02 | 3 | 57 | LNU876 | 0.801 | 9.52E−03 | 6 | 49 |
| LNU876 | 0.830 | 5.65E−03 | 6 | 3 | LNU876 | 0.790 | 1.12E−02 | 6 | 5 |
| LNU876 | 0.782 | 1.28E−02 | 6 | 45 | LNU876 | 0.798 | 9.87E−03 | 6 | 11 |
| LNU876 | 0.830 | 5.65E−03 | 6 | 23 | LNU876 | 0.774 | 1.43E−02 | 6 | 61 |
| LNU876 | 0.790 | 1.12E−02 | 6 | 24 | LNU876 | 0.797 | 1.01E−02 | 6 | 21 |
| LNU876 | 0.773 | 1.45E−02 | 6 | 38 | LNU876 | 0.760 | 1.74E−02 | 6 | 57 |
| LNU876 | 0.754 | 1.90E−02 | 6 | 41 | LNU876 | 0.740 | 2.25E−02 | 2 | 46 |
| LNU876 | 0.713 | 3.12E−02 | 2 | 12 | LNU876 | 0.827 | 5.95E−03 | 2 | 20 |
| LNU876 | 0.807 | 8.53E−03 | 5 | 14 | LNU876 | 0.720 | 1.89E−02 | 1 | 14 |
| LNU878 | 0.901 | 5.64E−03 | 3 | 27 | LNU878 | 0.825 | 2.22E−02 | 3 | 25 |
| LNU878 | 0.779 | 3.88E−02 | 3 | 11 | LNU878 | 0.793 | 3.33E−02 | 3 | 26 |
| LNU878 | 0.755 | 1.16E−02 | 1 | 30 | LNU878 | 0.877 | 9.44E−03 | 3 | 27 |
| LNU879 | 0.724 | 6.60E−02 | 3 | 25 | LNU879 | 0.904 | 5.24E−03 | 3 | 11 |
| LNU879 | 0.749 | 5.28E−02 | 3 | 28 | LNU879 | 0.897 | 6.12E−03 | 3 | 26 |
| LNU879 | 0.724 | 2.73E−02 | 7 | 54 | LNU879 | 0.811 | 7.99E−03 | 2 | 46 |
| LNU879 | 0.888 | 1.37E−03 | 2 | 32 | LNU879 | 0.711 | 3.17E−02 | 5 | 7 |
| LNU879 | 0.821 | 6.73E−03 | 5 | 56 | LNU879 | 0.761 | 1.71E−02 | 5 | 60 |
| LNU879 | 0.832 | 5.38E−03 | 5 | 37 | LNU879 | 0.785 | 1.23E−02 | 5 | 40 |
| LNU879 | 0.820 | 6.79E−03 | 5 | 14 | LNU879 | 0.741 | 1.43E−02 | 1 | 30 |
| LNU881 | 0.731 | 6.19E−02 | 3 | 38 | LNU883 | 0.744 | 5.51E−02 | 3 | 49 |
| LNU883 | 0.750 | 5.21E−02 | 3 | 3 | LNU883 | 0.901 | 5.61E−03 | 3 | 5 |
| LNU883 | 0.794 | 3.30E−02 | 3 | 45 | LNU883 | 0.708 | 7.50E−02 | 3 | 11 |
| LNU883 | 0.828 | 2.14E−02 | 3 | 61 | LNU883 | 0.781 | 3.82E−02 | 3 | 24 |
| LNU883 | 0.747 | 5.34E−02 | 3 | 21 | LNU883 | 0.701 | 7.93E−02 | 3 | 38 |
| LNU883 | 0.753 | 5.08E−02 | 3 | 19 | LNU883 | 0.839 | 1.83E−02 | 3 | 57 |
| LNU883 | 0.768 | 4.35E−02 | 3 | 41 | LNU883 | 0.700 | 3.57E−02 | 5 | 30 |
| LNU884 | 0.745 | 5.48E−02 | 3 | 23 | LNU884 | 0.725 | 6.54E−02 | 3 | 24 |
| LNU884 | 0.750 | 5.23E−02 | 3 | 21 | LNU884 | 0.704 | 7.77E−02 | 3 | 41 |
| LNU884 | 0.714 | 3.09E−02 | 8 | 50 | LNU884 | 0.713 | 3.12E−02 | 8 | 12 |
| LNU884 | 0.729 | 1.67E−02 | 1 | 7 | LNU884 | 0.748 | 1.28E−02 | 1 | 56 |
| LNU884 | 0.787 | 6.95E−03 | 1 | 37 | LNU885 | 0.851 | 1.51E−02 | 3 | 52 |
| LNU885 | 0.709 | 7.44E−02 | 3 | 28 | LNU885 | 0.736 | 2.37E−02 | 2 | 39 |
| LNU885 | 0.821 | 6.72E−03 | 5 | 18 | LNU888 | 0.835 | 1.93E−02 | 3 | 27 |
| LNU888 | 0.844 | 1.70E−02 | 3 | 25 | LNU888 | 0.762 | 4.66E−02 | 3 | 11 |
| LNU889 | 0.794 | 1.06E−02 | 5 | 10 | LNU889 | 0.740 | 2.27E−02 | 5 | 56 |
| LNU889 | 0.710 | 3.22E−02 | 5 | 60 | LNU889 | 0.713 | 3.11E−02 | 5 | 37 |
| LNU889 | 0.847 | 3.95E−03 | 5 | 14 | LNU892 | 0.799 | 3.12E−02 | 3 | 3 |
| LNU892 | 0.796 | 3.23E−02 | 3 | 11 | LNU895 | 0.803 | 2.96E−02 | 3 | 49 |

TABLE 46-continued

Correlation between the expression level of selected genes of some embodiments of the invention in roots and the phenotypic performance under normal or abiotic stress conditions across Sorghum accessions

| Gene Name | R | P value | Exp. set | Corr Set ID | Gene Name | R | P value | Exp. set | Corr. Set ID |
|---|---|---|---|---|---|---|---|---|---|
| LNU895 | 0.857 | 1.37E−02 | 3 | 3 | LNU895 | 0.845 | 1.66E−02 | 3 | 15 |
| LNU895 | 0.718 | 6.92E−02 | 3 | 5 | LNU895 | 0.868 | 1.14E−02 | 3 | 45 |
| LNU895 | 0.877 | 9.60E−03 | 3 | 23 | LNU895 | 0.700 | 7.99E−02 | 3 | 61 |
| LNU895 | 0.765 | 4.53E−02 | 3 | 24 | LNU895 | 0.826 | 2.22E−02 | 3 | 21 |
| LNU895 | 0.717 | 6.97E−02 | 3 | 38 | LNU895 | 0.779 | 3.91E−02 | 3 | 41 |
| LNU895 | 0.723 | 2.77E−02 | 6 | 45 | LNU895 | 0.707 | 3.31E−02 | 6 | 52 |
| LNU895 | 0.710 | 3.21E−02 | 2 | 53 | LNU895 | 0.825 | 6.24E−03 | 8 | 31 |
| LNU895 | 0.787 | 1.18E−02 | 8 | 53 | LNU895 | 0.765 | 9.90E−03 | 1 | 18 |
| LNU896 | 0.773 | 4.15E−02 | 3 | 27 | LNU896 | 0.806 | 2.87E−02 | 3 | 25 |
| LNU896 | 0.703 | 2.33E−02 | 1 | 30 | LNU897 | 0.715 | 3.05E−02 | 7 | 1 |
| LNU897 | 0.710 | 3.21E−02 | 8 | 46 | LNU897 | 0.751 | 1.97E−02 | 8 | 53 |
| LNU898 | 0.717 | 7.00E−02 | 3 | 45 | LNU898 | 0.918 | 3.53E−03 | 3 | 38 |
| LNU898 | 0.705 | 3.41E−02 | 6 | 38 | LNU898 | 0.771 | 9.01E−03 | 1 | 7 |
| LNU898 | 0.779 | 7.96E−03 | 1 | 56 | LNU898 | 0.723 | 1.82E−02 | 1 | 60 |
| LNU898 | 0.834 | 2.68E−03 | 1 | 37 | LNU898 | 0.825 | 3.31E−03 | 1 | 40 |
| LNU901 | 0.808 | 8.46E−03 | 8 | 50 | LNU901 | 0.726 | 2.68E−02 | 8 | 35 |
| LNU901 | 0.831 | 5.48E−03 | 8 | 39 | LNU901 | 0.786 | 1.20E−02 | 8 | 4 |
| LNU901 | 0.735 | 2.42E−02 | 8 | 62 | LNU901 | 0.796 | 1.03E−02 | 8 | 33 |
| LNU902 | 0.761 | 1.73E−02 | 6 | 5 | LNU902 | 0.738 | 2.33E−02 | 6 | 61 |
| LNU902 | 0.761 | 1.73E−02 | 6 | 24 | LNU902 | 0.738 | 2.32E−02 | 6 | 21 |
| LNU902 | 0.753 | 1.91E−02 | 6 | 57 | LNU902 | 0.714 | 3.06E−02 | 6 | 41 |
| LNU902 | 0.887 | 1.44E−03 | 7 | 1 | LNU902 | 0.923 | 3.91E−04 | 7 | 47 |
| LNU902 | 0.767 | 1.59E−02 | 5 | 18 | LNU903 | 0.701 | 7.93E−02 | 3 | 28 |
| LNU903 | 0.768 | 1.57E−02 | 6 | 52 | LNU903 | 0.863 | 1.29E−03 | 1 | 18 |
| LNU904 | 0.777 | 3.97E−02 | 3 | 22 | LNU904 | 0.716 | 3.01E−02 | 7 | 43 |
| LNU905 | 0.807 | 2.82E−02 | 3 | 22 | LNU905 | 0.708 | 3.27E−02 | 2 | 32 |
| LNU906 | 0.767 | 4.41E−02 | 3 | 49 | LNU906 | 0.729 | 6.29E−02 | 3 | 5 |
| LNU906 | 0.810 | 2.73E−02 | 3 | 45 | LNU906 | 0.777 | 3.97E−02 | 3 | 61 |
| LNU906 | 0.778 | 3.95E−02 | 3 | 38 | LNU906 | 0.750 | 5.22E−02 | 3 | 57 |
| LNU906 | 0.816 | 2.53E−02 | 3 | 41 | LNU907 | 0.758 | 1.79E−02 | 8 | 20 |
| LNU910 | 0.825 | 6.17E−03 | 6 | 49 | LNU910 | 0.846 | 4.09E−03 | 6 | 3 |
| LNU910 | 0.828 | 5.87E−03 | 6 | 25 | LNU910 | 0.725 | 2.71E−02 | 6 | 5 |
| LNU910 | 0.846 | 4.09E−03 | 6 | 23 | LNU910 | 0.745 | 2.12E−02 | 6 | 61 |
| LNU910 | 0.725 | 2.71E−02 | 6 | 24 | LNU910 | 0.780 | 1.32E−02 | 6 | 21 |
| LNU911 | 0.880 | 8.99E−03 | 3 | 27 | LNU911 | 0.745 | 5.47E−02 | 3 | 11 |
| LNU911 | 0.849 | 1.56E−02 | 3 | 26 | | | | | |
| LNU913 | 0.720 | 2.88E−02 | 7 | 55 | LNU913 | 0.762 | 1.71E−02 | 7 | 43 |
| LNU913 | 0.709 | 3.25E−02 | 5 | 51 | LNU914 | 0.778 | 3.95E−02 | 3 | 5 |
| LNU914 | 0.709 | 7.45E−02 | 3 | 45 | LNU914 | 0.807 | 2.83E−02 | 3 | 61 |
| LNU914 | 0.794 | 3.30E−02 | 3 | 19 | LNU914 | 0.840 | 1.81E−02 | 3 | 57 |
| LNU914 | 0.774 | 4.12E−02 | 3 | 41 | LNU914 | 0.787 | 1.19E−02 | 6 | 45 |
| LNU914 | 0.808 | 8.36E−03 | 6 | 52 | LNU914 | 0.726 | 2.67E−02 | 6 | 41 |
| LNU915 | 0.841 | 1.77E−02 | 3 | 49 | LNU915 | 0.887 | 7.78E−03 | 3 | 3 |
| LNU915 | 0.837 | 1.87E−02 | 3 | 15 | LNU915 | 0.710 | 7.36E−02 | 3 | 45 |
| LNU915 | 0.702 | 7.90E−02 | 3 | 61 | LNU915 | 0.701 | 3.53E−02 | 5 | 48 |
| LNU915 | 0.759 | 1.76E−02 | 5 | 2 | LNU917 | 0.840 | 4.56E−03 | 2 | 46 |
| LNU917 | 0.737 | 2.36E−02 | 2 | 32 | LNU917 | 0.888 | 1.38E−03 | 8 | 32 |
| LNU918 | 0.824 | 2.27E−02 | 3 | 25 | LNU918 | 0.859 | 3.03E−03 | 2 | 46 |
| LNU918 | 0.714 | 3.06E−02 | 2 | 53 | LNU918 | 0.748 | 2.04E−02 | 8 | 32 |
| LNU919 | 0.907 | 4.82E−03 | 3 | 25 | LNU920 | 0.743 | 2.18E−02 | 5 | 51 |
| LNU922 | 0.717 | 2.98E−02 | 6 | 22 | LNU922 | 0.803 | 5.12E−03 | 1 | 48 |
| LNU922 | 0.749 | 1.26E−02 | 1 | 2 | LNU922 | 0.769 | 9.35E−03 | 1 | 60 |
| LNU924 | 0.759 | 1.78E−02 | 8 | 16 | LNU926 | 0.705 | 7.68E−02 | 3 | 49 |
| LNU926 | 0.713 | 3.12E−02 | 7 | 1 | LNU926 | 0.792 | 1.10E−02 | 7 | 59 |
| LNU926 | 0.726 | 2.67E−02 | 7 | 47 | LNU926 | 0.802 | 9.37E−03 | 5 | 18 |
| LNU929 | 0.811 | 2.68E−02 | 3 | 23 | LNU929 | 0.726 | 6.46E−02 | 3 | 24 |
| LNU929 | 0.773 | 4.16E−02 | 3 | 21 | LNU929 | 0.834 | 5.24E−03 | 2 | 46 |
| LNU930 | 0.734 | 6.01E−02 | 3 | 52 | LNU930 | 0.757 | 4.87E−02 | 3 | 22 |
| LNU931 | 0.729 | 2.59E−02 | 2 | 50 | LNU931 | 0.769 | 1.54E−02 | 2 | 12 |
| LNU931 | 0.759 | 1.77E−02 | 2 | 58 | LNU931 | 0.759 | 1.78E−02 | 2 | 62 |
| LNU932 | 0.749 | 2.01E−02 | 6 | 22 | LNU933 | 0.881 | 8.82E−03 | 3 | 49 |
| LNU933 | 0.887 | 7.74E−03 | 3 | 3 | LNU933 | 0.742 | 5.60E−02 | 3 | 15 |
| LNU933 | 0.803 | 2.97E−02 | 3 | 23 | LNU933 | 0.713 | 7.22E−02 | 3 | 61 |
| LNU933 | 0.798 | 9.90E−03 | 8 | 12 | LNU933 | 0.713 | 3.12E−02 | 8 | 58 |
| LNU934 | 0.817 | 2.48E−02 | 3 | 27 | LNU934 | 0.818 | 2.45E−02 | 3 | 25 |
| LNU934 | 0.803 | 2.98E−02 | 3 | 11 | LNU934 | 0.703 | 7.80E−02 | 3 | 52 |

TABLE 46-continued

Correlation between the expression level of selected genes of some embodiments of the invention in roots and the phenotypic performance under normal or abiotic stress conditions across Sorghum accessions

| Gene Name | R | P value | Exp. set | Corr Set ID | Gene Name | R | P value | Exp. set | Corr. Set ID |
|---|---|---|---|---|---|---|---|---|---|
| LNU934 | 0.861 | 2.90E−03 | 5 | 51 | LNU934 | 0.771 | 1.50E−02 | 5 | 30 |
| LNU935 | 0.736 | 2.38E−02 | 6 | 41 | LNU935 | 0.700 | 3.57E−02 | 8 | 8 |
| LNU935 | 0.758 | 1.78E−02 | 8 | 39 | LNU935 | 0.746 | 2.10E−02 | 8 | 4 |
| LNU935 | 0.856 | 3.25E−03 | 8 | 42 | LNU940 | 0.851 | 1.51E−02 | 3 | 11 |
| LNU940 | 0.904 | 5.20E−03 | 3 | 52 | LNU941 | 0.785 | 3.66E−02 | 3 | 25 |
| LNU942 | 0.916 | 3.72E−03 | 3 | 49 | LNU942 | 0.915 | 3.90E−03 | 3 | 3 |
| LNU942 | 0.786 | 3.61E−02 | 3 | 23 | LNU942 | 0.759 | 4.80E−02 | 3 | 61 |
| LNU942 | 0.784 | 1.25E−02 | 7 | 44 | LNU942 | 0.764 | 1.66E−02 | 7 | 55 |
| LNU942 | 0.871 | 2.24E−03 | 7 | 9 | LNU942 | 0.793 | 1.08E−02 | 7 | 13 |
| LNU942 | 0.792 | 1.09E−02 | 7 | 36 | LNU942 | 0.744 | 2.15E−02 | 7 | 59 |
| LNU942 | 0.811 | 8.01E−03 | 7 | 43 | LNU942 | 0.767 | 1.59E−02 | 7 | 6 |
| LNU942 | 0.744 | 2.16E−02 | 8 | 4 | LNU943 | 0.713 | 3.11E−02 | 6 | 49 |
| LNU943 | 0.750 | 1.99E−02 | 6 | 3 | LNU943 | 0.790 | 1.12E−02 | 6 | 25 |
| LNU943 | 0.750 | 1.99E−02 | 6 | 23 | LNU944 | 0.715 | 7.09E−02 | 3 | 49 |
| LNU944 | 0.739 | 5.78E−02 | 3 | 3 | LNU944 | 0.928 | 2.57E−03 | 3 | 15 |
| LNU944 | 0.807 | 2.81E−02 | 3 | 45 | LNU944 | 0.735 | 6.01E−02 | 3 | 41 |
| LNU944 | 0.710 | 3.21E−02 | 7 | 6 | LNU944 | 0.826 | 6.07E−03 | 2 | 12 |
| LNU944 | 0.721 | 2.83E−02 | 2 | 35 | LNU944 | 0.715 | 3.05E−02 | 2 | 34 |
| LNU944 | 0.742 | 2.21E−02 | 2 | 8 | LNU944 | 0.714 | 3.07E−02 | 2 | 20 |
| LNU944 | 0.826 | 6.06E−03 | 2 | 39 | LNU944 | 0.748 | 2.04E−02 | 2 | 4 |
| LNU944 | 0.739 | 2.30E−02 | 2 | 58 | LNU944 | 0.734 | 2.44E−02 | 2 | 62 |
| LNU944 | 0.711 | 3.17E−02 | 2 | 33 | LNU945 | 0.830 | 2.08E−02 | 3 | 22 |
| LNU945 | 0.746 | 2.10E−02 | 6 | 22 | LNU952 | 0.789 | 1.15E−02 | 7 | 29 |
| LNU952 | 0.814 | 7.65E−03 | 7 | 54 | LNU952 | 0.708 | 3.28E−02 | 8 | 32 |
| LNU953 | 0.805 | 2.91E−02 | 3 | 27 | LNU953 | 0.776 | 4.04E−02 | 3 | 11 |
| LNU953 | 0.906 | 4.97E−03 | 3 | 26 | LNU953 | 0.729 | 2.58E−02 | 2 | 35 |
| LNU953 | 0.734 | 2.43E−02 | 2 | 39 | LNU953 | 0.701 | 3.53E−02 | 2 | 4 |
| LNU953 | 0.769 | 1.55E−02 | 2 | 33 | LNU953 | 0.741 | 1.43E−02 | 1 | 37 |
| LNU954 | 0.707 | 3.31E−02 | 5 | 10 | LNU955 | 0.718 | 2.95E−02 | 7 | 44 |
| LNU955 | 0.725 | 2.70E−02 | 8 | 33 | LNU956 | 0.720 | 6.80E−02 | 3 | 22 |
| LNU956 | 0.713 | 3.11E−02 | 6 | 22 | LNU958 | 0.797 | 3.17E−02 | 3 | 22 |
| LNU958 | 0.826 | 6.10E−03 | 6 | 15 | LNU958 | 0.724 | 2.75E−02 | 6 | 5 |
| LNU958 | 0.798 | 9.93E−03 | 6 | 45 | LNU958 | 0.704 | 3.43E−02 | 6 | 52 |
| LNU958 | 0.724 | 2.75E−02 | 6 | 24 | LNU958 | 0.711 | 3.18E−02 | 6 | 57 |
| LNU958 | 0.809 | 8.24E−03 | 6 | 41 | LNU958 | 0.846 | 4.08E−03 | 2 | 32 |
| LNU958 | 0.766 | 1.61E−02 | 5 | 37 | LNU958 | 0.789 | 1.14E−02 | 8 | 16 |
| LNU958 | 0.792 | 1.09E−02 | 8 | 42 | LNU959 | 0.799 | 3.12E−02 | 3 | 19 |
| LNU959 | 0.723 | 2.78E−02 | 8 | 50 | LNU959 | 0.749 | 2.03E−02 | 8 | 33 |
| LNU960 | 0.742 | 5.60E−02 | 3 | 11 | LNU962 | 0.739 | 5.80E−02 | 3 | 25 |
| LNU964 | 0.837 | 1.88E−02 | 3 | 49 | LNU964 | 0.852 | 1.49E−02 | 3 | 3 |
| LNU964 | 0.727 | 6.44E−02 | 3 | 15 | LNU964 | 0.884 | 8.34E−03 | 3 | 5 |
| LNU964 | 0.760 | 4.75E−02 | 3 | 45 | LNU964 | 0.834 | 1.97E−02 | 3 | 11 |
| LNU964 | 0.778 | 3.93E−02 | 3 | 23 | LNU964 | 0.756 | 4.91E−02 | 3 | 52 |
| LNU964 | 0.841 | 1.76E−02 | 3 | 61 | LNU964 | 0.813 | 2.63E−02 | 3 | 24 |
| LNU964 | 0.819 | 2.41E−02 | 3 | 21 | LNU964 | 0.780 | 3.84E−02 | 3 | 38 |
| LNU964 | 0.808 | 2.77E−02 | 3 | 57 | LNU964 | 0.716 | 7.03E−02 | 3 | 41 |
| LNU964 | 0.700 | 3.57E−02 | 6 | 45 | LNU964 | 0.705 | 3.40E−02 | 6 | 38 |
| LNU965 | 0.798 | 3.15E−02 | 3 | 27 | LNU965 | 0.848 | 1.59E−02 | 3 | 26 |
| LNU966 | 0.743 | 5.59E−02 | 3 | 61 | LNU966 | 0.757 | 4.86E−02 | 3 | 57 |
| LNU967 | 0.874 | 1.01E−02 | 3 | 49 | LNU967 | 0.890 | 7.28E−03 | 3 | 3 |
| LNU967 | 0.779 | 3.88E−02 | 3 | 23 | LNU967 | 0.702 | 7.88E−02 | 3 | 61 |
| LNU967 | 0.787 | 1.18E−02 | 6 | 41 | LNU968 | 0.732 | 6.15E−02 | 3 | 27 |
| LNU969 | 0.717 | 2.98E−02 | 7 | 9 | | | | | |

Table 46. Provided are the correlations (R) between the expression levels yield improving genes and their homologues in various tissues [Expression sets (Exp)] and the phenotypic performance [yield, biomass, growth rate and/or vigor components (Correlation vector)] under abiotic stress conditions (salinity) or normal conditions across Sorghum accessions. Cor.—Correlation vector as described hereinabove (Table 38). P = p value.

Example 7

Production of Maize Transcriptom and High Throughput Correlation Analysis with Yield and NUE Related Parameters Using 60K Maize Oligonucleotide Micro-Arrays In order to produce a high throughput correlation analysis between plant phenotype and gene expression level, the present inventors utilized a maize oligonucleotide micro-array, produced by Agilent Technologies [chem. (dot) agilent (dot) com/Scripts/PDS (dot) asp?1Page=50879]. The array oligonucleotide represents about 44,000 maize genes and transcripts.

Correlation of Maize Hybrids Across Ecotypes Grown Under Regular Growth Conditions Experimental Procedures 12 Maize hybrids were grown in 3 repetitive plots, in field. Maize seeds were planted and plants were grown in the field using commercial fertilization and irrigation protocols (485 metric cubes of water per dunam, 30 units of uran 21% fertilization per entire growth period). In order to define correlations between the levels of RNA expression with stress and yield components or vigor related parameters, the 12 different maize hybrids were analyzed. Among them, 10 hybrids encompassing the observed variance were selected for RNA expression analysis. The correlation between the RNA levels and the characterized parameters was analyzed using Pearson correlation test [davidmlane (dot) com/hyperstat/A34739 (dot) html].

Analyzed Maize tissues—All 10 selected maize hybrids were sampled per 3 time points (TP2=V6-V8, TP5=R1-R2, TP6=R3-R4). Four types of plant tissues [Ear, flag leaf indicated in Table 47 as "leaf", grain distal part, and internode] growing under Normal conditions were sampled and RNA was extracted as described above. Each micro-array expression information tissue type has received a Set ID as summarized in Table 47 below.

TABLE 47

Maize transcriptom expression sets

| Expression Set | Set ID |
|---|---|
| Maize field/Normal/Ear TP5 | 1 |
| Maize field/Normal/Ear TP6 | 2 |
| Maize field/Normal/Grain Distal | 3 |
| Maize field/Normal/Internode TP2 | 4 |
| Maize field/Normal/Internode TP5 | 5 |
| Maize field/Normal/Internode TP6 | 6 |
| Maize field/Normal/Leaf TP2 | 7 |
| Maize field/Normal/Leaf TP5 | 8 |

Table 47: Provided are the maize transcriptom expression sets.
Leaf = the leaf below the main ear;
Flower meristem = Apical meristem following male flower initiation;
Ear = the female flower at the anthesis day.
Grain Distal = maize developing grains from the cob extreme area,
Grain Basal = maize developing grains from the cob basal area;
Internodes = internodes located above and below the main ear in the plant.
TP = time point.

The following parameters were collected using digital imaging system:

Grain Area ($cm^2$)—At the end of the growing period the grains were separated from the ear. A sample of ~200 grains were weighted, photographed and images were processed using the below described image processing system. The grain area was measured from those images and was divided by the number of grains.

Grain Length and Grain width (cm)—At the end of the growing period the grains were separated from the ear. A sample of ~200 grains were weighted, photographed and images were processed using the below described image processing system. The sum of grain lengths/or width (longest axis) was measured from those images and was divided by the number of grains.

Ear Area ($cm^2$)—At the end of the growing period 5 ears were, photographed and images were processed using the below described image processing system. The Ear area was measured from those images and was divided by the number of Ears.

Ear Length and Ear Width (cm)—At the end of the growing period 5 ears were, photographed and images were processed using the below described image processing system. The Ear length and width (longest axis) was measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight per plant (gr.)—At the end of the experiment all ears from plots within blocks A-C were collected. Six ears were separately threshed and grains were weighted, all additional ears were threshed together and weighted as well.

The average grain weight per ear was calculated by dividing the total grain weight by number of total ears per plot (based on plot). In case of 6 ears, the total grains weight of 6 ears was divided by 6.

Ear FW (gr.)—At the end of the experiment (when ears were harvested) total and 6 selected ears per plots within blocks A-C were collected separately. The plants with (total and 6) were weighted (gr.) separately and the average ear per plant was calculated for total [Ear FW (fresh weight) per plot] and for 6 (Ear FW per plant).

Plant height and Ear height—Plants were characterized for height at harvesting. In each measure, 6 plants were measured for their height using a measuring tape. Height was measured from ground level to top of the plant below the tassel. Ear height was measured from the ground level to the place were the main ear is located.

Leaf number per plant—Plants were characterized for leaf number during growing period at 5 time points. In each measure, plants were measured for their leaf number by counting all the leaves of 3 selected plants per plot.

Relative Growth Rate was calculated using Formulas II-XIII (described above).

SPAD—Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS).

Dry weight per plant—At the end of the experiment (when inflorescence were dry) all vegetative material from plots within blocks A-C were collected.

Dry weight=total weight of the vegetative portion above ground (excluding roots) after drying at 70° C. in oven for 48 hours.

Harvest Index (HI) (Maize)—The harvest index was calculated using Formula XVII above.

Percent Filled Ear [%]—was calculated as the percentage of the Ear area with grains out of the total ear.

Cob diameter [cm]—The diameter of the cob without grains was measured using a ruler.

Kernel Row Number per Ear—The number of rows in each ear was counted.

Experimental Results 12 different maize hybrids were grown and characterized for different parameters. The correlated parameters are described in Table 48 below. The average for each of the measured parameter was calculated using the JMP software (Tables 49-50) and a subsequent correlation analysis was performed. Results were then integrated to the database.

TABLE 48

Maize correlated parameters (vectors)

| Correlated parameter with | Correlation ID |
|---|---|
| Cob Diameter mm | 1 |
| DW per Plant based on 6 gr | 2 |
| Ear Area cm$^2$ | 3 |
| Ear FW per Plant based on 6 gr | 4 |
| Ear Height cm | 5 |
| Ear Length cm | 6 |
| Ear Width cm | 7 |
| Ears FW per plant based on all gr | 8 |
| Filled per Whole Ear | 9 |
| Grain Area cm$^2$ | 10 |
| Grain Length cm | 11 |
| Grain Width cm | 12 |
| Growth Rate Leaf Num | 13 |
| Kernel Row Number per Ear | 14 |
| Leaf Number per Plant | 15 |
| Normalized Grain Weight per Plant based on all gr | 16 |
| Normalized Grain Weight per plant based on 6 gr | 17 |
| Percent Filled Ear | 18 |
| Plant Height per Plot cm | 19 |
| SPAD 46DPS TP2 | 20 |
| SPAD 54DPS TP5 | 21 |

Table 48. SPAD 46DPS and SPAD 54DPS: Chlorophyl level after 46 and 54 days after sowing (DPS).
"FW" = fresh weight;
"DW" = dry weight.

TABLE 49

Measured parameters in Maize accessions under normal conditions

| line ID | Corr. ID |  |  |  |  |  |  |  |  |  |  |  |
|---|---|---|---|---|---|---|---|---|---|---|---|---|
|  | 21 | 20 | 1 | 2 | 3 | 4 | 5 | 6 | 7 | 8 | 9 | 10 | 11 |
| Line-1 | 54.28 | 51.67 | 28.96 | 657.50 | 85.06 | 245.83 | 135.17 | 19.69 | 5.58 | 278.19 | 0.92 | 0.75 | 1.17 |
| Line-2 | 57.18 | 56.41 | 25.08 | 491.67 | 85.84 | 208.33 | 122.33 | 19.06 | 5.15 | 217.50 | 0.92 | 0.71 | 1.09 |
| Line-3 | 56.01 | 53.55 | 28.05 | 641.11 | 90.51 | 262.22 | 131.97 | 20.52 | 5.67 | 288.28 | 0.93 | 0.76 | 1.18 |
| Line-4 | 59.68 | 55.21 | 25.73 | 580.56 | 95.95 | 263.89 | 114.00 | 21.34 | 5.53 | 247.88 | 0.92 | 0.77 | 1.21 |
| Line-5 | 54.77 | 55.30 | 28.72 | 655.56 | 91.62 | 272.22 | 135.28 | 20.92 | 5.73 | 280.11 | 0.91 | 0.81 | 1.23 |
| Line-6 | 59.14 | 59.35 | 25.78 | 569.44 | 72.41 | 177.78 | 94.28 | 18.23 | 5.23 | 175.84 | 0.95 | 0.71 | 1.12 |
| Line-7 | 57.99 | 58.48 | 26.43 | 511.11 | 74.03 | 188.89 | 120.94 | 19.02 | 5.22 | 192.47 | 0.87 | 0.71 | 1.14 |
| Line-8 | 60.36 | 55.88 | 25.19 | 544.44 | 76.53 | 197.22 | 107.72 | 18.57 | 5.33 | 204.70 | 0.94 | 0.75 | 1.13 |
| Line-9 | 54.77 | 52.98 |  |  |  |  |  |  |  |  |  |  |  |
| Line-10 | 51.39 | 53.86 | 26.67 | 574.17 | 55.20 | 141.11 | 60.44 | 16.69 | 4.12 | 142.72 | 0.80 | 0.50 | 0.92 |
| Line-11 | 61.14 | 59.75 |  | 522.22 | 95.36 | 261.11 | 112.50 | 21.70 | 5.58 | 264.24 | 0.96 | 0.76 | 1.18 |
| Line-12 | 53.34 | 49.99 |  |  |  |  |  |  |  |  |  |  |  |

Table 49. Provided are the values of each of the parameters (as described above) measured in maize accessions (line ID) under regular growth conditions. Growth conditions are specified in the experimental procedure section.

TABLE 50

Additional measured parameters in Maize accessions under normal growth conditions

| line ID | Corr. ID |  |  |  |  |  |  |  |
|---|---|---|---|---|---|---|---|---|
|  | 12 | 13 | 14 | 15 | 16 | 17 | 18 | 19 |
| Line-1 | 0.81 | 0.28 | 16.17 | 12.00 | 153.90 | 140.68 | 80.62 | 278.08 |
| Line-2 | 0.81 | 0.22 | 14.67 | 11.11 | 135.88 | 139.54 | 86.76 | 260.50 |
| Line-3 | 0.80 | 0.28 | 16.20 | 11.69 | 152.50 | 153.67 | 82.14 | 275.13 |
| Line-4 | 0.80 | 0.27 | 15.89 | 11.78 | 159.16 | 176.98 | 92.71 | 238.50 |
| Line-5 | 0.82 | 0.31 | 16.17 | 11.94 | 140.46 | 156.61 | 80.38 | 286.94 |
| Line-6 | 0.80 | 0.24 | 15.17 | 12.33 | 117.14 | 119.67 | 82.76 | 224.83 |
| Line-7 | 0.79 | 0.24 | 16.00 | 12.44 | 123.24 | 119.69 | 73.25 | 264.44 |
| Line-8 | 0.84 | 0.27 | 14.83 | 12.22 | 131.27 | 133.51 | 81.06 | 251.61 |
| Line-9 |  |  |  |  |  |  |  |  |
| Line-10 | 0.68 | 0.19 | 14.27 | 9.28 | 40.84 | 54.32 | 81.06 | 163.78 |
| Line-11 | 0.81 | 0.30 | 15.39 | 12.56 | 170.66 | 173.23 | 91.60 | 278.44 |
| Line-12 |  |  |  |  |  |  |  |  |

Table 50. Provided are the values of each of the parameters (as described above) measured in maize accessions (line ID) under regular growth conditions. Growth conditions are specified in the experimental procedure section.

TABLE 51

Correlation between the expression level of selected genes of some embodiments of the invention in various tissues and the phenotypic performance under normal conditions across maize varieties

| Gene Name | R | P value | Exp. set | Cor. Set ID | Gene Name | R | P value | Exp. set | Cor. Set ID |
|---|---|---|---|---|---|---|---|---|---|
| LNU811 | 0.752 | 3.14E−02 | 8 | 13 | LNU811 | 0.724 | 4.23E−02 | 8 | 11 |
| LNU811 | 0.748 | 3.30E−02 | 8 | 10 | LNU813 | 0.737 | 3.68E−02 | 5 | 12 |
| LNU813 | 0.766 | 4.48E−02 | 4 | 15 | LNU813 | 0.738 | 5.84E−02 | 4 | 19 |
| LNU813 | 0.854 | 1.44E−02 | 4 | 5 | LNU813 | 0.827 | 2.16E−02 | 4 | 8 |
| LNU813 | 0.701 | 7.96E−02 | 4 | 4 | LNU813 | 0.746 | 3.37E−02 | 8 | 11 |
| LNU813 | 0.750 | 3.19E−02 | 8 | 6 | LNU813 | 0.873 | 9.59E−04 | 6 | 20 |
| LNU813 | 0.843 | 3.53E−02 | 2 | 15 | LNU814 | 0.726 | 4.16E−02 | 5 | 11 |
| LNU814 | 0.790 | 1.97E−02 | 5 | 6 | LNU814 | 0.753 | 8.40E−02 | 4 | 1 |
| LNU814 | 0.900 | 5.74E−03 | 4 | 14 | LNU814 | 0.748 | 5.34E−02 | 4 | 6 |
| LNU814 | 0.867 | 1.15E−02 | 4 | 8 | LNU814 | 0.825 | 2.22E−02 | 4 | 4 |
| LNU814 | 0.770 | 7.34E−02 | 7 | 1 | LNU814 | 0.746 | 5.40E−02 | 7 | 14 |
| LNU814 | 0.824 | 2.28E−02 | 7 | 13 | LNU814 | 0.815 | 2.54E−02 | 7 | 6 |
| LNU814 | 0.844 | 1.70E−02 | 7 | 8 | LNU814 | 0.813 | 2.62E−02 | 7 | 4 |
| LNU814 | 0.892 | 6.99E−03 | 1 | 14 | LNU814 | 0.735 | 5.99E−02 | 1 | 8 |
| LNU814 | 0.756 | 4.94E−02 | 1 | 4 | LNU814 | 0.789 | 6.62E−03 | 6 | 6 |
| LNU814 | 0.782 | 7.51E−03 | 6 | 8 | LNU814 | 0.770 | 9.12E−03 | 6 | 4 |
| LNU814 | 0.749 | 8.63E−02 | 2 | 3 | LNU814 | 0.722 | 1.05E−01 | 2 | 16 |
| LNU814 | 0.859 | 2.84E−02 | 2 | 6 | LNU814 | 0.964 | 1.90E−03 | 2 | 9 |
| LNU814 | 0.884 | 1.94E−02 | 2 | 18 | LNU814 | 0.829 | 4.12E−02 | 2 | 17 |
| LNU815 | 0.803 | 5.42E−02 | 2 | 9 | LNU815 | 0.715 | 1.10E−01 | 2 | 18 |
| LNU816 | 0.851 | 1.52E−02 | 4 | 19 | LNU816 | 0.825 | 2.24E−02 | 4 | 5 |
| LNU816 | 0.799 | 5.66E−02 | 1 | 1 | LNU816 | 0.778 | 6.87E−02 | 2 | 12 |
| LNU818 | 0.795 | 3.26E−02 | 4 | 12 | LNU818 | 0.726 | 6.45E−02 | 1 | 14 |
| LNU818 | 0.791 | 3.42E−02 | 1 | 15 | LNU818 | 0.727 | 6.40E−02 | 1 | 11 |
| LNU818 | 0.788 | 3.54E−02 | 1 | 9 | LNU818 | 0.733 | 6.10E−02 | 1 | 10 |
| LNU818 | 0.761 | 4.68E−02 | 1 | 7 | LNU818 | 0.792 | 3.36E−02 | 1 | 12 |
| LNU818 | 0.735 | 3.76E−02 | 8 | 13 | LNU818 | 0.827 | 1.14E−02 | 8 | 11 |
| LNU818 | 0.732 | 3.88E−02 | 8 | 10 | LNU818 | 0.735 | 2.40E−02 | 3 | 15 |
| LNU819 | 0.801 | 3.02E−02 | 4 | 18 | LNU819 | 0.726 | 6.45E−02 | 1 | 3 |
| LNU819 | 0.787 | 3.58E−02 | 1 | 6 | LNU819 | 0.951 | 9.89E−04 | 1 | 18 |
| LNU820 | 0.735 | 9.57E−02 | 2 | 12 | LNU821 | 0.840 | 9.08E−03 | 5 | 3 |
| LNU821 | 0.759 | 2.90E−02 | 5 | 16 | LNU821 | 0.821 | 1.24E−02 | 5 | 11 |
| LNU821 | 0.920 | 1.22E−03 | 5 | 6 | LNU821 | 0.810 | 1.48E−02 | 5 | 4 |
| LNU821 | 0.864 | 5.63E−03 | 5 | 17 | LNU821 | 0.908 | 4.74E−03 | 1 | 14 |
| LNU821 | 0.702 | 7.86E−02 | 1 | 13 | LNU821 | 0.729 | 6.31E−02 | 1 | 6 |
| LNU821 | 0.796 | 3.23E−02 | 1 | 8 | LNU821 | 0.812 | 2.65E−02 | 1 | 4 |
| LNU821 | 0.756 | 8.20E−02 | 2 | 9 | LNU821 | 0.752 | 8.49E−02 | 2 | 18 |
| LNU822 | 0.753 | 8.42E−02 | 4 | 1 | LNU822 | 0.839 | 1.84E−02 | 4 | 2 |
| LNU822 | 0.828 | 1.10E−02 | 8 | 1 | LNU822 | 0.730 | 3.99E−02 | 8 | 14 |
| LNU822 | 0.961 | 1.45E−04 | 8 | 13 | LNU822 | 0.809 | 1.50E−02 | 8 | 11 |
| LNU822 | 0.808 | 1.53E−02 | 8 | 10 | LNU822 | 0.948 | 3.34E−04 | 8 | 2 |
| LNU822 | 0.898 | 2.48E−03 | 8 | 7 | LNU822 | 0.707 | 5.00E−02 | 8 | 8 |
| LNU823 | 0.875 | 9.86E−03 | 7 | 3 | LNU823 | 0.790 | 3.44E−02 | 7 | 16 |
| LNU823 | 0.905 | 5.13E−03 | 7 | 6 | LNU823 | 0.950 | 1.02E−03 | 7 | 18 |
| LNU823 | 0.715 | 7.07E−02 | 7 | 19 | LNU823 | 0.774 | 4.10E−02 | 7 | 8 |
| LNU823 | 0.838 | 1.86E−02 | 7 | 4 | LNU823 | 0.806 | 2.85E−02 | 7 | 17 |
| LNU823 | 0.818 | 1.31E−02 | 8 | 12 | LNU823 | 0.770 | 7.33E−02 | 2 | 9 |
| LNU824 | 0.702 | 5.24E−02 | 5 | 2 | LNU824 | 0.835 | 9.85E−03 | 5 | 12 |
| LNU824 | 0.704 | 7.74E−02 | 1 | 5 | LNU824 | 0.780 | 2.25E−02 | 3 | 1 |
| LNU824 | 0.705 | 3.39E−02 | 3 | 5 | LNU824 | 0.849 | 3.25E−02 | 2 | 12 |
| LNU825 | 0.802 | 5.48E−02 | 2 | 12 | LNU829 | 0.931 | 7.75E−04 | 8 | 1 |
| LNU829 | 0.781 | 2.22E−02 | 8 | 13 | LNU829 | 0.876 | 4.34E−03 | 8 | 19 |
| LNU829 | 0.813 | 1.42E−02 | 8 | 2 | LNU829 | 0.787 | 2.05E−02 | 8 | 5 |
| LNU829 | 0.781 | 2.21E−02 | 8 | 7 | LNU829 | 0.756 | 3.00E−02 | 8 | 8 |
| LNU830 | 0.751 | 8.50E−02 | 2 | 9 | LNU830 | 0.772 | 7.20E−02 | 2 | 18 |
| LNU831 | 0.714 | 4.67E−02 | 8 | 2 | LNU831 | 0.704 | 5.13E−02 | 8 | 7 |
| LNU831 | 0.743 | 1.39E−02 | 6 | 8 | LNU832 | 0.712 | 7.28E−02 | 7 | 3 |
| LNU832 | 0.764 | 4.57E−02 | 7 | 16 | LNU832 | 0.761 | 4.68E−02 | 7 | 11 |
| LNU832 | 0.835 | 1.93E−02 | 7 | 10 | LNU832 | 0.774 | 4.12E−02 | 7 | 19 |
| LNU832 | 0.897 | 6.13E−03 | 7 | 5 | LNU832 | 0.788 | 3.54E−02 | 7 | 7 |
| LNU832 | 0.865 | 1.20E−02 | 7 | 12 | LNU832 | 0.745 | 5.44E−02 | 7 | 17 |
| LNU832 | 0.788 | 3.54E−02 | 1 | 15 | LNU832 | 0.760 | 4.76E−02 | 1 | 13 |
| LNU832 | 0.758 | 4.85E−02 | 1 | 9 | LNU832 | 0.714 | 7.14E−02 | 1 | 10 |
| LNU832 | 0.756 | 4.91E−02 | 1 | 7 | LNU832 | 0.749 | 3.25E−02 | 8 | 12 |
| LNU832 | 0.707 | 2.22E−02 | 6 | 10 | LNU832 | 0.828 | 3.07E−03 | 6 | 12 |
| LNU832 | 0.857 | 3.15E−03 | 3 | 15 | LNU832 | 0.714 | 3.08E−02 | 3 | 10 |
| LNU832 | 0.729 | 2.59E−02 | 3 | 12 | LNU832 | 0.780 | 6.70E−02 | 2 | 12 |
| LNU833 | 0.810 | 5.08E−02 | 7 | 1 | LNU833 | 0.805 | 1.60E−02 | 8 | 1 |
| LNU833 | 0.701 | 5.27E−02 | 8 | 14 | LNU833 | 0.780 | 2.25E−02 | 8 | 2 |
| LNU833 | 0.746 | 8.84E−02 | 2 | 14 | LNU834 | 0.718 | 6.89E−02 | 4 | 3 |
| LNU834 | 0.754 | 5.05E−02 | 4 | 6 | LNU834 | 0.717 | 6.99E−02 | 4 | 10 |
| LNU834 | 0.717 | 6.96E−02 | 4 | 19 | LNU834 | 0.867 | 1.15E−02 | 4 | 5 |
| LNU834 | 0.704 | 7.77E−02 | 4 | 7 | LNU834 | 0.733 | 6.11E−02 | 4 | 8 |

TABLE 51-continued

Correlation between the expression level of selected genes of some embodiments of the invention in various tissues and the phenotypic performance under normal conditions across maize varieties

| Gene Name | R | P value | Exp. set | Cor. Set ID | Gene Name | R | P value | Exp. set | Cor. Set ID |
|---|---|---|---|---|---|---|---|---|---|
| LNU834 | 0.724 | 6.56E−02 | 4 | 12 | LNU834 | 0.707 | 7.58E−02 | 4 | 4 |
| LNU834 | 0.843 | 1.72E−02 | 7 | 15 | LNU834 | 0.855 | 1.42E−02 | 7 | 21 |
| LNU834 | 0.883 | 8.46E−03 | 7 | 9 | LNU834 | 0.828 | 2.14E−02 | 7 | 12 |
| LNU834 | 0.717 | 6.97E−02 | 1 | 15 | LNU834 | 0.747 | 5.38E−02 | 1 | 9 |
| LNU834 | 0.778 | 3.93E−02 | 1 | 10 | LNU834 | 0.857 | 1.36E−02 | 1 | 12 |
| LNU834 | 0.972 | 5.30E−05 | 8 | 13 | LNU834 | 0.876 | 4.37E−03 | 8 | 11 |
| LNU834 | 0.958 | 1.78E−04 | 8 | 10 | LNU834 | 0.776 | 2.35E−02 | 8 | 2 |
| LNU834 | 0.876 | 4.30E−03 | 8 | 7 | LNU834 | 0.708 | 4.92E−02 | 8 | 8 |
| LNU834 | 0.729 | 4.01E−02 | 8 | 4 | LNU834 | 0.747 | 2.09E−02 | 3 | 3 |
| LNU834 | 0.828 | 5.89E−03 | 3 | 16 | LNU834 | 0.859 | 3.03E−03 | 3 | 15 |
| LNU834 | 0.840 | 4.61E−03 | 3 | 13 | LNU834 | 0.915 | 5.41E−04 | 3 | 11 |
| LNU834 | 0.723 | 2.77E−02 | 3 | 6 | LNU834 | 0.720 | 2.88E−02 | 3 | 9 |
| LNU834 | 0.943 | 1.39E−04 | 3 | 10 | LNU834 | 0.874 | 2.06E−03 | 3 | 19 |
| LNU834 | 0.778 | 1.35E−02 | 3 | 5 | LNU834 | 0.883 | 1.63E−03 | 3 | 7 |
| LNU834 | 0.906 | 7.68E−04 | 3 | 12 | LNU834 | 0.708 | 3.28E−02 | 3 | 4 |
| LNU834 | 0.835 | 5.12E−03 | 3 | 17 | LNU834 | 0.765 | 7.62E−02 | 2 | 15 |
| LNU834 | 0.703 | 1.20E−01 | 2 | 9 | LNU834 | 0.775 | 7.00E−02 | 2 | 18 |
| LNU834 | 0.860 | 2.81E−02 | 2 | 12 | LNU835 | 0.716 | 7.01E−02 | 4 | 16 |
| LNU835 | 0.734 | 6.03E−02 | 4 | 15 | LNU835 | 0.807 | 2.83E−02 | 4 | 9 |
| LNU835 | 0.791 | 3.43E−02 | 4 | 10 | LNU835 | 0.846 | 1.64E−02 | 4 | 19 |
| LNU835 | 0.777 | 3.98E−02 | 4 | 5 | LNU835 | 0.917 | 3.64E−03 | 4 | 12 |
| LNU835 | 0.766 | 4.45E−02 | 1 | 3 | LNU835 | 0.805 | 2.89E−02 | 1 | 16 |
| LNU835 | 0.707 | 7.55E−02 | 1 | 9 | LNU835 | 0.753 | 5.07E−02 | 1 | 10 |
| LNU835 | 0.960 | 6.02E−04 | 1 | 19 | LNU835 | 0.930 | 2.38E−03 | 1 | 5 |
| LNU835 | 0.791 | 3.42E−02 | 1 | 7 | LNU835 | 0.841 | 1.77E−02 | 1 | 8 |
| LNU835 | 0.746 | 5.42E−02 | 1 | 12 | LNU835 | 0.728 | 6.34E−02 | 1 | 4 |
| LNU835 | 0.732 | 6.14E−02 | 1 | 17 | LNU835 | 0.758 | 8.07E−02 | 2 | 9 |
| LNU835 | 0.882 | 2.00E−02 | 2 | 12 | LNU837 | 0.822 | 2.32E−02 | 1 | 14 |
| LNU837 | 0.703 | 7.79E−02 | 1 | 4 | LNU837 | 0.778 | 2.31E−02 | 8 | 11 |
| LNU837 | 0.755 | 3.02E−02 | 8 | 7 | LNU837 | 0.845 | 3.40E−02 | 2 | 14 |
| LNU837 | 0.907 | 1.26E−02 | 2 | 5 | LNU838 | 0.819 | 1.29E−02 | 5 | 19 |
| LNU838 | 0.711 | 4.80E−02 | 5 | 5 | LNU838 | 0.860 | 2.80E−02 | 2 | 9 |
| LNU838 | 0.948 | 4.01E−03 | 2 | 18 | LNU839 | 0.717 | 6.99E−02 | 4 | 10 |
| LNU839 | 0.717 | 6.96E−02 | 4 | 19 | LNU839 | 0.867 | 1.15E−02 | 4 | 5 |
| LNU839 | 0.704 | 7.77E−02 | 4 | 7 | LNU839 | 0.724 | 6.56E−02 | 4 | 12 |
| LNU839 | 0.972 | 5.30E−05 | 8 | 13 | LNU839 | 0.876 | 4.37E−03 | 8 | 11 |
| LNU839 | 0.958 | 1.78E−04 | 8 | 10 | LNU839 | 0.776 | 2.35E−02 | 8 | 2 |
| LNU839 | 0.876 | 4.30E−03 | 8 | 7 | LNU839 | 0.708 | 4.92E−02 | 8 | 8 |
| LNU839 | 0.729 | 4.01E−02 | 8 | 4 | LNU839 | 0.765 | 7.62E−02 | 2 | 15 |
| LNU839 | 0.703 | 1.20E−01 | 2 | 9 | LNU839 | 0.775 | 7.00E−02 | 2 | 18 |
| LNU840 | 0.759 | 4.77E−02 | 1 | 19 | LNU840 | 0.781 | 3.80E−02 | 1 | 8 |
| LNU840 | 0.834 | 3.89E−02 | 2 | 18 | LNU841 | 0.707 | 7.55E−02 | 7 | 16 |
| LNU841 | 0.755 | 5.00E−02 | 7 | 10 | LNU841 | 0.774 | 4.10E−02 | 7 | 19 |
| LNU841 | 0.861 | 1.29E−02 | 7 | 5 | LNU841 | 0.855 | 1.43E−02 | 7 | 12 |
| LNU841 | 0.704 | 2.31E−02 | 6 | 3 | LNU841 | 0.824 | 3.36E−03 | 6 | 8 |
| LNU841 | 0.775 | 8.41E−03 | 6 | 4 | LNU843 | 0.736 | 5.94E−02 | 7 | 3 |
| LNU843 | 0.796 | 3.22E−02 | 7 | 16 | LNU843 | 0.776 | 4.03E−02 | 7 | 21 |
| LNU843 | 0.729 | 6.29E−02 | 7 | 9 | LNU843 | 0.806 | 2.85E−02 | 7 | 10 |
| LNU843 | 0.866 | 1.17E−02 | 7 | 19 | LNU843 | 0.793 | 3.33E−02 | 7 | 5 |
| LNU843 | 0.721 | 6.77E−02 | 7 | 7 | LNU843 | 0.866 | 1.18E−02 | 7 | 12 |
| LNU843 | 0.770 | 4.28E−02 | 7 | 17 | LNU843 | 0.754 | 5.02E−02 | 1 | 15 |
| LNU845 | 0.801 | 3.03E−02 | 7 | 6 | LNU845 | 0.877 | 9.48E−03 | 7 | 18 |
| LNU845 | 0.703 | 7.84E−02 | 7 | 4 | LNU845 | 0.708 | 7.51E−02 | 7 | 17 |
| LNU845 | 0.834 | 3.90E−02 | 2 | 14 | LNU845 | 0.711 | 1.13E−01 | 2 | 5 |
| LNU846 | 0.817 | 2.49E−02 | 7 | 3 | LNU846 | 0.777 | 4.00E−02 | 7 | 16 |
| LNU846 | 0.721 | 6.76E−02 | 7 | 13 | LNU846 | 0.777 | 3.97E−02 | 7 | 11 |
| LNU846 | 0.889 | 7.41E−03 | 7 | 6 | LNU846 | 0.894 | 6.59E−03 | 7 | 18 |
| LNU846 | 0.796 | 3.22E−02 | 7 | 4 | LNU846 | 0.834 | 1.97E−02 | 7 | 17 |
| LNU846 | 0.733 | 9.72E−02 | 2 | 9 | LNU846 | 0.724 | 1.04E−01 | 2 | 12 |

Table 51. Provided are the correlations (R) between the expression levels yield improving genes and their homologs in various tissues [Expression (Exp) sets] and the phenotypic performance [yield, biomass, growth rate and/or vigor components (Correlation vector (Cor))] under normal conditions across maize varieties.
P = p value.

Example 8

Production of Maize Transcriptom and High Throughput Correlation Analysis with Yield and NUE Related Parameters when Grown Under Reduced Nitrogen Fertilization Using 60K Maize Oligonucleotide Micro-Arrays In order to produce a high throughput correlation analysis between plant phenotype and gene expression level, the present inventors utilized a maize oligonucleotide microarray, produced by Agilent Technologies [chem. (dot) agilent (dot) com/Scripts/PDS (dot) asp?1Page=50879]. The array oligonucleotide represents about 44,000 maize genes and transcripts.

Correlation of Maize Hybrids Across Ecotypes Grown Under Low Nitrogen Conditions Experimental Procedures 12 Maize hybrids were grown in 3 repetitive plots, in field. Maize seeds were planted and plants were grown in the field using commercial fertilization and irrigation protocols (485 metric cubes of water per dunam, 30 units of uran 21% fertilization per entire growth period). In order to define correlations between the levels of RNA expression with NUE and yield components or vigor related parameters, the 12 different maize hybrids were analyzed. Among them, 11 hybrids encompassing the observed variance were selected for RNA expression analysis. The correlation between the RNA levels and the characterized parameters was analyzed using Pearson correlation test [davidmlane (dot) com/hyperstat/A34739 (dot) html].

Analyzed Maize tissues—All 10 selected maize hybrids were sampled per each treatment (low N and normal conditions), in three time points: TP2=V6-V8 (six to eight collar leaf are visible, rapid growth phase and kernel row determination begins), TP5=R1-R2 (silking-blister), TP6=R3-R4 (milk-dough). Four types of plant tissues [Ear, flag leaf indicated in Tables 52-53 as leaf, grain distal part, and internode] were sampled and RNA was extracted as described above. Each micro-array expression information tissue type has received a Set ID as summarized in Tables 52-53 below.

TABLE 52

Maize under low N conditions transcriptom expression sets

| Expression Set | Set ID |
| --- | --- |
| Maize field/Low/N/Ear/TP5 | 1 |
| Maize field/Low/N/Ear/TP6 | 2 |
| Maize field/Low/N/Internodes/TP2 | 3 |
| Maize field/Low/N/Internodes/TP5 | 4 |
| Maize field/Low/N/Leaf/TP5 | 5 |
| Maize field/Low/N/Leaf/TP6 | 6 |

Table 52: Provided are the maize transcriptom expression sets.
Leaf = the leaf below the main ear;
Flower meristem = Apical meristem following male flower initiation;
Ear = the female flower at the anthesis day.
Grain Distal = maize developing grains from the cob extreme area,
Grain Basal = maize developing grains from the cob basal area;
Internodes = internodes located above and below the main ear in the plant.

TABLE 53

Maize under normal conditions transcriptom expression sets

| Set ID | Expression Set |
| --- | --- |
| 1 | Maize field/Normal/Ear/R1-R2 |
| 2 | Maize field/Normal/Ear/R3-R4 |
| 3 | Maize field Normal/Grain/Distal/R4-R5 |
| 4 | Maize field Normal/Internode/R1-R2 |
| 5 | Maize field Normal/Internode/R3-R4 |
| 6 | Maize field Normal/Internode/V6-V8 |
| 7 | Maize field Normal/Leaf/R1-R2 |
| 8 | Maize field Normal/Leaf/V6-V8 |

Table 53: Provided are the maize transcriptom expression sets.
Leaf = the leaf below the main ear;
Flower meristem = Apical meristem following male flower initiation;
Ear = the female flower at the anthesis day.
Grain Distal = maize developing grains from the cob extreme area,
Grain Basal = maize developing grains from the cob basal area;
Internodes = internodes located above and below the main ear in the plant.

The following parameters were collected were collected either by sampling 6 plants per plot or by measuring the parameter across all the plants within the plot.

Seed yield per plant (Kg.)—At the end of the experiment all ears from plots within blocks A-C were collected. 6 ears were separately threshed and grains were weighted, all additional ears were threshed together and weighted as well. The average grain weight per ear was calculated by dividing the total grain weight by number of total ears per plot (based on plot). In case of 6 ears, the total grains weight of 6 ears was divided by 6.

Ear weight per plot (gr.)—At the end of the experiment (when ears were harvested) total and 6 selected ears per plots within blocks were collected separately. The plants with (total and 6) were weighted (gr.) separately and the average ear per plant was calculated for Ear weight per plot (total of 42 plants per plot).

Plant height and Ear height—Plants were characterized for height at harvesting. In each measure, 6 plants were measured for their height using a measuring tape. Height was measured from ground level to top of the plant below the tassel. Ear height was measured from the ground level to the place were the main ear is located.

Leaf number per plant—Plants were characterized for leaf number during growing period at 5 time points. In each measure, plants were measured for their leaf number by counting all the leaves of 3 selected plants per plot.

SPAD—Chlorophyll content was determined using a Minolta SPAD 502 chlorophyll meter and measurement was performed 64 days post sowing. SPAD meter readings were done on young fully developed leaf. Seven measurements per leaf were taken per plot. Data were taken after once per weeks after sowing.

Dry weight per plant—At the end of the experiment (when Inflorescence were dry) all vegetative material from plots within blocks A-C were collected.

Dry weight=total weight of the vegetative portion above ground (excluding roots) after drying at 70° C. in oven for 48 hours;

Ear length of Filled Ear [cm]—it was calculated as the length of the ear with grains out of the total ear.

Ear length and width [cm]—it was calculated as the length and width of the ear in the filled. Measurement was performed in 6 plants per each plot.

Kernel Row Number per Ear—The number of rows in each ear was counted.

Stalk width [cm]—The diameter of the stalk was measured in the internode located below the main ear. Measurement was performed in 6 plants per each plot.

Leaf area index [LAI]=total leaf area of all plants in a plot. Measurement was performed using a Leaf area-meter.

NUE [kg/kg]—is the ratio between total grain yield per total N applied in soil.

NUpE [kg/kg]—is the ratio between total plant biomass per total N applied in soil.

Yield/stalk width [kg/cm]—is the ratio between total grain yields and the width of the stalk.

Yield/LAI [kg]—is the ratio between total grain yields and total leaf area index.

Experimental Results 11 different maize hybrids were grown and characterized for different parameters. Tables 54-55 describe the Maize correlated parameters. The average for each of the measured parameter was calculated using the JMP software (Tables 56-59) and a subsequent correlation analysis was performed (Tables 60-61). Results were then integrated to the database.

TABLE 54

Maize under low N conditions correlated parameters (vectors)

| Correlation ID | Correlated parameter with |
|---|---|
| 1 | Low N—Ear Length [cm] |
| 2 | Low N—Ear length of filled area [cm] |
| 3 | Low N—Ear with [mm] |
| 4 | Low N—Final Leaf Number |
| 5 | Low N—Final Main Ear Height [cm] |
| 6 | Low N—Final Plant Height [cm] |
| 7 | Low N—No of rows per ear |
| 8 | Low N—SPAD R1-2 |
| 9 | Low N—SPAD R3-R4 |
| 10 | Low N—Stalk width 20/08/09 close to TP5 [cm] |
| 11 | Low N—Ear weight per plot (42 plants per plot) [0 RH] [kg] |
| 12 | Low N—Final Plant DW [kg] |
| 13 | Low N—LAI |
| 14 | Low N—NUE yield kg/N applied in soil kg |
| 15 | Low N—NUE at early grain filling [R1-R2] yield Kg/N in plant SPAD |
| 16 | Low N—NUE at grain filling [R3-R4] yield Kg/N in plant SPAD |
| 17 | Low N—NUpE [biomass/N applied] |
| 18 | Low N—Seed yield per dunam [kg] |
| 19 | Low N—Yield/LAI |

TABLE 54-continued

Maize under low N conditions correlated parameters (vectors)

| Correlation ID | Correlated parameter with |
|---|---|
| 20 | Low N—Yield/stalk width |
| 21 | Low N—seed yield per 1 plant rest of the plot [0-RH in Kg] |

Table 54. "cm" = centimeters'
"mm" = millimeters;
"kg" = kilograms;
SPAD at R1-R2 and SPAD R3-R4: Chlorophyl level after early and late stages of grain filling;
"NUE" = nitrogen use efficiency;
"NUpE" = nitrogen uptake efficiency;
"LAI" = leaf area;
"N" = nitrogen;
Low N = under low Nitrogen conditions;
"Normal" = under normal conditions;
"dunam" = 1000 m².

TABLE 55

Maize under normal conditions correlated parameters (vectors)

| Correlation ID | Correlated parameter with |
|---|---|
| 1 | Normal—Final Plant DW [kg] |
| 2 | Normal—Ear Length [cm] |
| 3 | Normal—Ear length of filled area [cm] |
| 4 | Normal—Ear with [mm] |
| 5 | Normal—Final Leaf Number [number] |
| 6 | Normal—Final Main Ear Height [cm] |
| 7 | Normal—Final Plant Height [cm] |
| 8 | Normal—No of rows per ear |
| 9 | Normal—SPAD R1-2 |
| 10 | Normal—SPAD R3-R4 |
| 11 | Normal—Stalk width TP5 [mm] |
| 12 | Normal—Ear weight per plot [kg] |
| 13 | Normal—LAI |
| 14 | Normal—NUE yield kg/N applied in soil kg |
| 15 | Normal—NUE at early grain filling [R1-R2] yield Kg/N in plant SPAD |
| 16 | Normal—NUE at grain filling [R3-R4] yield Kg/N in plant SPAD |
| 17 | Normal—NUpE [biomass/N applied] |
| 18 | Normal—Seed yield per dunam [kg] |
| 19 | Normal—Yield/LAI |
| 20 | Normal—Yield/stalk width |
| 21 | Normal—seed yield per 1 plant rest of the plot [0-RH in Kg] |

Table 55. "cm" = centimeters'
"mm" = millimeters;
"kg" = kilograms;
SPAD at R1-R2 and SPAD R3-R4: Chlorophyl level after early and late stages of grain filling;
"NUE" = nitrogen use efficiency;
"NUpE" = nitrogen uptake efficiency;
"LAI" = leaf area;
"N" = nitrogen;
Low N = under low Nitrogen conditions;
"Normal" = under normal conditions;
"dunam" = 1000 m².

TABLE 56

Measured parameters in Maize accessions under normal conditions

| | Corr. ID | | | | | | | | | | |
|---|---|---|---|---|---|---|---|---|---|---|---|
| Line | 1 | 2 | 3 | 4 | 5 | 6 | 7 | 8 | 9 | 10 | 11 |
| Line-1 | 1.267 | 19.944 | 16.233 | 51.075 | 11.800 | 130.311 | 273.456 | 16.11 | 56.889 | 59.933 | 2.911 |
| Line-2 | 1.300 | 20.167 | 17.500 | 46.290 | 11.111 | 122.333 | 260.500 | 14.667 | 57.161 | 60.900 | 2.644 |
| Line-3 | 1.333 | 18.111 | 17.722 | 45.919 | 13.278 | 127.667 | 288.000 | 15.444 | 59.272 | 56.892 | 2.711 |
| Line-4 | 1.500 | 19.889 | 18.444 | 47.632 | 11.778 | 113.022 | 238.500 | 15.889 | 61.611 | 58.700 | 2.900 |

TABLE 56-continued

Measured parameters in Maize accessions under normal conditions

| Line | \multicolumn{11}{c}{Corr. ID} |
| | 1 | 2 | 3 | 4 | 5 | 6 | 7 | 8 | 9 | 10 | 11 |
|---|---|---|---|---|---|---|---|---|---|---|---|
| Line-5 | 1.300 | 19.500 | 15.667 | 51.407 | 11.944 | 135.278 | 286.944 | 16.167 | 58.628 | 58.700 | 2.700 |
| Line-6 | 1.583 | 17.722 | 14.667 | 47.420 | 12.333 | 94.278 | 224.833 | 15.167 | 61.228 | 63.158 | 2.622 |
| Line-7 | 1.417 | 17.667 | 12.944 | 47.253 | 12.444 | 120.944 | 264.444 | 16.000 | 60.167 | 59.750 | 2.922 |
| Line-8 | 1.367 | 17.278 | 14.028 | 46.846 | 12.222 | 107.722 | 251.611 | 14.833 | 61.089 | 62.350 | 2.722 |
| Line-9 | 11.383 | 20.500 | 18.778 | 49.275 | 12.556 | 112.500 | 278.444 | 15.389 | 62.200 | 61.925 | 2.844 |
| Line-10 | 1.700 | 17.500 | 12.333 | 48.283 | 11.667 | 139.667 | 279.000 | 17.667 | 57.506 | 57.225 | 2.656 |
| Line-11 | 0.417 | 19.856 | 16.067 | 41.837 | 9.278 | 60.444 | 163.778 | 14.267 | 52.044 | 49.342 | 2.256 |

Table 56. Provided are the values of each of the parameters (as described above) measured in maize accessions (line ID) under normal conditions. Growth conditions are specified in the experimental procedure section.

TABLE 57

Additional Measured parameters in Maize accessions under normal conditions

| Line | \multicolumn{10}{c}{Corr. ID} |
| | 12 | 14 | 15 | 16 | 17 | 18 | 20 | 21 | 13 | 19 |
|---|---|---|---|---|---|---|---|---|---|---|
| Line-1 | 8.943 | 4.452 | 23.431 | 24.978 | 0.008 | 1335.625 | 456.707 | 0.167 | 3.208 | 426.086 |
| Line-2 | 7.023 | 3.624 | 19.052 | 17.807 | 0.009 | 1087.058 | 412.443 | 0.136 | 3.947 | 312.975 |
| Line-3 | 7.533 | 4.008 | 20.293 | 20.332 | 0.009 | 1202.532 | 443.368 | 0.150 | 3.332 | 307.277 |
| Line-4 | 7.991 | 4.237 | 20.719 | 19.957 | 0.010 | 1271.204 | 438.705 | 0.159 | 4.012 | 362.442 |
| Line-5 | 8.483 | 4.010 | 20.486 | 19.026 | 0.009 | 1202.966 | 446.659 | 0.150 | 3.864 | 314.138 |
| Line-6 | 5.632 | 3.124 | 15.360 | 13.904 | 0.011 | 937.083 | 356.950 | 0.117 | 4.191 | 224.582 |
| Line-7 | 6.100 | 3.286 | 16.383 | 16.234 | 0.009 | 985.893 | 337.486 | 0.123 | 3.969 | 266.437 |
| Line-8 | 6.659 | 3.500 | 17.191 | 17.214 | 0.009 | 1050.131 | 385.790 | 0.131 | 4.322 | 261.664 |
| Line-9 | 8.402 | 4.551 | 21.955 | 21.017 | 0.076 | 1365.293 | 481.942 | 0.171 | 2.888 | 482.329 |
| Line-10 | 8.215 | 4.087 | 20.994 | 21.529 | 0.004 | 1226.077 | 471.568 | 0.153 | 4.306 | |
| Line-11 | 1.879 | 1.003 | 5.725 | 5.519 | 0.003 | 300.928 | 139.728 | 0.038 | | |

Table 57. Provided are the values of each of the parameters (as described above) measured in maize accessions (line ID) under normal conditions. Growth conditions are specified in the experimental procedure section.

TABLE 58

Measured parameters in Maize accessions under low Nitrogen conditions

| Line | \multicolumn{11}{c}{Corr. ID} |
| | 1 | 2 | 3 | 4 | 5 | 6 | 7 | 8 | 9 | 10 | 11 |
|---|---|---|---|---|---|---|---|---|---|---|---|
| Line-1 | 20.614 | 18.398 | 46.713 | 15.024 | 158.076 | 305.836 | 14.181 | 60.236 | 59.286 | 2.764 | 6.605 |
| Line-2 | 20.976 | 18.417 | 48.222 | 11.643 | 136.238 | 270.929 | 15.214 | 57.938 | 57.621 | 2.419 | 7.974 |
| Line-3 | 20.222 | 19.778 | 48.323 | 13.500 | 128.389 | 290.611 | 15.000 | 58.761 | 58.400 | 2.650 | 9.634 |
| Line-4 | 20.111 | 18.833 | 49.863 | 11.611 | 133.056 | 252.167 | 15.667 | 59.478 | 59.189 | 2.767 | 9.222 |
| Line-5 | 20.111 | 16.222 | 52.873 | 11.833 | 137.833 | 260.222 | 16.000 | 58.500 | 58.194 | 2.672 | 7.630 |
| Line-6 | 18.500 | 16.000 | 47.436 | 11.889 | 99.556 | 227.222 | 15.944 | 64.039 | 62.667 | 2.594 | 7.215 |
| Line-7 | 19.056 | 15.278 | 49.609 | 12.556 | 130.167 | 271.722 | 15.556 | 56.422 | 61.044 | 2.983 | 7.917 |
| Line-8 | 18.250 | 15.694 | 48.567 | 11.667 | 114.611 | 248.611 | 14.500 | 60.000 | 59.867 | 2.611 | 28.961 |
| Line-9 | 20.095 | 16.771 | 52.406 | 12.443 | 143.862 | 279.329 | 16.410 | 58.317 | 57.467 | 2.650 | 7.797 |
| Line-10 | 17.806 | 14.056 | 42.634 | 9.278 | 61.611 | 171.278 | 14.367 | 53.061 | 49.611 | 2.278 | 2.410 |
| Line-11 | 21.250 | 19.556 | 50.003 | 13.167 | 114.444 | 269.778 | 15.744 | 61.717 | 61.867 | 2.817 | 9.775 |

Table 58: Provided are the values of each of the parameters (as described above) measured in maize accessions (line ID) under low nitrogen conditions. Growth conditions are specified in the experimental procedure section.

TABLE 59

Additional measured parameters in Maize accessions under low Nitrogen conditions

| Line | \multicolumn{10}{c}{Corr. ID} |
| | 12 | 14 | 15 | 16 | 17 | 18 | 20 | 21 | 13 | 19 |
|---|---|---|---|---|---|---|---|---|---|---|
| Line-1 | 1.593 | 7.225 | 18.023 | 18.352 | 0.011 | 1083.749 | 416.532 | 0.135 | 2.923 | 341.501 |
| Line-2 | 1.429 | 8.411 | 21.787 | 21.919 | 0.010 | 1261.635 | 528.383 | 0.158 | 3.155 | 408.093 |
| Line-3 | 1.533 | 10.328 | 26.335 | 26.479 | 0.010 | 1549.245 | 583.458 | 0.194 | 3.330 | 464.768 |

TABLE 59-continued

Additional measured parameters in Maize accessions under low Nitrogen conditions

| Line | Corr. ID | | | | | | | | | |
|---|---|---|---|---|---|---|---|---|---|---|
| | 12 | 14 | 15 | 16 | 17 | 18 | 20 | 21 | 13 | 19 |
| Line-4 | 1.950 | 9.986 | 25.144 | 25.333 | 0.013 | 1497.865 | 541.017 | 0.187 | 2.873 | 522.258 |
| Line-5 | 1.483 | 7.626 | 19.547 | 19.685 | 0.010 | 1143.850 | 428.089 | 0.143 | 2.786 | 439.525 |
| Line-6 | 1.600 | 7.728 | 18.049 | 18.541 | 0.011 | 1159.260 | 444.294 | 0.145 | 3.764 | 312.581 |
| Line-7 | 1.583 | 8.049 | 21.388 | 19.785 | 0.011 | 1207.424 | 407.200 | 0.151 | 3.499 | 345.901 |
| Line-8 | 1.283 | 8.334 | 20.788 | 20.917 | 0.009 | 1250.052 | 477.438 | 0.156 | 5.016 | 287.735 |
| Line-9 | 1.514 | 7.640 | 19.676 | 19.935 | 0.010 | 1146.036 | 445.604 | 0.143 | | |
| Line-10 | 0.433 | 2.555 | 7.213 | 7.722 | 0.003 | 383.219 | 167.902 | 0.048 | | |
| Line-11 | 1.517 | 10.599 | 25.702 | 25.902 | 0.010 | 1589.914 | 562.294 | 0.199 | 3.157 | 501.239 |

Table 59: Provided are the values of each of the parameters (as described above) measured in maize accessions (line ID) under low nitrogen conditions. Growth conditions are specified in the experimental procedure section.

TABLE 60

Correlation between the expression level of selected genes of some embodiments of the invention in various tissues and the phenotypic performance under normal conditions across maize varieties

| Gene Name | R | P value | Exp. set | Cor. Set ID | Gene Name | R | P value | Exp. set | Cor. Set ID |
|---|---|---|---|---|---|---|---|---|---|
| LNU811 | 0.880 | 2.07E−02 | 1 | 13 | LNU811 | 0.809 | 5.10E−02 | 5 | 13 |
| LNU811 | 0.748 | 3.29E−02 | 2 | 12 | LNU811 | 0.896 | 2.58E−03 | 2 | 4 |
| LNU811 | 0.814 | 1.39E−02 | 2 | 8 | LNU811 | 0.855 | 3.02E−02 | 6 | 13 |
| LNU813 | 0.945 | 4.45E−03 | 5 | 5 | LNU813 | 0.934 | 6.46E−03 | 5 | 10 |
| LNU813 | 0.825 | 4.34E−02 | 5 | 9 | LNU813 | 0.718 | 4.48E−02 | 2 | 17 |
| LNU813 | 0.757 | 2.96E−02 | 2 | 11 | LNU813 | 0.718 | 4.48E−02 | 2 | 1 |
| LNU813 | 0.747 | 5.37E−02 | 4 | 17 | LNU813 | 0.747 | 5.37E−02 | 4 | 1 |
| LNU813 | 0.849 | 7.73E−03 | 3 | 10 | LNU813 | 0.809 | 2.74E−02 | 6 | 7 |
| LNU813 | 0.704 | 7.72E−02 | 6 | 10 | LNU813 | 0.701 | 7.93E−02 | 6 | 16 |
| LNU813 | 0.851 | 1.52E−02 | 6 | 6 | LNU813 | 0.743 | 5.58E−02 | 6 | 9 |
| LNU814 | 0.766 | 4.47E−02 | 1 | 8 | LNU814 | 0.976 | 8.47E−04 | 5 | 17 |
| LNU814 | 0.713 | 1.11E−01 | 5 | 3 | LNU814 | 0.976 | 8.47E−04 | 5 | 1 |
| LNU814 | 0.725 | 1.03E−01 | 5 | 9 | LNU814 | 0.702 | 1.20E−01 | 5 | 19 |
| LNU814 | 0.745 | 3.41E−02 | 2 | 11 | LNU814 | 0.718 | 6.94E−02 | 4 | 3 |
| LNU814 | 0.757 | 4.90E−02 | 4 | 6 | LNU814 | 0.847 | 1.61E−02 | 4 | 8 |
| LNU814 | 0.711 | 7.30E−02 | 6 | 8 | LNU815 | 0.736 | 3.72E−02 | 2 | 10 |
| LNU815 | 0.845 | 8.22E−03 | 3 | 12 | LNU815 | 0.833 | 1.02E−02 | 3 | 15 |
| LNU815 | 0.761 | 2.83E−02 | 3 | 14 | LNU815 | 0.877 | 4.20E−03 | 3 | 4 |
| LNU815 | 0.881 | 3.87E−03 | 3 | 16 | LNU815 | 0.761 | 2.83E−02 | 3 | 18 |
| LNU815 | 0.761 | 2.83E−02 | 3 | 21 | LNU815 | 0.725 | 4.20E−02 | 3 | 19 |
| LNU815 | 0.794 | 1.87E−02 | 7 | 13 | LNU816 | 0.807 | 5.22E−02 | 1 | 19 |
| LNU816 | 0.710 | 7.39E−02 | 1 | 2 | LNU816 | 0.945 | 4.48E−03 | 5 | 13 |
| LNU816 | 0.711 | 4.80E−02 | 2 | 10 | LNU816 | 0.866 | 2.58E−02 | 4 | 13 |
| LNU816 | 0.705 | 5.09E−02 | 3 | 5 | LNU816 | 0.833 | 2.01E−02 | 6 | 7 |
| LNU816 | 0.738 | 5.82E−02 | 6 | 16 | LNU816 | 0.726 | 6.47E−02 | 6 | 6 |
| LNU816 | 0.816 | 7.34E−03 | 7 | 11 | LNU816 | 0.759 | 1.78E−02 | 7 | 9 |
| LNU817 | 0.728 | 1.01E−01 | 5 | 11 | LNU818 | 0.708 | 7.51E−02 | 1 | 12 |
| LNU818 | 0.731 | 6.18E−02 | 1 | 11 | LNU818 | 0.879 | 9.14E−03 | 1 | 5 |
| LNU818 | 0.719 | 6.85E−02 | 1 | 14 | LNU818 | 0.907 | 4.80E−03 | 1 | 4 |
| LNU818 | 0.937 | 1.84E−03 | 1 | 10 | LNU818 | 0.719 | 6.85E−02 | 1 | 18 |
| LNU818 | 0.719 | 6.85E−02 | 1 | 21 | LNU818 | 0.814 | 2.60E−02 | 1 | 9 |
| LNU818 | 0.721 | 6.75E−02 | 1 | 20 | LNU818 | 0.741 | 9.18E−02 | 5 | 11 |
| LNU818 | 0.796 | 5.80E−02 | 5 | 10 | LNU818 | 0.766 | 7.60E−02 | 5 | 8 |
| LNU818 | 0.758 | 2.94E−02 | 2 | 4 | LNU818 | 0.789 | 2.00E−02 | 3 | 10 |
| LNU818 | 0.869 | 2.47E−02 | 6 | 13 | LNU818 | 0.700 | 7.98E−02 | 6 | 11 |
| LNU818 | 0.758 | 4.81E−02 | 6 | 10 | LNU818 | 0.805 | 8.91E−03 | 7 | 10 |
| LNU818 | 0.801 | 9.46E−03 | 7 | 9 | LNU819 | 0.772 | 4.19E−02 | 1 | 3 |
| LNU819 | 0.770 | 7.32E−02 | 1 | 19 | LNU819 | 0.773 | 4.15E−02 | 1 | 2 |
| LNU819 | 0.813 | 4.92E−02 | 5 | 5 | LNU819 | 0.722 | 1.83E−02 | 8 | 7 |
| LNU819 | 0.769 | 9.28E−03 | 8 | 5 | LNU819 | 0.709 | 2.18E−02 | 8 | 6 |
| LNU819 | 0.742 | 5.64E−02 | 4 | 10 | LNU819 | 0.713 | 4.73E−02 | 3 | 17 |
| LNU819 | 0.713 | 4.73E−02 | 3 | 1 | LNU819 | 0.727 | 6.44E−02 | 6 | 4 |
| LNU820 | 0.714 | 4.66E−02 | 3 | 3 | LNU820 | 0.749 | 3.25E−02 | 3 | 2 |
| LNU821 | 0.702 | 7.87E−02 | 1 | 5 | LNU821 | 0.753 | 5.08E−02 | 1 | 8 |
| LNU822 | 0.824 | 1.18E−02 | 7 | 13 | LNU823 | 0.705 | 7.67E−02 | 4 | 11 |
| LNU823 | 0.879 | 9.16E−03 | 4 | 3 | LNU823 | 0.795 | 3.25E−02 | 4 | 8 |
| LNU823 | 0.812 | 4.97E−02 | 4 | 19 | LNU823 | 0.717 | 4.54E−02 | 3 | 9 |
| LNU823 | 0.710 | 7.37E−02 | 6 | 17 | LNU823 | 0.710 | 7.37E−02 | 6 | 1 |
| LNU823 | 0.702 | 3.50E−02 | 7 | 9 | LNU824 | 0.704 | 7.74E−02 | 1 | 6 |
| LNU824 | 0.791 | 1.93E−02 | 2 | 11 | LNU824 | 0.764 | 2.72E−02 | 2 | 9 |
| LNU824 | 0.754 | 1.89E−02 | 7 | 6 | LNU825 | 0.725 | 4.18E−02 | 2 | 4 |

TABLE 60-continued

Correlation between the expression level of selected genes of some
embodiments of the invention in various tissues and the phenotypic
performance under normal conditions across maize varieties

| Gene Name | R | P value | Exp. set | Cor. Set ID | Gene Name | R | P value | Exp. set | Cor. Set ID |
|---|---|---|---|---|---|---|---|---|---|
| LNU825 | 0.706 | 5.04E−02 | 3 | 2 | LNU828 | 0.829 | 4.12E−02 | 5 | 5 |
| LNU829 | 0.894 | 2.72E−03 | 2 | 7 | LNU829 | 0.771 | 2.52E−02 | 2 | 6 |
| LNU829 | 0.907 | 7.49E−04 | 7 | 17 | LNU829 | 0.907 | 7.49E−04 | 7 | 1 |
| LNU830 | 0.862 | 2.73E−02 | 5 | 9 | LNU830 | 0.738 | 3.67E−02 | 2 | 11 |
| LNU831 | 0.790 | 3.44E−02 | 4 | 3 | LNU832 | 0.734 | 6.02E−02 | 1 | 7 |
| LNU832 | 0.932 | 2.24E−03 | 1 | 5 | LNU832 | 0.714 | 1.11E−01 | 5 | 10 |
| LNU832 | 0.778 | 3.92E−02 | 4 | 7 | LNU832 | 0.809 | 2.74E−02 | 4 | 12 |
| LNU832 | 0.747 | 5.34E−02 | 4 | 11 | LNU832 | 0.814 | 2.60E−02 | 4 | 15 |
| LNU832 | 0.780 | 3.86E−02 | 4 | 14 | LNU832 | 0.822 | 2.33E−02 | 4 | 16 |
| LNU832 | 0.917 | 3.65E−03 | 4 | 6 | LNU832 | 0.780 | 3.86E−02 | 4 | 18 |
| LNU832 | 0.780 | 3.86E−02 | 4 | 21 | LNU832 | 0.803 | 2.98E−02 | 4 | 20 |
| LNU832 | 0.722 | 6.68E−02 | 6 | 5 | LNU832 | 0.703 | 3.48E−02 | 7 | 11 |
| LNU832 | 0.809 | 8.29E−03 | 7 | 5 | LNU832 | 0.709 | 3.24E−02 | 7 | 10 |
| LNU832 | 0.795 | 1.05E−02 | 7 | 9 | LNU833 | 0.843 | 3.50E−02 | 5 | 5 |
| LNU833 | 0.728 | 1.01E−01 | 5 | 4 | LNU833 | 0.789 | 1.99E−02 | 2 | 5 |
| LNU833 | 0.823 | 3.43E−03 | 8 | 10 | LNU833 | 0.710 | 7.40E−02 | 4 | 3 |
| LNU833 | 0.721 | 4.37E−02 | 3 | 10 | LNU833 | 0.740 | 9.27E−02 | 6 | 13 |
| LNU833 | 0.702 | 7.84E−02 | 6 | 10 | LNU833 | 0.884 | 3.56E−03 | 7 | 13 |
| LNU834 | 0.935 | 6.23E−03 | 1 | 13 | LNU834 | 0.847 | 1.62E−02 | 1 | 10 |
| LNU834 | 0.754 | 5.01E−02 | 1 | 9 | LNU834 | 0.853 | 3.08E−02 | 5 | 4 |
| LNU834 | 0.804 | 5.40E−02 | 5 | 10 | LNU834 | 0.712 | 1.13E−01 | 5 | 19 |
| LNU834 | 0.807 | 5.22E−02 | 5 | 2 | LNU834 | 0.707 | 5.00E−02 | 2 | 8 |
| LNU834 | 0.727 | 1.73E−02 | 8 | 15 | LNU834 | 0.731 | 1.64E−02 | 8 | 16 |
| LNU834 | 0.735 | 2.42E−02 | 8 | 19 | LNU834 | 0.792 | 3.39E−02 | 4 | 4 |
| LNU834 | 0.947 | 1.20E−03 | 4 | 10 | LNU834 | 0.871 | 1.07E−02 | 6 | 17 |
| LNU834 | 0.720 | 6.82E−02 | 6 | 4 | LNU834 | 0.820 | 2.38E−02 | 6 | 6 |
| LNU834 | 0.871 | 1.07E−02 | 6 | 1 | LNU834 | 0.825 | 4.33E−02 | 6 | 19 |
| LNU834 | 0.706 | 7.62E−02 | 6 | 20 | LNU834 | 0.779 | 1.33E−02 | 7 | 7 |
| LNU834 | 0.801 | 9.44E−03 | 7 | 12 | LNU834 | 0.716 | 3.00E−02 | 7 | 11 |
| LNU834 | 0.742 | 2.22E−02 | 7 | 15 | LNU834 | 0.768 | 1.57E−02 | 7 | 14 |
| LNU834 | 0.853 | 3.46E−03 | 7 | 4 | LNU834 | 0.712 | 3.13E−02 | 7 | 10 |
| LNU834 | 0.761 | 1.73E−02 | 7 | 6 | LNU834 | 0.768 | 1.57E−02 | 7 | 18 |
| LNU834 | 0.768 | 1.57E−02 | 7 | 21 | LNU834 | 0.764 | 1.65E−02 | 7 | 20 |
| LNU835 | 0.966 | 3.91E−04 | 1 | 7 | LNU835 | 0.793 | 3.32E−02 | 1 | 12 |
| LNU835 | 0.743 | 5.55E−02 | 1 | 5 | LNU835 | 0.816 | 2.52E−02 | 1 | 15 |
| LNU835 | 0.778 | 3.92E−02 | 1 | 14 | LNU835 | 0.836 | 1.91E−02 | 1 | 16 |
| LNU835 | 0.915 | 3.86E−03 | 1 | 6 | LNU835 | 0.778 | 3.92E−02 | 1 | 18 |
| LNU835 | 0.778 | 3.92E−02 | 1 | 21 | LNU835 | 0.822 | 2.34E−02 | 1 | 20 |
| LNU835 | 0.753 | 8.37E−02 | 5 | 10 | LNU835 | 0.772 | 2.48E−02 | 2 | 10 |
| LNU835 | 0.881 | 8.80E−03 | 6 | 7 | LNU835 | 0.811 | 2.69E−02 | 6 | 12 |
| LNU835 | 0.711 | 7.35E−02 | 6 | 11 | LNU835 | 0.724 | 6.57E−02 | 6 | 5 |
| LNU835 | 0.809 | 2.76E−02 | 6 | 15 | LNU835 | 0.801 | 3.06E−02 | 6 | 14 |
| LNU835 | 0.759 | 4.77E−02 | 6 | 4 | LNU835 | 0.821 | 2.36E−02 | 6 | 10 |
| LNU835 | 0.812 | 2.66E−02 | 6 | 16 | LNU835 | 0.814 | 2.59E−02 | 6 | 6 |
| LNU835 | 0.801 | 3.06E−02 | 6 | 18 | LNU835 | 0.801 | 3.06E−02 | 6 | 21 |
| LNU835 | 0.833 | 2.00E−02 | 6 | 20 | LNU837 | 0.713 | 7.24E−02 | 1 | 11 |
| LNU837 | 0.879 | 9.15E−03 | 1 | 8 | LNU837 | 0.737 | 9.44E−02 | 5 | 7 |
| LNU837 | 0.845 | 3.41E−02 | 5 | 6 | LNU837 | 0.731 | 2.54E−02 | 8 | 19 |
| LNU837 | 0.752 | 5.14E−02 | 4 | 2 | LNU838 | 0.821 | 4.54E−02 | 5 | 17 |
| LNU838 | 0.715 | 1.10E−01 | 5 | 3 | LNU838 | 0.821 | 4.54E−02 | 5 | 1 |
| LNU838 | 0.784 | 2.14E−02 | 3 | 7 | LNU838 | 0.717 | 4.53E−02 | 3 | 6 |
| LNU839 | 0.853 | 3.08E−02 | 5 | 4 | LNU839 | 0.712 | 1.13E−01 | 5 | 19 |
| LNU839 | 0.807 | 5.22E−02 | 5 | 2 | LNU839 | 0.707 | 5.00E−02 | 2 | 8 |
| LNU839 | 0.820 | 2.38E−02 | 6 | 6 | LNU840 | 0.842 | 1.74E−02 | 1 | 7 |
| LNU840 | 0.701 | 7.90E−02 | 1 | 6 | LNU840 | 0.884 | 1.95E−02 | 5 | 17 |
| LNU840 | 0.884 | 1.95E−02 | 5 | 1 | LNU841 | 0.754 | 5.01E−02 | 4 | 7 |
| LNU841 | 0.761 | 4.68E−02 | 4 | 12 | LNU841 | 0.781 | 3.80E−02 | 4 | 15 |
| LNU841 | 0.729 | 6.29E−02 | 4 | 14 | LNU841 | 0.760 | 4.76E−02 | 4 | 16 |
| LNU841 | 0.894 | 6.56E−03 | 4 | 6 | LNU841 | 0.729 | 6.29E−02 | 4 | 18 |
| LNU841 | 0.729 | 6.29E−02 | 4 | 21 | LNU841 | 0.769 | 4.32E−02 | 4 | 20 |
| LNU843 | 0.761 | 4.69E−02 | 1 | 4 | LNU843 | 0.726 | 6.49E−02 | 1 | 9 |
| LNU843 | 0.717 | 1.97E−02 | 8 | 5 | LNU843 | 0.828 | 2.15E−02 | 4 | 7 |
| LNU843 | 0.864 | 1.21E−02 | 4 | 12 | LNU843 | 0.800 | 3.08E−02 | 4 | 11 |
| LNU843 | 0.852 | 1.48E−02 | 4 | 15 | LNU843 | 0.840 | 1.79E−02 | 4 | 14 |
| LNU843 | 0.742 | 5.64E−02 | 4 | 4 | LNU843 | 0.717 | 6.98E−02 | 4 | 10 |
| LNU843 | 0.859 | 1.34E−02 | 4 | 16 | LNU843 | 0.834 | 1.98E−02 | 4 | 6 |
| LNU843 | 0.840 | 1.79E−02 | 4 | 18 | LNU843 | 0.840 | 1.79E−02 | 4 | 21 |
| LNU843 | 0.848 | 1.59E−02 | 4 | 20 | LNU844 | 0.894 | 1.63E−02 | 5 | 5 |
| LNU845 | 0.761 | 7.91E−02 | 5 | 6 | LNU845 | 0.800 | 1.71E−02 | 2 | 17 |
| LNU845 | 0.800 | 1.71E−02 | 2 | 1 | LNU845 | 0.825 | 1.17E−02 | 2 | 9 |
| LNU845 | 0.710 | 2.14E−02 | 8 | 11 | LNU845 | 0.874 | 1.01E−02 | 4 | 8 |
| LNU846 | 0.809 | 5.14E−02 | 5 | 10 | LNU846 | 0.787 | 2.06E−02 | 2 | 12 |

TABLE 60-continued

Correlation between the expression level of selected genes of some embodiments of the invention in various tissues and the phenotypic performance under normal conditions across maize varieties

| Gene Name | R | P value | Exp. set | Cor. Set ID | Gene Name | R | P value | Exp. set | Cor. Set ID |
|---|---|---|---|---|---|---|---|---|---|
| LNU846 | 0.865 | 5.50E−03 | 2 | 4 | LNU846 | 0.707 | 4.99E−02 | 2 | 19 |
| LNU846 | 0.735 | 1.55E−02 | 8 | 11 | LNU846 | 0.706 | 2.26E−02 | 8 | 8 |
| LNU846 | 0.746 | 5.39E−02 | 4 | 12 | LNU846 | 0.819 | 2.41E−02 | 4 | 11 |
| LNU846 | 0.737 | 5.88E−02 | 4 | 15 | LNU846 | 0.771 | 4.23E−02 | 4 | 14 |
| LNU846 | 0.796 | 3.24E−02 | 4 | 4 | LNU846 | 0.703 | 7.81E−02 | 4 | 16 |
| LNU846 | 0.771 | 4.23E−02 | 4 | 18 | LNU846 | 0.899 | 5.94E−03 | 4 | 8 |
| LNU846 | 0.771 | 4.23E−02 | 4 | 21 | LNU846 | 0.726 | 6.45E−02 | 4 | 9 |
| LNU846 | 0.755 | 8.24E−02 | 4 | 19 | LNU846 | 0.724 | 6.56E−02 | 4 | 20 |
| LNU846 | 0.809 | 8.33E−03 | 7 | 3 | LNU846 | 0.849 | 7.69E−03 | 7 | 19 |
| LNU846 | 0.746 | 2.09E−02 | 7 | 2 | | | | | |

Table 60. Provided are the correlations (R) between the expression levels yield improving genes and their homologs in various tissues [Expression (Exp) sets] and the phenotypic performance [yield, biomass, growth rate and/or vigor components (Correlation vector (Cor))] under normal conditions across maize varieties.
P = p value.

TABLE 61

Correlation between the expression level of selected genes of some embodiments of the invention in various tissues and the phenotypic performance under low N conditions across maize varieties

| Gene Name | R | P value | Exp. set | Corr. Set ID | Gene Name | R | P value | Exp. set | Corr. Set ID |
|---|---|---|---|---|---|---|---|---|---|
| LNU811 | 0.836 | 3.80E−02 | 1 | 13 | LNU811 | 0.782 | 2.18E−02 | 5 | 19 |
| LNU813 | 0.876 | 2.22E−02 | 1 | 13 | LNU813 | 0.762 | 4.66E−02 | 1 | 11 |
| LNU813 | 0.835 | 1.93E−02 | 1 | 2 | LNU813 | 0.731 | 6.18E−02 | 1 | 1 |
| LNU813 | 0.766 | 1.61E−02 | 5 | 7 | LNU813 | 0.705 | 5.09E−02 | 5 | 19 |
| LNU813 | 0.730 | 9.98E−02 | 6 | 10 | LNU813 | 0.842 | 3.53E−02 | 6 | 9 |
| LNU813 | 0.879 | 2.10E−02 | 6 | 5 | LNU813 | 0.941 | 5.07E−03 | 6 | 6 |
| LNU813 | 0.708 | 1.16E−01 | 6 | 15 | LNU813 | 0.708 | 1.15E−02 | 6 | 19 |
| LNU813 | 0.733 | 9.77E−02 | 6 | 1 | LNU813 | 0.727 | 1.73E−02 | 3 | 10 |
| LNU813 | 0.766 | 9.82E−03 | 3 | 9 | LNU813 | 0.843 | 1.72E−02 | 8 | 13 |
| LNU813 | 0.726 | 6.48E−02 | 7 | 13 | LNU813 | 0.702 | 5.21E−02 | 7 | 8 |
| LNU813 | 0.746 | 5.42E−02 | 4 | 6 | LNU813 | 0.832 | 3.97E−02 | 1 | 19 |
| LNU814 | 0.923 | 3.02E−03 | 1 | 2 | LNU814 | 0.752 | 5.12E−02 | 1 | 1 |
| LNU814 | 0.713 | 7.21E−02 | 1 | 16 | LNU814 | 0.873 | 4.67E−03 | 5 | 13 |
| LNU814 | 0.786 | 2.07E−02 | 5 | 19 | LNU814 | 0.777 | 6.88E−02 | 6 | 18 |
| LNU814 | 0.850 | 3.20E−02 | 6 | 4 | LNU814 | 0.776 | 6.94E−02 | 6 | 8 |
| LNU814 | 0.777 | 6.88E−02 | 6 | 14 | LNU814 | 0.703 | 1.20E−01 | 6 | 20 |
| LNU814 | 0.897 | 1.54E−02 | 6 | 6 | LNU814 | 0.881 | 2.04E−02 | 6 | 15 |
| LNU814 | 0.808 | 5.18E−02 | 6 | 19 | LNU814 | 0.777 | 6.88E−02 | 6 | 2 |
| LNU814 | 0.777 | 6.88E−02 | 6 | 21 | LNU814 | 0.833 | 3.95E−02 | 6 | 16 |
| LNU814 | 0.785 | 3.64E−02 | 8 | 13 | LNU814 | 0.752 | 3.14E−02 | 8 | 10 |
| LNU814 | 0.727 | 4.08E−02 | 8 | 4 | LNU814 | 0.873 | 1.03E−02 | 7 | 13 |
| LNU814 | 0.799 | 1.73E−02 | 7 | 11 | LNU814 | 0.826 | 2.21E−02 | 7 | 19 |
| LNU814 | 0.766 | 2.67E−02 | 7 | 2 | LNU814 | 0.774 | 2.43E−02 | 2 | 10 |
| LNU814 | 0.802 | 3.02E−02 | 4 | 5 | LNU814 | 0.729 | 6.28E−02 | 4 | 11 |
| LNU814 | 0.742 | 5.61E−02 | 4 | 15 | LNU814 | 0.839 | 1.83E−02 | 4 | 19 |
| LNU814 | 0.703 | 7.78E−02 | 4 | 2 | LNU814 | 0.709 | 7.47E−02 | 4 | 16 |
| LNU815 | 0.775 | 7.03E−02 | 6 | 13 | LNU815 | 0.903 | 1.37E−02 | 6 | 11 |
| LNU816 | 0.830 | 2.08E−02 | 1 | 1 | LNU816 | 0.934 | 6.40E−03 | 6 | 3 |
| LNU816 | 0.815 | 4.09E−03 | 3 | 9 | LNU816 | 0.911 | 4.27E−03 | 8 | 13 |
| LNU816 | 0.753 | 3.10E−02 | 8 | 7 | LNU816 | 0.883 | 8.36E−03 | 7 | 13 |
| LNU816 | 0.910 | 1.71E−03 | 7 | 11 | LNU817 | 0.748 | 2.04E−02 | 5 | 6 |
| LNU817 | 0.737 | 9.47E−02 | 6 | 5 | LNU817 | 0.708 | 4.94E−02 | 2 | 10 |
| LNU817 | 0.792 | 1.92E−02 | 2 | 4 | LNU817 | 0.916 | 1.41E−03 | 2 | 5 |
| LNU817 | 0.893 | 2.82E−03 | 2 | 6 | LNU817 | 0.775 | 4.09E−02 | 4 | 6 |
| LNU818 | 0.878 | 9.37E−03 | 1 | 8 | LNU818 | 0.844 | 8.44E−03 | 5 | 13 |
| LNU818 | 0.705 | 3.40E−02 | 5 | 11 | LNU818 | 0.910 | 1.19E−02 | 6 | 18 |
| LNU818 | 0.760 | 7.98E−02 | 6 | 4 | LNU818 | 0.709 | 1.15E−01 | 6 | 8 |
| LNU818 | 0.910 | 1.19E−02 | 6 | 14 | LNU818 | 0.716 | 1.10E−01 | 6 | 20 |
| LNU818 | 0.771 | 7.29E−02 | 6 | 15 | LNU818 | 0.796 | 5.84E−02 | 6 | 19 |
| LNU818 | 0.742 | 9.11E−02 | 6 | 2 | LNU818 | 0.910 | 1.19E−02 | 6 | 21 |
| LNU818 | 0.814 | 4.89E−02 | 6 | 16 | LNU818 | 0.806 | 8.77E−03 | 3 | 13 |
| LNU818 | 0.705 | 5.08E−02 | 8 | 8 | LNU818 | 0.828 | 1.12E−02 | 7 | 8 |
| LNU818 | 0.882 | 8.69E−03 | 2 | 13 | LNU818 | 0.882 | 3.71E−03 | 2 | 11 |
| LNU818 | 0.776 | 4.04E−02 | 4 | 9 | LNU818 | 0.860 | 1.31E−02 | 4 | 8 |
| LNU819 | 0.712 | 1.12E−01 | 6 | 18 | LNU819 | 0.712 | 1.12E−01 | 6 | 14 |

TABLE 61-continued

Correlation between the expression level of selected genes of some embodiments of the invention in various tissues and the phenotypic performance under low N conditions across maize varieties

| Gene Name | R | P value | Exp. set | Corr. Set ID | Gene Name | R | P value | Exp. set | Corr. Set ID |
|---|---|---|---|---|---|---|---|---|---|
| LNU819 | 0.703 | 1.19E−01 | 6 | 15 | LNU819 | 0.889 | 1.78E−02 | 6 | 19 |
| LNU819 | 0.946 | 4.29E−03 | 6 | 1 | LNU819 | 0.712 | 1.12E−01 | 6 | 21 |
| LNU819 | 0.742 | 5.63E−02 | 4 | 17 | LNU819 | 0.729 | 6.32E−02 | 4 | 8 |
| LNU819 | 0.859 | 1.32E−02 | 4 | 7 | LNU819 | 0.742 | 5.63E−02 | 4 | 12 |
| LNU820 | 0.854 | 3.06E−02 | 6 | 10 | LNU820 | 0.748 | 8.71E−02 | 6 | 3 |
| LNU820 | 0.771 | 7.27E−02 | 6 | 5 | LNU820 | 0.738 | 3.67E−02 | 8 | 17 |
| LNU820 | 0.738 | 3.67E−02 | 8 | 12 | LNU820 | 0.783 | 2.16E−02 | 2 | 18 |
| LNU820 | 0.783 | 2.16E−02 | 2 | 14 | LNU820 | 0.826 | 1.15E−02 | 2 | 20 |
| LNU820 | 0.778 | 2.29E−02 | 2 | 15 | LNU820 | 0.783 | 2.16E−02 | 2 | 21 |
| LNU820 | 0.798 | 1.76E−02 | 2 | 16 | LNU821 | 0.705 | 1.18E−01 | 1 | 19 |
| LNU821 | 0.701 | 7.95E−02 | 1 | 2 | LNU821 | 0.835 | 3.85E−02 | 6 | 8 |
| LNU821 | 0.846 | 8.04E−03 | 2 | 18 | LNU821 | 0.846 | 8.04E−03 | 2 | 14 |
| LNU821 | 0.874 | 4.59E−03 | 2 | 20 | LNU821 | 0.818 | 1.31E−02 | 2 | 15 |
| LNU821 | 0.888 | 7.64E−03 | 2 | 19 | LNU821 | 0.922 | 1.13E−03 | 2 | 2 |
| LNU821 | 0.763 | 2.75E−02 | 2 | 1 | LNU821 | 0.846 | 8.04E−03 | 2 | 21 |
| LNU821 | 0.867 | 5.26E−03 | 2 | 16 | LNU821 | 0.953 | 8.86E−04 | 4 | 17 |
| LNU821 | 0.953 | 8.86E−04 | 4 | 12 | LNU822 | 0.727 | 6.41E−02 | 8 | 19 |
| LNU822 | 0.795 | 3.24E−02 | 4 | 17 | LNU822 | 0.795 | 3.24E−02 | 4 | 12 |
| LNU823 | 0.832 | 2.02E−02 | 1 | 17 | LNU823 | 0.712 | 7.28E−02 | 1 | 9 |
| LNU823 | 0.712 | 7.29E−02 | 1 | 3 | LNU823 | 0.710 | 7.38E−02 | 1 | 5 |
| LNU823 | 0.926 | 2.77E−03 | 1 | 7 | LNU823 | 0.832 | 2.02E−02 | 1 | 12 |
| LNU823 | 0.710 | 3.23E−02 | 5 | 10 | LNU823 | 0.770 | 9.19E−03 | 3 | 3 |
| LNU823 | 0.735 | 3.79E−02 | 2 | 3 | LNU823 | 0.842 | 8.65E−03 | 2 | 7 |
| LNU823 | 0.713 | 7.21E−02 | 4 | 4 | LNU823 | 0.704 | 7.75E−02 | 4 | 7 |
| LNU824 | 0.769 | 4.32E−02 | 1 | 18 | LNU824 | 0.757 | 4.88E−02 | 1 | 4 |
| LNU824 | 0.769 | 4.32E−02 | 1 | 14 | LNU824 | 0.740 | 5.71E−02 | 1 | 15 |
| LNU824 | 0.800 | 5.60E−02 | 1 | 19 | LNU824 | 0.774 | 4.10E−02 | 1 | 2 |
| LNU824 | 0.784 | 3.71E−02 | 1 | 1 | LNU824 | 0.769 | 4.32E−02 | 1 | 21 |
| LNU824 | 0.746 | 5.40E−02 | 1 | 16 | LNU824 | 0.791 | 1.12E−02 | 5 | 9 |
| LNU824 | 0.714 | 3.07E−02 | 5 | 4 | LNU824 | 0.758 | 4.85E−02 | 8 | 19 |
| LNU824 | 0.703 | 5.17E−02 | 2 | 17 | LNU824 | 0.835 | 9.93E−03 | 2 | 4 |
| LNU824 | 0.877 | 4.25E−03 | 2 | 5 | LNU824 | 0.889 | 3.12E−03 | 2 | 6 |
| LNU824 | 0.703 | 5.17E−02 | 2 | 12 | LNU824 | 0.786 | 3.60E−02 | 4 | 13 |
| LNU824 | 0.846 | 1.65E−02 | 4 | 11 | LNU825 | 0.800 | 3.06E−02 | 1 | 8 |
| LNU825 | 0.916 | 3.70E−03 | 8 | 13 | LNU825 | 0.885 | 3.45E−03 | 8 | 11 |
| LNU825 | 0.729 | 4.03E−02 | 7 | 8 | LNU825 | 0.908 | 4.75E−03 | 2 | 13 |
| LNU825 | 0.804 | 1.62E−02 | 2 | 11 | LNU825 | 0.740 | 5.74E−02 | 4 | 17 |
| LNU825 | 0.740 | 5.74E−02 | 4 | 12 | LNU828 | 0.990 | 1.44E−04 | 6 | 5 |
| LNU828 | 0.823 | 4.40E−02 | 6 | 6 | LNU828 | 0.721 | 1.06E−01 | 6 | 15 |
| LNU829 | 0.805 | 2.91E−02 | 4 | 8 | LNU830 | 0.762 | 2.78E−02 | 5 | 19 |
| LNU830 | 0.748 | 8.74E−02 | 6 | 7 | LNU831 | 0.939 | 5.45E−03 | 1 | 13 |
| LNU831 | 0.715 | 7.09E−02 | 1 | 11 | LNU831 | 0.904 | 2.03E−03 | 5 | 13 |
| LNU831 | 0.757 | 1.81E−02 | 5 | 11 | LNU831 | 0.702 | 7.90E−02 | 8 | 13 |
| LNU831 | 0.894 | 6.66E−03 | 2 | 13 | LNU831 | 0.921 | 3.25E−03 | 4 | 13 |
| LNU831 | 0.978 | 1.40E−04 | 4 | 11 | LNU832 | 0.825 | 2.23E−02 | 1 | 5 |
| LNU832 | 0.768 | 4.36E−02 | 1 | 20 | LNU832 | 0.866 | 1.18E−02 | 1 | 6 |
| LNU832 | 0.719 | 6.85E−02 | 1 | 15 | LNU832 | 0.801 | 3.05E−02 | 1 | 1 |
| LNU832 | 0.706 | 7.60E−02 | 1 | 16 | LNU832 | 0.895 | 1.61E−02 | 6 | 5 |
| LNU832 | 0.875 | 2.24E−02 | 6 | 6 | LNU832 | 0.856 | 3.21E−03 | 3 | 13 |
| LNU832 | 0.767 | 9.66E−03 | 3 | 9 | LNU832 | 0.827 | 3.13E−03 | 3 | 11 |
| LNU832 | 0.707 | 4.96E−02 | 8 | 5 | LNU832 | 0.746 | 3.36E−02 | 8 | 11 |
| LNU832 | 0.713 | 4.73E−02 | 8 | 6 | LNU832 | 0.797 | 1.79E−02 | 7 | 18 |
| LNU832 | 0.827 | 1.13E−02 | 7 | 4 | LNU832 | 0.725 | 4.20E−02 | 7 | 3 |
| LNU832 | 0.893 | 2.85E−03 | 7 | 5 | LNU832 | 0.797 | 1.79E−02 | 7 | 14 |
| LNU832 | 0.829 | 1.09E−02 | 7 | 20 | LNU832 | 0.944 | 4.10E−04 | 7 | 6 |
| LNU832 | 0.839 | 9.28E−03 | 7 | 15 | LNU832 | 0.797 | 1.79E−02 | 7 | 21 |
| LNU832 | 0.817 | 1.33E−02 | 7 | 16 | LNU832 | 0.809 | 1.51E−02 | 2 | 9 |
| LNU832 | 0.734 | 3.80E−02 | 2 | 4 | LNU832 | 0.717 | 4.54E−02 | 2 | 11 |
| LNU832 | 0.751 | 3.17E−02 | 2 | 6 | LNU833 | 0.778 | 3.96E−02 | 1 | 10 |
| LNU833 | 0.813 | 2.61E−02 | 1 | 5 | LNU833 | 0.765 | 4.51E−02 | 1 | 11 |
| LNU833 | 0.746 | 5.44E−02 | 1 | 6 | LNU833 | 0.873 | 1.02E−02 | 1 | 1 |
| LNU833 | 0.776 | 6.99E−02 | 6 | 8 | LNU833 | 0.738 | 9.37E−02 | 6 | 11 |
| LNU833 | 0.853 | 1.46E−02 | 7 | 13 | LNU833 | 0.904 | 2.03E−03 | 7 | 11 |
| LNU833 | 0.715 | 4.62E−02 | 2 | 20 | LNU833 | 0.738 | 3.66E−02 | 2 | 11 |
| LNU833 | 0.715 | 4.63E−02 | 2 | 16 | LNU833 | 0.745 | 5.46E−02 | 4 | 9 |
| LNU833 | 0.836 | 1.92E−02 | 4 | 8 | LNU834 | 0.820 | 2.41E−02 | 1 | 18 |
| LNU834 | 0.737 | 5.87E−02 | 1 | 10 | LNU834 | 0.871 | 1.07E−02 | 1 | 17 |
| LNU834 | 0.810 | 2.71E−02 | 1 | 9 | LNU834 | 0.722 | 6.72E−02 | 1 | 4 |
| LNU834 | 0.819 | 2.43E−02 | 1 | 3 | LNU834 | 0.805 | 2.90E−02 | 1 | 5 |
| LNU834 | 0.894 | 6.67E−03 | 1 | 7 | LNU834 | 0.820 | 2.41E−02 | 1 | 14 |
| LNU834 | 0.750 | 5.23E−02 | 1 | 20 | LNU834 | 0.803 | 2.96E−02 | 1 | 6 |
| LNU834 | 0.869 | 1.10E−02 | 1 | 15 | LNU834 | 0.871 | 1.07E−02 | 1 | 12 |

TABLE 61-continued

Correlation between the expression level of selected genes of some embodiments of the invention in various tissues and the phenotypic performance under low N conditions across maize varieties

| Gene Name | R | P value | Exp. set | Corr. Set ID | Gene Name | R | P value | Exp. set | Corr. Set ID |
|---|---|---|---|---|---|---|---|---|---|
| LNU834 | 0.886 | 1.88E−02 | 1 | 19 | LNU834 | 0.805 | 2.88E−02 | 1 | 2 |
| LNU834 | 0.724 | 6.61E−02 | 1 | 1 | LNU834 | 0.820 | 2.41E−02 | 1 | 21 |
| LNU834 | 0.852 | 1.49E−02 | 1 | 16 | LNU834 | 0.927 | 7.87E−03 | 6 | 18 |
| LNU834 | 0.846 | 3.38E−02 | 6 | 4 | LNU834 | 0.927 | 7.87E−03 | 6 | 14 |
| LNU834 | 0.831 | 4.03E−02 | 6 | 15 | LNU834 | 0.879 | 2.12E−02 | 6 | 19 |
| LNU834 | 0.758 | 8.05E−02 | 6 | 2 | LNU834 | 0.927 | 7.87E−03 | 6 | 21 |
| LNU834 | 0.839 | 3.69E−02 | 6 | 16 | LNU834 | 0.723 | 2.78E−02 | 3 | 13 |
| LNU834 | 0.743 | 1.37E−02 | 3 | 17 | LNU834 | 0.786 | 7.05E−03 | 3 | 9 |
| LNU834 | 0.711 | 2.12E−02 | 3 | 3 | LNU834 | 0.795 | 6.03E−03 | 3 | 11 |
| LNU834 | 0.743 | 1.37E−02 | 3 | 12 | LNU834 | 0.700 | 5.31E−02 | 8 | 10 |
| LNU834 | 0.927 | 9.31E−04 | 8 | 4 | LNU834 | 0.758 | 2.93E−02 | 8 | 5 |
| LNU834 | 0.855 | 6.81E−03 | 8 | 6 | LNU834 | 0.775 | 2.38E−02 | 7 | 7 |
| LNU834 | 0.760 | 2.87E−02 | 7 | 11 | LNU834 | 0.933 | 2.14E−03 | 2 | 13 |
| LNU834 | 0.748 | 3.29E−02 | 2 | 17 | LNU834 | 0.765 | 2.69E−02 | 2 | 9 |
| LNU834 | 0.883 | 3.63E−03 | 2 | 4 | LNU834 | 0.851 | 7.38E−03 | 2 | 5 |
| LNU834 | 0.850 | 7.48E−03 | 2 | 6 | LNU834 | 0.748 | 3.29E−02 | 2 | 12 |
| LNU834 | 0.822 | 2.31E−02 | 4 | 13 | LNU834 | 0.990 | 1.73E−05 | 4 | 11 |
| LNU835 | 0.867 | 1.16E−02 | 1 | 8 | LNU835 | 0.710 | 7.37E−02 | 1 | 20 |
| LNU835 | 0.822 | 4.45E−02 | 6 | 11 | LNU835 | 0.754 | 1.89E−02 | 3 | 13 |
| LNU835 | 0.892 | 6.97E−03 | 8 | 13 | LNU835 | 0.973 | 4.88E−05 | 8 | 11 |
| LNU835 | 0.739 | 3.61E−02 | 7 | 5 | LNU835 | 0.711 | 4.81E−02 | 7 | 20 |
| LNU835 | 0.788 | 2.01E−02 | 2 | 4 | LNU835 | 0.780 | 2.25E−02 | 2 | 6 |
| LNU835 | 0.881 | 8.78E−03 | 4 | 13 | LNU837 | 0.897 | 1.54E−02 | 1 | 19 |
| LNU837 | 0.776 | 4.02E−02 | 1 | 2 | LNU837 | 0.825 | 2.24E−02 | 1 | 1 |
| LNU838 | 0.941 | 1.55E−03 | 4 | 13 | LNU838 | 0.953 | 9.08E−04 | 4 | 11 |
| LNU839 | 0.820 | 2.41E−02 | 1 | 18 | LNU839 | 0.739 | 5.77E−02 | 1 | 17 |
| LNU839 | 0.722 | 6.72E−02 | 1 | 4 | LNU839 | 0.740 | 5.73E−02 | 1 | 3 |
| LNU839 | 0.805 | 2.90E−02 | 1 | 5 | LNU839 | 0.820 | 2.41E−02 | 1 | 14 |
| LNU839 | 0.750 | 5.23E−02 | 1 | 20 | LNU839 | 0.803 | 2.96E−02 | 1 | 6 |
| LNU839 | 0.869 | 1.10E−02 | 1 | 15 | LNU839 | 0.739 | 5.77E−02 | 1 | 12 |
| LNU839 | 0.886 | 1.88E−02 | 1 | 19 | LNU839 | 0.805 | 2.88E−02 | 1 | 2 |
| LNU839 | 0.724 | 6.61E−02 | 1 | 1 | LNU839 | 0.820 | 2.41E−02 | 1 | 21 |
| LNU839 | 0.852 | 1.49E−02 | 1 | 16 | LNU839 | 0.927 | 7.87E−03 | 6 | 18 |
| LNU839 | 0.846 | 3.38E−02 | 6 | 4 | LNU839 | 0.731 | 9.85E−02 | 6 | 8 |
| LNU839 | 0.927 | 7.87E−03 | 6 | 14 | LNU839 | 0.831 | 4.03E−02 | 6 | 15 |
| LNU839 | 0.879 | 2.12E−02 | 6 | 19 | LNU839 | 0.758 | 8.05E−02 | 6 | 2 |
| LNU839 | 0.927 | 7.87E−03 | 6 | 21 | LNU839 | 0.839 | 3.69E−02 | 6 | 16 |
| LNU839 | 0.723 | 2.78E−02 | 3 | 13 | LNU839 | 0.795 | 6.03E−03 | 3 | 11 |
| LNU839 | 0.760 | 2.87E−02 | 7 | 11 | LNU839 | 0.883 | 3.63E−03 | 2 | 4 |
| LNU839 | 0.851 | 7.38E−03 | 2 | 5 | LNU839 | 0.850 | 7.48E−03 | 2 | 6 |
| LNU839 | 0.822 | 2.31E−02 | 4 | 13 | LNU839 | 0.752 | 5.11E−02 | 4 | 9 |
| LNU839 | 0.930 | 2.40E−03 | 4 | 8 | LNU839 | 0.990 | 1.73E−05 | 4 | 11 |
| LNU840 | 0.701 | 5.28E−02 | 7 | 9 | LNU841 | 0.843 | 3.50E−02 | 6 | 13 |
| LNU841 | 0.737 | 3.69E−02 | 8 | 8 | LNU841 | 0.929 | 2.48E−03 | 7 | 13 |
| LNU841 | 0.808 | 1.54E−02 | 7 | 11 | LNU843 | 0.701 | 7.94E−02 | 1 | 18 |
| LNU843 | 0.871 | 1.07E−02 | 1 | 10 | LNU843 | 0.890 | 7.22E−03 | 1 | 17 |
| LNU843 | 0.787 | 3.58E−02 | 1 | 9 | LNU843 | 0.803 | 2.97E−02 | 1 | 3 |
| LNU843 | 0.821 | 2.36E−02 | 1 | 7 | LNU843 | 0.701 | 7.94E−02 | 1 | 14 |
| LNU843 | 0.890 | 7.22E−03 | 1 | 12 | LNU843 | 0.701 | 7.94E−02 | 1 | 21 |
| LNU843 | 0.722 | 1.84E−02 | 3 | 10 | LNU844 | 0.745 | 8.95E−02 | 6 | 10 |
| LNU844 | 0.865 | 5.60E−03 | 8 | 7 | LNU844 | 0.765 | 2.69E−02 | 7 | 17 |
| LNU844 | 0.814 | 1.38E−02 | 7 | 7 | LNU844 | 0.765 | 2.69E−02 | 7 | 12 |
| LNU845 | 0.823 | 2.28E−02 | 1 | 18 | LNU845 | 0.706 | 7.65E−02 | 1 | 17 |
| LNU845 | 0.786 | 3.60E−02 | 1 | 9 | LNU845 | 0.746 | 5.42E−02 | 1 | 3 |
| LNU845 | 0.903 | 5.33E−03 | 1 | 5 | LNU845 | 0.823 | 2.28E−02 | 1 | 14 |
| LNU845 | 0.847 | 1.61E−02 | 1 | 20 | LNU845 | 0.840 | 1.81E−02 | 1 | 6 |
| LNU845 | 0.871 | 1.06E−02 | 1 | 15 | LNU845 | 0.706 | 7.65E−02 | 1 | 12 |
| LNU845 | 0.818 | 4.68E−02 | 1 | 19 | LNU845 | 0.879 | 9.12E−03 | 1 | 2 |
| LNU845 | 0.909 | 4.59E−03 | 1 | 1 | LNU845 | 0.823 | 2.28E−02 | 1 | 21 |
| LNU845 | 0.873 | 1.04E−02 | 1 | 16 | LNU845 | 0.818 | 4.64E−02 | 6 | 9 |
| LNU845 | 0.894 | 1.62E−02 | 6 | 7 | LNU845 | 0.705 | 2.28E−02 | 3 | 7 |
| LNU845 | 0.710 | 3.20E−02 | 3 | 19 | LNU845 | 0.785 | 7.12E−03 | 3 | 1 |
| LNU845 | 0.784 | 2.12E−02 | 8 | 17 | LNU845 | 0.839 | 9.14E−03 | 8 | 9 |
| LNU845 | 0.816 | 1.35E−02 | 8 | 8 | LNU845 | 0.740 | 3.58E−02 | 8 | 7 |
| LNU845 | 0.717 | 4.54E−02 | 8 | 20 | LNU845 | 0.784 | 2.12E−02 | 8 | 12 |
| LNU845 | 0.763 | 2.75E−02 | 7 | 9 | LNU845 | 0.762 | 2.79E−02 | 7 | 8 |
| LNU845 | 0.797 | 3.17E−02 | 4 | 5 | LNU845 | 0.703 | 7.81E−02 | 4 | 6 |
| LNU846 | 0.711 | 1.13E−01 | 6 | 10 | LNU846 | 0.791 | 6.08E−02 | 6 | 3 |
| LNU846 | 0.843 | 8.57E−03 | 8 | 17 | LNU846 | 0.881 | 3.86E−03 | 8 | 5 |
| LNU846 | 0.788 | 2.03E−02 | 8 | 6 | LNU846 | 0.843 | 8.57E−03 | 8 | 12 |
| LNU846 | 0.779 | 2.26E−02 | 7 | 10 | LNU846 | 0.701 | 5.25E−02 | 2 | 18 |
| LNU846 | 0.820 | 1.26E−02 | 2 | 10 | LNU846 | 0.845 | 8.19E−03 | 2 | 9 |

TABLE 61-continued

Correlation between the expression level of selected genes of some embodiments of the invention in various tissues and the phenotypic performance under low N conditions across maize varieties

| Gene Name | R | P value | Exp. set | Corr. Set ID | Gene Name | R | P value | Exp. set | Corr. Set ID |
|---|---|---|---|---|---|---|---|---|---|
| LNU846 | 0.832 | 1.05E−02 | 2 | 3 | LNU846 | 0.701 | 5.25E−02 | 2 | 14 |
| LNU846 | 0.724 | 4.25E−02 | 2 | 6 | LNU846 | 0.711 | 4.82E−02 | 2 | 15 |
| LNU846 | 0.701 | 5.25E−02 | 2 | 21 | | | | | |

Table 61. Provided are the correlations (R) between the expression levels yield improving genes and their homologs in various tissues [Expression (Exp) sets] and the phenotypic performance [yield, biomass, growth rate and/or vigor components (Correlation vector (Cor))] under low Nitrogen conditions across maize varieties.
P = p value.

Example 9

Production of Tomato Transcriptom and High Throughput Correlation Analysis Using 44K Tomato Oligonucleotide Micro-Array In order to produce a high throughput correlation analysis between NUE related phenotypes and gene expression, the present inventors utilized a Tomato oligonucleotide microarray, produced by Agilent Technologies [chem. (dot) agilent (dot) com/Scripts/PDS (dot) asp?1Page=50879]. The array oligonucleotide represents about 44,000 Tomato genes and transcripts. In order to define correlations between the levels of RNA expression with NUE, ABST, yield components or vigor related parameters various plant characteristics of 18 different Tomato varieties were analyzed.

Among them, 10 varieties encompassing the observed variance were selected for RNA expression analysis. The correlation between the RNA levels and the characterized parameters was analyzed using Pearson correlation test [davidmlane (dot) com/hyperstat/A34739 (dot) html].

Correlation of Tomato Varieties Across Ecotypes Grown Under Low Nitrogen, Drought and Regular Growth Conditions Experimental Procedures:

10 Tomato varieties were grown in 3 repetitive blocks, each containing 6 plants per plot were grown at net house. Briefly, the growing protocol was as follows:

1. Regular growth conditions: Tomato varieties were grown under normal conditions (4-6 Liters/m$^2$ of water per day and fertilized with NPK as recommended in protocols for commercial tomato production).

2. Low Nitrogen fertilization conditions: Tomato varieties were grown under normal conditions (4-6 Liters/m$^2$ per day and fertilized with NPK as recommended in protocols for commercial tomato production) until flower stage. At this time, Nitrogen fertilization was stopped.

3. Drought stress: Tomato variety was grown under normal conditions (4-6 Liters/m$^2$ per day) until flower stage. At this time, irrigation was reduced to 50% compared to normal conditions.

Plants were phenotyped on a daily basis following the standard descriptor of tomato (Table 63). Harvest was conducted while 50% of the fruits were red (mature). Plants were separated to the vegetative part and fruits, of them, 2 nodes were analyzed for additional inflorescent parameters such as size, number of flowers, and inflorescent weight. Fresh weight of all vegetative material was measured. Fruits were separated to colors (red vs. green) and in accordance with the fruit size (small, medium and large). Next, analyzed data was saved to text files and processed using the JMP statistical analysis software (SAS institute). Data parameters collected are summarized in Tables 64-70, hereinbelow.

Analyzed Tomato Tissues—

Two tissues at different developmental stages [flower and leaf], representing different plant characteristics, were sampled and RNA was extracted as described above. For convenience, each micro-array expression information tissue type has received a Set ID as summarized in Table 62 below.

TABLE 62

Tomato transcriptom expression sets

| Set ID | Expression Set |
|---|---|
| 1 | Tomato field/NUE/leaf |
| 2 | Tomato field/NUE/flower |
| 3 | Tomato field/Drought/leaf |
| 4 | Tomato field/Normal/leaf |
| 5 | Tomato field/Normal/flower |
| 6 | Tomato field/Drought/flower |
| 7 | Tomato field Drought leaf |
| 8 | Tomato field Drought flower |
| 9 | Tomato field NUE leaf |
| 10 | Tomato field NUE flower |
| 11 | Tomato field Normal leaf |
| 12 | Tomato field Normal flower |

Table 62: Provided are the identification (ID) letters of each of the tomato expression sets.

Table 63 provides the tomato correlated parameters (Vectors). The average for each of the measured parameter was calculated using the JMP software and values are summarized in Tables 64-70 below. Subsequent correlation analysis was conducted (Table 71). Results were integrated to the database.

TABLE 63

Tomato correlated parameters (vectors)

| Correlated parameter with | Correlation ID |
|---|---|
| 100 weight green fruit (Drought) [kg] | 1 |
| 100 weight green fruit (Low N) [kg] | 2 |
| 100 weight green fruit (Normal) [kg] | 3 |
| 100 weight red fruit (Drought) [kg] | 4 |
| 100 weight red fruit (Low N) [kg] | 5 |
| 100 weight red fruit (Normal) [kg] | 6 |
| Cluster Weight NUE/Normal [kg] | 7 |
| FW NUE/Normal [gr.] | 8 |
| FW drought/Normal [gr.] | 9 |
| FW/Plant (NUE) [gr.] | 10 |
| FW/Plant (Normal) [gr.] | 11 |
| FW/Plant Drought [gr.] | 12 |
| Fruit Drought/NUE [gr.] | 13 |

TABLE 63-continued

Tomato correlated parameters (vectors)

| Correlated parameter with | Correlation ID |
|---|---|
| Fruit NUE/Normal [gr.] | 14 |
| Fruit Yield Drought/Normal [gr.] | 15 |
| Fruit Yield/Plant (NUE) [gr.] | 16 |
| Fruit Yield/Plant Drought [gr.] | 17 |
| Fruit yield/Plant (Normal) [gr.] | 18 |
| HI [yield/yield + biomass] (Low N) | 19 |
| HI [yield/yield + biomass] (Normal) | 20 |
| Leaflet Length [cm] (Low N) [cm] | 21 |
| Leaflet Length [cm] (Normal) [cm] | 22 |
| Leaflet Length [cm]) (Drought) [cm] | 23 |
| Leaflet Width (Low N) [cm] | 24 |
| Leaflet Width (Normal) [cm] | 25 |
| Leaflet Width [cm] (Drought) [cm] | 26 |
| NUE [yield/SPAD] (Low N) | 27 |
| NUE [yield/SPAD] (Normal) | 28 |
| NUE2 [total biomass/SPAD] (Low N) | 29 |
| NUE2 [total biomass/SPAD] (Normal) | 30 |
| NUpE [biomass/SPAD] (Low N) | 31 |
| NUpE [biomass/SPAD] (Normal) | 32 |
| No flowers (NUE) | 33 |
| No flowers (Normal) | 34 |
| Num of Flower Drought/NUE | 35 |
| Num of Flower Drought/Normal | 36 |
| Num of flowers (Drought) | 37 |
| Num. Flowers NUE/Normal | 38 |
| RWC (Normal) [%] | 39 |
| RWC Drought [%] | 40 |
| RWC Drought/Normal [%] | 41 |
| RWC NUE [%] | 42 |
| RWC NUE/Normal [%] | 43 |
| SAPD 100% RWC NUE/Normal [SPAD unit] | 44 |
| SLA [leaf area/plant biomass] (Low N) | 45 |
| SLA [leaf area/plant biomass] (Normal) | 46 |
| SPAD (Normal) [SPAD unit] | 47 |
| SPAD 100% RWC (NUE) [SPAD unit] | 48 |
| SPAD 100% RWC (Normal) [SPAD unit] | 49 |
| SPAD NUE [SPAD unit] | 50 |
| SPAD NUE/Normal [SPAD unit] | 51 |
| Total Leaf Area [cm$^2$] (Low N) | 52 |
| Total Leaf Area [cm$^2$] (Normal) | 53 |
| Total Leaf Area [cm$^2$]) (Drought) | 54 |
| Weight Flower clusters (Normal) [gr.] | 55 |
| Weight clusters (flowers) (NUE) [gr.] | 56 |
| Weight flower clusters (Drought) [gr.] | 57 |
| Yield/SLA (Low N) | 58 |
| Yield/SLA (Normal) | 59 |
| Yield/total leaf area (Low N) | 60 |
| Yield/total leaf area (Normal) | 61 |
| average red fruit weight (NUE) [gr.] | 62 |
| average red fruit weight (Normal) [gr.] | 63 |
| average red fruit weight Drought [gr.] | 64 |
| flower cluster weight Drought/NUE [gr.] | 65 |
| flower cluster weight Drought/Normal [gr.] | 66 |
| red fruit weight Drought/Normal [gr.] | 67 |

Table 63. Provided are the tomato correlated parameters.
"gr." = grams;
"FW" = fresh weight;
"NUE" = nitrogen use efficiency;
"RWC" = relative water content;
"NUpE" = nitrogen uptake efficiency;
"SPAD" = chlorophyll levels;
"HI" = harvest index (vegetative weight divided on yield);
"SLA" = specific leaf area (leaf area divided by leaf dry weight).

Fruit Yield (grams)—At the end of the experiment [when 50% of the fruit were ripe (red)] all fruits from plots within blocks A-C were collected. The total fruits were counted and weighted. The average fruits weight was calculated by dividing the total fruit weight by the number of fruits.

Yield/SLA and Yield/total leaf area—Fruit yield divided by the specific leaf area or the total leaf area gives a measurement of the balance between reproductive and vegetative processes.

Plant Fresh Weight (grams)—At the end of the experiment [when 50% of the fruit were ripe (red)] all plants from plots within blocks A-C were collected. Fresh weight was measured (grams).

Inflorescence Weight (grams)—At the end of the experiment [when 50% of the fruits were ripe (red)] two inflorescence from plots within blocks A-C were collected. The inflorescence weight (gr.) and number of flowers per inflorescence were counted.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Water use efficiency (WUE)—can be determined as the biomass produced per unit transpiration. To analyze WUE, leaf relative water content was measured in control and transgenic plants. Fresh weight (FW) was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) was calculated according to the following Formula I [(FW−DW/TW−DW)×100] as described above.

Plants that maintain high relative water content (RWC) compared to control lines were considered more tolerant to drought than those exhibiting reduced relative water content.

Experimental Results

TABLE 64

Measured parameters in Tomato accessions under drought conditions

| line ID | Cor. ID 9 | 12 | 13 | 15 | 17 | 35 | 36 | 37 | 40 | 41 | 57 | 64 |
|---|---|---|---|---|---|---|---|---|---|---|---|---|
| Line-1 | 1.717 | 2.620 | 1.151 | 0.565 | 0.467 | 0.877 | 2.941 | 16.667 | 72.120 | 0.990 | 0.368 | 0.009 |
| Line-2 | 0.344 | 1.092 | 0.732 | 1.415 | 0.483 | 1.219 | 0.336 | 6.500 | 74.510 | 0.974 | 0.407 | 0.195 |
| Line-3 | 0.611 | 1.847 | 1.321 | 1.274 | 0.629 | 1.741 | 2.474 | 15.667 | 65.330 | 1.016 | 0.325 | 0.209 |
| Line-4 | 2.630 | 2.221 | 0.756 | 2.876 | 0.347 | 1.564 | 2.652 | 20.333 | 72.220 | 1.077 | 0.288 | 0.005 |
| Line-5 | 1.177 | 2.634 | 1.513 | 4.201 | 2.044 | 1.094 | 1.207 | 11.667 | 66.130 | 1.207 | 0.551 | 0.102 |
| Line-6 | 1.365 | 2.708 | 0.705 | 0.550 | 0.250 | 1.520 | 3.040 | 25.333 | 68.303 | 0.880 | 0.311 | 0.002 |
| Line-7 | 4.018 | 3.406 | 5.063 | 0.085 | 0.045 | 4.956 | 5.947 | 29.733 | 78.130 | 1.343 | 0.445 | 0.035 |
| Line-8 | 1.010 | 2.108 | 0.891 | 1.030 | 0.453 | 1.083 | 2.080 | 17.333 | 18.460 | 0.278 | 0.555 | 0.006 |

TABLE 64-continued

Measured parameters in Tomato accessions under drought conditions

| line ID | Cor. ID 9 | 12 | 13 | 15 | 17 | 35 | 36 | 37 | 40 | 41 | 57 | 64 |
|---|---|---|---|---|---|---|---|---|---|---|---|---|
| Line-9  | 0.608 | 1.948 | 0.671 | 1.392 | 0.292 | 0.978 | 1.467 | 14.667 | 73.210 | 1.131 | 0.304 | 0.005 |
| Line-10 | 0.640 | 1.763 | 2.171 | 3.280 | 1.017 | 4.944 | 4.238 | 29.667 | 62.500 | 0.831 | 0.315 | 0.005 |
| Line-11 | 0.950 | 1.721 | 0.377 | 0.906 | 0.600 | 0.882 | 1.667 | 15.000 | 67.210 | 1.015 | 0.308 | 0.005 |
| Line-12 | 0.510 | 1.923 | 1.273 | 2.618 | 0.494 | 0.795 | 1.292 | 10.333 | 75.760 | 1.199 | 0.311 | 0.012 |
| Line-13 | 1.168 | 2.206 | 0.842 | 0.319 | 0.272 | 2.115 | 3.438 | 18.333 | 62.820 | 1.107 | 8.360 | 0.005 |
| Line-14 | 1.938 | 3.731 | 1.512 | 2.484 | 0.679 | 1.286 | 1.500 | 12.000 | 70.690 | 1.966 | 0.288 | 0.006 |
| Line-15 | 0.352 | 0.754 | 0.984 | 0.405 | 0.140 | 1.605 | 2.652 | 20.333 | 55.750 | 0.718 | 0.342 | 0.303 |
| Line-16 | 1.063 | 1.757 | 1.337 | 1.619 | 0.529 | 1.900 | 1.407 | 12.667 | 75.220 | 0.752 | 0.441 | 0.138 |
| Line-17 | 0.208 | 0.626 | 0.384 | 1.763 | 0.554 | 1.357 | 1.188 | 12.667 | 63.680 | 1.008 | 0.268 | 0.040 |
| Line-18 | 0.483 | 1.109 | 0.837 | 1.424 | 0.414 | 1.417 | 1.259 | 11.333 | 62.310 | 0.829 | 0.426 | 0.089 |

Table 64: Provided are the values of each of the parameters (as described above) measured in Sorghum accessions (line ID) under drought growth conditions. Growth conditions are specified in the experimental procedure section.

TABLE 65

Additional Measured parameters in Tomato accessions under drought conditions

| line ID | Cor. ID 65 | 66 | 67 | 1 | 4 | 23 | 26 | 54 |
|---|---|---|---|---|---|---|---|---|
| Line-1  | 0.689  | 0.315 | 0.193  |         |         |         |         |         |
| Line-2  | 1.110  | 1.190 | 24.373 |         |         |         |         |         |
| Line-3  | 1.060  | 0.469 | 25.384 |         |         |         |         |         |
| Line-4  | 0.823  | 0.005 | 0.016  |         |         |         |         |         |
| Line-5  | 1.163  | 1.252 | 20.259 |         |         |         |         |         |
| Line-6  | 1.250  | 0.028 | 0.036  |         |         |         |         |         |
| Line-7  | 1.517  | 0.563 | 0.150  |         |         |         |         |         |
| Line-8  | 1.190  | 0.963 | 0.022  |         |         |         |         |         |
| Line-9  | 0.759  | 0.416 | 0.863  |         |         |         |         |         |
| Line-10 | 1.039  | 0.378 | 0.737  |         |         |         |         |         |
| Line-11 | 0.376  | 0.358 | 0.090  |         |         |         |         |         |
| Line-12 | 0.778  | 0.622 | 1.715  | 0.8     | 0.88667 | 5.1504  | 2.55142 | 337.63  |
| Line-13 | 24.115 | 8.196 | 0.171  | 0.28    | 0.34667 | 3.38139 | 2.04437 | 130.779 |
| Line-14 | 0.673  | 0.411 | 0.024  | 0.38    | 0.62667 | 7.13977 | 4.16522 | 557.927 |
| Line-15 | 0.967  | 0.907 | 10.501 | 0.63333 | 2.27    | 5.47615 | 3.08653 | 176.671 |
| Line-16 | 0.988  | 0.669 | 27.890 | 2.86    | 7.4     | 8.62307 | 4.69436 | 791.863 |
| Line-17 | 0.949  | 0.383 | 11.789 | 1.16    | 2.94    | 6.34602 | 3.86722 | 517.049 |
| Line-18 | 0.907  | 1.305 | 9.979  | 4.39667 | 11.6    | 6.77153 | 2.9104  | 832.265 |

Table 65: Provided are the values of each of the parameters (as described above) measured in Tomato accessions (line ID) under drought conditions. Growth conditions are specified in the experimental procedure section.

TABLE 66

Measured parameters in Tomato accessions under low nitrogen conditions

| line ID | Cor. ID 7 | 8 | 10 | 14 | 16 | 33 | 38 | 42 | 43 | 44 | 48 |
|---|---|---|---|---|---|---|---|---|---|---|---|
| Line-1  | 0.457 | 2.649 | 4.041 | 0.491 | 0.406 | 19.000 | 3.353 | 74.070  | 1.017 | 0.787 | 28.469 |
| Line-2  | 1.072 | 0.382 | 1.213 | 1.932 | 0.660 | 5.333  | 0.276 | 99.080  | 1.296 | 1.372 | 39.039 |
| Line-3  | 0.442 | 0.743 | 2.246 | 0.965 | 0.477 | 9.000  | 1.421 | 69.490  | 1.081 | 0.920 | 33.009 |
| Line-4  | 0.006 | 3.008 | 2.540 | 3.802 | 0.458 | 13.000 | 1.696 | 63.240  | 0.943 | 0.753 | 23.418 |
| Line-5  | 1.076 | 0.827 | 1.850 | 2.776 | 1.351 | 10.667 | 1.103 | 77.360  | 1.412 | 1.309 | 34.528 |
| Line-6  | 0.022 | 1.544 | 3.063 | 0.780 | 0.354 | 16.667 | 2.000 | 77.910  | 1.004 | 0.965 | 32.513 |
| Line-7  | 0.371 | 3.697 | 3.134 | 0.017 | 0.009 | 6.000  | 1.200 | 80.490  | 1.383 | 1.107 | 27.661 |
| Line-8  | 0.809 | 1.218 | 2.542 | 1.157 | 0.509 | 16.000 | 1.920 | 67.400  | 1.013 | 0.949 | 33.676 |
| Line-9  | 0.548 | 0.575 | 1.844 | 2.074 | 0.436 | 15.000 | 1.500 | 67.160  | 1.038 | 0.793 | 30.045 |
| Line-10 | 0.364 | 0.551 | 1.517 | 1.511 | 0.468 | 6.000  | 0.857 | 66.070  | 0.878 | 0.924 | 35.502 |
| Line-11 | 0.953 | 1.056 | 1.913 | 2.406 | 1.593 | 17.000 | 1.889 | 69.570  | 1.050 | 0.937 | 24.812 |
| Line-12 | 0.800 | 0.492 | 1.856 | 2.056 | 0.388 | 13.000 | 1.625 | 69.300  | 1.096 | 1.356 | 40.771 |
| Line-13 | 0.340 | 1.310 | 2.472 | 0.379 | 0.323 | 8.667  | 1.625 | 100.000 | 1.761 | 1.443 | 47.467 |

TABLE 66-continued

Measured parameters in Tomato accessions under low nitrogen conditions

| line ID | Cor. ID | | | | | | | | | | |
|---|---|---|---|---|---|---|---|---|---|---|---|
| | 7 | 8 | 10 | 14 | 16 | 33 | 38 | 42 | 43 | 44 | 48 |
| Line-14 | 0.611 | 1.361 | 2.621 | 1.642 | 0.449 | 9.333 | 1.167 | 57.660 | 1.603 | 1.502 | 26.064 |
| Line-15 | 0.938 | 0.506 | 1.084 | 0.412 | 0.143 | 12.667 | 1.652 | 90.790 | 1.170 | 1.046 | 35.378 |
| Line-16 | 0.677 | 0.705 | 1.166 | 1.211 | 0.396 | 6.667 | 0.741 | 68.000 | 0.680 | 0.562 | 30.600 |
| Line-17 | 0.404 | 0.306 | 0.921 | 4.587 | 1.442 | 9.333 | 0.875 | 59.650 | 0.944 | 1.484 | 38.971 |
| Line-18 | 1.439 | 0.474 | 1.088 | 1.700 | 0.495 | 8.000 | 0.889 | 72.170 | 0.961 | 0.843 | 37.456 |

Table 66: Provided are the values of each of the parameters (as described above) measured in Tomato accessions (Seed ID) under low nitrogen growth conditions. Growth conditions are specified in the experimental procedure section.

TABLE 67

Additional measured parameters in Tomato accessions under low nitrogen conditions

| line ID | Cor. ID | | | | | | | | | | |
|---|---|---|---|---|---|---|---|---|---|---|---|
| | 50 | 51 | 56 | 62 | 2 | 19 | 21 | 24 | 27 | 29 | 31 |
| Line-1 | 38.400 | 0.773 | 0.533 | 0.024 | 0.87 | 0.0912 | 6.39865 | 3.46688 | 0.01425 | 0.15619 | 0.14195 |
| Line-2 | 39.400 | 1.059 | 0.367 | 0.191 | 3.66333 | 0.35231 | 5.92027 | 1.97373 | 0.01691 | 0.04799 | 0.03108 |
| Line-3 | 47.500 | 0.851 | 0.307 | 0.006 | 0.56667 | 0.1751 | 3.68636 | 1.78501 | 0.01444 | 0.08247 | 0.06803 |
| Line-4 | 37.000 | 0.797 | 0.350 | 0.005 | 0.37 | 0.15286 | 5.42713 | 2.55198 | 0.01957 | 0.12803 | 0.10846 |
| Line-5 | 44.600 | 0.925 | 0.473 | 0.096 | 3.40333 | 0.42208 | 6.95119 | 3.51776 | 0.03913 | 0.09271 | 0.05358 |
| Line-6 | 41.700 | 0.961 | 0.249 | 0.004 | 0.68333 | 0.10371 | 3.73374 | 1.73101 | 0.0109 | 0.10512 | 0.09422 |
| Line-7 | 34.400 | 0.802 | 0.293 | 0.006 | 0.45333 | 0.00283 | 4.38515 | 1.87221 | 0.00032 | 0.11364 | 0.11332 |
| Line-8 | 50.000 | 0.938 | 0.467 | 0.007 | 0.47333 | 0.16679 | 6.72386 | 3.54186 | 0.01511 | 0.0906 | 0.07549 |
| Line-9 | 44.700 | 0.764 | 0.400 | 0.006 | 0.54 | 0.19103 | 6.65657 | 3.27815 | 0.0145 | 0.07589 | 0.06139 |
| Line-10 | 53.700 | 1.051 | 0.303 | 0.013 | 0.39333 | 0.23594 | 4.38654 | 2.5225 | 0.01319 | 0.05591 | 0.04272 |
| Line-11 | 35.700 | 0.893 | 0.820 | 0.021 | 0.97 | 0.45446 | 3.90107 | 2.60788 | 0.06422 | 0.1413 | 0.07709 |
| Line-12 | 58.800 | 1.235 | 0.400 | 0.005 | 0.91333 | 0.17306 | 5.29057 | 2.61233 | 0.00952 | 0.05504 | 0.04551 |
| Line-13 | 47.500 | 0.820 | 0.347 | 0.006 | 0.36333 | 0.11548 | 6.31683 | 3.57772 | 0.0068 | 0.05888 | 0.05208 |
| Line-14 | 45.200 | 0.936 | 0.428 | 0.047 | 0.34667 | 0.14622 | 5.1126 | 2.5642 | 0.01722 | 0.11779 | 0.10056 |
| Line-15 | 39.000 | 0.894 | 0.353 | 0.357 | 0.56667 | 0.11634 | 4.72494 | 2.48302 | 0.00404 | 0.03469 | 0.03065 |
| Line-16 | 45.000 | 0.826 | 0.447 | 0.037 | 4.38333 | 0.25338 | 6.83245 | 3.43048 | 0.01293 | 0.05102 | 0.03809 |
| Line-17 | 65.300 | 1.570 | 0.283 | 0.626 | 2.02 | 0.61025 | 7.09701 | 3.29874 | 0.03701 | 0.06064 | 0.02364 |
| Line-18 | 51.900 | 0.878 | 0.470 | | 8.13 | 0.31274 | 8.21338 | 3.68939 | 0.01322 | 0.04226 | 0.02904 |

Table 67: Provided are the values of each of the parameters (as described above) measured in Tomato accessions (Seed ID) under low nitrogen growth conditions. Growth conditions are specified in the experimental procedure section.

TABLE 68

Additional measured parameters in Tomato accessions under low nitrogen conditions

| line ID/ Cor. ID | 45 | 52 | 58 | 60 | 5 |
|---|---|---|---|---|---|
| Line-1 | 140.044 | 565.932 | 0.0029 | 0.00072 | 1.06 |
| Line-2 | 317.118 | 384.77 | 0.00208 | 0.00172 | 6.86667 |
| Line-3 | 131.293 | 294.827 | 0.00363 | 0.00162 | 0.64667 |
| Line-4 | 148.817 | 377.995 | 0.00308 | 0.00121 | 0.53 |
| Line-5 | 257.51 | 476.393 | 0.00525 | 0.00284 | 7.17333 |
| Line-6 | 64.3367 | 197.085 | 0.00551 | 0.0018 | 0.44 |
| Line-7 | 144.599 | 453.236 | 6.1E-05 | 2E-05 | |
| Line-8 | 246.05 | 625.515 | 0.00207 | 0.00081 | 0.55333 |
| Line-9 | 405.548 | 748.01 | 0.00107 | 0.00058 | 0.74667 |
| Line-10 | 299.316 | 453.962 | 0.00156 | 0.00103 | 0.58 |
| Line-11 | 86.1901 | 164.853 | 0.01849 | 0.00967 | 1.26667 |
| Line-12 | 182.319 | 338.303 | 0.00213 | 0.00115 | 1.34 |

TABLE 68-continued

Additional measured parameters in Tomato accessions under low nitrogen conditions

| line ID/ Cor. ID | 45 | 52 | 58 | 60 | 5 |
|---|---|---|---|---|---|
| Line-13 | 160.178 | 395.995 | 0.00202 | 0.00082 | 0.52 |
| Line-14 | 90.0951 | 236.149 | 0.00498 | 0.0019 | 0.57333 |
| Line-15 | 160.99 | 174.585 | 0.00089 | 0.00082 | 0.94333 |
| Line-16 | 379.028 | 441.778 | 0.00104 | 0.0009 | 6.17 |
| Line-17 | 531.079 | 489.183 | 0.00272 | 0.00295 | 3.67333 |
| Line-18 | 650.684 | 707.8 | 0.00076 | 0.0007 | 11.325 |

Table 68: Provided are the values of each of the parameters (as described above) measured in Tomato accessions (Seed ID) under low nitrogen growth conditions. Growth conditions are specified in the experimental procedure section.

TABLE 69

Measured parameters in Tomato accessions under normal conditions

| | Cor. ID | | | | | | | | | |
|---|---|---|---|---|---|---|---|---|---|---|
| line ID | 11 | 18 | 34 | 39 | 47 | 49 | 55 | 63 | 20 | 28 |
| Line-1 | 1.526 | 0.826 | 5.667 | 72.830 | 49.700 | 36.170 | 1.167 | 0.048 | 0.351 | 0.017 |
| Line-2 | 3.174 | 0.342 | 19.333 | 76.470 | 37.200 | 28.447 | 0.342 | 0.008 | 0.097 | 0.009 |
| Line-3 | 3.022 | 0.494 | 6.333 | 64.290 | 55.800 | 35.893 | 0.693 | 0.008 | 0.140 | 0.009 |
| Line-4 | 0.844 | 0.121 | 7.667 | 67.070 | 46.400 | 31.085 | 56.348 | 0.286 | 0.125 | 0.003 |
| Line-5 | 2.238 | 0.487 | 9.667 | 54.790 | 48.200 | 26.384 | 0.440 | 0.005 | 0.179 | 0.010 |
| Line-6 | 1.984 | 0.454 | 8.333 | 77.610 | 43.400 | 33.684 | 11.313 | 0.054 | 0.186 | 0.010 |
| Line-7 | 0.848 | 0.529 | 5.000 | 58.180 | 42.900 | 24.979 | 0.790 | 0.231 | 0.384 | 0.012 |
| Line-8 | 2.088 | 0.440 | 8.333 | 66.510 | 53.300 | 35.472 | 0.577 | 0.290 | 0.174 | 0.008 |
| Line-9 | 3.206 | 0.210 | 10.000 | 64.710 | 58.500 | 37.875 | 0.730 | 0.006 | 0.061 | 0.004 |
| Line-10 | 2.754 | 0.310 | 7.000 | 75.250 | 51.100 | 38.426 | 0.833 | 0.007 | 0.101 | 0.006 |
| Line-11 | 1.811 | 0.662 | 9.000 | 66.230 | 40.000 | 26.494 | 0.860 | 0.058 | 0.268 | 0.017 |
| Line-12 | 3.770 | 0.189 | 8.000 | 63.210 | 47.600 | 30.066 | 0.500 | 0.007 | 0.048 | 0.004 |
| Line-13 | 1.888 | 0.852 | 5.333 | 56.770 | 57.900 | 32.889 | 1.020 | 0.026 | 0.311 | 0.015 |
| Line-14 | 1.926 | 0.273 | 8.000 | 35.960 | 48.300 | 17.354 | 0.700 | 0.261 | 0.124 | 0.006 |
| Line-15 | 2.143 | 0.347 | 7.667 | 77.620 | 43.600 | 33.818 | 0.377 | 0.029 | 0.139 | 0.008 |
| Line-16 | 1.652 | 0.327 | 9.000 | 100.000 | 54.500 | 54.467 | 0.660 | 0.005 | 0.165 | 0.006 |
| Line-17 | 3.011 | 0.314 | 10.667 | 63.160 | 41.600 | 26.253 | 0.700 | 0.003 | 0.095 | 0.008 |
| Line-18 | 2.294 | 0.291 | 9.000 | 75.130 | 59.100 | 44.427 | 0.327 | 0.009 | 0.113 | 0.005 |

Table 69: Provided are the values of each of the parameters (as described above) measured in Tomato accessions (lined ID) under normal growth conditions. Growth conditionsare specified in the experimental procedure section.

TABLE 70

Additional measured parameters in Tomato accessions under normal conditions

| | Cor. ID | | | | | | | | | |
|---|---|---|---|---|---|---|---|---|---|---|
| line ID | 30 | 32 | 3 | 6 | 22 | 25 | 46 | 53 | 59 | 61 |
| Line-1 | 0.047 | 0.031 | | | | | | | | |
| Line-2 | 0.095 | 0.085 | | | | | | | | |
| Line-3 | 0.063 | 0.054 | 0.55667 | 0.82333 | 6.34284 | 3.69046 | 140.989 | 426.099 | 0.0035 | 0.00116 |
| Line-4 | 0.021 | 0.018 | 3.05333 | 2.45667 | 7.98803 | 4.76756 | 689.665 | 582.384 | 0.00017 | 0.00021 |
| Line-5 | 0.057 | 0.046 | 0.24 | 0.50333 | 5.59331 | 3.43357 | 130.22 | 291.403 | 0.00374 | 0.00167 |
| Line-6 | 0.056 | 0.046 | 2.57667 | 2.76 | 7.69722 | 4.56061 | 299.118 | 593.583 | 0.00152 | 0.00077 |
| Line-7 | 0.032 | 0.020 | 6.32333 | 5.31667 | 7.84568 | 4.43534 | 1117.74 | 947.594 | 0.00047 | 0.00056 |
| Line-8 | 0.047 | 0.039 | 5.75333 | 5.24 | 6.21698 | 3.15039 | 111.77 | 233.352 | 0.00394 | 0.00189 |
| Line-9 | 0.058 | 0.055 | 0.37667 | 0.61 | 6.159 | 3.36888 | 106.294 | 340.731 | 0.00198 | 0.00062 |
| Line-10 | 0.060 | 0.054 | 0.29667 | 0.66 | 5.652 | 3.13112 | 123.139 | 339.111 | 0.00252 | 0.00091 |
| Line-11 | 0.062 | 0.045 | 1.95333 | 2.70333 | 4.39488 | 2.39632 | 104.986 | 190.141 | 0.00631 | 0.00348 |
| Line-12 | 0.083 | 0.079 | 2.53333 | 0.7 | 4.441.38 | 2.02436 | 111.88 | 421.789 | 0.00169 | 0.00045 |
| Line-13 | 0.047 | 0.033 | 1.42333 | 2.64 | 6.7696 | 3.8002 | 307.946 | 581.334 | 0.00277 | 0.00147 |
| Line-14 | 0.046 | 0.040 | 2.03 | 4.67 | 7.41586 | 3.7433 | 419.365 | 807.511 | 0.00065 | 0.00034 |
| Line-15 | 0.057 | 0.049 | 1.385 | 2.16667 | 6.70898 | 2.97523 | 365.812 | 784.056 | 0.00095 | 0.00044 |
| Line-16 | 0.036 | 0.030 | 2.27 | 0.49333 | 5.86525 | 3.21956 | 212.926 | 351.801 | 0.00153 | 0.00093 |
| Line-17 | 0.080 | 0.072 | 0.45 | 0.34333 | 4.16 | 2.08898 | 84.9441 | 255.776 | 0.0037 | 0.00123 |
| Line-18 | 0.044 | 0.039 | 0.41667 | 0.75333 | 10.2902 | 5.91228 | 469.874 | 1078.1 | 0.00062 | 0.00027 |

Table 70: Provided are the values of each of the parameters (as described above) measured in Tomato accessions (line ID) under normal growth conditions. Growth conditions are specified in the experimental procedure section.

TABLE 71

Correlation between the expression level of selected genes of some embodiments of the invention in various tissues and the phenotypic performance under normal and stress conditions across tomato ecotypes

| Gene Name | R | P value | Exp. set | Cor. Set ID | Gene Name | R | P value | Exp. set | Cor. Set ID |
|---|---|---|---|---|---|---|---|---|---|
| LNU971 | 0.830 | 5.67E−03 | 11 | 32 | LNU971 | 0.836 | 5.02E−03 | 11 | 30 |
| LNU971 | 0.730 | 1.66E−02 | 10 | 52 | LNU971 | 0.986 | 1.83E−07 | 1 | 55 |
| LNU972 | 0.787 | 1.18E−02 | 11 | 20 | LNU972 | 0.802 | 9.36E−03 | 11 | 28 |
| LNU972 | 0.782 | 2.19E−02 | 12 | 59 | LNU972 | 0.783 | 2.15E−02 | 12 | 61 |
| LNU973 | 0.793 | 6.26E−03 | 3 | 43 | LNU973 | 0.773 | 2.44E−02 | 12 | 3 |
| LNU973 | 0.825 | 3.31E−03 | 2 | 49 | LNU974 | 0.700 | 2.41E−02 | 10 | 52 |
| LNU975 | 0.739 | 1.45E−02 | 3 | 51 | LNU975 | 0.857 | 3.15E−03 | 3 | 62 |
| LNU975 | 0.927 | 1.12E−04 | 1 | 55 | LNU975 | 0.825 | 3.30E−03 | 1 | 63 |

Table 71. Provided are the correlations (R) between the expression levels yield improving genes and their homologs in various tissues [Expression (Exp) sets] and the phenotypic performance [yield, biomass, growth rate and/or vigor components (Correlation vector (Cor))] under normal and low nitrogen conditions across tomato ecotypes. P = p value.

Correlation of early vigor traits across collection of Tomato ecotypes under Low nitrogen, 300 mM NaCl, and normal growth conditions—Ten tomato hybrids were grown in 3 repetitive plots, each containing 17 plants, at a net house under semi-hydroponics conditions. Briefly, the growing protocol was as follows: Tomato seeds were sown in trays filled with a mix of vermiculite and peat in a 1:1 ratio. Following germination, the trays were transferred to the high salinity solution (300 mM NaCl in addition to the Full Hoagland solution), low nitrogen ("low N") solution (the amount of total nitrogen was reduced in 90% from the full Hoagland solution, final amount of 0.8 mM N), or at Normal growth solution (Full Hoagland containing 8 mM N solution, grown at 28±2° C.). Plants were grown at 28±2° C.

Full Hoagland solution consists of: $KNO_3$—0.808 grams/liter, $MgSO_4$—0.12 grams/liter, $KH_2PO_4$—0.172 grams/liter and 0.01% (volume/volume) of 'Super coratin' micro elements (Iron-EDDHA [ethylenediamine-N,N'-bis(2-hydroxyphenylacetic acid)]- 40.5 grams/liter; Mn—20.2 grams/liter; Zn 10.1 grams/liter; Co 1.5 grams/liter; and Mo 1.1 grams/liter), solution's pH should be 6.5-6.8.

Analyzed tomato tissues—All 10 selected Tomato varieties were sample per each treatment. Three tissues [leaves, meristems and flowers] were sampled and RNA was extracted as described above. For convenience, each microarray expression information tissue type has received a Set ID as summarized in Table 72 below.

TABLE 72

Tomato transcriptom experimental sets

| Set ID | Expression Set |
|---|---|
| 1 | Normal/leaf |
| 2 | Normal/root |
| 3 | Low N/leaf |
| 4 | Low N/root |
| 5 | Salinity/leaf |
| 6 | Salinity/root |
| 7 | Low N/root |
| 8 | Low N/leaf |
| 9 | Normal/root |
| 10 | Normal/leaf |
| 11 | Salinity/root |
| 12 | Salinity/leaf |

Table 72. Provided are the tomato transcriptom experimental sets.

Tomato vigor related parameters—following 5 weeks of growing, plant were harvested and analyzed for Leaf number, plant height, chlorophyll levels (SPAD units), different indices of nitrogen use efficiency (NUE) and plant biomass. Next, analyzed data was saved to text files and processed using the JMP statistical analysis software (SAS institute). Data parameters collected are summarized in Table 73, herein below.

TABLE 73

Tomato correlated parameters (vectors)

| Correlation ID | Correlated parameter with |
|---|---|
| 1 | Leaf No. Low N/Normal [number] |
| 2 | Leaf No. NaCl/Normal [number] |
| 3 | Leaf No. NaCl/Low N [number] |
| 4 | N level/Leaf [spad unit/leaf] |
| 5 | NUE roots (Root Biomass [DW]/SPAD) |
| 6 | NUE shoots (shoot Biomass [DW]/SPAD) |
| 7 | NUE total biomass (Total Biomass [DW]/SPAD) |
| 8 | Percent Root Biomass reduction compared to normal [%] |
| 9 | Percent Shoot Biomass reduction compared to normal[%] |
| 10 | Plant Height Low N/Normal [cm] |
| 11 | Plant Height NaCl/Low N [cm] |
| 12 | Plant Height NaCl/Normal [cm] |
| 13 | Plant biomass NaCl [cm] |
| 14 | Plant height Low N [cm] |
| 15 | Plant height NaCl [cm] |
| 16 | Plant height Normal [cm] |
| 17 | Root Biomass [DW]/SPAD |
| 18 | SPAD Low N/Normal [SPAD unit] |
| 19 | SPAD Low N [SPAD unit] |
| 20 | SPAD Normal [SPAD unit] |
| 21 | Shoot Biomass [DW]/SPAD |
| 22 | Shoot/Root |
| 23 | Total Biomass [Root + Shoot DW]/SPAD |
| 24 | height Normal |
| 25 | leaf No. Low N |
| 26 | leaf No. Normal |
| 27 | leaf No. NaCl |

Table 73. Provided are the tomato correlated parameters,.
"DW" = dry weight;
"cm" = centimeter.
"Leaf No." = leaf number.

Experimental Results 10 different Tomato varieties were grown and characterized for parameters as described above. The average for each of the measured parameter was calculated using the JMP software and values are summarized in Tables 74-77 below. Subsequent correlation analysis was conducted (Table 78). Follow, results were integrated to the database.

TABLE 74

Measured parameters in Tomato accessions under low nitrogen conditions

| Line | \multicolumn{9}{c}{Cor. ID} |
|---|---|---|---|---|---|---|---|---|---|
|  | 1 | 10 | 14 | 18 | 19 | 24 | 25 | 4 | 5 |
| Line-1 | 0.850 | 0.810 | 36.780 | 1.010 | 34.570 | 45.330 | 5.560 | 10.854 | 6.990 |
| Line-2 | 0.900 | 0.830 | 39.890 | 0.980 | 24.870 | 47.780 | 6.220 | 11.409 | 2.540 |
| Line-3 | 0.980 | 0.840 | 34.440 | 1.020 | 28.580 | 40.780 | 7.220 |  |  |
| Line-4 | 1.090 | 0.850 | 47.000 | 1.000 | 31.580 | 55.330 | 6.780 | 10.438 | 7.040 |
| Line-5 | 0.880 | 0.830 | 46.440 | 0.980 | 29.720 | 56.220 | 5.560 | 11.169 | 5.040 |
| Line-6 | 1.020 | 0.930 | 45.440 | 0.980 | 31.830 | 48.670 | 6.560 | 8.929 | 8.010 |
| Line-7 | 0.870 | 0.850 | 47.670 | 0.930 | 30.330 | 55.780 | 5.110 | 7.926 | 15.090 |
| Line-8 | 1.060 | 1.050 | 39.330 | 1.050 | 30.290 | 37.440 | 5.890 | 7.993 | 9.020 |
| Line-9 | 0.910 | 0.840 | 41.780 | 1.010 | 31.320 | 49.560 | 5.560 | 10.304 | 8.780 |
| Line-10 | 1.120 | 0.880 | 41.000 | 0.990 | 28.770 | 46.330 | 6.330 | 8.585 | 7.250 |
| Line-11 |  |  |  |  |  |  |  | 11.528 | 7.730 |
| Line-12 |  |  |  |  |  |  |  | 14.491 | 15.940 |

Table 74. Provided are the values of each of the parameters (as described above) measured in Tomato accessions (Line) under low nitrogen growth conditions. Growth conditions are specified in the experimental procedure section.

20

TABLE 75

Additional measured parameters in Tomato accessions under low nitrogen conditions

| Line | \multicolumn{8}{c}{Cor. ID} |
|---|---|---|---|---|---|---|---|---|
|  | 6 | 7 | 8 | 9 | 17 | 21 | 22 | 23 |
| Line-1 | 35.350 | 58.470 | 62.592 | 75.380 | 0.001 | 0.004 | 5.010 | 0.005 |
| Line-2 | 24.090 | 63.750 | 54.158 | 55.112 | 0.000 | 0.003 | 11.393 | 0.003 |
| Line-3 |  |  |  |  |  |  |  |  |
| Line-4 | 65.020 | 69.290 | 70.547 | 49.726 | 0.001 | 0.007 | 9.494 | 0.008 |
| Line-5 | 46.710 | 71.100 | 59.685 | 63.189 | 0.001 | 0.005 | 11.600 | 0.005 |
| Line-6 | 46.670 | 60.540 | 96.129 | 82.667 | 0.001 | 0.005 | 8.200 | 0.006 |
| Line-7 | 120.070 | 73.900 | 106.502 | 66.924 | 0.001 | 0.011 | 10.375 | 0.013 |
| Line-8 | 60.090 | 68.810 | 111.905 | 107.98 | 0.001 | 0.007 | 10.523 | 0.008 |
| Line-9 | 66.270 | 66.740 | 81.644 | 55.401 | 0.001 | 0.007 | 8.242 | 0.008 |
| Line-10 | 56.460 | 70.820 | 32.214 | 54.433 | 0.001 | 0.007 | 7.967 | 0.008 |
| Line-11 | 38.350 | 69.700 | 143.714 | 62.155 | 0.001 | 0.004 | 6.414 | 0.005 |
| Line-12 | 60.320 | 49.720 | 87.471 | 59.746 | 0.001 | 0.006 | 3.909 | 0.007 |

Table 75. Provided are the values of each of the parameters (as described above) measured in Tomato accessions (Line) under low nitrogen growth conditions. Growth conditions are specified in the experimental procedure section.

TABLE 76

Measured parameters in Tomato accessions under normal conditions

| Line | \multicolumn{11}{c}{Corr. ID} |
|---|---|---|---|---|---|---|---|---|---|---|---|
|  | 16 | 20 | 26 | 4 | 5 | 6 | 7 | 17 | 21 | 22 | 23 |
| Line-1 | 45.330 | 34.300 | 6.560 | 9.293 | 1.120 | 4.690 | 7.470 | 0.001 | 0.005 | 5.400 | 0.006 |
| Line-2 | 47.780 | 25.310 | 6.890 | 8.868 | 0.470 | 4.370 | 8.630 | 0.001 | 0.005 | 10.021 | 0.006 |
| Line-3 | 40.780 | 28.120 | 7.330 |  |  |  |  |  |  |  |  |
| Line-4 | 55.330 | 31.430 | 6.220 | 8.433 | 1.000 | 13.080 | 8.850 | 0.001 | 0.014 | 15.417 | 0.015 |
| Line-5 | 56.220 | 30.240 | 6.330 | 9.827 | 0.840 | 7.390 | 7.220 | 0.001 | 0.008 | 8.833 | 0.009 |
| Line-6 | 48.670 | 32.430 | 6.440 | 8.573 | 0.830 | 5.650 | 7.870 | 0.001 | 0.005 | 7.519 | 0.006 |
| Line-7 | 55.780 | 32.580 | 5.890 | 6.567 | 0.940 | 17.940 | 9.090 | 0.001 | 0.017 | 12.611 | 0.019 |
| Line-8 | 37.440 | 28.770 | 5.560 | 6.968 | 0.810 | 5.560 | 7.910 | 0.001 | 0.007 | 7.989 | 0.008 |
| Line-9 | 49.560 | 30.920 | 6.110 | 8.710 | 1.080 | 11.960 | 8.550 | 0.001 | 0.011 | 14.306 | 0.012 |
| Line-10 | 46.330 | 28.990 | 5.670 | 7.348 | 2.250 | 10.370 | 8.680 | 0.003 | 0.012 | 4.797 | 0.014 |
| Line-11 |  |  |  | 10.181 | 0.540 | 6.170 | 9.100 | 0.001 | 0.006 | 12.650 | 0.007 |
| Line-12 |  |  |  | 9.370 | 1.820 | 10.100 | 6.240 | 0.002 | 0.009 | 6.294 | 0.011 |

Table 76. Provided are the values of each of the parameters (as described above) measured in Tomato accessions (Line) under normal growth conditions. Growth conditions are specified in the experimental procedure section.

TABLE 77

Measured parameters in Tomato accessions under salinity conditions

| Line | Cor. ID | | | | | | | | | | |
|---|---|---|---|---|---|---|---|---|---|---|---|
| | 2 | 3 | 11 | 12 | 13 | 15 | 27 | 4 | 21 | 17 | 23 |
| Line-1 | 0.540 | 0.640 | 0.150 | 0.120 | 0.360 | 5.600 | 3.560 | 11.400 | 0.001 | 0.000 | 0.001 |
| Line-2 | 0.570 | 0.630 | 0.160 | 0.140 | 0.440 | 6.460 | 3.940 | 11.639 | 0.001 | 0.000 | 0.001 |
| Line-3 | 0.680 | 0.690 | 0.250 | 0.210 | 0.260 | 8.470 | 5.000 | | | | |
| Line-4 | 0.640 | 0.590 | 0.180 | 0.150 | 0.710 | 8.560 | 4.000 | 10.788 | 0.001 | 0.000 | 0.001 |
| Line-5 | 0.560 | 0.640 | 0.190 | 0.160 | 0.460 | 8.870 | 3.560 | 10.776 | 0.002 | 0.000 | 0.002 |
| Line-6 | 0.680 | 0.670 | 0.170 | 0.160 | 0.540 | 7.560 | 4.390 | 6.952 | 0.001 | 0.000 | 0.001 |
| Line-7 | 0.540 | 0.620 | 0.180 | 0.150 | 0.660 | 8.640 | 3.170 | 9.213 | 0.001 | 0.000 | 0.001 |
| Line-8 | 0.670 | 0.630 | 0.140 | 0.150 | 0.400 | 5.570 | 3.720 | 8.538 | 0.001 | 0.000 | 0.001 |
| Line-9 | 0.650 | 0.720 | 0.140 | 0.120 | 0.520 | 5.820 | 4.000 | 10.370 | 0.001 | 0.000 | 0.001 |
| Line-10 | 0.750 | 0.680 | 0.230 | 0.200 | 0.450 | 9.360 | 4.280 | 8.840 | 0.001 | | |
| Line-11 | | | | | | | | 10.434 | 0.001 | 0.000 | 0.001 |
| Line-12 | | | | | | | | 12.429 | 0.001 | 0.000 | 0.001 |

Table 77. Provided are the values of each of the parameters (as described above) measured in Tomato accessions (Line) under salinity growth conditions. Growth conditions are specified in the experimental procedure section.

TABLE 78

Correlation between the expression level of selected genes of some embodiments of the invention in various tissues and the phenotypic performance under normal and stress conditions across tomato ecotypes

| Gene Name | R | P value | Exp. set | Cor. Set ID | Gene Name | R | P value | Exp. set | Cor. Set ID |
|---|---|---|---|---|---|---|---|---|---|
| LNU971 | 0.729 | 4.01E-02 | 4 | 10 | LNU971 | 0.878 | 1.86E-03 | 4 | 9 |
| LNU971 | 0.845 | 4.12E-03 | 6 | 21 | LNU971 | 0.786 | 2.07E-02 | 6 | 23 |
| LNU971 | 0.736 | 2.38E-02 | 3 | 8 | LNU971 | 0.736 | 2.39E-02 | 8 | 8 |
| LNU972 | 0.843 | 4.32E-03 | 6 | 21 | LNU972 | 0.798 | 1.76E-02 | 6 | 23 |
| LNU972 | 0.817 | 7.24E-03 | 3 | 8 | LNU973 | 0.808 | 1.52E-02 | 3 | 10 |
| LNU973 | 0.716 | 2.99E-02 | 3 | 9 | LNU974 | 0.738 | 3.65E-02 | 1 | 20 |
| LNU974 | 0.724 | 2.73E-02 | 4 | 4 | LNU974 | 0.757 | 2.97E-02 | 4 | 1 |
| LNU974 | 0.730 | 2.56E-02 | 3 | 8 | LNU974 | 0.715 | 3.05E-02 | 7 | 4 |
| LNU974 | 0.737 | 2.34E-02 | 8 | 8 | LNU975 | 0.729 | 2.57E-02 | 9 | 4 |
| LNU975 | 0.773 | 1.45E-02 | 4 | 4 | LNU975 | 0.736 | 2.36E-02 | 3 | 8 |
| LNU975 | 0.729 | 2.58E-02 | 2 | 4 | LNU975 | 0.839 | 9.17E-03 | 2 | 26 |
| LNU975 | 0.778 | 1.36E-02 | 7 | 4 | | | | | |

Table 78. Provided are the correlations (R) between the expression levels yield improving genes and their homologs in various tissues [Expression (Exp) sets] and the phenotypic performance [yield, biomass, growth rate and/or vigor components (Correlation vector (Corr))] under normal and low nitrogen conditions across tomato ecotypes. P = p value.

Example 10

Production of Maize Transcriptom and High Throughput Correlation Analysis when Grown Under Normal and Defoliation Conditions Using 60K Maize Oligonucleotide Micro-Array To produce a high throughput correlation analysis, the present inventors utilized a Maize oligonucleotide microarray, produced by Agilent Technologies [chem. (dot) agilent (dot) com/Scripts/PDS (dot) asp?1Page=50879]. The array oligonucleotide represents about 60K Maize genes and transcripts designed based on data from Public databases (Example 1). To define correlations between the levels of RNA expression and yield, biomass components or vigor related parameters, various plant characteristics of 13 different Maize varieties were analyzed under normal conditions and defoliation treatment. Same varieties were subjected to RNA expression analysis. The correlation between the RNA levels and the characterized parameters was analyzed using Pearson correlation test [davidmlane (dot) com/hyperstat/A34739 (dot) html].

Experimental Procedures 13 maize varieties lines were grown in 6 repetitive plots, in field. Maize seeds were planted and plants were grown in the field using commercial fertilization and irrigation protocols. After silking 3 plots in every varieties line underwent the defoliation treatment. In this treatment all the leaves above the ear were removed. After the treatment all the plants were grown according to the same commercial fertilization and irrigation protocols.

Three tissues at flowering developmental (R1) stage including leaf (flowering—R1), stem (flowering—R1), and flowering meristem (flowering—R1) representing different plant characteristics, were sampled from treated and untreated plants. RNA was extracted as described in "GENERAL EXPERIMENTAL AND BIOINFORMATICS METHODS". For convenience, each micro-array expression information tissue type has received a Set ID as summarized in Tables 79-80 below.

TABLE 79

Tissues used for Maize transcriptom expression sets
(Under normal conditions)

| Expression Set | Set ID |
|---|---|
| Female meristem/Normal | 1 |
| leaf/Normal | 2 |
| stem/Normal | 3 |

Table 79: Provided are the identification (ID) number of each of the Maize expression sets.

TABLE 80

Tissues used for Maize transcriptom expression sets
(Under defoliation conditions)

| Expression Set | Set ID |
|---|---|
| Female meristem/Defoliation: | 1 |
| leaf/Defoliation | 2 |
| stem/Defoliation | 3 |

Table 80: Provided are the identification (ID) number of each of the Maize expression sets.

The following parameters were collected by imaging.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

1000 grain weight—At the end of the experiment all seeds from all plots were collected and weighed and the weight of 1000 was calculated.

Ear Area ($cm^2$)—At the end of the growing period 5 ears were, photographed and images were processed using the below described image processing system. The Ear area was measured from those images and was divided by the number of ears.

Ear Length and Ear Width (cm)—At the end of the growing period 6 ears were, photographed and images were processed using the below described image processing system. The Ear length and width (longest axis) was measured from those images and was divided by the number of ears.

Grain Area ($cm^2$)—At the end of the growing period the grains were separated from the ear. A sample of ~200 grains were weight, photographed and images were processed using the below described image processing system. The grain area was measured from those images and was divided by the number of grains.

Grain Length and Grain width (cm)—At the end of the growing period the grains were separated from the ear. A sample of ~200 grains were weight, photographed and images were processed using the below described image processing system. The sum of grain lengths/or width (longest axis) was measured from those images and was divided by the number of grains.

Grain Perimeter (cm)—At the end of the growing period the grains were separated from the ear. A sample of ~200 grains were weight, photographed and images were processed using the below described image processing system. The sum of grain perimeter was measured from those images and was divided by the number of grains.

Ear filled grain area ($cm^2$)—At the end of the growing period 5 ears were, photographed and images were processed using the below described image processing system. The Ear area filled with kernels was measured from those images and was divided by the number of Ears.

Filled per Whole Ear—was calculated as the length of the ear with grains out of the total ear.

Additional parameters were collected either by sampling 6 plants per plot or by measuring the parameter across all the plants within the plot.

Cob width [cm]—The diameter of the cob without grains was measured using a ruler.

Ear average weight [kg]—At the end of the experiment (when ears were harvested) total and 6 selected ears per plots were collected. The ears were weighted and the average ear per plant was calculated. The ear weight was normalized using the relative humidity to be 0%.

Plant height and Ear height—Plants were characterized for height at harvesting. In each measure, 6 plants were measured for their height using a measuring tape. Height was measured from ground level to top of the plant below the tassel. Ear height was measured from the ground level to the place were the main ear is located Ear row num—The number of rows per ear was counted.

Ear fresh weight per plant (GF)—During the grain filling period (GF) and total and 6 selected ears per plot were collected separately. The ears were weighted and the average ear weight per plant was calculated.

Ears dry weight—At the end of the experiment (when ears were harvested) total and 6 selected ears per plots were collected and weighted. The ear weight was normalized using the relative humidity to be 0%.

Ears fresh weight—At the end of the experiment (when ears were harvested) total and 6 selected ears per plots were collected and weighted.

Ears per plant—number of ears per plant were counted.

Grains weight (Kg.)—At the end of the experiment all ears were collected. Ears from 6 plants from each plot were separately threshed and grains were weighted.

Grains dry weight (Kg.)—At the end of the experiment all ears were collected. Ears from 6 plants from each plot were separately threshed and grains were weighted. The grain weight was normalized using the relative humidity to be 0%.

Grain weight per ear (Kg.)—At the end of the experiment all ears were collected. 5 ears from each plot were separately threshed and grains were weighted. The average grain weight per ear was calculated by dividing the total grain weight by the number of ears.

Leaves area per plant (GF) and (HD) [LAI]=Total leaf area of 6 plants in a plot his parameter was measured at two time points during the course of the experiment; at heading (HD) and during the grain filling period (GF). Measurement was performed using a Leaf area-meter at two time points in the course of the experiment; during the grain filling period and at the heading stage (VT).

Leaves fresh weight (GF) and (HD)—This parameter was measured at two time points during the course of the experiment; at heading (HD) and during the grain filling period (GF). Leaves used for measurement of the LAI were weighted.

Lower stem fresh weight (GF) (HD) and (H)—This parameter was measured at three time points during the course of the experiment: at heading (HD), during the grain filling period (GF) and at harvest (H). Lower internodes from at least 4 plants per plot were separated from the plant and weighted. The average internode weight per plant was calculated by dividing the total grain weight by the number of plants.

Lower stem length (GF) (HD) and (H)—This parameter was measured at three time points during the course of the experiment; at heading (HD), during the grain filling period (GF) and at harvest (H). Lower internodes from at least 4 plants per plot were separated from the plant and their length was measured using a ruler. The average internode length per plant was calculated by dividing the total grain weight by the number of plants.

Lower stem width (GF) (HD) and (H)—This parameter was measured at three time points during the course of the experiment: at heading (HD), during the grain filling period (GF) and at harvest (H). Lower internodes from at least 4 plants per plot were separated from the plant and their diameter was measured using a caliber. The average internode width per plant was calculated by dividing the total grain weight by the number of plants.

Plant height growth: the relative growth rate (RGR) of Plant Height was calculated using Formula III above.

SPAD—Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS).

Stem fresh weight (GF) and (HD)—This parameter was measured at two time points during the course of the experiment: at heading (HD) and during the grain filling period (GF). Stems of the plants used for measurement of the LAI were weighted.

Total dry matter was calculated using Formula XXXV.

Upper stem fresh weight (GF) (HD) and (H)—This parameter was measured at three time points during the course of the experiment; at heading (HD), during the grain filling period (GF) and at harvest (H). Upper internodes from at least 4 plants per plot were separated from the plant and weighted. The average internode weight per plant was calculated by dividing the total grain weight by the number of plants.

Upper stem length (GF) (HD) and (H)—This parameter was measured at three time points during the course of the experiment; at heading (HD), during the grain filling period (GF) and at harvest (H). Upper internodes from at least 4 plants per plot were separated from the plant and their length was measured using a ruler. The average internode length per plant was calculated by dividing the total grain weight by the number of plants.

Upper stem width (GF) (HD) and (H) (mm)—This parameter was measured at three time points during the course of the experiment; at heading (HD), during the grain filling period (GF) and at harvest (H). Upper internodes from at least 4 plants per plot were separated from the plant and their diameter was measured using a caliber. The average internode width per plant was calculated by dividing the total grain weight by the number of plants.

Vegetative dry weight (Kg.)—total weight of the vegetative portion of 6 plants (above ground excluding roots) after drying at 70° C. in oven for 48 hours weight by the number of plants.

Vegetative fresh weight (Kg.)—total weight of the vegetative portion of 6 plants (above ground excluding roots).

Node number—nodes on the stem were counted at the heading stage of plant development.

TABLE 81

Maize correlated parameters (vectors) under normal conditions and under defoliation

| Normal conditions | | Defoliation | |
|---|---|---|---|
| Correlated parameter with | Correlation ID | Correlated parameter with | Correlation ID |
| 1000 grains weight [g] | 1 | 1000 grains weight [g] | 1 |
| Cob width [mm] | 2 | Cob width [mm] | 2 |
| Ear Area [cm$^2$] | 3 | Ear Area [cm$^2$] | 3 |
| Ear Filled Grain Area [cm$^2$] | 4 | Ear Filled Grain Area [cm$^2$] | 4 |
| Ear Width [cm] | 5 | Ear Width [cm] | 5 |
| Ear avr weight [g] | 6 | Ear avr weight [g] | 6 |
| Ear height [cm] | 7 | Ear height [cm] | 7 |
| Ear length (feret's) [cm] | 8 | Ear length (feret's) [cm] | 8 |
| Ear row num | 9 | Ear row num | 9 |
| Ears FW per plant (GF) [g/plant] | 10 | Ears dry weight (SP) [g/plant] | 10 |
| Ears dry weight (SP) [kg] | 11 | Ears fresh weight (SP) [kg] | 11 |
| Ears fresh weight (SP) [kg] | 12 | Ears per plant (SP) [g/plant] | 12 |
| Ears per plant (SP) [g/plant] | 13 | Filled/Whole Ear [value] | 13 |
| Filled/Whole Ear [value] | 14 | Grain Perimeter [cm] | 14 |
| Grain Perimeter [cm] | 15 | Grain RH [%] | 15 |
| Grain RH [%] | 16 | Grain area [cm$^2$] | 16 |
| Grain area [cm$^2$] | 17 | Grain length [cm] | 17 |
| Grain length [cm] | 18 | Grain width [cm] | 18 |
| Grain width [cm] | 19 | Grains dry weight (SP) [kg] | 19 |
| Grains dry weight (SP) [kg] | 20 | Grains weight (SP) [kg] | 20 |
| Grains weight (SP) [kg] | 21 | Grains weight per ear (SP) [kg] | 21 |
| Grains weight per ear (SP) [kg] | 22 | Leaves FW (hd) [g] | 22 |
| Leaves FW (GF) [g] | 23 | Leaves area PP (hd) [cm$^2$] | 23 |
| Leaves FW (hd) [g] | 24 | Leaves num (LAI) (hd) | 24 |
| Leaves area PP (GF) [cm$^2$] | 25 | Leaves num 1 | 25 |
| Leaves area PP (hd) [cm$^2$] | 26 | Leaves temperature (GF) | 26 |
| Leaves num (LAI) (hd) | 27 | Lower Stem FW (h) [g] | 27 |
| Leaves num 1 | 28 | Lower Stem FW (hd) [g] | 28 |
| Leaves temperature (GF) | 29 | Lower Stem length (h) [cm] | 29 |
| Lower Stem FW (GF) [g] | 30 | Lower Stem length (hd) [cm] | 30 |
| Lower Stem FW (h) [g] | 31 | Lower Stem width (h) [mm] | 31 |

TABLE 81-continued

Maize correlated parameters (vectors) under normal conditions and under defoliation

| Normal conditions | | Defoliation | |
|---|---|---|---|
| Correlated parameter with | Correlation ID | Correlated parameter with | Correlation ID |
| Lower Stem FW (hd) [g] | 32 | Lower Stem width (hd) [mm] | 32 |
| Lower Stem length (GF) [cm] | 33 | Node number | 33 |
| Lower Stem length (h) [cm] | 34 | Num days to Heading (field) | 34 |
| Lower Stem length (hd) [cm] | 35 | Plant height [cm] | 35 |
| Lower Stem width (GF) [cm] | 36 | Plant height growth [cm/day] | 36 |
| Lower Stem width (h) [mm] | 37 | SPAD (GF) [value] | 37 |
| Lower Stem width (hd) [mm] | 38 | Stem FW (hd) [mm] | 38 |
| Node number | 39 | Total dry matter (SP) [kg] | 39 |
| Num days to Heading (field) | 40 | Upper Stem FW (h) [g] | 40 |
| Plant height [cm] | 41 | Upper Stem length (h) [cm] | 41 |
| Plant height growth [cm/day] | 42 | Upper Stem width (h) [mm] | 42 |
| SPAD (GF) [value] | 43 | Vegetative DW (SP) [kg] | 43 |
| Stem FW (GF) [g] | 44 | Vegetative FW (SP) [kg] | 44 |
| Stem FW (hd) [g] | 45 | | |
| Total dry matter (SP) [kg] | 46 | | |
| Upper Stem FW (GF) [g] | 47 | | |
| Upper Stem FW (h) [g] | 48 | | |
| Upper Stem length (GF) [cm] | 49 | | |
| Upper Stem length (h) [cm] | 50 | | |
| Upper Stem width (GF) [mm] | 51 | | |
| Upper Stem width (h) [mm] | 52 | | |
| Vegetative DW (SP) [kg] | 53 | | |
| Vegetative FW (SP) [kg] | 54 | | |

Table 81. Provided are the maize correlated parameters,.
"NUE" = nitrogen use efficiency;
"DW" = dry weight;
"cm" = centimeter,
"GF" = grain filling,
"PP" = per plant,
"h" = harvest,
"avr" = average,
"NUM" = number.
"mm" = millimeter;
"g" = grams;
"kg" = kilograms;
"cm" = centimeter.

Thirteen maize varieties were grown, and characterized for parameters, as described above. The average for each parameter was calculated using the JMP software, and values are summarized in Tables 82-85 below. Subsequent correlation between the various transcriptom sets for all or sub set of lines was done by the bioinformatic unit and results were integrated into the database (Tables 86-87 below).

TABLE 82

Measured parameters in Maize varieties under normal conditions

| Ecotype/Treatment | Line-1 | Line-2 | Line-3 | Line-4 | Line-5 | Line-6 |
|---|---|---|---|---|---|---|
| 1 | 241.091 | 296.503 | 232.402 | 263.250 | 305.376 | 303.614 |
| 2 | 23.427 | 24.633 | 22.149 | 25.106 | 24.714 | 23.207 |
| 3 | 47.516 | 82.296 | 36.009 | 74.626 | 61.731 | 76.997 |
| 4 | 46.808 | 80.887 | 17.431 | 72.415 | 56.829 | 73.430 |
| 5 | 4.249 | 4.656 | 3.210 | 4.787 | 5.016 | 4.961 |
| 6 | 22.854 | 209.500 | 55.556 | 164.627 | 132.917 | 177.444 |
| 7 | 71.139 | 121.667 | 110.611 | 134.235 | 89.333 | 149.639 |
| 8 | 13.937 | 22.091 | 13.897 | 19.622 | 16.062 | 20.024 |
| 9 | 11.778 | 13.000 | 13.750 | 14.944 | 15.471 | 14.556 |
| 10 | 228.743 | 351.262 | 201.689 | 323.077 | 217.161 | 307.874 |
| 11 | 0.615 | 1.257 | 0.333 | 1.087 | 0.798 | 1.065 |
| 12 | 0.688 | 1.687 | 0.468 | 1.457 | 1.072 | 1.412 |
| 13 | 1.667 | 1.000 | 1.000 | 1.111 | 1.000 | 1.000 |
| 14 | 0.985 | 0.982 | 0.406 | 0.969 | 0.919 | 0.953 |
| 15 | 3.146 | 3.299 | 2.793 | 3.233 | 3.318 | 3.275 |
| 16 | 12.700 | 12.500 | 12.367 | 12.367 | 12.233 | 11.967 |
| 17 | 0.652 | 0.720 | 0.517 | 0.667 | 0.705 | 0.706 |
| 18 | 1.058 | 1.125 | 0.895 | 1.123 | 1.155 | 1.133 |
| 19 | 0.783 | 0.808 | 0.734 | 0.753 | 0.776 | 0.789 |
| 20 | 0.415 | 0.907 | 0.121 | 0.800 | 0.367 | 0.766 |
| 21 | 0.475 | 1.037 | 0.138 | 0.913 | 0.418 | 0.869 |
| 22 | 0.069 | 0.151 | 0.020 | 0.133 | 0.061 | 0.128 |

TABLE 82-continued

Measured parameters in Maize varieties under normal conditions

| Ecotype/Treatment | Line-1 | Line-2 | Line-3 | Line-4 | Line-5 | Line-6 |
|---|---|---|---|---|---|---|
| 23 | 137.328 | 230.129 | 141.263 | 197.636 | 154.760 | 201.031 |
| 24 | 96.392 | 110.968 | 103.967 | 80.570 | 119.360 | 157.210 |
| 25 | 4186.917 | 7034.596 | 4884.333 | 6402.795 | 4297.250 | 6353.074 |
| 26 | 4341.250 | 3171.000 | 4347.500 | 3527.000 | 4517.333 | 3984.750 |
| 27 | 9.000 | 8.000 | 8.833 | 6.750 | 8.500 | 7.750 |
| 28 | 4.333 | 4.833 | 3.917 | 4.167 | 4.000 | 4.833 |
| 29 | 32.294 | 33.111 | 35.214 | 33.517 | 34.526 | 33.869 |
| 30 | 29.703 | 35.403 | 15.660 | 25.025 | 23.986 | 26.514 |
| 31 | 33.690 | 23.517 | 21.746 | 20.340 | 23.466 | 25.083 |
| 32 | 38.818 | 72.988 | 36.998 | 59.900 | 32.614 | 74.715 |
| 33 | 13.417 | 19.350 | 15.833 | 20.400 | 16.342 | 20.925 |
| 34 | 12.484 | 16.761 | 16.094 | 20.022 | 15.006 | 22.594 |
| 35 | 9.417 | 14.500 | 14.133 | 17.750 | 11.083 | 20.000 |
| 36 | 20.208 | 19.855 | 15.904 | 16.841 | 15.593 | 16.139 |
| 37 | 21.518 | 19.423 | 15.819 | 17.188 | 17.028 | 16.086 |
| 38 | 23.494 | 24.138 | 20.247 | 20.533 | 20.812 | 20.973 |
| 39 | 14.667 | 15.222 | 13.778 | 14.556 | 13.667 | 14.611 |
| 40 | 74.000 | 69.667 | 74.000 | 71.000 | 74.000 | 69.667 |
| 41 | 173.389 | 265.111 | 203.556 | 255.944 | 177.444 | 271.111 |
| 42 | 4.030 | 6.302 | 4.153 | 6.519 | 4.358 | 7.144 |
| 43 | 60.952 | 59.772 | 48.589 | 53.170 | 57.919 | 53.206 |
| 44 | 447.155 | 649.026 | 347.648 | 489.318 | 404.783 | 524.055 |
| 45 | 468.300 | 758.610 | 392.713 | 587.875 | 437.855 | 801.320 |
| 46 | 1.615 | 2.565 | 1.411 | 2.058 | 1.835 | 2.316 |
| 47 | 14.369 | 19.614 | 8.862 | 15.539 | 13.003 | 17.824 |
| 48 | 10.441 | 12.937 | 8.003 | 11.212 | 10.438 | 12.975 |
| 49 | 11.792 | 16.633 | 13.917 | 18.755 | 13.217 | 18.375 |
| 50 | 10.422 | 16.928 | 13.683 | 18.756 | 12.306 | 18.717 |

Table 82.

TABLE 83

Measured parameters in Maize varieties under normal conditions, additional maize lines

| Ecotype/Treatment | Line-14 | Line-15 | Line-16 | Line-17 | Line-18 | Line-19 | Line-20 |
|---|---|---|---|---|---|---|---|
| 1 | 290.881 | 202.573 | 250.257 | 275.409 | 306.201 | 256.858 | 187.316 |
| 2 | 23.184 | 25.919 | 24.876 | 22.751 | 26.468 | 21.662 | 24.046 |
| 3 | 78.355 | 51.175 | 93.914 | 57.832 | 96.772 | 64.428 | 55.077 |
| 4 | 74.411 | 45.927 | 92.312 | 54.139 | 95.429 | 61.811 | 51.437 |
| 5 | 4.786 | 4.368 | 5.182 | 4.430 | 5.001 | 4.091 | 4.264 |
| 6 | 147.490 | 101.917 | 207.111 | 100.476 | 228.444 | 129.889 | 84.805 |
| 7 | 118.389 | 117.889 | 145.235 | 99.222 | 133.778 | 81.444 | 125.000 |
| 8 | 20.313 | 14.750 | 22.601 | 16.653 | 23.837 | 19.849 | 16.955 |
| 9 | 16.118 | 15.944 | 15.889 | 13.545 | 14.000 | 12.667 | 17.941 |
| 10 | 325.083 | 244.997 | 327.145 | 241.060 | 363.704 | 262.126 | 146.149 |
| 11 | 1.159 | 0.612 | 1.292 | 0.632 | 1.371 | 0.779 | 0.690 |
| 12 | 1.800 | 0.704 | 1.595 | 0.865 | 1.739 | 1.213 | 0.861 |
| 13 | 1.000 | 1.000 | 1.056 | 1.056 | 1.000 | 1.000 | 0.944 |
| 14 | 0.930 | 0.889 | 0.982 | 0.934 | 0.986 | 0.955 | 0.934 |
| 15 | 3.246 | 2.860 | 3.182 | 3.082 | 3.291 | 2.946 | 2.810 |
| 16 | 12.600 | 12.033 | 12.233 | 11.200 | 11.967 | 13.133 | 11.667 |
| 17 | 0.665 | 0.526 | 0.646 | 0.627 | 0.705 | 0.587 | 0.495 |
| 18 | 1.142 | 0.992 | 1.118 | 1.041 | 1.151 | 0.969 | 0.962 |
| 19 | 0.740 | 0.672 | 0.730 | 0.763 | 0.774 | 0.767 | 0.653 |
| 20 | 0.820 | 0.362 | 0.921 | 0.419 | 1.017 | 0.516 | 0.408 |
| 21 | 0.940 | 0.411 | 1.050 | 0.471 | 1.155 | 0.595 | 0.462 |
| 22 | 0.137 | 0.064 | 0.154 | 0.073 | 0.169 | 0.086 | 0.073 |
| 23 | 212.413 | 137.330 | 181.432 | 133.844 | 199.221 | 155.821 | 140.336 |
| 24 | 116.750 | 96.150 | 106.945 | 107.158 | 85.973 | 98.842 | 134.450 |
| 25 | 7123.475 | 4162.750 | 6075.206 | 4339.788 | 6597.666 | 4756.583 | 4209.091 |
| 26 | | | | | | 4205.500 | |
| 27 | 7.000 | 8.667 | 7.250 | 7.833 | 7.250 | 9.000 | 9.833 |
| 28 | 4.250 | 3.833 | 4.833 | 3.333 | 4.083 | 3.833 | 4.167 |
| 29 | 33.185 | 34.815 | 33.659 | 36.480 | 33.781 | 34.431 | 34.898 |
| 30 | 27.606 | 24.589 | 25.264 | 24.006 | 26.178 | 21.142 | 29.925 |
| 31 | 20.603 | 15.197 | 16.347 | 19.856 | 18.901 | 22.333 | 31.712 |
| 32 | 60.358 | 50.068 | 63.067 | 46.065 | 55.885 | 29.802 | 68.184 |
| 33 | 18.083 | 17.700 | 20.182 | 15.475 | 19.808 | 16.042 | 23.075 |
| 34 | 17.072 | 18.267 | 20.694 | 14.622 | 18.478 | 16.206 | 21.117 |
| 35 | 15.000 | 12.333 | 18.675 | 14.633 | 20.500 | 11.240 | 18.333 |
| 36 | 18.105 | 16.705 | 17.094 | 15.435 | 16.868 | 15.521 | 14.653 |

TABLE 83-continued

Measured parameters in Maize varieties under normal conditions, additional maize lines

| Ecotype/Treatment | Line-14 | Line-15 | Line-16 | Line-17 | Line-18 | Line-19 | Line-20 |
|---|---|---|---|---|---|---|---|
| 37 | 17.962 | 15.953 | 18.421 | 16.266 | 17.434 | 15.489 | 16.656 |
| 38 | 23.473 | 21.292 | 20.973 | 20.593 | 21.458 | 18.966 | 22.008 |
| 39 | 14.278 | 13.889 | 14.722 | 14.444 | 15.444 | 12.556 | 13.389 |
| 40 | 72.000 | 74.000 | 69.667 | 74.000 | 71.000 | 74.000 | 68.333 |
| 41 | 244.250 | 215.206 | 273.556 | 229.889 | 273.222 | 194.056 | 260.167 |
| 42 | 5.603 | 4.686 | 6.960 | 4.424 | 7.017 | 4.298 | 6.424 |
| 43 | 55.376 | 56.450 | 56.759 | 54.600 | 55.812 | 52.548 | 61.457 |
| 44 | 507.783 | 475.345 | 549.336 | 463.157 | 509.738 | 324.976 | 477.917 |
| 45 | 660.695 | 468.267 | 724.575 | 435.500 | 618.460 | 339.267 | 592.130 |
| 46 | 2.233 | 1.347 | 2.727 | 1.503 | 2.331 | 1.560 | 1.615 |
| 47 | 15.849 | 12.442 | 14.395 | 16.773 | 17.848 | 13.457 | 20.847 |
| 48 | 9.723 | 3.074 | 6.981 | 9.759 | 9.396 | 11.344 | 16.205 |
| 49 | 17.067 | 14.467 | 17.518 | 17.542 | 18.150 | 15.625 | 20.150 |
| 50 | 16.417 | 12.094 | 18.339 | 15.622 | 16.628 | 16.572 | 18.494 |

Table 83.

TABLE 84

Measured parameters in Maize varieties under defoliation

| Ecotype/Treatment | Line-2 | Line-3 | Line-4 | Line-5 | Line-6 | Line-7 |
|---|---|---|---|---|---|---|
| 1 | 280.025 | 249.808 | 251.859 | 244.024 | 294.292 | 262.463 |
| 2 | 19.028 | 21.874 | 22.115 | 19.269 | 16.306 | 21.460 |
| 3 | 53.600 | NA | 45.503 | 25.764 | 38.307 | 37.749 |
| 4 | 51.497 | NA | 42.952 | 21.912 | 34.591 | 36.008 |
| 5 | 4.181 | NA | 4.207 | 3.376 | 3.919 | 3.945 |
| 6 | 89.202 | 56.056 | 100.750 | 26.773 | 73.389 | 79.167 |
| 7 | 119.444 | 102.778 | 131.556 | 91.375 | 145.528 | 121.000 |
| 8 | 16.338 | NA | 13.626 | 10.542 | 12.889 | 12.481 |
| 9 | 12.706 | 13.909 | 14.357 | 13.600 | 13.000 | 13.167 |
| 10 | 0.747 | 0.317 | 0.583 | 0.189 | 0.440 | 0.475 |
| 11 | 0.973 | 0.464 | 0.833 | 0.250 | 0.629 | 0.637 |
| 12 | 1.000 | 0.944 | 0.944 | 0.471 | 1.000 | 1.000 |
| 13 | 0.954 | NA | 0.915 | 0.820 | 0.873 | 0.951 |
| 14 | 3.109 | 2.936 | 3.144 | 2.894 | 3.179 | 2.919 |
| 15 | 13.467 | 12.767 | 12.367 | 13.200 | 12.833 | 12.400 |
| 16 | 0.649 | 0.562 | 0.632 | 0.563 | 0.669 | 0.570 |
| 17 | 1.052 | 0.947 | 1.080 | 0.957 | 1.079 | 0.956 |
| 18 | 0.777 | 0.753 | 0.740 | 0.729 | 0.781 | 0.757 |
| 19 | 0.523 | 0.155 | 0.400 | 0.087 | 0.289 | 0.283 |
| 20 | 0.604 | 0.178 | 0.456 | 0.097 | 0.331 | 0.323 |
| 21 | 0.087 | 0.027 | 0.069 | 0.021 | 0.048 | 0.047 |
| 22 | 112.270 | 78.475 | 94.985 | 107.475 | 125.138 | 93.500 |
| 23 | 3914.000 | NA | 3480.000 | NA | 4276.500 | NA |
| 24 | 7.750 | 8.000 | 7.500 | 8.667 | 8.000 | 8.167 |
| 25 | 4.500 | 3.917 | 4.083 | 4.917 | 4.333 | 4.583 |
| 26 | 32.472 | 34.626 | 33.093 | 34.456 | 33.637 | 32.433 |
| 27 | 23.021 | 18.392 | 26.502 | 19.689 | 26.975 | 14.456 |
| 28 | 64.160 | 30.778 | 53.813 | 28.248 | 56.413 | 47.118 |
| 29 | 16.294 | 15.306 | 21.439 | 14.294 | 20.850 | 14.056 |
| 30 | 15.150 | 12.250 | 18.500 | 9.133 | 16.667 | 14.917 |
| 31 | 19.539 | 15.813 | 16.899 | 15.916 | 15.793 | 15.517 |
| 32 | 24.300 | 18.868 | 20.565 | 21.737 | 21.058 | 22.490 |
| 33 | 15.167 | 13.167 | 14.389 | 13.294 | 15.000 | 13.833 |
| 34 | 72.000 | 78.000 | 73.000 | 74.000 | 73.000 | 74.000 |
| 35 | 251.417 | 191.000 | 248.639 | 175.500 | 268.056 | 203.444 |
| 36 | 6.385 | 3.787 | 6.319 | 4.232 | 6.315 | 4.214 |
| 37 | 61.213 | 47.106 | 57.363 | 55.451 | 58.022 | 58.156 |
| 38 | 713.540 | 323.125 | 538.043 | 442.733 | 705.525 | 421.642 |

Table 84.

TABLE 85

Measured parameters in Maize varieties under defoliation, additional maize lines

| Ecotype/Treatment | Line-14 | Line-15 | Line-16 | Line-17 | Line-18 | Line-19 | Line-20 |
|---|---|---|---|---|---|---|---|
| 1 | 230.119 | 200.087 | 271.250 | 236.886 | 259.427 | 218.764 | 203.643 |
| 2 | 19.768 | 23.640 | 22.441 | 20.880 | 20.283 | 20.871 | 21.198 |
| 3 | 39.827 | 32.330 | 47.329 | 21.782 | 65.896 | 37.337 | 63.114 |
| 4 | 36.313 | 25.193 | 43.339 | 20.167 | 64.803 | 34.644 | 54.962 |
| 5 | 4.099 | 3.520 | 4.202 | 2.743 | 4.664 | 3.532 | 4.562 |
| 6 | 85.044 | 53.044 | 33.100 | 92.167 | 161.761 | 66.500 | 89.497 |
| 7 | 123.375 | 112.722 | 135.000 | 96.000 | 136.500 | 73.500 | 113.944 |
| 8 | 13.214 | 11.957 | 14.818 | 10.472 | 17.602 | 13.734 | 17.210 |
| 9 | 14.063 | 15.125 | 13.750 | 12.333 | 13.938 | 12.471 | 18.000 |
| 10 | 0.454 | 0.300 | 0.630 | 0.128 | 0.803 | 0.399 | 0.478 |
| 11 | 0.648 | 0.371 | 0.819 | 0.136 | 1.148 | 0.739 | 0.599 |
| 12 | 0.889 | 0.944 | 1.000 | 0.222 | 0.882 | 1.000 | 0.944 |
| 13 | 0.905 | 0.709 | 0.905 | 0.933 | 0.983 | 0.918 | 0.757 |
| 14 | 3.130 | 2.558 | 3.016 | 2.810 | 3.117 | 2.767 | 2.934 |
| 15 | 12.567 | 13.000 | 13.150 | 12.800 | 13.150 | 12.967 | 11.700 |
| 16 | 0.631 | 0.442 | 0.610 | 0.528 | 0.623 | 0.513 | 0.543 |
| 17 | 1.066 | 0.826 | 1.024 | 0.932 | 1.084 | 0.927 | 1.020 |
| 18 | 0.750 | 0.672 | 0.750 | 0.716 | 0.724 | 0.699 | 0.670 |
| 19 | 0.302 | 0.143 | 0.439 | 0.044 | 0.667 | 0.255 | 0.359 |
| 20 | 0.345 | 0.165 | 0.505 | 0.050 | 0.767 | 0.293 | 0.406 |
| 21 | 0.056 | 0.025 | 0.073 | 0.026 | 0.124 | 0.043 | 0.076 |
| 22 | 113.783 | 93.190 | 93.738 | 94.367 | 89.858 | 91.600 | 122.070 |
| 23 | 3436.000 | NA | 4593.000 | NA | 4315.500 | NA | NA |
| 24 | 6.750 | 8.800 | 7.500 | 7.833 | 6.250 | 8.500 | 9.400 |
| 25 | 4.417 | 4.667 | 4.500 | 4.000 | 4.083 | 4.333 | 4.167 |
| 26 | 33.433 | 32.831 | 33.424 | 33.020 | 33.981 | 31.871 | 33.320 |
| 27 | 27.885 | 17.561 | 17.329 | 17.691 | 20.510 | 23.057 | 34.332 |
| 28 | 64.188 | 48.835 | 76.233 | 45.857 | 57.850 | 27.597 | 59.030 |
| 29 | 18.759 | 17.972 | 20.883 | 13.228 | 17.828 | 14.911 | 20.122 |
| 30 | 16.100 | 12.917 | 14.833 | 12.917 | 17.500 | 10.667 | 17.200 |
| 31 | 18.215 | 17.289 | 17.233 | 16.176 | 17.882 | 15.890 | 18.708 |
| 32 | 20.955 | 22.352 | 22.470 | 20.057 | 21.230 | 18.472 | 20.590 |
| 33 | 14.389 | 13.667 | 14.667 | 14.222 | 15.611 | 12.333 | 13.111 |
| 34 | 71.000 | 74.000 | 70.667 | 74.000 | 71.000 | 75.333 | 72.000 |
| 35 | 254.639 | 210.222 | 261.944 | 215.889 | 268.878 | 181.722 | 251.000 |
| 36 | 6.482 | 4.912 | 6.282 | 4.450 | 7.044 | 3.711 | 5.808 |
| 37 | 59.654 | 58.322 | 59.985 | 54.907 | 56.761 | 50.606 | 60.657 |
| 38 | 673.238 | 485.700 | 738.368 | 392.267 | 692.225 | 327.840 | 539.167 |

Table 85.

Tables 86 and 87 here in below provide the correlations (R) between the expression levels yield improving genes and their homologs in various tissues [Expression (Exp) sets] and the phenotypic performance [yield, biomass, growth rate and/or vigor components (Correlation vector (Cor))] under normal and defoliation conditions across maize varieties. P=p value.

TABLE 86

Correlation between the expression level of selected genes of some embodiments of the invention in various tissues and the phenotypic performance under normal conditions across maize varieties

| Gene Name | R | P value | Exp. set | Cor. Set ID | Gene Name | R | P value | Exp. set | Cor. Set ID |
|---|---|---|---|---|---|---|---|---|---|
| LNU814 | 0.711 | 1.41E−02 | 3 | 26 | LNU824 | 0.727 | 3.85E−05 | 3 | 50 |
| LNU824 | 0.843 | 1.24E−07 | 3 | 12 | LNU824 | 0.720 | 4.95E−05 | 3 | 6 |
| LNU824 | 0.770 | 6.81E−06 | 3 | 20 | LNU824 | 0.779 | 4.47E−06 | 3 | 11 |
| LNU824 | 0.775 | 5.45E−06 | 3 | 21 | LNU824 | 0.752 | 1.44E−05 | 3 | 25 |
| LNU824 | 0.701 | 9.54E−05 | 3 | 10 | LNU824 | 0.754 | 1.34E−05 | 3 | 22 |
| LNU824 | 0.776 | 1.35E−05 | 2 | 50 | LNU824 | 0.704 | 1.76E−04 | 2 | 23 |
| LNU824 | 0.743 | 4.96E−05 | 2 | 12 | LNU824 | 0.708 | 1.56E−04 | 2 | 11 |
| LNU832 | 0.766 | 1.60E−02 | 2 | 26 | LNU813 | 0.722 | 1.21E−02 | 2 | 49 |
| LNU813 | 0.738 | 6.14E−03 | 3 | 13 | LNU814 | 0.700 | 1.12E−02 | 3 | 32 |
| LNU813 | 0.719 | 1.26E−02 | 2 | 48 | LNU815 | 0.835 | 7.34E−04 | 1 | 36 |
| LNU814 | 0.729 | 1.10E−02 | 1 | 5 | LNU815 | 0.732 | 6.85E−03 | 1 | 19 |
| LNU815 | 0.705 | 1.05E−02 | 1 | 1 | LNU816 | 0.703 | 1.57E−02 | 2 | 7 |
| LNU815 | 0.753 | 4.68E−03 | 1 | 30 | LNU817 | 0.840 | 1.21E−03 | 2 | 38 |

TABLE 86-continued

Correlation between the expression level of selected genes of some embodiments of the invention in various tissues and the phenotypic performance under normal conditions across maize varieties

| Gene Name | R | P value | Exp. set | Cor. Set ID | Gene Name | R | P value | Exp. set | Cor. Set ID |
|---|---|---|---|---|---|---|---|---|---|
| LNU816 | 0.722 | 7.99E−03 | 1 | 13 | LNU818 | 0.834 | 7.40E−04 | 3 | 37 |
| LNU818 | 0.731 | 6.92E−03 | 3 | 28 | LNU818 | 0.737 | 9.61E−03 | 2 | 41 |
| LNU818 | 0.794 | 2.02E−03 | 3 | 7 | LNU818 | 0.770 | 5.60E−03 | 2 | 34 |
| LNU818 | 0.700 | 1.64E−02 | 2 | 51 | LNU818 | 0.749 | 8.04E−03 | 1 | 5 |
| LNU818 | 0.829 | 1.60E−03 | 2 | 7 | LNU819 | 0.712 | 1.40E−02 | 2 | 40 |
| LNU819 | 0.764 | 6.20E−03 | 3 | 5 | LNU820 | 0.755 | 4.57E−03 | 3 | 18 |
| LNU819 | 0.713 | 1.37E−02 | 1 | 5 | LNU820 | 0.834 | 7.46E−04 | 3 | 32 |
| LNU820 | 0.794 | 2.05E−03 | 3 | 46 | LNU820 | 0.704 | 1.07E−02 | 3 | 21 |
| LNU820 | 0.712 | 9.44E−03 | 3 | 20 | LNU820 | 0.759 | 4.22E−03 | 1 | 36 |
| LNU820 | 0.712 | 9.44E−03 | 3 | 22 | LNU821 | 0.715 | 8.92E−03 | 3 | 51 |
| LNU820 | 0.736 | 6.32E−03 | 1 | 19 | LNU823 | 0.780 | 2.76E−03 | 3 | 34 |
| LNU823 | 0.766 | 3.65E−03 | 3 | 51 | LNU823 | 0.757 | 4.38E−03 | 3 | 42 |
| LNU823 | 0.741 | 5.79E−03 | 3 | 33 | LNU823 | 0.726 | 7.47E−03 | 3 | 35 |
| LNU823 | 0.776 | 3.03E−03 | 3 | 43 | LNU823 | 0.753 | 1.19E−02 | 2 | 8 |
| LNU823 | 0.744 | 8.61E−03 | 2 | 51 | LNU825 | 0.745 | 5.38E−03 | 3 | 19 |
| LNU824 | 0.705 | 1.05E−02 | 3 | 13 | LNU828 | 0.726 | 7.57E−03 | 3 | 34 |
| LNU825 | 0.704 | 1.56E−02 | 2 | 1 | LNU828 | 0.719 | 8.47E−03 | 1 | 49 |
| LNU828 | 0.804 | 1.62E−03 | 3 | 33 | LNU828 | 0.726 | 7.53E−03 | 1 | 48 |
| LNU828 | 0.789 | 2.31E−03 | 1 | 45 | LNU829 | 0.713 | 9.30E−03 | 3 | 19 |
| LNU828 | 0.823 | 1.02E−03 | 1 | 30 | LNU831 | 0.865 | 2.82E−04 | 1 | 36 |
| LNU831 | 0.746 | 5.30E−03 | 3 | 44 | LNU834 | 0.730 | 6.97E−03 | 1 | 24 |
| LNU831 | 0.777 | 2.96E−03 | 1 | 53 | LNU834 | 0.805 | 1.57E−03 | 1 | 34 |
| LNU834 | 0.751 | 7.71E−03 | 1 | 5 | LNU834 | 0.702 | 1.09E−02 | 1 | 46 |
| LNU834 | 0.723 | 7.92E−03 | 1 | 18 | LNU834 | 0.767 | 3.57E−03 | 1 | 20 |
| LNU834 | 0.829 | 8.51E−04 | 1 | 32 | LNU834 | 0.751 | 4.89E−03 | 1 | 11 |
| LNU834 | 0.723 | 7.86E−03 | 1 | 7 | LNU834 | 0.767 | 3.57E−03 | 1 | 22 |
| LNU834 | 0.758 | 4.28E−03 | 1 | 21 | LNU835 | 0.876 | 1.86E−04 | 1 | 49 |
| LNU835 | 0.725 | 1.15E−02 | 2 | 51 | LNU835 | 0.809 | 1.46E−03 | 1 | 44 |
| LNU835 | 0.748 | 5.16E−03 | 1 | 52 | LNU835 | 0.925 | 1.61E−05 | 1 | 48 |
| LNU835 | 0.869 | 2.39E−04 | 1 | 45 | LNU835 | 0.806 | 1.54E−03 | 1 | 31 |
| LNU835 | 0.784 | 2.52E−03 | 1 | 10 | LNU839 | 0.751 | 7.71E−03 | 1 | 5 |
| LNU835 | 0.916 | 2.89E−05 | 1 | 30 | LNU841 | 0.792 | 3.65E−03 | 2 | 25 |
| LNU840 | 0.844 | 5.57E−04 | 1 | 25 | LNU841 | 0.845 | 5.38E−04 | 1 | 36 |
| LNU841 | 0.710 | 9.70E−03 | 1 | 47 | LNU841 | 0.849 | 4.80E−04 | 1 | 37 |
| LNU841 | 0.854 | 4.03E−04 | 1 | 53 | LNU841 | 0.729 | 7.17E−03 | 1 | 54 |
| LNU841 | 0.772 | 3.27E−03 | 1 | 55 | LNU844 | 0.716 | 8.75E−03 | 3 | 46 |
| LNU844 | 0.724 | 7.79E−03 | 3 | 24 | LNU844 | 0.758 | 4.28E−03 | 3 | 20 |
| LNU844 | 0.812 | 1.34E−03 | 3 | 32 | LNU844 | 0.747 | 5.21E−03 | 3 | 21 |
| LNU844 | 0.717 | 8.64E−03 | 3 | 11 | LNU844 | 0.835 | 7.31E−04 | 1 | 44 |
| LNU844 | 0.758 | 4.28E−03 | 3 | 22 | LNU844 | 0.727 | 7.35E−03 | 1 | 55 |
| LNU844 | 0.731 | 6.88E−03 | 1 | 45 | LNU845 | 0.799 | 1.81E−03 | 3 | 33 |

Table 86.

TABLE 87

Correlation between the expression level of selected genes of some embodiments of the invention in various tissues and the phenotypic performance under defoliation across maize varieties

| Gene Name | R | P value | Exp. set | Cor. Set ID | Gene Name | R | P value | Exp. set | Cor. Set ID |
|---|---|---|---|---|---|---|---|---|---|
| LNU814 | 0.761 | 1.01E−05 | 3 | 21 | LNU819 | 0.765 | 8.32E−06 | 1 | 21 |
| LNU824 | 0.720 | 4.95E−05 | 3 | 41 | LNU824 | 0.715 | 5.85E−05 | 2 | 41 |
| LNU824 | 0.719 | 5.18E−05 | 2 | 11 | LNU829 | 0.725 | 7.62E−03 | 3 | 23 |
| LNU829 | 0.753 | 1.41E−05 | 3 | 21 | LNU832 | 0.703 | 8.91E−05 | 1 | 21 |
| LNU835 | 0.720 | 4.98E−05 | 1 | 21 | LNU813 | 0.721 | 8.15E−03 | 2 | 15 |
| LNU813 | 0.740 | 5.93E−03 | 1 | 22 | LNU814 | 0.701 | 1.11E−02 | 1 | 36 |
| LNU814 | 0.701 | 1.11E−02 | 3 | 24 | LNU815 | 0.766 | 3.70E−03 | 3 | 16 |
| LNU815 | 0.710 | 9.74E−03 | 3 | 14 | LNU815 | 0.773 | 3.20E−03 | 1 | 18 |
| LNU815 | 0.769 | 3.49E−03 | 1 | 16 | LNU816 | 0.714 | 9.14E−03 | 1 | 21 |
| LNU816 | 0.751 | 4.86E−03 | 3 | 2 | LNU817 | 0.718 | 8.54E−03 | 1 | 22 |
| LNU817 | 0.732 | 6.79E−03 | 3 | 24 | LNU819 | 0.754 | 4.59E−03 | 2 | 22 |
| LNU819 | 0.716 | 8.80E−03 | 3 | 42 | LNU819 | 0.767 | 3.57E−03 | 2 | 2 |
| LNU819 | 0.792 | 2.16E−03 | 2 | 5 | LNU819 | 0.730 | 6.98E−03 | 2 | 7 |
| LNU819 | 0.733 | 6.71E−03 | 2 | 37 | LNU823 | 0.706 | 1.03E−02 | 3 | 14 |
| LNU820 | 0.771 | 3.29E−03 | 1 | 36 | LNU823 | 0.738 | 6.19E−03 | 3 | 1 |
| LNU823 | 0.765 | 3.78E−03 | 3 | 16 | LNU824 | 0.834 | 7.54E−04 | 1 | 36 |

TABLE 87-continued

Correlation between the expression level of selected genes of some embodiments of the invention in various tissues and the phenotypic performance under defoliation across maize varieties

| Gene Name | R | P value | Exp. set | Cor. Set ID | Gene Name | R | P value | Exp. set | Cor. Set ID |
|---|---|---|---|---|---|---|---|---|---|
| LNU823 | 0.764 | 3.81E−03 | 1 | 36 | LNU829 | 0.725 | 7.62E−03 | 3 | 23 |
| LNU825 | 0.700 | 1.12E−02 | 3 | 8 | LNU829 | 0.870 | 2.32E−04 | 1 | 36 |
| LNU829 | 0.744 | 5.55E−03 | 3 | 32 | LNU831 | 0.703 | 1.08E−02 | 3 | 31 |
| LNU829 | 0.733 | 6.68E−03 | 2 | 27 | LNU833 | 0.752 | 4.82E−03 | 2 | 42 |
| LNU832 | 0.712 | 9.33E−03 | 3 | 40 | LNU834 | 0.771 | 3.30E−03 | 3 | 30 |
| LNU834 | 0.723 | 7.83E−03 | 3 | 2 | LNU837 | 0.748 | 5.16E−03 | 3 | 22 |
| LNU834 | 0.705 | 1.05E−02 | 1 | 21 | LNU837 | 0.786 | 2.45E−03 | 2 | 22 |
| LNU837 | 0.728 | 7.24E−03 | 3 | 37 | LNU837 | 0.718 | 8.55E−03 | 2 | 31 |
| LNU837 | 0.768 | 3.56E−03 | 2 | 37 | LNU839 | 0.771 | 3.30E−03 | 3 | 30 |
| LNU837 | 0.728 | 7.24E−03 | 2 | 24 | LNU843 | 0.709 | 9.87E−03 | 1 | 32 |
| LNU841 | 0.815 | 1.23E−03 | 3 | 26 | LNU844 | 0.827 | 9.07E−04 | 1 | 2 |
| LNU844 | 0.731 | 6.88E−03 | 1 | 5 | LNU845 | 0.805 | 1.57E−03 | 3 | 2 |
| LNU844 | 0.808 | 1.49E−03 | 1 | 9 | LNU813 | 0.783 | 2.59E−03 | 3 | 4 |
| LNU845 | 0.779 | 2.85E−03 | 1 | 30 | LNU813 | 0.737 | 6.26E−03 | 3 | 8 |
| LNU811 | 0.733 | 4.40E−03 | 1 | 15 | LNU813 | 0.701 | 7.60E−03 | 1 | 11 |
| LNU813 | 0.760 | 4.15E−03 | 3 | 3 | LNU814 | 0.744 | 3.54E−03 | 3 | 6 |
| LNU813 | 0.749 | 3.23E−03 | 3 | 26 | LNU814 | 0.832 | 4.23E−04 | 1 | 21 |
| LNU814 | 0.721 | 5.42E−03 | 3 | 1 | LNU815 | 0.806 | 8.77E−04 | 1 | 21 |
| LNU814 | 0.819 | 6.19E−04 | 3 | 21 | LNU816 | 0.871 | 1.07E−04 | 3 | 9 |
| LNU815 | 0.703 | 7.34E−03 | 1 | 6 | LNU816 | 0.722 | 5.28E−03 | 1 | 44 |
| LNU816 | 0.724 | 5.11E−03 | 3 | 28 | LNU817 | 0.707 | 6.87E−03 | 3 | 2 |
| LNU816 | 0.750 | 3.16E−03 | 1 | 40 | LNU817 | 0.716 | 5.92E−03 | 2 | 12 |
| LNU816 | 0.854 | 2.00E−04 | 1 | 27 | LNU818 | 0.702 | 7.45E−03 | 1 | 39 |
| LNU817 | 0.764 | 2.35E−03 | 1 | 2 | LNU818 | 0.743 | 3.64E−03 | 1 | 11 |
| LNU818 | 0.791 | 1.27E−03 | 1 | 22 | LNU818 | 0.756 | 2.77E−03 | 1 | 19 |
| LNU818 | 0.796 | 1.12E−03 | 1 | 38 | LNU818 | 0.765 | 2.33E−03 | 1 | 20 |
| LNU818 | 0.707 | 6.93E−03 | 1 | 37 | LNU819 | 0.704 | 1.07E−02 | 3 | 4 |
| LNU818 | 0.740 | 3.82E−03 | 1 | 10 | LNU819 | 0.717 | 5.84E−03 | 3 | 30 |
| LNU818 | 0.733 | 4.40E−03 | 1 | 32 | LNU819 | 0.809 | 8.02E−04 | 1 | 16 |
| LNU819 | 0.745 | 3.45E−03 | 3 | 28 | LNU819 | 0.731 | 4.53E−03 | 1 | 6 |
| LNU819 | 0.741 | 3.75E−03 | 1 | 14 | LNU819 | 0.925 | 5.82E−06 | 1 | 21 |
| LNU819 | 0.839 | 3.34E−04 | 1 | 1 | LNU821 | 0.751 | 3.07E−03 | 1 | 6 |
| LNU819 | 0.830 | 4.53E−04 | 1 | 18 | LNU821 | 0.886 | 5.50E−05 | 1 | 21 |
| LNU821 | 0.704 | 7.29E−03 | 1 | 1 | LNU822 | 0.710 | 6.59E−03 | 2 | 44 |
| LNU821 | 0.700 | 1.12E−02 | 1 | 8 | LNU824 | 0.707 | 6.94E−03 | 1 | 41 |
| LNU822 | 0.756 | 2.77E−03 | 2 | 31 | LNU825 | 0.761 | 2.54E−03 | 3 | 40 |
| LNU823 | 0.709 | 9.90E−03 | 1 | 8 | LNU825 | 0.736 | 4.13E−03 | 2 | 16 |
| LNU824 | 0.749 | 3.19E−03 | 1 | 43 | LNU825 | 0.749 | 3.20E−03 | 2 | 18 |
| LNU825 | 0.700 | 7.70E−03 | 3 | 27 | LNU829 | 0.739 | 3.94E−03 | 3 | 14 |
| LNU825 | 0.707 | 6.85E−03 | 2 | 6 | LNU829 | 0.848 | 2.48E−04 | 3 | 1 |
| LNU829 | 0.757 | 4.39E−03 | 3 | 4 | LNU829 | 0.709 | 9.84E−03 | 3 | 3 |
| LNU829 | 0.773 | 1.93E−03 | 3 | 16 | LNU829 | 0.931 | 3.74E−06 | 3 | 21 |
| LNU829 | 0.771 | 2.02E−03 | 3 | 18 | LNU831 | 0.771 | 2.02E−03 | 2 | 10 |
| LNU829 | 0.740 | 5.92E−03 | 3 | 8 | LNU832 | 0.799 | 1.05E−03 | 1 | 41 |
| LNU831 | 0.714 | 6.16E−03 | 2 | 33 | LNU832 | 0.785 | 1.46E−03 | 1 | 21 |
| LNU831 | 0.711 | 6.49E−03 | 2 | 20 | LNU834 | 0.723 | 5.22E−03 | 3 | 35 |
| LNU832 | 0.726 | 7.53E−03 | 1 | 8 | LNU834 | 0.708 | 6.75E−03 | 1 | 33 |
| LNU832 | 0.783 | 1.54E−03 | 2 | 34 | LNU835 | 0.726 | 5.00E−03 | 1 | 6 |
| LNU834 | 0.746 | 3.40E−03 | 3 | 6 | LNU835 | 0.828 | 4.72E−04 | 1 | 21 |
| LNU835 | 0.715 | 5.98E−03 | 1 | 1 | LNU835 | 0.756 | 2.80E−03 | 2 | 18 |
| LNU835 | 0.704 | 7.26E−03 | 1 | 18 | LNU838 | 0.744 | 3.57E−03 | 1 | 41 |
| LNU835 | 0.718 | 5.69E−03 | 2 | 1 | LNU838 | 0.746 | 5.33E−03 | 1 | 8 |
| LNU835 | 0.841 | 3.17E−04 | 2 | 21 | LNU839 | 0.746 | 3.40E−03 | 3 | 6 |
| LNU838 | 0.750 | 3.16E−03 | 1 | 40 | LNU841 | 0.719 | 5.61E−03 | 1 | 21 |
| LNU839 | 0.723 | 5.22E−03 | 3 | 35 | LNU843 | 0.734 | 4.27E−03 | 2 | 27 |
| LNU839 | 0.708 | 6.75E−03 | 1 | 33 | LNU846 | 0.739 | 3.91E−03 | 2 | 36 |
| LNU841 | 0.745 | 3.46E−03 | 2 | 2 | LNU846 | 0.714 | 6.16E−03 | 2 | 29 |

Table 87.

Example 11

Production of Foxtail Millet Transcriptom and High Throughput Correlation Analysis Using 60K Foxtail Millet Oligonucleotide Micro-Array In order to produce a high throughput correlation analysis comparing between plant phenotype and gene expression level, the present inventors utilized a foxtail millet oligonucleotide micro-array, produced by Agilent Technologies [chem. (dot) agilent (dot) com/Scripts/PDS (dot) asp?1Page=50879]. The array oligonucleotide represents about 60K foxtail millet genes and transcripts. In order to define correlations between the levels of RNA expression and yield or vigor related parameters, various plant characteristics of 14 different foxtail millet accessions were analyzed. Among them, 11 accessions encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures 14 foxtail millet varieties were grown in 5 repetitive plots, in field. Briefly, the growing protocol was as follows:

1. Regular growth conditions: foxtail millet plants were grown in the field using commercial fertilization and irrigation protocols, which include 283 m³ water per dunam (100 square meters) per entire growth period and fertilization of 16 units of URAN® 32% (Nitrogen Fertilizer Solution; PCS Sales, Northbrook, Ill., USA) (normal growth conditions).

2. Drought conditions: foxtail millet seeds were sown in soil and grown under normal condition until heading stage (22 days from sowing), drought treatment was imposed by irrigating plants with 50% water relative to the normal treatment from this stage (171 m³ water per dunam (100 square meters) per entire growth period).

Analyzed foxtail millet tissues—All 14 foxtail millet lines were sample per each treatment. Three tissues [leaf, flower, and stem] at 2 different developmental stages [flowering, grain filling], representing different plant characteristics, were sampled and RNA was extracted as described above. Each micro-array expression information tissue type has received a Set ID as summarized in Tables 88-89 below.

TABLE 88

Foxtail millet transcriptom expression sets under drought conditions

| Expression Set | Set ID |
| --- | --- |
| flower: flowering stage: drought | 1 |
| leaf: flowering stage: drought | 2 |
| stem: flowering stage: drought | 3 |
| grain: grain filling stage: drought | 4 |
| leaf: grain filling stage: drought | 5 |
| stem: grain filling stage: drought | 6 |

Table 88. Provided are the barley transcriptome expression sets under drought conditions

TABLE 89

Foxtail millet transcriptom expression sets under normal conditions

| Expression Set | Set ID |
| --- | --- |
| flower: flowering stage | 1 |
| leaf: flowering stage | 2 |
| grain: grain filling stage: normal | 4 |
| leaf: grain filling stage: normal | 5 |
| stem: grain filling stage: normal | 6 |

Table 89. Provided are the barley transcriptome expression sets under normal conditions Foxtail millet yield components and vigor related parameters assessment—Plants were continuously phenotyped during the growth period and at harvest (Table 102, below). The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

The following parameters were collected using digital imaging system:

At the end of the growing period the grains were separated from the Plant 'Head' and the following parameters were measured and collected:

Average Grain Area (cm²)—A sample of ~200 grains was weighted, photographed and images were processed using the below described image processing system. The grain area was measured from those images and was divided by the number of grains.

Average Grain Length and width (cm)—A sample of ~200 grains was weighted, photographed and images were processed using the below described image processing system. The sum of grain lengths and width (longest axis) were measured from those images and were divided by the number of grains.

At the end of the growing period 14 'Heads' were photographed and images were processed using the below described image processing system.

Average Grain Perimeter (cm)—At the end of the growing period the grains were separated from the Plant 'Head'. A sample of ~200 grains were weighted, photographed and images were processed using the below described image processing system. The sum of grain perimeter was measured from those images and was divided by the number of grains.

Head Average Area (cm²) The 'Head' area was measured from those images and was divided by the number of 'Heads'.

Head Average Length and width (mm) The 'Head' length and width (longest axis) were measured from those images and were divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Head weight (gr.) and head number (num.)—At the end of the experiment, heads were harvested from each plot and were counted and weighted.

Total Grain Yield (gr.)—At the end of the experiment (plant 'Heads') heads from plots were collected, the heads were threshed and grains were weighted. In addition, the average grain weight per head was calculated by dividing the total grain weight by number of total heads per plot (based on plot).

1000 Seeds weight [gr]—weight of 1000 seeds per plot

Biomass at harvest—At the end of the experiment the vegetative portion above ground (excluding roots) from plots was weighted.

Total dry mater per plot—Calculated as Vegetative portion above ground plus all the heads dry weight per plot.

Num days to anthesis—Calculated as the number of days from sowing till 50% of the plot arrives anthesis.

Maintenance of performance under drought conditions: Represent ratio for the specified parameter of Drought condition results divided by Normal conditions results (maintenance of phenotype under drought in comparison to normal conditions).

Data parameters collected are summarized in Table 90, herein below.

TABLE 90

Foxtail millet correlated parameters (vectors)

| Correlated parameter with | Correlation ID |
|---|---|
| 1000 grain weight (gr) | 1 |
| Biomass at harvest (1M) (Kg.) | 2 |
| Grain Perimeter (cm) | 3 |
| Grain area (cm$^2$) | 4 |
| Grain length (cm) | 5 |
| Grain width (cm) | 6 |
| Grains yield per Head (plot) (gr) | 7 |
| Head Area (cm$^2$) | 8 |
| Head Width (cm) | 9 |
| Head length (cm) | 10 |
| Heads num | 11 |
| Num days to Anthesis | 12 |
| Total Grains yield (gr) | 13 |
| Total dry matter (1M) (Kg.) | 14 |
| Total heads weight (Kg.) | 15 |

Table 90. Provided are the foxtail millet collected parameters.

Experimental Results 14 different foxtail millet accessions were grown and characterized for different parameters as described above (Table 90). The average for each of the measured parameter was calculated using the JMP software and values are summarized in Tables 91-96 below. Subsequent correlation analysis between the various transcriptom sets and the average parameters (Tables 91-96) was conducted (Tables 97-99). Follow, results were integrated to the database.

TABLE 91

Measured parameters of correlation IDs in foxtail millet accessions under drought conditions

| Line/Cor. ID | 1 | 2 | 3 | 4 | 5 | 6 | 7 | 8 |
|---|---|---|---|---|---|---|---|---|
| Line-1 | 2.6392 | 1.5284 | 0.6825 | 0.0333 | 0.2416 | 0.1755 | 3.0533 | 35.7477 |
| Line-2 | 3.3285 | 3.4592 | 0.7215 | 0.0373 | 0.2445 | 0.1943 | 8.8318 | 50.7137 |
| Line-3 | 2.6105 | 2.8720 | 0.6888 | 0.0335 | 0.2496 | 0.1707 | 1.3364 | 18.3997 |
| Line-4 | 2.2948 | 2.9348 | 0.6827 | 0.0319 | 0.2543 | 0.1597 | 1.0933 | 14.9379 |
| Line-5 | 2.3036 | 3.0224 | 0.6902 | 0.0326 | 0.2568 | 0.1618 | 1.3094 | 17.6865 |
| Line-6 | 2.6419 | 2.6648 | 0.6923 | 0.0334 | 0.2504 | 0.1701 | 0.4864 | 9.9107 |
| Line-7 | 2.2151 | 2.9750 | 0.6481 | 0.0297 | 0.2331 | 0.1626 | 1.6279 | 20.9859 |
| Line-8 | 1.8374 | 0.7652 | 0.5695 | 0.0238 | 0.1944 | 0.1561 | 3.7375 | 39.9290 |
| Line-9 | 2.5396 | 2.6616 | 0.6607 | 0.0317 | 0.2230 | 0.1807 | 9.9001 | 42.1487 |
| Line-10 | 1.6912 | 2.9464 | 0.5929 | 0.0252 | 0.2034 | 0.1581 | 4.1426 | 43.5237 |
| Line-11 | 3.0961 | 3.2304 | 0.7204 | 0.0365 | 0.2608 | 0.1782 | 2.9746 | 26.9309 |
| Line-12 | 2.5413 | 3.3032 | 0.6747 | 0.0321 | 0.2448 | 0.1665 | 1.3047 | 21.2295 |
| Line-13 | 3.2382 | 2.6316 | 0.7484 | 0.0391 | 0.2700 | 0.1842 | 0.3629 | 7.3024 |
| Line-14 | 2.2454 | 0.8856 | 0.6593 | 0.0301 | 0.2417 | 0.1586 | 1.7407 | 13.1262 |

Table 91: Provided are the values of each of the parameters (as described above) measured in Foxtail millet accessions (line) under drought growth conditions. Growth conditions are specified in the experimental procedure section

TABLE 92

Additional measured parameters of correlation IDs in foxtail millet accessions under drought conditions

| Line/Cor. ID | 9 | 10 | 11 | 12 | 13 | 14 | 15 |
|---|---|---|---|---|---|---|---|
| Line-1 | 1.8708 | 22.3630 | 374.4 | 34 | 11418.4938 | 0.5038 | 2.8880 |
| Line-2 | 2.6767 | 21.8851 | 127 | 41 | 1116.1782 | 0.7328 | 6.0868 |
| Line-3 | 1.3254 | 16.5045 | 737.8 | 51 | 988.2113 | 0.7984 | 5.3252 |
| Line-4 | 1.3341 | 13.3077 | 1100.8 | 41 | 1202.7733 | 0.6160 | 5.4020 |
| Line-5 | 1.5008 | 13.9981 | 1047.2 | 41 | 13606.5106 | 0.7079 | 5.5700 |
| Line-6 | 1.1661 | 9.1123 | 2050 | 30 | 995.1714 | 0.4700 | 5.2800 |
| Line-7 | 1.6655 | 15.0971 | 581.5 | 38 | 946.8482 | 0.6075 | 5.1205 |
| Line-8 | 2.1528 | 21.1335 | 311.6 | 30 | 1159.7839 | 0.3491 | 2.2884 |
| Line-9 | 2.3622 | 20.0249 | 147.2 | 38 | 1391.3882 | 0.4366 | 5.8340 |
| Line-10 | 2.3216 | 21.7995 | 95.4 | NA | 394.5104 | 0.6448 | 4.3164 |
| Line-11 | 1.5449 | 20.7968 | 414.4 | 44 | 1199.5016 | 0.7484 | 5.6392 |
| Line-12 | 1.5902 | 15.8491 | 667.8 | 51 | 872.4820 | 0.8724 | 5.1316 |
| Line-13 | 1.2536 | 6.4468 | 2441 | 31 | 873.9356 | 0.5228 | 5.1264 |
| Line-14 | 1.7376 | 9.1779 | 687.5 | 27 | 1187.9820 | 0.3605 | 2.3065 |

Table 92: Provided are the values of each of the parameters (as described above) measured in Foxtail millet accessions (line) under drought growth conditions. Growth conditions are specified in the experimental procedure section

TABLE 93

Measured parameters of correlation IDs in foxtail millet accessions for Maintenance of performance under drought conditions

| Line/Cor. ID | 1 | 2 | 3 | 4 | 5 | 6 | 7 |
|---|---|---|---|---|---|---|---|
| Line-1 | 107.28492 | 63.80296 | 101.14903 | 103.09389 | 100.71910 | 102.26639 | 89.85420 |
| Line-2 | 97.44009 | 86.66199 | 100.63477 | 101.05865 | 101.13165 | 100.03126 | 121.19054 |
| Line-3 | 99.89264 | 90.61080 | 101.03545 | 102.80522 | 100.39213 | 102.38873 | 76.40597 |
| Line-4 | 97.29088 | 81.97765 | 100.28207 | 100.87451 | 100.43193 | 100.42313 | 83.95708 |
| Line-5 | 95.73134 | 84.03025 | 100.56979 | 101.56544 | 100.17700 | 101.33417 | 83.22790 |
| Line-6 | 99.52308 | 87.17613 | 99.36660 | 99.75367 | 99.50116 | 100.23080 | 70.03712 |
| Line-7 | 101.38380 | 73.57305 | 100.86771 | 101.13885 | 101.03305 | 100.21823 | 77.37223 |
| Line-8 | 102.16287 | 66.77138 | 99.64822 | 99.96068 | 99.16887 | 100.78369 | 111.74037 |
| Line-9 | 94.53807 | 83.21661 | 99.83736 | 98.88644 | 100.70881 | 98.15907 | 86.38569 |
| Line-10 | 102.69124 | 75.47131 | 101.82094 | 102.67156 | 102.00421 | 100.61236 | 57.78836 |
| Line-11 | 97.60676 | 90.15405 | 98.93543 | 97.94887 | 99.40096 | 98.50410 | 68.36558 |
| Line-12 | 97.81459 | 89.80968 | 97.98844 | 96.37703 | 97.77776 | 98.54474 | 57.64576 |
| Line-13 | 101.68636 | 89.51020 | 100.39095 | 101.18981 | 100.33465 | 100.85848 | 83.16443 |
| Line-14 | 99.50250 | 59.88639 | 99.19422 | 99.24780 | 98.98318 | 100.25762 | 132.38018 |

Table 93: Provided are the values of each of the parameters (as described above) measured in Foxtail millet accessions (line) for maintenance of performance under drought (calculated as % of change under drought vs normal growth conditions). Growth conditions are specified in the experimental procedure section.

TABLE 94

Additional measured parameters of correlation IDs in foxtail millet accessions for Maintenance of performance under drought conditions

| Line/Cor. ID | 8 | 9 | 10 | 11 | 12 | 13 | 14 |
|---|---|---|---|---|---|---|---|
| Line-1 | 94.50182 | 98.17799 | 96.68963 | 87.55847 | 78.74402 | 71.70254 | 75.80848 |
| Line-2 | 87.63360 | 98.29102 | 90.24976 | 85.12064 | 104.52251 | 85.76779 | 102.30604 |
| Line-3 | 93.93199 | 99.87804 | 93.97174 | 85.09804 | 64.38181 | 82.89037 | 85.90141 |
| Line-4 | 87.35732 | 98.42025 | 89.95839 | 91.42857 | 76.74662 | 66.68110 | 95.83452 |
| Line-5 | 89.50996 | 97.94159 | 91.00586 | 91.34682 | 75.80281 | 78.32485 | 88.82439 |
| Line-6 | 105.26046 | 98.75548 | 106.44273 | 96.15385 | 67.41849 | 98.01877 | 86.91644 |
| Line-7 | 91.55461 | 98.97568 | 93.88055 | 77.30657 | 59.82989 | 66.27755 | 81.03596 |
| Line-8 | 97.65054 | 101.33701 | 96.59358 | 79.04617 | 88.00374 | 77.03001 | 81.18348 |
| Line-9 | 93.05666 | 94.53334 | 98.09741 | 78.88532 | 65.27431 | 73.53882 | 80.43346 |
| Line-10 | 88.21016 | 95.66287 | 93.49773 | 72.38240 | 42.06192 | 64.63512 | 82.30493 |
| Line-11 | 97.27140 | 99.48243 | 99.65504 | 95.43989 | 63.79603 | 81.97152 | 85.75426 |
| Line-12 | 87.80382 | 100.35077 | 88.13167 | 103.31064 | 61.13590 | 84.96299 | 87.70167 |
| Line-13 | 102.45818 | 100.81763 | 101.47055 | 87.24712 | 71.85533 | 83.88960 | 91.15220 |
| Line-14 | 89.37679 | 95.46426 | 93.80683 | 69.12327 | 91.61620 | 77.76100 | 84.42533 |

Table 94: Provided are the values of each of the parameters (as described above) measured in Foxtail millet accessions (line) for maintenance of performance under drought (calculated as % of change under drought vs normal growth conditions). Growth conditions are specified in the experimental procedure section

TABLE 95

Measured parameters of correlation IDs in foxtail millet accessions under normal conditions

| Line/Cor. ID | 1 | 2 | 3 | 4 | 5 | 6 | 7 |
|---|---|---|---|---|---|---|---|
| Line-1 | 2.45995 | 2.39550 | 0.67477 | 0.03230 | 0.23989 | 0.17157 | 3.39810 |
| Line-2 | 3.41596 | 3.99160 | 0.71695 | 0.03689 | 0.24172 | 0.19428 | 7.28754 |
| Line-3 | 2.61327 | 3.16960 | 0.68170 | 0.03255 | 0.24860 | 0.16670 | 1.74902 |
| Line-4 | 2.35874 | 3.58000 | 0.68083 | 0.03161 | 0.25317 | 0.15900 | 1.30220 |
| Line-5 | 2.40635 | 3.59680 | 0.68626 | 0.03213 | 0.25634 | 0.15968 | 1.57325 |
| Line-6 | 2.65459 | 3.05680 | 0.69667 | 0.03353 | 0.25168 | 0.16966 | 0.69451 |
| Line-7 | 2.18488 | 4.04360 | 0.64249 | 0.02941 | 0.23076 | 0.16223 | 2.10395 |
| Line-8 | 1.79847 | 1.14600 | 0.57148 | 0.02386 | 0.19607 | 0.15493 | 3.34479 |
| Line-9 | 2.68629 | 3.19840 | 0.66174 | 0.03201 | 0.22145 | 0.18410 | 11.46040 |
| Line-10 | 1.64690 | 3.90400 | 0.58226 | 0.02458 | 0.19936 | 0.15712 | 7.16855 |
| Line-11 | 3.17197 | 3.58320 | 0.72818 | 0.03729 | 0.26240 | 0.18093 | 4.35102 |

TABLE 95-continued

Measured parameters of correlation IDs in foxtail millet accessions under normal conditions

| Line/Cor. ID | 1 | 2 | 3 | 4 | 5 | 6 | 7 |
|---|---|---|---|---|---|---|---|
| Line-12 | 2.59803 | 3.67800 | 0.68858 | 0.03326 | 0.25037 | 0.16901 | 2.26328 |
| Line-13 | 3.18446 | 2.94000 | 0.74550 | 0.03864 | 0.26910 | 0.18267 | 0.43640 |
| Line-14 | 2.25661 | 1.47880 | 0.66464 | 0.03032 | 0.24416 | 0.15822 | 1.31493 |

Table 95: Provided are the values of each of the parameters (as described above) measured in Foxtail millet accessions (line) under normal growth conditions. Growth conditions are specified in the experimental procedure section

TABLE 96

Additional measured parameters of correlation IDs in foxtail millet accessions under normal conditions

| Line/Cor. ID | 8 | 9 | 10 | 11 | 12 | 13 | 14 |
|---|---|---|---|---|---|---|---|
| Line-1 | 37.82752 | 1.90548 | 23.12861 | 427.60000 | 1449.62604 | 0.70263 | 3.80960 |
| Line-2 | 57.87014 | 2.72325 | 24.24950 | 149.20000 | 1067.88312 | 0.85440 | 5.94960 |
| Line-3 | 19.58832 | 1.32700 | 17.56325 | 867.00000 | 1534.92310 | 0.96320 | 6.19920 |
| Line-4 | 17.09980 | 1.35550 | 14.79317 | 1204.00000 | 1567.20040 | 0.92380 | 5.63680 |
| Line-5 | 19.75921 | 1.53239 | 15.38157 | 1146.40000 | 1794.80240 | 0.90380 | 6.27080 |
| Line-6 | 9.41542 | 1.18075 | 8.56073 | 2132.00000 | 1476.11048 | 0.47950 | 6.07480 |
| Line-7 | 22.92173 | 1.68275 | 16.08119 | 752.20000 | 1582.56728 | 0.91660 | 6.31880 |
| Line-8 | 40.88973 | 2.12436 | 21.87883 | 394.20000 | 1317.88024 | 0.45320 | 2.81880 |
| Line-9 | 45.29355 | 2.49875 | 20.41332 | 186.60000 | 2131.60156 | 0.59370 | 7.25320 |
| Line-10 | 49.34091 | 2.42686 | 23.31557 | 131.80000 | 937.92760 | 0.99760 | 5.24440 |
| Line-11 | 27.68630 | 1.55289 | 20.86882 | 434.20000 | 1880.21340 | 0.91300 | 6.57600 |
| Line-12 | 24.17832 | 1.58464 | 17.98348 | 646.40000 | 1427.11884 | 1.02680 | 5.85120 |
| Line-13 | 7.12724 | 1.24343 | 6.35334 | 2797.80000 | 1216.24320 | 0.62320 | 5.62400 |
| Line-14 | 14.68632 | 1.82013 | 9.78380 | 994.60000 | 1296.69424 | 0.46360 | 2.73200 |

Table 96: Provided are the values of each of the parameters (as described above) measured in Foxtail millet accessions (line) under normal growth conditions. Growth conditions are specified in the experimental procedure section

TABLE 97

Correlation between the expression level of selected genes of some embodiments of the invention in various tissues and the phenotypic performance under drought conditions across foxtail millet varieties

| Gene Name | R | P value | Exp. set | Cor. Set ID | Gene Name | R | P value | Exp. set | Cor. Set ID |
|---|---|---|---|---|---|---|---|---|---|
| LNU801 | 0.761 | 1.05E-02 | 2 | 16 | LNU801 | 0.789 | 6.66E-03 | 2 | 2 |
| LNU801 | 0.735 | 1.55E-02 | 2 | 17 | LNU802 | 0.846 | 3.37E-02 | 1 | 1 |
| LNU802 | 0.817 | 4.71E-02 | 1 | 4 | LNU802 | 0.817 | 4.72E-02 | 1 | 10 |
| LNU802 | 0.750 | 8.58E-02 | 1 | 3 | LNU802 | 0.795 | 5.87E-02 | 1 | 11 |
| LNU802 | 0.785 | 6.42E-02 | 1 | 8 | LNU802 | 0.870 | 2.42E-02 | 1 | 6 |
| LNU802 | 0.854 | 3.03E-02 | 1 | 9 | LNU803 | 0.824 | 4.40E-02 | 1 | 13 |
| LNU804 | 0.736 | 9.50E-02 | 1 | 12 | LNU804 | 0.711 | 1.13E-01 | 1 | 7 |
| LNU805 | 0.795 | 5.97E-03 | 2 | 7 | LNU806 | 0.797 | 5.77E-02 | 1 | 7 |
| LNU806 | 0.756 | 1.14E-02 | 2 | 1 | LNU806 | 0.816 | 3.96E-03 | 2 | 6 |
| LNU807 | 0.760 | 7.96E-02 | 1 | 15 | LNU807 | 0.865 | 2.60E-02 | 1 | 10 |
| LNU807 | 0.792 | 6.05E-02 | 1 | 11 | LNU807 | 0.857 | 2.91E-02 | 1 | 8 |
| LNU807 | 0.873 | 2.30E-02 | 1 | 9 | LNU807 | 0.739 | 1.47E-02 | 2 | 10 |
| LNU807 | 0.803 | 5.12E-03 | 2 | 8 | LNU807 | 0.737 | 1.50E-02 | 2 | 9 |
| LNU808 | 0.828 | 3.12E-03 | 2 | 5 | LNU809 | 0.703 | 1.19E-01 | 1 | 16 |
| LNU809 | 0.721 | 1.06E-01 | 1 | 2 | LNU809 | 0.709 | 2.16E-02 | 3 | 15 |
| LNU810 | 0.713 | 2.07E-02 | 2 | 13 | LNU810 | 0.705 | 2.28E-02 | 3 | 16 |
| LNU810 | 0.703 | 2.33E-02 | 3 | 13 | | | | | |

Table 97. Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient;
"P" = p value.

TABLE 98

Correlation between the expression level of selected genes of some embodiments of the invention in various tissues and the phenotypic performance of maintenance of performance under drought conditions across foxtail millet varieties

| Gene Name | R | P value | Exp. set | Cor. Set ID | Gene Name | R | P value | Exp. set | Cor. Set ID |
|---|---|---|---|---|---|---|---|---|---|
| LNU802 | 0.736 | 1.53E−02 | 1 | 1 | LNU802 | 0.818 | 3.82E−03 | 1 | 16 |
| LNU802 | 0.711 | 2.11E−02 | 1 | 13 | LNU804 | 0.728 | 2.62E−02 | 3 | 1 |
| LNU804 | 0.701 | 3.55E−02 | 3 | 6 | LNU804 | 0.917 | 7.23E−05 | 2 | 1 |
| LNU804 | 0.883 | 3.20E−04 | 2 | 4 | LNU804 | 0.808 | 2.61E−03 | 2 | 3 |
| LNU804 | 0.863 | 6.21E−04 | 2 | 6 | LNU807 | 0.712 | 1.40E−02 | 2 | 11 |
| LNU810 | 0.761 | 1.06E−02 | 1 | 16 | LNU810 | 0.706 | 2.25E−02 | 1 | 13 |
| LNU802 | 0.736 | 1.53E−02 | 1 | 1 | LNU802 | 0.818 | 3.82E−03 | 1 | 16 |
| LNU802 | 0.711 | 2.11E−02 | 1 | 13 | LNU804 | 0.728 | 2.62E−02 | 3 | 1 |
| LNU804 | 0.701 | 3.55E−02 | 3 | 6 | LNU804 | 0.917 | 7.23E−05 | 2 | 1 |
| LNU804 | 0.883 | 3.20E−04 | 2 | 4 | LNU804 | 0.808 | 2.61E−03 | 2 | 3 |
| LNU804 | 0.863 | 6.21E−04 | 2 | 6 | LNU807 | 0.712 | 1.40E−02 | 2 | 11 |
| LNU810 | 0.761 | 1.06E−02 | 1 | 16 | LNU810 | 0.706 | 2.25E−02 | 1 | 13 |

Table 98. Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient;
"P" = p value.

TABLE 99

Correlation between the expression level of selected genes of some embodiments of the invention in various tissues and the phenotypic performance under normal conditions across foxtail millet varieties

| Gene Name | R | P value | Exp. set | Cor. Set ID | Gene Name | R | P value | Exp. set | Cor. Set ID |
|---|---|---|---|---|---|---|---|---|---|
| LNU801 | 0.752 | 1.22E−02 | 2 | 15 | LNU802 | 0.711 | 1.42E−02 | 1 | 16 |
| LNU802 | 0.740 | 9.19E−03 | 1 | 13 | LNU803 | 0.704 | 2.30E−02 | 2 | 12 |
| LNU804 | 0.703 | 1.59E−02 | 1 | 5 | LNU804 | 0.748 | 8.11E−03 | 1 | 4 |
| LNU804 | 0.779 | 4.76E−03 | 1 | 3 | LNU805 | 0.748 | 1.29E−02 | 2 | 12 |
| LNU806 | 0.814 | 4.13E−03 | 2 | 11 | LNU807 | 0.765 | 6.06E−03 | 1 | 16 |
| LNU807 | 0.713 | 1.38E−02 | 1 | 2 | LNU809 | 0.786 | 4.09E−03 | 1 | 12 |
| LNU809 | 0.811 | 4.42E−03 | 2 | 17 | LNU801 | 0.703 | 5.17E−02 | 3 | 1 |
| LNU801 | 0.783 | 7.38E−03 | 2 | 8 | LNU801 | 0.823 | 1.21E−02 | 3 | 6 |
| LNU801 | 0.759 | 2.90E−02 | 3 | 17 | LNU801 | 0.744 | 9.00E−02 | 1 | 11 |
| LNU801 | 0.832 | 4.00E−02 | 1 | 10 | LNU801 | 0.810 | 5.07E−02 | 1 | 9 |
| LNU801 | 0.787 | 6.31E−02 | 1 | 6 | LNU802 | 0.756 | 1.13E−02 | 2 | 13 |
| LNU802 | 0.764 | 1.01E−02 | 2 | 14 | LNU802 | 0.904 | 2.09E−03 | 3 | 4 |
| LNU802 | 0.878 | 4.14E−03 | 3 | 1 | LNU802 | 0.817 | 4.70E−02 | 1 | 1 |
| LNU802 | 0.844 | 8.46E−03 | 3 | 3 | LNU802 | 0.764 | 7.68E−02 | 1 | 11 |
| LNU802 | 0.890 | 1.75E−02 | 1 | 10 | LNU802 | 0.863 | 2.68E−02 | 1 | 9 |
| LNU802 | 0.866 | 2.57E−02 | 1 | 6 | LNU803 | 0.833 | 3.94E−02 | 1 | 15 |
| LNU803 | 0.800 | 1.72E−02 | 3 | 15 | LNU804 | 0.886 | 1.88E−02 | 1 | 11 |
| LNU804 | 0.837 | 3.77E−02 | 1 | 10 | LNU804 | 0.834 | 3.91E−02 | 1 | 6 |
| LNU804 | 0.717 | 1.09E−01 | 1 | 8 | LNU805 | 0.774 | 8.66E−03 | 2 | 5 |
| LNU804 | 0.844 | 3.47E−02 | 1 | 9 | LNU805 | 0.828 | 4.18E−02 | 1 | 10 |
| LNU805 | 0.722 | 1.83E−02 | 2 | 7 | LNU805 | 0.778 | 6.84E−02 | 1 | 6 |
| LNU805 | 0.938 | 5.71E−03 | 1 | 8 | LNU806 | 0.838 | 2.47E−03 | 2 | 8 |
| LNU805 | 0.726 | 1.03E−01 | 1 | 9 | LNU806 | 0.733 | 1.60E−02 | 2 | 9 |
| LNU806 | 0.793 | 6.19E−03 | 2 | 6 | LNU806 | 0.715 | 4.63E−02 | 3 | 11 |
| LNU806 | 0.700 | 5.30E−02 | 3 | 15 | LNU806 | 0.741 | 9.19E−02 | 1 | 4 |
| LNU806 | 0.818 | 4.65E−02 | 1 | 1 | LNU806 | 0.985 | 3.40E−04 | 1 | 11 |
| LNU806 | 0.854 | 3.02E−02 | 1 | 10 | LNU806 | 0.936 | 5.93E−03 | 1 | 9 |
| LNU806 | 0.902 | 1.40E−02 | 1 | 6 | LNU807 | 0.765 | 9.98E−03 | 2 | 8 |
| LNU807 | 0.766 | 9.71E−03 | 2 | 10 | LNU807 | 0.823 | 1.20E−02 | 3 | 12 |
| LNU807 | 0.806 | 4.89E−03 | 2 | 9 | LNU807 | 0.816 | 4.77E−02 | 1 | 10 |
| LNU807 | 0.750 | 8.57E−02 | 1 | 1 | LNU807 | 0.810 | 5.07E−02 | 1 | 6 |
| LNU807 | 0.709 | 1.14E−01 | 1 | 11 | LNU808 | 0.725 | 4.19E−02 | 3 | 4 |
| LNU807 | 0.803 | 5.44E−02 | 1 | 9 | LNU808 | 0.871 | 4.83E−03 | 3 | 12 |
| LNU808 | 0.766 | 2.65E−02 | 3 | 3 | LNU808 | 0.955 | 3.05E−03 | 1 | 10 |
| LNU808 | 0.716 | 1.09E−01 | 1 | 1 | LNU808 | 0.902 | 1.38E−02 | 1 | 6 |
| LNU808 | 0.867 | 2.53E−02 | 1 | 8 | LNU809 | 0.706 | 2.25E−02 | 2 | 2 |
| LNU808 | 0.881 | 2.06E−02 | 1 | 9 | LNU809 | 0.823 | 1.21E−02 | 3 | 10 |
| LNU809 | 0.828 | 1.11E−02 | 3 | 15 | LNU809 | 0.930 | 8.08E−04 | 3 | 8 |
| LNU809 | 0.856 | 6.71E−03 | 3 | 11 | LNU809 | 0.885 | 1.91E−02 | 1 | 16 |
| LNU809 | 0.981 | 1.74E−05 | 3 | 9 | LNU809 | 0.770 | 7.31E−02 | 1 | 13 |

TABLE 99-continued

Correlation between the expression level of selected genes of some embodiments of the invention in various tissues and the phenotypic performance under normal conditions across foxtail millet varieties

| Gene Name | R | P value | Exp. set | Cor. Set ID | Gene Name | R | P value | Exp. set | Cor. Set ID |
|---|---|---|---|---|---|---|---|---|---|
| LNU809 | 0.872 | 2.37E−02 | 1 | 5 | LNU810 | 0.722 | 1.85E−02 | 2 | 16 |
| LNU809 | 0.792 | 6.03E−02 | 1 | 12 | LNU810 | 0.724 | 4.22E−02 | 3 | 16 |
| LNU810 | 0.785 | 7.20E−03 | 2 | 13 | LNU810 | 0.707 | 1.16E−01 | 1 | 13 |
| LNU810 | 0.722 | 4.31E−02 | 3 | 14 | LNU810 | 0.792 | 6.04E−02 | 1 | 12 |

Table 99. Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient;
"P" = p value.

Example 12

Gene Cloning and Generation of Binary Vectors for Plant Expression

To validate their role in improving yield, selected genes were over-expressed in plants, as follows.

Cloning Strategy

Selected genes from those presented in Examples 1-13 hereinabove were cloned into binary vectors for the generation of transgenic plants. For cloning, the full-length open reading frames (ORFs) were identified. EST clusters and in some cases mRNA sequences were analyzed to identify the entire open reading frame by comparing the results of several translation algorithms to known proteins from other plant species.

In order to clone the full-length cDNAs, reverse transcription (RT) followed by polymerase chain reaction (PCR; RT-PCR) was performed on total RNA extracted from leaves, roots or other plant tissues, growing under normal/limiting or stress conditions. Total RNA extraction, production of cDNA and PCR amplification was performed using standard protocols described elsewhere (Sambrook J., E. F. Fritsch, and T. Maniatis. 1989. Molecular Cloning. A Laboratory Manual, 2nd Ed. Cold Spring Harbor Laboratory Press, New York.) which are well known to those skilled in the art. PCR products were purified using PCR purification kit (Qiagen).

Usually, 2 sets of primers were prepared for the amplification of each gene, via nested PCR (if required). Both sets of primers were used for amplification on a cDNA. In case no product was obtained, a nested PCR reaction was performed. Nested PCR was performed by amplification of the gene using external primers and then using the produced PCR product as a template for a second PCR reaction, where the internal set of primers were used. Alternatively, one or two of the internal primers were used for gene amplification, both in the first and the second PCR reactions (meaning only 2-3 primers are designed for a gene). To facilitate further cloning of the cDNAs, an 8-12 base pairs (bp) extension was added to the 5' of each internal primer. The primer extension includes an endonuclease restriction site. The restriction sites were selected using two parameters: (a) the restriction site does not exist in the cDNA sequence; and (b) the restriction sites in the forward and reverse primers were designed such that the digested cDNA was inserted in the sense direction into the binary vector utilized for transformation.

PCR products were digested with the restriction endonucleases (New England BioLabs Inc) according to the sites designed in the primers. Each digested/undigested PCR product was inserted into a high copy vector pUC19 (New England BioLabs Inc], or into plasmids originating from this vector. In some cases the undigested PCR product was inserted into pCR-Blunt II-TOPO (Invitrogen) or into pJET1.2 (CloneJET PCR Cloning Kit, Thermo Scientific) or directly into the binary vector. The digested/undigested products and the linearized plasmid vector were ligated using T4 DNA ligase enzyme (Roche, Switzerland or other manufacturers). In cases where pCR-Blunt II-TOPO is used no T4 ligase is needed.

Sequencing of the inserted genes was performed, using the ABI 377 sequencer (Applied Biosystems). In some cases, after confirming the sequences of the cloned genes, the cloned cDNA was introduced into a modified pGI binary vector containing the At6669 promoter (e.g., pQFNc) and the NOS terminator (SEQ ID NO: 4891) via digestion with appropriate restriction endonucleases.

Figure 9A:
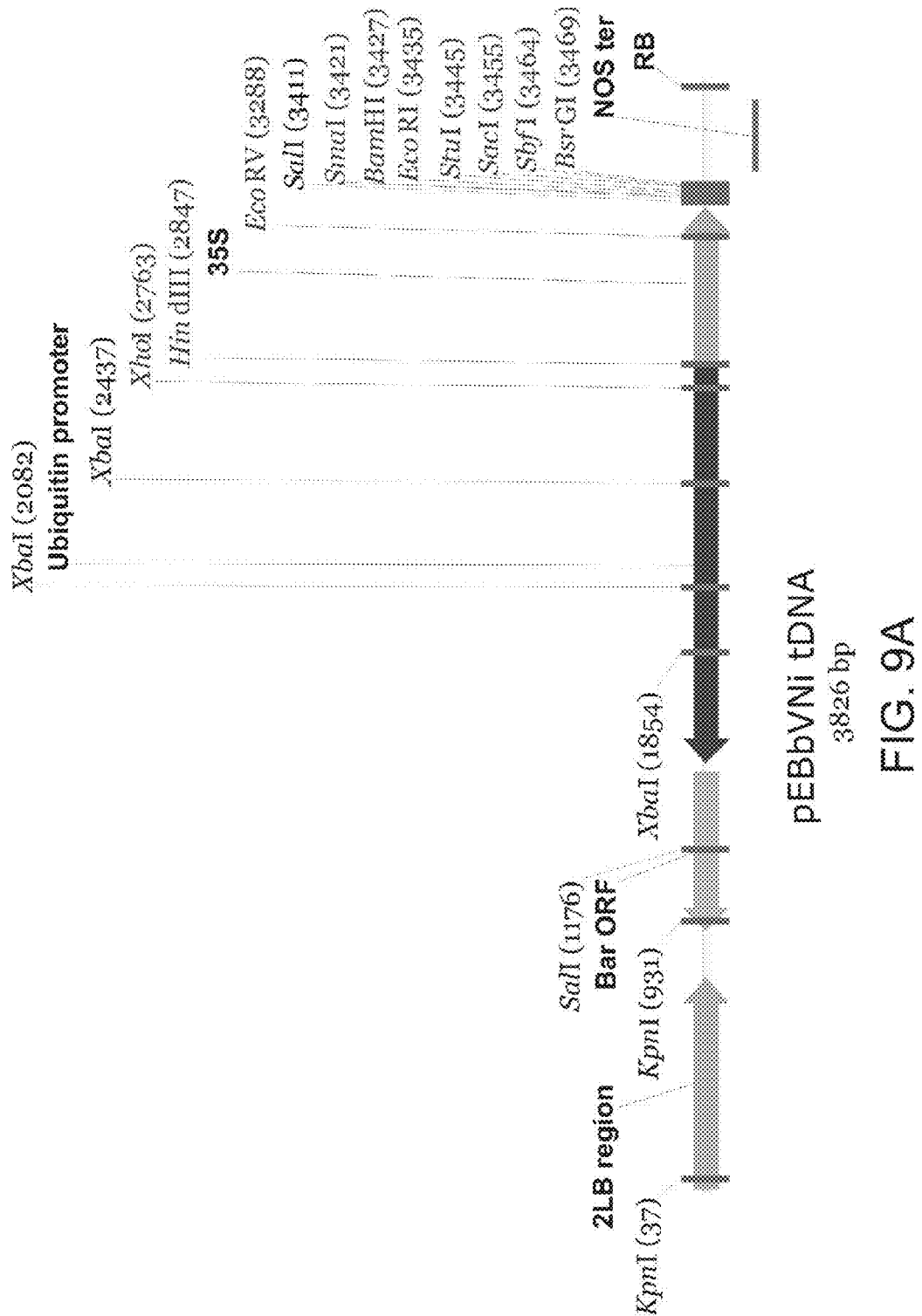
FIGS. 9A-B are schematic illustrations of the pEBbVNi tDNA (FIG. 9A) and the pEBbNi tDNA (FIG. 9B) plasmids used in the Brachypodium experiments. pEBbVNi tDNA (FIG. 9A) was used for expression of the isolated polynucleotide sequences of some embodiments of the invention in *Brachypodium*. pEBbNi tDNA (FIG. 9B) was used for transformation into *Brachypodium* as a negative control. "RB"=right border; "2LBregion"=2 repeats of left border; "35S"=35S promoter (SEQ ID NO:4892); "NOS ter"=nopaline synthase terminator; "Bar ORF"—BAR open reading frame (GenBank Accession No. JQ293091.1; SEQ ID NO:5436); The isolated polynucleotide sequences of some embodiments of the invention were cloned into the Multiple cloning site of the vector using one or more of the indicated restriction enzyme sites.

In case of *Brachypodium* transformation, after confirming the sequences of the cloned genes, the cloned cDNAs were introduced into pEBbVNi (FIG. 9A) containing 35S promoter (SEQ ID NO: 4892) and the NOS terminator (SEQ ID NO:4891) via digestion with appropriate restriction endonucleases. The genes were cloned downstream to the 35S promoter and upstream to the NOS terminator.

Several DNA sequences of the selected genes were synthesized by GeneArt (Life Technologies, Grand Island, N.Y., USA). Synthetic DNA was designed in silico. Suitable restriction enzymes sites were added to the cloned sequences at the 5' end and at the 3' end to enable later cloning into the desired binary vector.

Binary vectors—

The pPI plasmid vector was constructed by inserting a synthetic poly-(A) signal sequence, originating from pGL3 basic plasmid vector (Promega, GenBank Accession No. U47295; nucleotides 4658-4811) into the HindIII restriction site of the binary vector pBI101.3 (Clontech, GenBank Accession No. U12640). pGI is similar to pPI, but the original gene in the backbone is GUS-Intron and not GUS.

The modified pGI vector (e.g., pQFN, pQFNc, pQYN_6669, pQNa_RP, pQFYN or pQXNc) is a modified version of the pGI vector in which the cassette is inverted between the left and right borders so the gene and its corresponding promoter are close to the right border and the NPTII gene is close to the left border.

At6669, the new *Arabidopsis thaliana* promoter sequence (SEQ ID NO:4880) was inserted in the modified pGI binary vector, upstream to the cloned genes, followed by DNA ligation and binary plasmid extraction from positive *E. coli* colonies, as described above. Colonies were analyzed by PCR using the primers covering the insert which were designed to span the introduced promoter and gene. Positive plasmids were identified, isolated and sequenced.

pEBbVNi (FIG. 9A) is a modified version of pJJ2LB in which the Hygromycin resistance gene was replaced with the BAR gene which confers resistance to the BASTA herbicide [BAR gene coding sequence is provided in Gen-Bank Accession No. JQ293091.1 (SEQ ID NO:5436); further description is provided in Akama K, et al. "*Efficient Agrobacterium-mediated transformation of Arabidopsis thaliana using the bar gene as selectable marker*", Plant Cell Rep. 1995, 14(7):450-4; Christiansen P, et al. "*A rapid and efficient transformation protocol for the grass Brachypodium distachyon*", Plant Cell Rep. 2005 March; 23(10-11): 751-8. Epub 2004 Oct. 19; and Păcurar D I, et al. "*A high-throughput Agrobacterium-mediated transformation system for the grass model species Brachypodium distachyon L*", Transgenic Res. 2008 17(5):965-75; each of which is fully incorporated herein by reference in its entirety]. The pEBbVNi construct contains the 35S promoter (SEQ ID NO:4892). pJJ2LB is a modified version of pCambia0305.2 (Cambia).

In case genomic DNA was cloned, the genes were amplified by direct PCR on genomic DNA extracted from leaf tissue using the DNAeasy kit (Qiagen Cat. No. 69104).

Selected genes cloned by the present inventors are provided in Table 100 below.

TABLE 100

| Gene Name | High copy plasmid | Organism | Primers used SEQ ID NOs: | Polynucleotide SEQ ID NO: | Polypeptide SEQ ID NO: |
|---|---|---|---|---|---|
| LNU749 | pQFNc_LNU749 | barley | 5383, 4897, 5412, 4906 | 289 | 747 |
| LNU750 | pQFNc_LNU750 | barley | 5182, 5357, 5182, 5245 | 2 | 497 |
| LNU751 | pQFNc_LNU751 | barley | 5096, 5214, 5073, 5362 | 290 | 498 |
| LNU752 | pUC19c_LNU752 | barley | 5087, 5232, 5087, 5232 | 291 | 748 |
| LNU753 | pQFNc_LNU753 | barley | 5416, 4974, 5416, 4972 | 292 | 500 |
| LNU754 | pQFNc_LNU754 | barley | 5067, 5338, 5067, 5338 | 293 | 501 |
| LNU756 | pQFNc_LNU756 | barley | 5019, 5321, 5164, 5326 | 294 | 502 |
| LNU757 | pQFNc_LNU757 | barley | 5088, 5273, 5137, 5257 | 295 | 503 |
| LNU758 | pMA-RQ_LNU758_GA | | | 296 | 504 |
| LNU759 | pQFNc_LNU759 | barley | 5392, 4949, 5402, 4976 | 297 | 505 |
| LNU760_H1 | pQFNc_LNU760_H1 | brachypodium | 5043, 5359, 5043, 5359 | 491 | 708 |
| LNU761 | pUC19c_LNU761 | barley | 5373, 4954, 5373, 4962 | 298 | 507 |
| LNU762 | pQFNc_LNU762 | barley | 5371, 4898, 5391, 4912 | 299 | 508 |
| LNU763 | pQFNc_LNU763 | barley | 5149, 5349, 5026, 5228 | 300 | 509 |
| LNU764 | pUC19c_LNU764 | barley | 5396, 4899, 5396, 4913 | 301 | 510 |
| LNU766 | pUC19c_LNU766 | barley | 5125, 4965, 5125, 4965 | 302 | 749 |
| LNU767 | pMA_LNU767_GA | | | 303 | 512 |
| LNU768 | pQFNc_LNU768 | barley | 5146, 5345, 5146, 5332 | 304 | 513 |
| LNU769 | pUC19c_LNU769 | barley | 4929, 4987, 4929, 4989 | 305 | 750 |
| LNU770 | pQFNc_LNU770 | barley | 5201, 5316, 5061, 5240 | 306 | 515 |
| LNU771 | pQFNc_LNU771 | barley | 5175, 5242, 5175, 5242 | 307 | 516 |
| LNU772 | TopoB_LNU772 | barley | 5107, 5351, 5107, 5285 | 308 | 517 |
| LNU773 | TopoB_LNU773 | barley | 5165, 4960, 5165, 4960 | 309 | 751 |
| LNU774 | pQFNc_LNU774 | barley | 4928, 4943, 4928, 4943 | 310 | 519 |
| LNU775 | pQFNc_LNU775 | barley | 5389, 5183, 5389, 5183 | 311 | 520 |
| LNU776 | pUC19_LNU776 | barley | 5075, 5266, 5085, 5266 | 312 | 752 |
| LNU777 | pQFNc_LNU777 | barley | 5174, 5205, 5174, 5205 | 313 | 522 |
| LNU778 | pMK-RQ_LNU778_GA | | | 314 | 523 |
| LNU779 | pQFNc_LNU779 | barley | 5428, 4902, 5403, 4895 | 315 | 524 |
| LNU780 | pQFNc_1NU780 | barley | 5098, 5354, 5098, 5354 | 316 | 753 |
| LNU781 | pMA-RQ_LNU781_GA | | | 317 | 526 |
| LNU782 | pQFNc_LNU782 | barley | 5415, 4996, 5415, 4996 | 318 | 527 |
| LNU783 | pQFNc_LNU783 | barley | 5103, 5212, 5160, 5238 | 319 | 528 |
| LNU784 | pQFNc_LNU784 | barley | 5143, 5243, 5143, 5243 | 320 | 754 |
| LNU785 | TopoB_LNU785 | barley | 5111, 5246, 5056, 5282 | 321 | 530 |
| LNU786 | TopoB_LNU786 | barley | 5082, 5010, 5082, 5000 | 322 | 755 |
| LNU787 | pMA-RQ_LNU787_GA | | | 323 | 532 |
| LNU788 | pQFNc_LNU788 | brachypodium | 5184, 5310, 5153, 5227 | 324 | 756 |
| LNU789 | pQFNc_LNU789 | brachypodium | 5409, 5001, 5414, 5013 | 325 | 534 |
| LNU790 | pQFNc_LNU790 | brachypodium | 5101, 5237, 5101, 5237 | 326 | 535 |
| LNU791 | pQFNc_LNU791 | brachypodium | 5080, 5203, 5080, 5203 | 327 | 536 |
| LNU792 | pQFNc_LNU792 | brachypodium | 5055, 5003, 5018, 5006 | 328 | 537 |
| LNU793 | pUC19c_LNU793 | brachypodium | 5144, 5253, 5023, 5343 | 329 | 538 |
| LNU794 | pMA-T_LNU794_GA | | | 330 | 539 |
| LNU795 | pQFNc_LNU795 | brachypodium | 5119, 5234, 5119, 5234 | 331 | 757 |
| LNU796 | pQFNc_LNU796 | brachypodium | 5400, 4971, 5400, 4971 | 332 | 541 |
| LNU797 | pQFNc_LNU797 | brachypodium | 5148, 5358, 5123, 5287 | 333 | 542 |
| LNU798 | pMA-RQ_LNU798_GA | | | 334 | 543 |
| LNU799 | pQFNc_LNU799 | *Brachypodiums distachyon* ND | 5390, 5028, 5390, 5028 | 335 | 544 |
| LNU800 | pQFNc_LNU800 | brachypodium | 5063, 5337, 5069, 5236 | 336 | 545 |
| LNU801 | pUC19d_LNU801 | foxtail_millet | 5002, 4923, 5002, 4930 | 337 | 546 |
| LNU802 | pUC19c_LNU802 | foxtail_millet | 5186, 5344, 5186, 5262 | 338 | 547 |
| LNU803 | pQFNc_LNU803 | foxtail_millet | 5092, 5218, 5052, 5356 | 339 | 548 |
| LNU804 | pUC19c_LNU804 | foxtail_millet | 5062, 5215, 5131, 5292 | 340 | 758 |
| LNU805 | pQFNc_LNU805 | foxtail_millet | 5395, 4893, 5431, 4900 | 341 | 550 |
| LNU806 | pQFNc_LNU806 | foxtail_millet | 5401, 4940, 5376, 4975 | 342 | 759 |

TABLE 100-continued

| Gene Name | High copy plasmid | Organism | Primers used SEQ ID NOs: | Polynucleotide SEQ ID NO: | Polypeptide SEQ ID NO: |
|---|---|---|---|---|---|
| LNU807 | pUC19c_LNU807 | foxtail_millet | 4926, 4907, 4927, 4911 | 343 | 552 |
| LNU808 | pQFNc_LNU808 | foxtail_millet | 5124, 5366, 5099, 5221 | 344 | 553 |
| LNU809 | pQFNc_LNU809 | foxtail_millet | 5033, 5275, 5033, 5275 | 345 | 760 |
| LNU811 | pUC19c_LNU811 | maize | 5021, 5259, 5021, 5259 | 346 | 556 |
| LNU813 | pQFNc_LNU813 | maize | 5387, 4968, 5387, 4968 | 347 | 557 |
| LNU814 | pMA-RQ_LNU814_GA | | | 348 | 558 |
| LNU815 | pQFNc_LNU815 | maize | 5115, 5334, 5158, 5335 | 349 | 559 |
| LNU816 | pUC19c_LNU816 | maize | 4916, 4937, 4918, 4932 | 350 | 761 |
| LNU817 | pQFNc_LNU817 | maize | 5135, 5244, 5135, 5244 | 351 | 762 |
| LNU818 | TopoB_LNU818 | maize | 5369, 5077, 5372, 5138 | 352 | 763 |
| LNU819 | pQFNc_LNU819 | maize | 5038, 5283, 5038, 5283 | 353 | 563 |
| LNU820 | pQFNc_LNU820 | maize | 5150, 5249, 5150, 5249 | 354 | 564 |
| LNU821 | TopoB_LNU821 | maize | 5393, 5104, 5393, 5104 | 355 | 764 |
| LNU822 | pMA-T_LNU822_GA | | | 356 | 566 |
| LNU823 | pQFNc_LNU823 | maize | 5042, 5339, 5095, 5225 | 357 | 567 |
| LNU824 | pQFNc_LNU824 | maize | 5051, 5361, 5051, 5361 | 358 | 765 |
| LNU825 | pQFNc_LNU825 | maize | 5079, 5324, 5079, 5324 | 359 | 766 |
| LNU828 | pQFNc_LNU828 | maize | 5426, 4981, 5426, 4981 | 360 | 570 |
| LNU829 | pQFNc_LNU829 | maize | 5024, 5217, 5059, 5220 | 361 | 767 |
| LNU830 | TopoB_LNU830 | maize | 5004, 4985, 5004, 4985 | 362 | 572 |
| LNU831 | pQFNc_LNU831 | maize | 5118, 5226, 5142, 5224 | 363 | 768 |
| LNU832_H2 | pQFNc_LNU832_H2 | sorghum | 5418, 5083, 5418, 5083 | 492 | 709 |
| LNU833 | pUC19c_LNU833 | maize | 5110, 5250, 5025, 5223 | 364 | 769 |
| LNU834_H1 | pMA-RQ_LNU834_H1_GA | | | 493 | 710 |
| LNU835 | pUC19c_LNU835 | maize | 5384, 5189, 5394, 5199 | 365 | 577 |
| LNU837 | TopoB_LNU837 | maize | 5040, 5260, 5040, 5260 | 366 | 770 |
| LNU838 | pQFNc_LNU838 | maize | 5434, 4956, 5434, 4956 | 367 | 579 |
| LNU839 | pQFNc_LNU839 | maize | 4931, 4966, 4931, 4966 | 368 | 580 |
| LNU840 | pQFNc_LNU840 | maize | 5020, 5261, 5020, 5308 | 369 | 581 |
| LNU841 | pQFNc_LNU841 | maize | 5197, 5435 | 370 | 582 |
| LNU843 | pUC19_LNU843 | maize | 5022, 5009, 5022, 5005 | 371 | 583 |
| LNU844 | pQFNc_LNU844 | maize | 4933, 4958, 4936, 4991 | 372 | 584 |
| LNU845 | TopoB_LNU845 | maize | 5375, 4986, 5413, 4994 | 373 | 771 |
| LNU846 | pUC19c_LNU846 | maize | 5058, 5286, 5162, 5269 | 374 | 586 |
| LNU847 | pUC19c_LNU847 | medicago | 5430, 4905, 5419, 4910 | 375 | 772 |
| LNU848 | pQFNc_LNU848 | rice | 5060, 5268, 5035, 5314 | 376 | 588 |
| LNU849 | pMA_LNU849_GA | | | 377 | 589 |
| LNU850 | pMA_LNU850_GA | | | 378 | 590 |
| LNU851 | pMA-RQ_LNU851_GA | | | 379 | 591 |
| LNU852 | pMK-RQ_LNU852_GA | | | 380 | 592 |
| LNU853 | TopoB_LNU853 | rice | 4983, 4909, 4983, 4909 | 381 | 593 |
| LNU854 | pUC19c_LNU854 | rice | 4935, 4973, 4938, 4979 | 382 | 594 |
| LNU856 | pUC19c_LNU856 | sorghum | 5198, 5241, 5198, 5241 | 383 | 595 |
| LNU857 | pQFNc_LNU857 | sorghum | 5070, 5350, 5070, 5208 | 384 | 773 |
| LNU858 | pUC19_LNU858 | sorghum | 5427, 4964, 5427, 4964 | 385 | 774 |
| LNU859 | TopoB_LNU859 | sorghum | 5417, 4999, 5417, 4999 | 495 | |
| LNU861_H3 | pMA_LNU861_H3_GA | | | 494 | 711 |
| LNU862 | TopoB_LNU862 | sorghum | 5422, 4957, 5406, 4970 | 386 | 599 |
| LNU864 | pQFNc_LNU864 | sorghum | 5140, 5336, 5017, 5309 | 387 | 600 |
| LNU865 | pUC19c_LNU865 | sorghum | 5181, 5346, 5181, 5346 | 388 | 601 |
| LNU866 | pQFNc_LNU866 | sorghum | 5151, 5307, 5185, 5363 | 389 | 775 |
| LNU867 | pUC19c_LNU867 | sorghum | 5045, 5353, 5045, 5353 | 390 | 603 |
| LNU868 | pQFNc_LNU868 | sorghum | 5084, 5333, 5159, 5291 | 391 | 604 |
| LNU869 | pQFNc_LNU869 | sorghum | 5170, 5272, 5170, 5289 | 392 | 605 |
| LNU870 | pUC19c_LNU870 | sorghum | 5108, 5322, 5132, 5204 | 393 | 606 |
| LNU871 | pUC19c_LNU871 | sorghum | 5404, 4955, 5404, 4955 | 394 | 607 |
| LNU872 | pQFNc_LNU872 | sorghum | 5177, 5248, 5048, 5231 | 395 | 608 |
| LNU873 | pUC19_LNU873 | sorghum | 4934, 4967, 4934, 4967 | 396 | 609 |
| LNU874 | TopoB_LNU874 | sorghum | 5027, 5012, 5027, 5007 | 397 | 610 |
| LNU875 | pUC19c_LNU875 | sorghum | 5423, 4945, 5386, 4995 | 398 | 611 |
| LNU876 | TopoB_LNU876 | sorghum | 5178, 5263, 5136, 5213 | 399 | 612 |
| LNU878 | pQFNc_LNU878 | sorghum | 5432, 5166, 5432, 5166 | 400 | 613 |
| LNU879 | pQFNc_LNU879 | sorghum | 5112, 5288, 5112, 5288 | 401 | 614 |
| LNU880 | pUC19c_LNU880 | sorghum | 5109, 5303, 5157, 5296 | 402 | 615 |
| LNU881 | pUC19c_LNU881 | sorghum | 4915, 5105, 4917, 5106 | 403 | 616 |
| LNU882 | pUC19c_LNU882 | sorghum | 4978, 4896, 4977, 4904 | 404 | 617 |
| LNU884 | pMA-RQ_LNU884_GA | | | 405 | 619 |
| LNU885 | pMA_LNU885_GA | | | 406 | 620 |
| LNU886 | pQFNc_LNU886 | sorghum | 5011, 4939, 5008, 4925 | 407 | 776 |
| LNU887 | TopoB_LNU887 | sorghum | 4924, 4982, 4924, 4982 | 408 | 622 |
| LNU888 | pQFNc_LNU888 | sorghum | 5081, 5278, 5081, 5278 | 409 | 623 |
| LNU889 | pUC19c_LNU889 | sorghum | 5411, 4961, 5411, 4961 | 410 | 624 |
| LNU890 | pUC19c_LNU890 | sorghum | 5076, 5211, 5076, 5211 | 411 | 625 |
| LNU892 | pMA-RQ_LNU892_GA | | | 412 | 626 |
| LNU893 | pQFNc_LNU893 | sorghum | 5036, 5277, 5030, 5277 | 413 | 627 |
| LNU894 | pUC19c_LNU894 | sorghum | 5155, 5219, 5155, 5313 | 414 | 628 |

TABLE 100-continued

| Gene Name | High copy plasmid | Organism | Primers used SEQ ID NOs: | Polynucleotide SEQ ID NO: | Polypeptide SEQ ID NO: |
|---|---|---|---|---|---|
| LNU895 | pQFNc_LNU895 | sorghum | 5398, 5071, 5398, 5169 | 415 | 629 |
| LNU896 | pUC19_LNU896 | sorghum | 5130, 5206, 5133, 5300 | 416 | 630 |
| LNU897 | pQFNc_LNU897 | sorghum | 5037, 5210, 5032, 5229 | 417 | 777 |
| LNU898 | pUC19_LNU898 | sorghum | 5176, 4950, 5128, 4992 | 418 | 778 |
| LNU899 | pUC19_LNU899 | sorghum | 5195, 5348, 5113, 5355 | 419 | 633 |
| LNU900 | pQFNc_LNU900 | sorghum | 5086, 5270, 5086, 5270 | 420 | 779 |
| LNU901 | TopoB_LNU901 | sorghum | 5163, 5280 | 421 | 780 |
| LNU902 | pQFNc_LNU902 | sorghum | 5129, 5311, 5167, 5264 | 422 | 636 |
| LNU903 | pMK-RQ_LNU903_GA | | | 423 | 637 |
| LNU904 | pUC19c_LNU904 | sorghum | 5368, 5057, 5421, 5188 | 424 | 781 |
| LNU905 | pUC19c_LNU905 | sorghum | 5029, 5235, 5091, 5319 | 425 | 639 |
| LNU906 | pQFNc_LNU906 | sorghum | 5154, 5325, 5050, 5274 | 426 | 782 |
| LNU907 | pQFNc_LNU907 | sorghum | 5377, 5360, 5377, 5360 | 427 | 783 |
| LNU908 | pQFNc_LNU908 | sorghum | 5397, 5065, 5382, 5041 | 428 | 642 |
| LNU909 | pUC19c_LNU909 | sorghum | 5424, 4998, 5407, 4941 | 429 | 784 |
| LNU910 | pQFNc_LNU910 | sorghum | 5200, 5279, 5200, 5279 | 430 | 644 |
| LNU911 | pUC19_LNU911 | sorghum | 5090, 5202, 5194, 5230 | 431 | 785 |
| LNU912 | pQFNc_LNU912 | sorghum | 5187, 5327, 5074, 5299 | 432 | 646 |
| LNU913 | pUC19_LNU913 | sorghum | 5156, 5015, 5196, 5014 | 433 | 647 |
| LNU914 | TopoB_LNU914 | sorghum | 4914, 4919, 4920, 4921 | 434 | 648 |
| LNU915 | pUC19c_LNU915 | sorghum | 5134, 5239, 5134, 5239 | 435 | 649 |
| LNU916 | TopoB_LNU916 | sorghum | 5180, 5276, 5190, 5290 | 436 | 650 |
| LNU917 | pQFNc_LNU917 | sorghum | 5168, 5347, 5121, 5233 | 437 | 651 |
| LNU918 | pUC19c_LNU918 | sorghum | 5381, 4980, 5381, 4980 | 438 | 652 |
| LNU919 | pMA_LNU919_GA | | | 439 | 653 |
| LNU920 | pMA-RQ_LNU920_GA | | | 440 | 654 |
| LNU921 | pQFNc_LNU921 | sorghum | 5094, 5222, 5193, 5256 | 441 | 655 |
| LNU922 | pMA-T_LNU922_GA | | | 442 | 656 |
| LNU923 | pQFNc_LNU923 | sorghum | 5173, 5293, 5173, 5293 | 443 | 657 |
| LNU924 | pQFNc_LNU924 | sorghum | 5049, 5365 | 444 | 658 |
| LNU925 | pUC19c_LNU925 | sorghum | 5410, 5097, 5405, 5066 | 445 | 659 |
| LNU926 | pQFNc_LNU926 | sorghum | 5145, 5301, 5145, 5320 | 446 | 660 |
| LNU928 | pUC19c_LNU928 | sorghum | 5114, 5252, 5141, 5329 | 447 | 661 |
| LNU930 | pUC19c_LNU930 | sorghum | 5039, 5251, 5089, 5209 | 448 | 786 |
| LNU931 | pMA_LNU931_GA | | | 449 | 664 |
| LNU932 | TopoB_LNU932 | sorghum | 5117, 5255, 5117, 5255 | 450 | 787 |
| LNU933 | pQFNc_LNU933 | sorghum | 5379, 5046, 5433, 5191 | 451 | 666 |
| LNU934 | pOA_LNU934_GA | | | 452 | 667 |
| LNU935 | pQFNc_LNU935 | sorghum | 5152, 5267, 5152, 5267 | 453 | 788 |
| LNU936 | pMA-RQ_LNU936_GA | | | 454 | 669 |
| LNU938 | pQFNc_LNU938 | sorghum | 5072, 5284, 5047, 5265 | 455 | 789 |
| LNU940 | pQFNc_LNU940 | sorghum | 5161, 5254, 5161, 5254 | 456 | 672 |
| LNU941 | pQFNc_LNU941 | sorghum | 5031, 5323, 5031, 5323 | 457 | 673 |
| LNU942 | pQFNc_LNU942 | sorghum | 5054, 5258 | 458 | 674 |
| LNU943 | pQFNc_LNU943 | sorghum | 5388, 4948, 5385, 4944 | 459 | 675 |
| LNU944 | pUC19_LNU944 | sorghum | 5100, 5294, 5100, 5342 | 460 | 676 |
| LNU945 | pMA-RQ_LNU945_GA | | | 461 | 677 |
| LNU946 | pUC19_LNU946 | sorghum | 4984, 4908, 4959, 4901 | 462 | 678 |
| LNU947 | pQFNc_LNU947 | sorghum | 5370, 4946, 5370, 4946 | 463 | 679 |
| LNU948 | pUC19c_LNU948 | sorghum | 5120, 5306, 5127, 5216 | 464 | 680 |
| LNU949 | pMA-RQ_LNU949_GA | | | 465 | 681 |
| LNU950 | pUC19c_LNU950 | sorghum | 5116, 5312, 5116, 5312 | 466 | 682 |
| LNU951 | pQFNc_LNU951 | sorghum | 4922, 4951, 4922, 4951 | 467 | 790 |
| LNU952 | pUC19c_LNU952 | sorghum | 5380, 4997, 5378, 4947 | 468 | 684 |
| LNU953 | pUC19c_LNU953 | sorghum | 5078, 5247, 5078, 5207 | 469 | 685 |
| LNU954 | pQFNc_LNU954 | sorghum | 5139, 5340, 5044, 5298 | 470 | 791 |
| LNU955 | pMA_LNU955_GA | | | 471 | 687 |
| LNU956 | pQFNc_LNU956 | sorghum | 5429, 4993, 5425, 4952 | 472 | 792 |
| LNU957 | pMK-RQ_LNU957_GA | | | 473 | 689 |
| LNU958 | pQFNc_LNU958 | sorghum | 5122, 5295, 5122, 5295 | 474 | 690 |
| LNU959 | pUC19c_LNU959 | sorghum | 5172, 5297 | 475 | 691 |
| LNU960 | pUC19_LNU960 | sorghum | 5147, 5304, 5034, 5331 | 476 | 692 |
| LNU961 | pOA_LNU961_GA | | | 477 | 693 |
| LNU962 | pUC19_LNU962 | sorghum | 4988, 4894, 4990, 4903 | 478 | 694 |
| LNU963 | pUC19c_LNU963 | sorghum | 5420, 4942, 5408, 4963 | 479 | 695 |
| LNU964 | pMA-RQ_LNU964_GA | | | 480 | 696 |
| LNU965 | pQFNc_LNU965 | sorghum | 5102, 5302 | 481 | 697 |
| LNU966 | TopoB_LNU966 | sorghum | 5068, 5328, 5192, 5330 | 482 | 698 |
| LNU967 | pUC19_LNU967 | sorghum | 5399, 4953, 5374, 4969 | 483 | 699 |
| LNU968 | pQFNc_LNU968 | sorghum | 5093, 5315 | 484 | 793 |
| LNU970 | pMA-T_LNU970_GA | | | 485 | 702 |
| LNU971 | pMA-T_LNU971_GA | | | 486 | 703 |
| LNU972 | TopoB_LNU972 | tomato | 5171, 5305, 5126, 5318 | 487 | 704 |

TABLE 100-continued

| Gene Name | High copy plasmid | Organism | Primers used SEQ ID NOs: | Polynucleotide SEQ ID NO: | Polypeptide SEQ ID NO: |
|---|---|---|---|---|---|
| LNU975 | pQFNc_LNU975 | tomato | 5064, 5367, 5016, 5271 | 488 | 705 |
| LNU976 | pQFNc_LNU976 | wheat | 5053, 5341, 5179, 5352 | 489 | 706 |
| LNU977 | pQFNc_LNU977 | wheat | 5281, 5364, 5281, 5317 | 490 | 794 |

Table 100. Provided are the names of the cloned genes, the high copy plasmids, the organism from which the gene was cloned, the primers used for cloning, and the sequence identifiers of the polynucleotides and polypeptides of the cloned genes.

Example 13

Transforming *Agrobacterium tumefaciens* Cells with Binary Vectors Harboring the Polynucleotides of the Invention The above described binary vectors were used to transform *Agrobacterium* cells. Two additional binary constructs, having only the At6669 or the 35S promoter, or no additional promoter were used as negative controls.

The binary vectors were introduced to *Agrobacterium tumefaciens* GV301 or LB4404 (for *Arabidopsis*) or to AGL1 (for *Brachypodium*) competent cells (about $10^9$ cells/mL) by electroporation. The electroporation was performed using a MicroPulser electroporator (Biorad), 0.2 cm cuvettes (Biorad) and EC-2 electroporation program (Biorad). The treated cells were cultured in LB liquid medium at 28° C. for 3 hours, then plated over LB agar supplemented with gentamycin (for *Arabidopsis*; 50 mg/L; for *Agrobacterium* strains GV301) or streptomycin (for *Arabidopsis*; 300 mg/L; for *Agrobacterium* strain LB4404); or with Carbenicillin (for *Brachypodium*; 50 mg/L) and kanamycin (for *Arabidopsis* and *Brachypodium*; 50 mg/L) at 28° C. for 48 hours. *Agrobacterium* colonies, which were developed on the selective media, were further analyzed by PCR using the primers designed to span the inserted sequence in the pPI plasmid. The resulting PCR products were isolated and sequenced to verify that the correct polynucleotide sequences of the invention are properly introduced to the *Agrobacterium* cells.

Example 14

Transformation of *Arabidopsis thaliana* Plants with the Polynucleotides of the Invention

*Arabidopsis thaliana* Columbia plants ($T_0$ plants) were transformed using the Floral Dip procedure described by Clough and Bent, 1998 (Floral dip: a simplified method for *Agrobacterium*-mediated transformation of *Arabidopsis thaliana*. Plant J 16:735-43) and by Desfeux et al., 2000 (Female Reproductive Tissues Are the Primary Target of *Agrobacterium*-Mediated Transformation by the *Arabidopsis* Floral-Dip Method. Plant Physiol, July 2000, Vol. 123, pp. 895-904), with minor modifications. Briefly, $T_0$ Plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hour light/dark cycles. The $T_0$ plants were ready for transformation six days before anthesis.

Single colonies of *Agrobacterium* carrying the binary constructs were generated as described in Examples 12-13 above. Colonies were cultured in LB medium supplemented with kanamycin (50 mg/L) and gentamycin (50 mg/L). The cultures were incubated at 28° C. for 48 hours under vigorous shaking and then centrifuged at 4000 rpm for 5 minutes. The pellets comprising the *Agrobacterium* cells were re-suspended in a transformation medium containing half-strength (2.15 g/L) Murashige-Skoog (Duchefa); 0.044 µM benzylamino purine (Sigma); 112 µg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants was performed by inverting each plant into an *Agrobacterium* suspension, such that the above ground plant tissue was submerged for 3-5 seconds. Each inoculated $T_0$ plant was immediately placed in a plastic tray, then covered with clear plastic dome to maintain humidity and is kept in the dark at room temperature for 18 hours, to facilitate infection and transformation. Transformed (transgenic) plants were then uncovered and transferred to a greenhouse for recovery and maturation. The transgenic $T_0$ plants were grown in the greenhouse for 3-5 weeks until siliques were brown and dry. Seeds were harvested from plants and kept at room temperature until sowing.

For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochloride and 0.05% triton for 5 minutes. The surface-sterilized seeds were thoroughly washed in sterile distilled water then placed on culture plates containing half-strength Murashige-Skoog (Duchefa); 2% sucrose; 0.8% plant agar; 50 mM kanamycin; and 200 mM carbenicylin (Duchefa). The culture plates were incubated at 4° C. for 48 hours, then transferred to a growth room at 25° C. for an additional week of incubation. Vital $T_1$ *Arabidopsis* plants were transferred to fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 15

Transformation of *Brachypodium distachyon* Plants with the Polynucleotides of the Invention Similar to the *Arabidopsis* model plant, *Brachypodium distachyon* has several features that recommend it as a model plant for functional genomic studies, especially in the grasses. Traits that make it an ideal model include its small genome (~160 Mbp for a diploid genome and 355 Mbp for a polyploidy genome), small physical stature, a short life-cycle, and few growth requirements. *Brachypodium* is related to the major cereal grain species but it is understood to be more closely related to the Triticeae (wheat, barley) than to the other cereals. *Brachypodium*, with its polyploidy accessions, can serve as an ideal model for these grains (whose genomics size and complexity is a major barrier to biotechnological improvement).

*Brachypodium distachyon* embryogenic calli were transformed using the procedure described by Vogel and Hill (2008) [High-efficiency *Agrobacterium*-mediated transformation of *Brachypodium distachyon* inbred line Bd21-3. Plant Cell Rep 27:471-478], Vain et al (2008) [*Agrobacterium*-mediated transformation of the temperate grass *Brachypodium distachyon* (genotypeBd21) for T-DNA insertional mutagenesis. Plant Biotechnology J 6: 236-245], and Vogel J, et al. (2006) [*Agrobacterium* mediated transformation and inbred line development in the model grass *Brachypodium distachyon*. Plant Cell Tiss Org. Cult. 85:199-211], each of which is fully incorporated herein by reference, with some minor modifications, which are briefly summarized hereinbelow.

Callus initiation—Immature spikes (about 2 months after seeding) were harvested at the very beginning of seeds filling. Spikes were then husked and surface sterilized with 3% NaClO containing 0.1% Tween 20, shaked on a gyratory shaker at low speed for 20 minutes. Following three rinses with sterile distilled water, embryos were excised under a dissecting microscope in a laminar flow hood using fine forceps.

Excised embryos (size ~0.3 mm, bell shaped) were placed on callus induction medium (CIM) [LS salts (Linsmaier, E. M. & Skoog, F. 1965. Physiol. Plantarum 18, 100) and vitamins plus 3% sucrose, 6 mg/L $CuSO_4$, 2.5 mg/l 2,4-Dichlorophenoxyacetic Acid, pH 5.8 and 0.25% phytagel (Sigma)] scutellar side down, 100 embryos on a plate, and incubated at 28° C. in the dark. One week later, the embryonic calli was cleaned from emerging roots, shoots and somatic calli, and was subcultured onto fresh CIM medium. During culture, yellowish embryogenic callus (EC) appeared and were further selected (e.g., picked and transferred) for further incubation in the same conditions for additional 2 weeks. Twenty-five pieces of sub-cultured calli were then separately placed on 90×15 mm petri plates, and incubated as before for three additional weeks.

Transformation—As described in Vogel and Hill (2008, Supra), *Agrobacterium* was scraped off 2-day-old MGL plates (plates with the MGL medium which contains: Tryptone 5 g/l, Yeast Extract 2.5 g/l, NaCl 5 g/l, D-Mannitol 5 g/l, $MgSO_4$*$7H_2O$ 0.204 g/l, $K_2HPO_4$ 0.25 g/l, Glutamic Acid 1.2 g/l, Plant Agar 7.5 g/l) and resuspended in liquid MS medium supplemented with 200 μM acetosyringone to an optic density (OD) at 600 nm ($OD_{600}$) of 0.6. Once the desired OD was attained, 1 ml of 10% Synperonic PE/F68 (Sigma) per 100 ml of inoculation medium was added.

To begin inoculation, 300 callus pieces were placed in approximately 12 plates (25 callus pieces in each plate) and covered with the *Agrobacterium* suspension (8-8.5 ml). The callus was incubated in the *Agrobacterium* suspension for 15 minutes with occasional gentle rocking. After incubation, the *Agrobacterium* suspension was aspirated off and the calli were then transferred into co-cultivation plates, prepared by placing a sterile 7-cm diameter filter paper in an empty 90×15 mm petri plate. The calli pieces were then gently distributed on the filter paper. One co-cultivation plate was used for two starting callus plates (50 initial calli pieces). The co-cultivation plates were then sealed with parafilm and incubated at 22° C. in the dark for 3 days. The callus pieces were then individually transferred onto CIM medium as described above, which was further supplemented with 200 mg/l Ticarcillin (to kill the *Agrobacterium*) and Bialaphos (5 mg/L) (for selection of the transformed resistant embryogenic calli sections), and incubated at 28° C. in the dark for 14 days.

The calli pieces were then transferred to shoot induction media (SIM; LS salts and vitamins plus 3% Maltose monohydrate) supplemented with 200 mg/l Ticarcillin, Bialaphos (5 mg/L), Indol-3-acetic acid (IAA) (0.25 mg/L), and 6-Benzylaminopurine (BAP) (1 mg/L), and were sub-cultured in light to the same media after 10 days (total of 20 days). At each sub-culture all the pieces from a single callus were kept together to maintain their independence and were incubated under the following conditions: lighting to a level of 60 lE m-2 s-1, a 16-h light, 8-h dark photoperiod and a constant 24° C. temperature. Plantlets emerged from the transformed calli.

When plantlets were large enough to handle without damage, they were transferred to plates containing the above mentioned shoot induction media (SIM) without Bialaphos. Each plantlet was considered as a different event. The plantlets grew axillary tillers and eventually became bushy. Each bush from the same plant (event ID) was then divided to tissue culture boxes ("Humus") containing "rooting medium" [MS basal salts, 3% sucrose, 3 g/L phytagel, 2 mg/l α-Naphthalene Acetic Acid (NAA) and 1 mg/L IAA and Ticarcillin 200 mg/L, PH 5.8). All plants in a "Humus box" were different plants of the same transformation event.

When plantlets established roots they were transplanted to soil and transferred to a greenhouse. To verify the transgenic status of plants containing the other constructs, T0 plants were subjected to PCR as previously described by Vogel et al. 2006 *[Agrobacterium* mediated transformation and inbred line development in the model grass *Brachypodium distachyon*. Plant Cell Tiss Org. Cult. 85:199-211].

Example 16

Evaluating Transgenic *Arabidopsis* NUE Under Low or Normal Nitrogen Conditions Using Seedling Assays Assay 1: Plant Growth Under Low and Favorable Nitrogen Concentration Levels Surface sterilized seeds were sown in basal media [50% Murashige-Skoog medium (MS) supplemented with 0.8% plant agar as solidifying agent] in the presence of Kanamycin (used as a selecting agent). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing ½ MS media (15 mM N) for the normal nitrogen concentration treatment and 0.30 mM nitrogen for the low nitrogen concentration treatments. For experiments performed in $T_2$ lines, each plate contained 5 seedlings of the same transgenic event, and 3-4 different plates (replicates) for each event. For each polynucleotide of the invention at least four-five independent transformation events were analyzed from each construct. For experiments performed in $T_1$ lines, each plate contained 5 seedlings of 5 independent transgenic events and 3-4 different plates (replicates) were planted. In total, for $T_1$ lines, 20 independent events were evaluated. Plants expressing the polynucleotides of the invention were compared to the average measurement of the control plants (empty vector or GUS reporter gene under the same promoter) used in the same experiment.

Digital imaging—A laboratory image acquisition system, which consists of a digital reflex camera (Canon EOS 300D)

attached with a 55 mm focal length lens (Canon EF-S series), mounted on a reproduction device (Kaiser RS), which includes 4 light units (4×150 Watts light bulb) and located in a darkroom, is used for capturing images of plantlets sawn in agar plates.

Figure 3A:
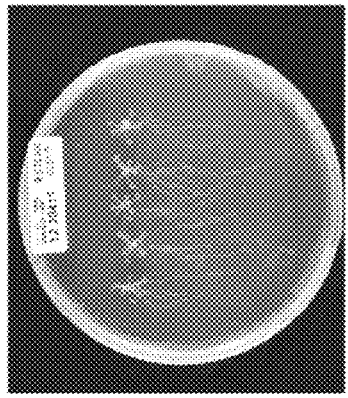
FIGS. 3A-F are images depicting visualization of root development of transgenic plants exogenously expressing the polynucleotide of some embodiments of the invention when grown in transparent agar plates under normal (FIGS. 3A-B), osmotic stress (15% PEG.
Figure 3C:
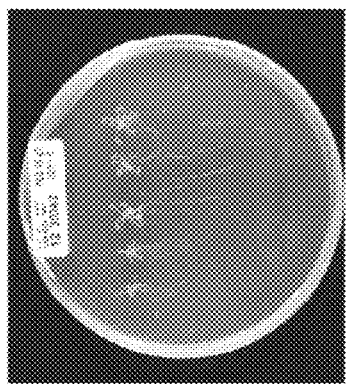
Figure 3E:
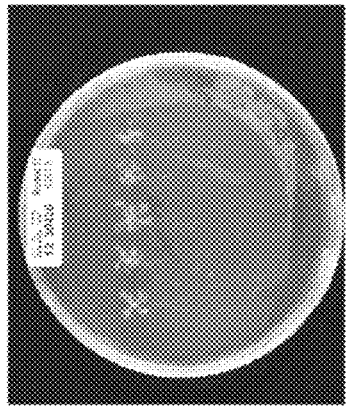
Figure 3B:
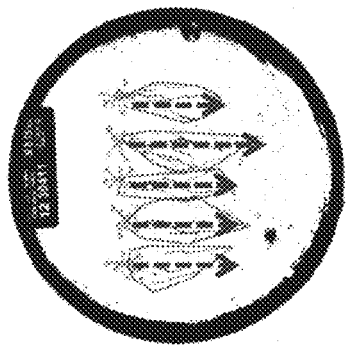
Figure 3D:
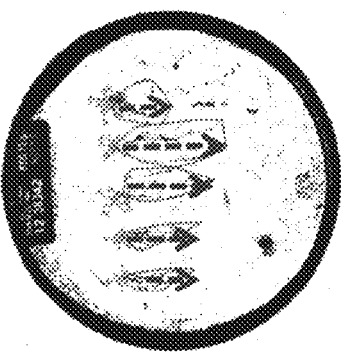
Figure 3F:
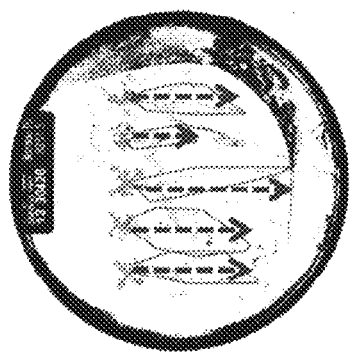
Figure 4:
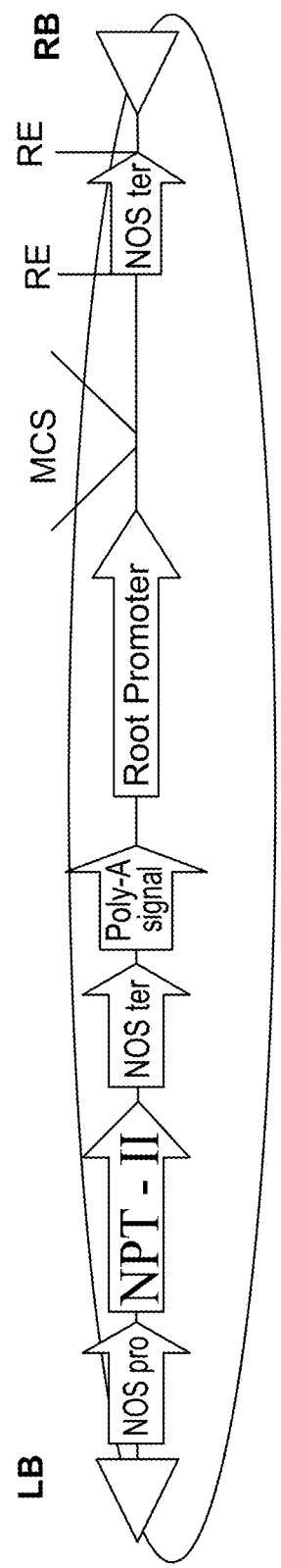
FIG. 4 is a schematic illustration of the modified pGI binary plasmid containing the Root Promoter (pQNa RP) used for expressing the isolated polynucleotide sequences of the invention. RB—T-DNA right border; LB—T-DNA left border; NOS pro=nopaline synthase promoter; NPT-II=neomycin phosphotransferase gene; NOS ter=nopaline synthase terminator; Poly-A signal (polyadenylation signal); The isolated polynucleotide sequences according to some embodiments of the invention were cloned into the MCS (Multiple cloning site) of the vector.
Figure 5:
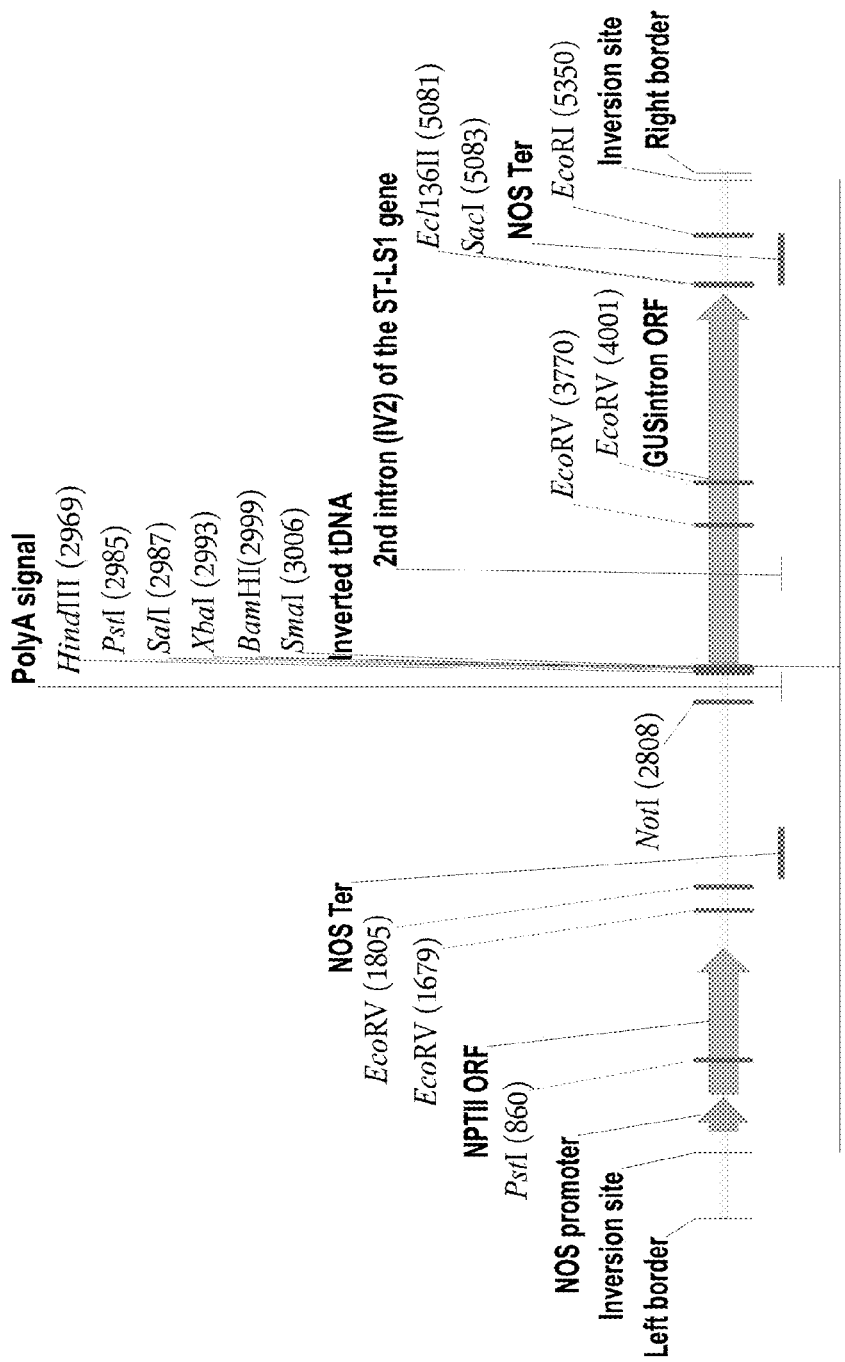
FIG. 5 is a schematic illustration of the pQYN plasmid.
Figure 6:
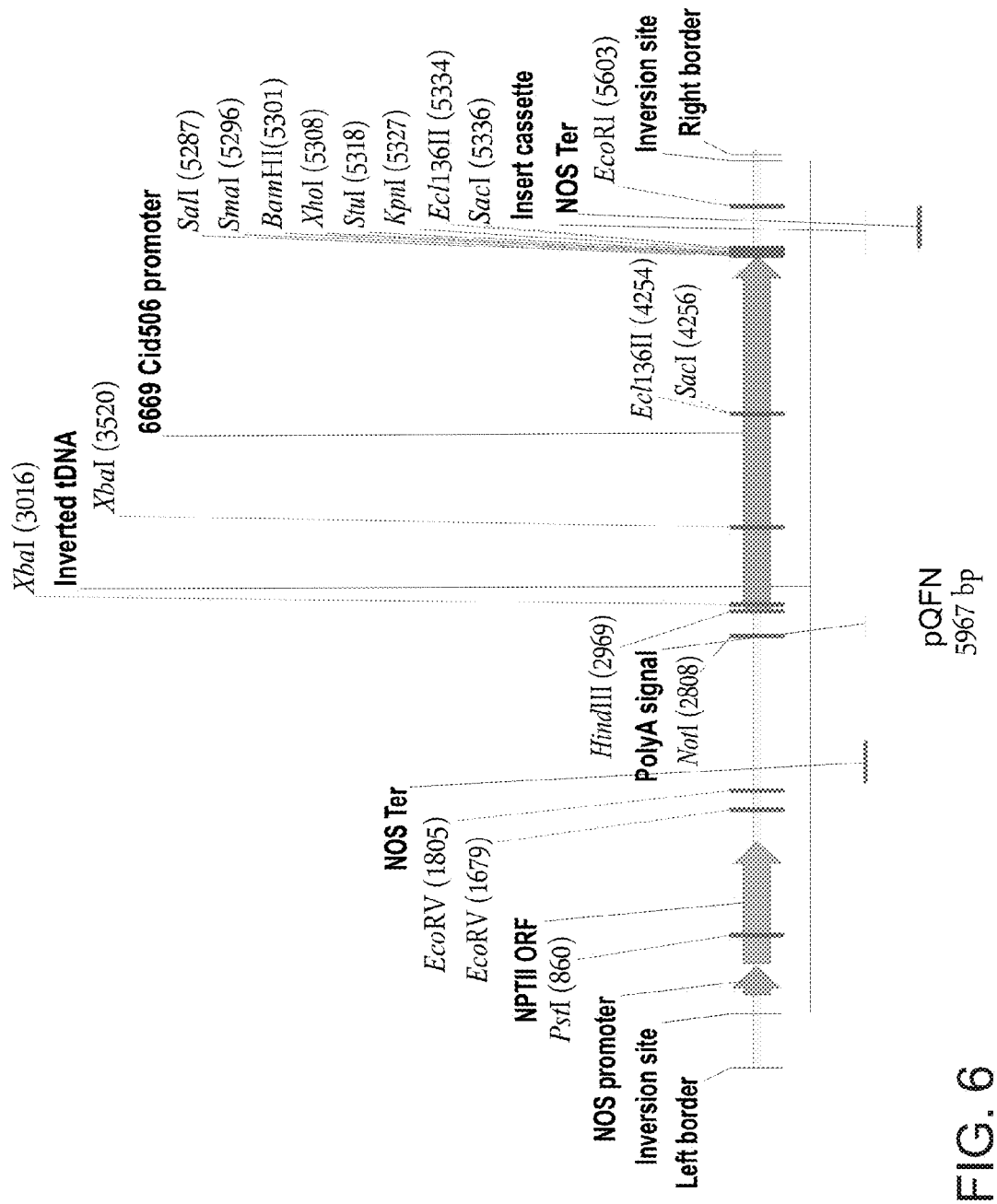
FIG. 6 is a schematic illustration of the pQFN plasmid.
Figure 7:
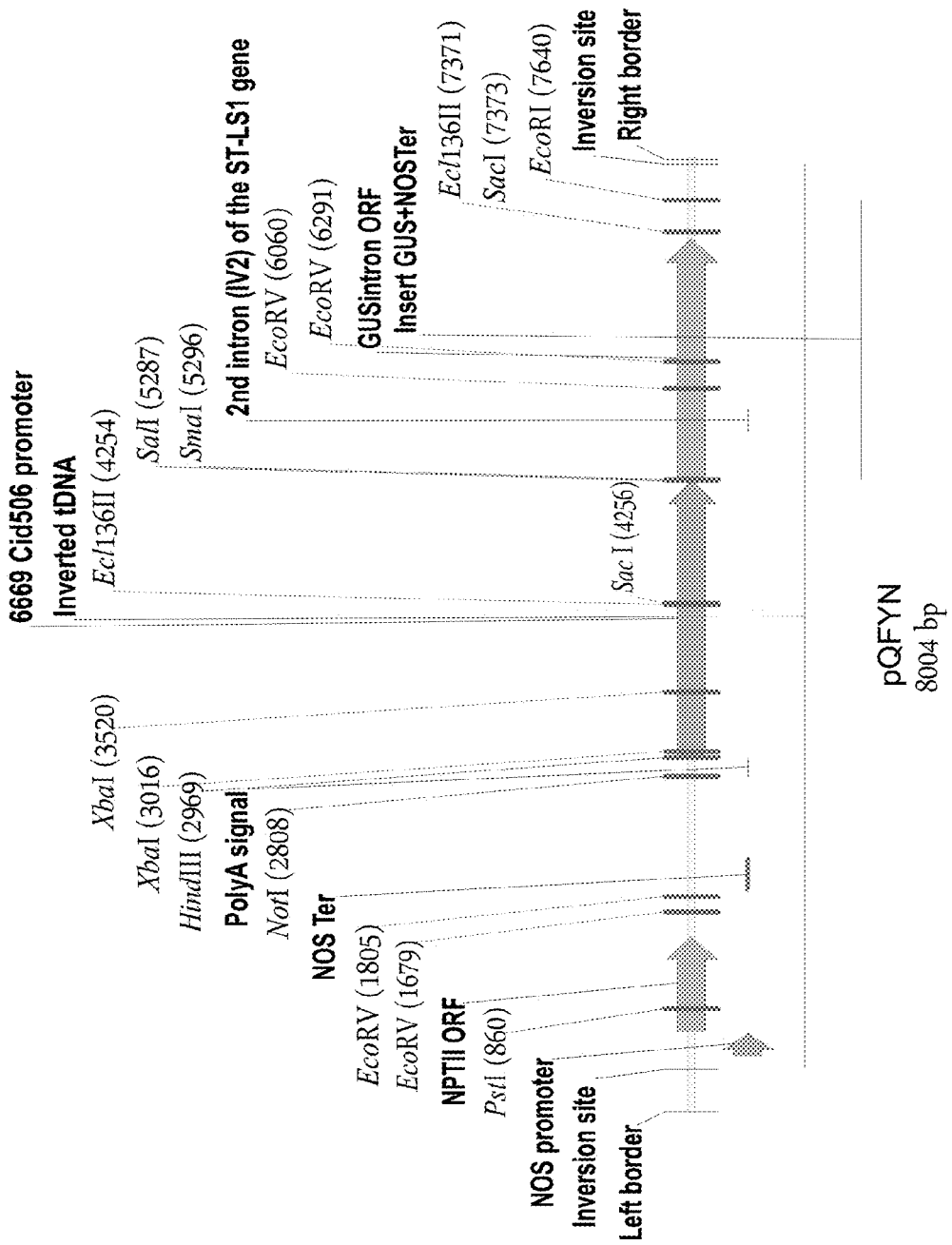
FIG. 7 is a schematic illustration of the pQFYN plasmid.
Figure 8:
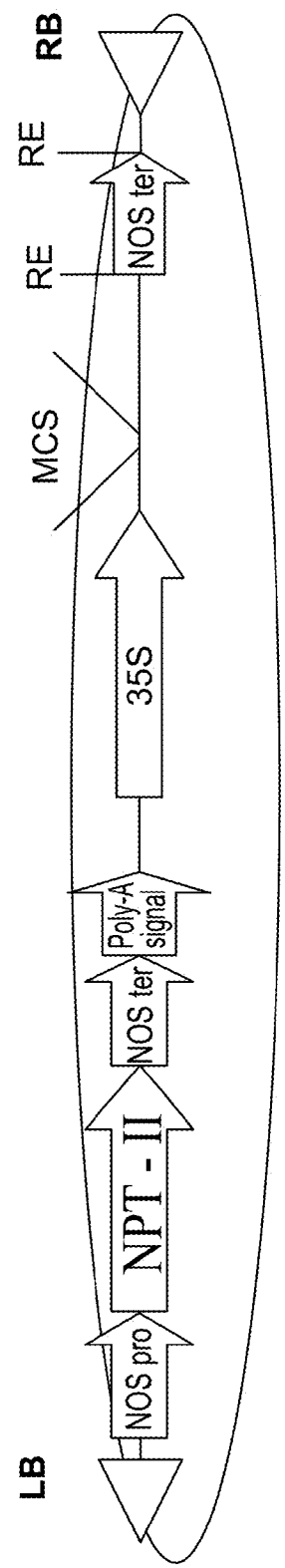
FIG. 8 is a schematic illustration of the modified pGI binary plasmid (pQXNc) used for expressing the isolated polynucleotide sequences of some embodiments of the invention. RB—T-DNA right border; LB—T-DNA left border; NOS pro=nopaline synthase promoter; NPT-II=neomycin phosphotransferase gene; NOS ter=nopaline synthase terminator; RE=any restriction enzyme; Poly-A signal (polyadenylation signal); 35S—the 35S promoter (pqfnc; SEQ ID NO: 4876). The isolated polynucleotide sequences of some embodiments of the invention were cloned into the MCS (Multiple cloning site) of the vector.

The image capturing process was repeated every 3-4 days starting at day 1 till day 10 (see for example the images in FIGS. 3A-B). An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at rsbweb (dot) nih (dot) gov/]. Images are captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling analysis—Using the digital analysis seedling data was calculated, including leaf area, root coverage and root length.

The relative growth rate for the various seedling parameters was calculated according to the following Formulas XIII (Relative growth rate of leaf area) and VI (Relative growth rate of root length).

At the end of the experiment, plantlets were removed from the media and weighed for the determination of plant fresh weight. Plantlets were then dried for 24 hours at 60° C., and weighed again to measure plant dry weight for later statistical analysis. Growth rate was determined by comparing the leaf area coverage, root coverage and root length, between each couple of sequential photographs, and results were used to resolve the effect of the gene introduced on plant vigor under optimal conditions. Similarly, the effect of the gene introduced on biomass accumulation, under optimal conditions, was determined by comparing the plants' fresh and dry weight to that of control plants (containing an empty vector or the GUS reporter gene under the same promoter). From every construct created, 3-5 independent transformation events are examined in replicates.

Statistical analyses—To identify genes conferring significantly improved plant vigor or enlarged root architecture, the results obtained from the transgenic plants were compared to those obtained from control plants. To identify outperforming genes and constructs, results from the independent transformation events tested were analyzed separately. To evaluate the effect of a gene event over a control the data was analyzed by Student's t-test and the p value was calculated. Results were considered significant if p≤0.1. The JMP statistics software package was used (Version 5.2.1, SAS Institute Inc., Cary, N.C., USA).

Experimental Results:

The genes presented in the following Tables were cloned under the regulation of a constitutive promoter (At6669). Evaluation of the effect of transformation in a plant of each gene was carried out by testing the performance of different number of transformation events. Some of the genes were evaluated in more than one seedling assay. The results obtained in these second experiments were significantly positive as well. Event with p-value <0.1 was considered statistically significant.

The genes presented in Tables 101-104 showed a significant improvement in plant NUE since they produced larger plant biomass (plant fresh and dry weight; leaf area, root length and root coverage) in T2 generation (Tables 101-102) or T1 generation (Tables 103-104) when grown under limiting nitrogen growth conditions, compared to control plants that were grown under identical growth conditions. Plants producing larger root biomass have better possibilities to absorb larger amount of nitrogen from soil.

TABLE 101

Genes showing improved plant performance at nitrogen deficient conditions (T2 generation)

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LNU938 | 80352.1 | 5.65 | L | 46 | 117.0 | 0.24 | 68 |
| LNU938 | 80353.1 | — | — | — | 103.8 | 0.04 | 49 |
| LNU938 | 80355.5 | 5.40 | 0.18 | 40 | 90.1 | 0.22 | 29 |
| LNU910 | 80350.1 | 5.03 | 0.17 | 30 | 103.2 | 0.09 | 48 |
| LNU869 | 80083.3 | 5.75 | L | 49 | 86.0 | 0.21 | 23 |
| LNU869 | 80084.4 | 5.35 | 0.10 | 39 | — | — | — |
| LNU869 | 80085.2 | 4.62 | 0.27 | 20 | — | — | — |
| LNU869 | 80085.3 | 5.15 | 0.03 | 34 | 85.8 | 0.23 | 23 |
| LNU840 | 78676.4 | — | — | — | 84.8 | 0.26 | 22 |
| LNU837 | 79574.5 | 4.60 | 0.26 | 19 | — | — | — |
| LNU837 | 79574.7 | 4.98 | 0.04 | 29 | 91.5 | 0.17 | 31 |
| LNU771 | 80077.2 | 5.28 | 0.02 | 37 | 85.8 | 0.06 | 23 |
| LNU771 | 80079.3 | — | — | — | 103.7 | 0.14 | 49 |
| CONT. | — | 3.86 | — | — | 69.7 | — | — |
| LNU964 | 80552.4 | 4.77 | 0.04 | 14 | 94.8 | 0.29 | 19 |
| LNU964 | 80552.6 | 5.05 | 0.01 | 20 | 103.2 | 0.06 | 30 |
| LNU957 | 80437.1 | 5.95 | L | 42 | 95.0 | 0.14 | 20 |
| LNU957 | 80437.6 | 5.28 | 0.29 | 26 | 99.7 | 0.05 | 26 |
| LNU953 | 80428.1 | 5.62 | 0.05 | 34 | 115.3 | 0.15 | 45 |
| LNU952 | 78218.3 | — | — | — | 104.1 | 0.14 | 31 |
| LNU920 | 78510.1 | 5.40 | 0.08 | 29 | 105.0 | L | 32 |
| LNU914 | 80514.5 | 5.50 | 0.02 | 31 | 86.1 | 0.14 | 8 |
| LNU911 | 80420.5 | — | — | — | 98.4 | 0.29 | 24 |
| LNU911 | 80424.2 | 5.15 | 0.03 | 23 | 127.8 | 0.09 | 61 |
| LNU903 | 80417.6 | — | — | — | 98.2 | 0.01 | 24 |
| LNU901 | 80474.5 | 4.62 | 0.28 | 10 | — | — | — |
| LNU901 | 80476.4 | 4.85 | 0.18 | 15 | — | — | — |
| LNU897 | 80448.3 | 5.40 | 0.20 | 29 | 99.0 | 0.03 | 25 |
| LNU897 | 80449.1 | 4.70 | 0.10 | 12 | — | — | — |
| LNU892 | 80410.1 | — | — | — | 98.8 | 0.10 | 24 |
| LNU892 | 80412.1 | 4.85 | 0.13 | 15 | 96.0 | 0.17 | 21 |
| LNU884 | 80407.1 | 6.17 | 0.02 | 47 | 116.2 | L | 46 |
| LNU884 | 80407.5 | 4.88 | 0.22 | 16 | — | — | — |
| LNU872 | 77724.7 | 5.15 | 0.13 | 23 | 99.7 | L | 26 |
| LNU872 | 77725.4 | 5.10 | 0.11 | 21 | 90.4 | 0.05 | 14 |
| LNU869 | 80084.3 | 5.30 | L | 26 | 93.6 | 0.05 | 18 |
| LNU869 | 80084.4 | 5.53 | 0.02 | 32 | 114.5 | L | 44 |
| LNU866 | 80443.5 | 5.17 | 0.09 | 23 | — | — | — |
| LNU866 | 80444.2 | 5.07 | 0.09 | 21 | — | — | — |
| LNU844 | 80342.1 | 4.55 | 0.17 | 8 | — | — | — |
| LNU844 | 80344.2 | 5.05 | 0.21 | 20 | 95.6 | 0.12 | 20 |
| LNU834_H1 | 80402.7 | 5.38 | 0.17 | 28 | 112.4 | 0.08 | 42 |
| LNU791 | 77893.1 | 5.05 | 0.08 | 20 | — | — | — |
| LNU749 | 80793.5 | — | — | — | 95.5 | 0.21 | 20 |
| CONT. | — | 4.20 | — | — | 79.4 | — | — |
| LNU975 | 80622.1 | 5.33 | 0.02 | 27 | — | — | — |
| LNU975 | 80624.3 | 5.00 | 0.07 | 19 | — | — | — |
| LNU819 | 78133.3 | 5.53 | 0.02 | 32 | 89.4 | 0.11 | 12 |
| LNU817 | 80596.2 | 4.68 | 0.19 | 12 | — | — | — |
| LNU801 | 78584.7 | 4.93 | 0.04 | 18 | — | — | — |
| LNU800 | 77896.2 | 6.38 | L | 52 | 127.4 | 0.22 | 60 |
| LNU794 | 78522.1 | 5.22 | 0.08 | 25 | — | — | — |
| LNU760_H1 | 80127.4 | 4.88 | 0.12 | 16 | 87.1 | 0.16 | 9 |
| CONT. | — | 4.19 | — | — | 79.9 | — | — |
| LNU971 | 78395.1 | — | — | — | 92.1 | 0.13 | 32 |
| LNU971 | 78395.5 | — | — | — | 94.8 | 0.21 | 36 |
| LNU944 | 79779.3 | 4.07 | 0.27 | 14 | — | — | — |
| LNU944 | 79781.6 | — | — | — | 98.0 | 0.11 | 41 |
| LNU931 | 79774.5 | 3.92 | 0.28 | 10 | — | — | — |
| LNU930 | 79770.5 | 4.88 | 0.03 | 36 | — | — | — |
| LNU930 | 79772.1 | 3.98 | 0.11 | 11 | — | — | — |
| LNU928 | 78211.4 | 4.50 | 0.16 | 26 | 94.9 | 0.18 | 36 |
| LNU928 | 78215.4 | 4.28 | 0.03 | 19 | — | — | — |
| LNU917 | 77498.2 | 4.42 | 0.09 | 24 | 88.8 | 0.24 | 28 |
| LNU917 | 77500.1 | 4.55 | 0.01 | 27 | — | — | — |
| LNU906 | 79219.6 | — | — | — | 87.2 | 0.17 | 25 |
| LNU904 | 78987.1 | — | — | — | 115.6 | 0.29 | 66 |

TABLE 101-continued

Genes showing improved plant performance at nitrogen deficient conditions (T2 generation)

| Gene Name | Event # | Dry Weight [mg] Ave. | P-Val. | % Incr. | Fresh Weight [mg] Ave. | P-Val. | % Incr. |
|---|---|---|---|---|---|---|---|
| LNU904 | 78987.2 | 4.33 | 0.01 | 21 | — | — | — |
| LNU874 | 78369.1 | — | — | — | 85.5 | 0.12 | 23 |
| LNU870 | 78501.1 | 4.53 | 0.01 | 26 | — | — | — |
| LNU870 | 78505.1 | 4.12 | 0.06 | 15 | 104.9 | 0.11 | 51 |
| LNU870 | 78505.7 | 4.22 | 0.14 | 18 | 97.9 | 0.29 | 41 |
| LNU867 | 79589.3 | 4.40 | 0.03 | 23 | — | — | — |
| LNU862 | 79757.1 | 4.45 | 0.08 | 24 | 76.6 | 0.22 | 10 |
| LNU856 | 79753.3 | — | — | — | 80.9 | 0.14 | 16 |
| LNU856 | 79753.5 | 4.65 | 0.21 | 30 | 97.0 | 0.20 | 39 |
| LNU829 | 77912.5 | 4.38 | 0.11 | 22 | 114.0 | 0.26 | 64 |
| LNU825 | 77716.4 | 4.03 | 0.20 | 13 | — | — | — |
| LNU796 | 78235.7 | 4.35 | 0.27 | 22 | — | — | — |
| LNU792 | 79161.2 | 4.33 | L | 21 | — | — | — |
| LNU792 | 79215.1 | 4.15 | 0.14 | 16 | — | — | — |
| LNU763 | 77588.7 | — | — | — | 97.1 | 0.26 | 39 |
| LNU758 | 79739.5 | 4.00 | 0.18 | 12 | — | — | — |
| LNU758 | 79740.3 | — | — | — | 99.3 | 0.29 | 43 |
| CONT. | — | 3.58 | — | — | 69.6 | — | — |
| LNU955 | 80432.7 | 5.25 | 0.02 | 35 | — | — | — |
| LNU953 | 80428.1 | — | — | — | 84.9 | 0.17 | 25 |
| LNU949 | 80557.1 | — | — | — | 83.8 | 0.05 | 24 |
| LNU949 | 80557.4 | — | — | — | 77.9 | 0.23 | 15 |
| LNU901 | 80474.2 | 4.70 | 0.16 | 21 | 86.9 | 0.20 | 28 |
| LNU901 | 80474.3 | 4.70 | 0.09 | 21 | 98.7 | 0.04 | 46 |
| LNU901 | 80476.4 | 4.33 | 0.29 | 11 | — | — | — |
| LNU892 | 80414.5 | — | — | — | 80.2 | 0.25 | 19 |
| LNU866 | 80444.6 | 4.47 | 0.21 | 15 | 87.8 | 0.11 | 30 |
| LNU843 | 78963.5 | — | — | — | 79.5 | 0.27 | 17 |
| LNU834_H1 | 80402.3 | — | — | — | 80.6 | 0.12 | 19 |
| LNU834_H1 | 80402.7 | — | — | — | 75.9 | 0.24 | 12 |
| LNU798 | 79671.4 | — | — | — | 86.8 | 0.20 | 28 |
| LNU798 | 79673.2 | — | — | — | 80.9 | 0.24 | 20 |
| LNU787 | 80547.5 | 4.97 | 0.12 | 27 | 93.0 | L | 37 |
| LNU766 | 78932.1 | 4.60 | 0.04 | 18 | 100.7 | 0.13 | 49 |
| CONT. | — | 3.90 | — | — | 67.7 | — | — |
| LNU844 | 80344.2 | — | — | — | 94.6 | 0.13 | 18 |
| CONT. | — | — | — | — | 80.2 | — | — |

Table 101:
"CONT."—Control;
"Ave."—Average;
"% Incr." = % increment;
"p-val."—p-value;
L means that p-value is less than 0.01, p < 0.1 was considered as significant.

TABLE 102

Genes showing improved plant performance at nitrogen deficient conditions (T2 generation)

| Gene Name | Event # | Leaf Area [cm²] Ave. | P-Val. | % Incr. | Roots Coverage [cm²] Ave. | P-Val. | % Incr. | Roots Length [cm] Ave. | P-Val. | % Incr. |
|---|---|---|---|---|---|---|---|---|---|---|
| LNU954 | 80358.5 | 0.434 | 0.02 | 21 | 10.8 | 0.06 | 40 | 7.19 | L | 16 |
| LNU938 | 80352.1 | — | — | — | 12.4 | L | 60 | 6.92 | 0.02 | 12 |
| LNU938 | 80353.1 | 0.440 | L | 22 | 10.2 | 0.01 | 32 | 7.48 | L | 21 |
| LNU938 | 80355.5 | 0.400 | 0.18 | 11 | 12.8 | 0.25 | 66 | 7.22 | 0.05 | 17 |
| LNU910 | 80346.1 | — | — | — | — | — | — | 6.80 | 0.28 | 10 |
| LNU910 | 80348.1 | 0.403 | 0.08 | 12 | — | — | — | 6.82 | 0.04 | 11 |
| LNU910 | 80350.1 | 0.461 | 0.02 | 28 | 11.3 | 0.09 | 47 | 7.18 | L | 16 |
| LNU869 | 80083.3 | — | — | — | 13.0 | 0.16 | 69 | 7.16 | L | 16 |
| LNU869 | 80084.3 | 0.424 | 0.09 | 18 | 10.3 | L | 33 | 6.55 | 0.23 | 6 |
| LNU869 | 80084.4 | 0.404 | 0.28 | 12 | 9.92 | 0.16 | 28 | — | — | — |
| LNU869 | 80085.2 | 0.414 | 0.14 | 15 | — | — | — | — | — | — |
| LNU869 | 80085.3 | 0.477 | L | 33 | 13.9 | 0.02 | 80 | 7.69 | L | 25 |
| LNU840 | 78676.4 | 0.456 | L | 27 | — | — | — | 6.82 | 0.28 | 11 |
| LNU840 | 78677.1 | 0.415 | 0.08 | 15 | 8.73 | 0.18 | 13 | — | — | — |
| LNU840 | 78763.2 | — | — | — | 9.27 | 0.09 | 20 | — | — | — |
| LNU840 | 78763.6 | 0.432 | 0.11 | 20 | — | — | — | — | — | — |
| LNU837 | 79574.5 | 0.433 | 0.09 | 20 | 11.2 | 0.17 | 44 | — | — | — |
| LNU837 | 79574.7 | 0.434 | 0.02 | 21 | 10.6 | 0.03 | 38 | 7.16 | 0.02 | 16 |
| LNU837 | 79575.2 | — | — | — | — | — | — | 6.54 | 0.18 | 6 |
| LNU837 | 79575.4 | 0.437 | 0.19 | 21 | — | — | — | — | — | — |
| LNU771 | 80077.2 | 0.490 | L | 36 | 12.9 | L | 67 | 7.53 | L | 22 |
| LNU771 | 80078.5 | 0.398 | 0.22 | 11 | 8.87 | 0.18 | 15 | 6.58 | 0.23 | 7 |
| LNU771 | 80079.3 | 0.495 | L | 37 | — | — | — | 7.16 | 0.22 | 16 |
| LNU771 | 80079.4 | 0.459 | L | 28 | 10.0 | 0.19 | 30 | 6.89 | 0.03 | 12 |
| CONT. | — | 0.360 | — | — | 7.72 | — | — | 6.17 | — | — |
| LNU964 | 80552.4 | 0.460 | 0.05 | 8 | 12.5 | L | 39 | 7.62 | 0.11 | 11 |
| LNU964 | 80552.6 | 0.514 | 0.10 | 21 | 12.2 | 0.11 | 35 | 8.16 | L | 19 |
| LNU957 | 80437.1 | 0.478 | 0.16 | 13 | 11.8 | L | 30 | 7.34 | 0.19 | 7 |
| LNU957 | 80437.6 | — | — | — | — | — | — | 7.61 | 0.05 | 11 |
| LNU953 | 80428.1 | 0.467 | 0.26 | 10 | 10.9 | 0.02 | 20 | 7.32 | 0.15 | 7 |
| LNU920 | 78509.5 | — | — | — | 10.8 | 0.05 | 19 | 7.70 | 0.04 | 12 |
| LNU920 | 78510.1 | — | — | — | 10.7 | 0.17 | 18 | 7.66 | 0.02 | 12 |
| LNU911 | 80420.5 | — | — | — | 10.8 | 0.26 | 19 | 7.50 | 0.09 | 9 |
| LNU911 | 80424.2 | 0.493 | 0.03 | 16 | 11.8 | 0.19 | 31 | 7.51 | 0.04 | 10 |
| LNU910 | 80350.1 | — | — | — | — | — | — | 7.20 | 0.20 | 5 |
| LNU903 | 80417.6 | — | — | — | 10.7 | 0.11 | 18 | 7.36 | 0.10 | 7 |

TABLE 102-continued

Genes showing improved plant performance at nitrogen deficient conditions (T2 generation)

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU901 | 80474.3 | — | — | — | 10.6 | 0.17 | 17 | — | — | — |
| LNU901 | 80476.4 | 0.450 | 0.29 | 6 | 10.9 | 0.27 | 20 | 7.38 | 0.07 | 8 |
| LNU897 | 80448.3 | — | — | — | 11.1 | 0.22 | 23 | — | — | — |
| LNU897 | 80449.1 | — | — | — | 10.8 | 0.14 | 20 | 7.50 | 0.05 | 9 |
| LNU892 | 80412.1 | — | — | — | 12.5 | 0.07 | 39 | 7.57 | 0.04 | 10 |
| LNU884 | 80407.1 | 0.481 | 0.07 | 13 | 15.0 | 0.05 | 66 | 7.46 | 0.07 | 9 |
| LNU872 | 77724.7 | — | — | — | — | — | — | 7.52 | 0.08 | 10 |
| LNU872 | 77725.6 | — | — | — | — | — | — | 7.24 | 0.20 | 6 |
| LNU869 | 80084.4 | 0.481 | 0.27 | 13 | 15.0 | L | 66 | 8.19 | L | 19 |
| LNU866 | 80443.5 | 0.464 | 0.07 | 9 | — | — | — | — | — | — |
| LNU844 | 80341.2 | — | — | — | — | — | — | 7.31 | 0.22 | 7 |
| LNU844 | 80342.1 | 0.457 | 0.23 | 8 | 11.6 | 0.06 | 29 | 7.54 | 0.13 | 10 |
| LNU844 | 80342.4 | — | — | — | 10.1 | 0.19 | 11 | 7.21 | 0.20 | 5 |
| LNU844 | 80344.2 | — | — | — | 11.3 | 0.06 | 25 | 7.64 | 0.08 | 12 |
| LNU834_H1 | 80402.7 | 0.499 | L | 18 | 12.9 | 0.09 | 43 | 7.77 | 0.01 | 13 |
| LNU805 | 80784.1 | — | — | — | — | — | — | 7.37 | 0.18 | 8 |
| LNU773 | 80398.1 | — | — | — | 10.7 | 0.13 | 19 | — | — | — |
| LNU749 | 80793.5 | — | — | — | 11.9 | 0.09 | 32 | 7.82 | 0.02 | 14 |
| CONT. | — | 0.424 | — | — | 9.05 | — | — | 6.85 | — | — |
| LNU956 | 80856.3 | 0.372 | 0.21 | 12 | 8.68 | 0.23 | 20 | 7.25 | 0.29 | 7 |
| LNU818 | 80919.1 | — | — | — | — | — | — | 7.21 | 0.09 | 6 |
| CONT. | — | 0.334 | — | — | 7.23 | — | — | 6.79 | — | — |
| LNU975 | 80622.1 | 0.400 | 0.16 | 15 | — | — | — | — | — | — |
| LNU975 | 80624.3 | 0.375 | 0.17 | 7 | 7.86 | L | 18 | 7.03 | L | 14 |
| LNU832_H2 | 80605.6 | 0.407 | 0.02 | 17 | 8.29 | 0.12 | 25 | 6.82 | L | 11 |
| LNU819 | 78133.3 | 0.405 | 0.07 | 16 | 9.58 | 0.01 | 44 | 6.60 | L | 7 |
| LNU817 | 80596.2 | — | — | — | 7.47 | 0.19 | 12 | — | — | — |
| LNU801 | 78584.7 | — | — | — | 7.34 | 0.04 | 11 | — | — | — |
| LNU801 | 78585.5 | — | — | — | 7.32 | 0.09 | 10 | — | — | — |
| LNU801 | 78585.7 | 0.427 | 0.09 | 22 | 8.56 | 0.07 | 29 | 6.47 | 0.26 | 5 |
| LNU800 | 77896.2 | 0.433 | L | 24 | 10.00 | 0.02 | 51 | — | — | — |
| LNU799 | 78672.5 | — | — | — | 7.39 | 0.24 | 11 | — | — | — |
| LNU794 | 78522.1 | — | — | — | 8.83 | 0.21 | 33 | 6.69 | 0.08 | 9 |
| LNU760_H1 | 80127.4 | 0.378 | 0.17 | 8 | 9.25 | 0.06 | 39 | 6.45 | 0.30 | 5 |
| LNU760_H1 | 80130.1 | — | — | — | 7.87 | 0.09 | 19 | — | — | — |
| LNU760_H1 | 80130.4 | — | — | — | 8.15 | 0.01 | 23 | 6.38 | 0.16 | 4 |
| CONT. | — | 0.350 | — | — | 6.64 | — | — | 6.14 | — | — |
| LNU971 | 78393.3 | — | — | — | — | — | — | 7.22 | 0.14 | 7 |
| LNU971 | 78395.2 | — | — | — | — | — | — | 7.06 | 0.21 | 5 |
| LNU971 | 78395.5 | 0.486 | 0.05 | 19 | — | — | — | 7.11 | 0.19 | 5 |
| LNU931 | 79774.1 | — | — | — | — | — | — | 7.25 | 0.07 | 7 |
| LNU930 | 79770.5 | — | — | — | 10.3 | 0.30 | 10 | 7.15 | 0.16 | 6 |
| LNU930 | 79772.5 | — | — | — | 11.8 | 0.02 | 26 | 7.10 | 0.24 | 5 |
| LNU928 | 78211.4 | 0.442 | 0.15 | 8 | 11.0 | 0.18 | 17 | 7.40 | 0.01 | 10 |
| LNU917 | 77500.1 | 0.497 | L | 22 | 12.7 | 0.01 | 36 | 7.47 | 0.01 | 11 |
| LNU904 | 78987.1 | 0.471 | 0.11 | 15 | — | — | — | 7.38 | 0.17 | 9 |
| LNU904 | 78987.2 | — | — | — | 10.7 | 0.26 | 14 | — | — | — |
| LNU904 | 78989.1 | — | — | — | — | — | — | 7.04 | 0.16 | 4 |
| LNU899 | 79765.4 | — | — | — | 10.4 | 0.21 | 11 | 7.57 | L | 12 |
| LNU899 | 79765.5 | — | — | — | — | — | — | 7.26 | 0.03 | 8 |
| LNU874 | 78369.1 | 0.460 | 0.08 | 13 | — | — | — | 7.15 | 0.16 | 6 |
| LNU870 | 78501.1 | 0.441 | 0.16 | 8 | 12.1 | 0.14 | 29 | 7.23 | 0.12 | 7 |
| LNU870 | 78505.7 | 0.474 | 0.09 | 16 | — | — | — | — | — | — |
| LNU867 | 79589.3 | — | — | — | 14.0 | 0.05 | 49 | 7.27 | 0.27 | 8 |
| LNU867 | 79590.5 | — | — | — | — | — | — | 7.08 | 0.24 | 5 |
| LNU862 | 79755.9 | — | — | — | 12.7 | 0.09 | 36 | 7.39 | 0.02 | 10 |
| LNU862 | 79757.1 | 0.447 | 0.18 | 9 | 12.5 | 0.04 | 33 | 7.29 | 0.04 | 8 |
| LNU856 | 79753.3 | 0.481 | 0.13 | 18 | 12.3 | 0.02 | 31 | 7.93 | L | 18 |
| LNU829 | 77912.3 | — | — | — | — | — | — | 7.16 | 0.27 | 6 |
| LNU829 | 77912.5 | 0.455 | 0.24 | 11 | 10.1 | 0.28 | 8 | 7.44 | L | 10 |
| LNU829 | 77914.1 | — | — | — | — | — | — | 7.18 | 0.07 | 6 |
| LNU829 | 77914.2 | — | — | — | — | — | — | 7.51 | L | 11 |
| LNU796 | 78234.5 | — | — | — | — | — | — | 7.31 | 0.04 | 8 |
| LNU796 | 78235.7 | — | — | — | — | — | — | 7.44 | 0.10 | 10 |
| LNU792 | 79161.2 | 0.499 | 0.03 | 22 | 11.3 | 0.08 | 21 | 7.29 | 0.03 | 8 |
| LNU792 | 79215.3 | 0.469 | 0.21 | 15 | — | — | — | 7.16 | 0.08 | 6 |
| LNU763 | 77588.1 | — | — | — | 10.5 | 0.28 | 11 | — | — | — |
| LNU763 | 77588.6 | 0.459 | 0.14 | 12 | — | — | — | — | — | — |
| LNU753 | 77143.3 | — | — | — | — | — | — | 7.38 | 0.02 | 9 |
| CONT. | — | 0.409 | — | — | 9.38 | — | — | 6.75 | — | — |
| LNU955 | 80432.7 | — | — | — | — | — | — | 6.81 | 0.27 | 17 |

TABLE 102-continued

Genes showing improved plant performance at nitrogen deficient conditions (T2 generation)

| Gene Name | Event # | Leaf Area [cm²] Ave. | P-Val. | % Incr. | Roots Coverage [cm²] Ave. | P-Val. | % Incr. | Roots Length [cm] Ave. | P-Val. | % Incr. |
|---|---|---|---|---|---|---|---|---|---|---|
| LNU953 | 80428.1 | 0.458 | 0.06 | 11 | 9.88 | 0.04 | 32 | 6.52 | 0.07 | 12 |
| LNU949 | 80557.1 | — | — | — | 9.85 | 0.05 | 32 | 6.31 | 0.15 | 9 |
| LNU949 | 80557.2 | 0.468 | 0.10 | 13 | 8.31 | 0.29 | 11 | — | — | — |
| LNU949 | 80557.4 | — | — | — | 9.07 | 0.10 | 21 | — | — | — |
| LNU901 | 80474.2 | 0.525 | 0.10 | 27 | 10.4 | 0.09 | 39 | 7.03 | 0.02 | 21 |
| LNU901 | 80476.4 | 0.454 | 0.25 | 9 | 10.5 | 0.10 | 40 | 6.40 | 0.15 | 10 |
| LNU892 | 80410.1 | — | — | — | 9.13 | 0.03 | 22 | 6.37 | 0.09 | 10 |
| LNU892 | 80414.7 | — | — | — | 9.87 | 0.11 | 32 | — | — | — |
| LNU873 | 80473.6 | — | — | — | 12.1 | 0.17 | 61 | 6.45 | 0.26 | 11 |
| LNU866 | 80444.6 | 0.467 | 0.05 | 13 | 9.26 | 0.18 | 24 | 6.23 | 0.29 | 7 |
| LNU834_H1 | 80402.1 | — | — | — | 9.04 | 0.21 | 21 | — | — | — |
| LNU834_H1 | 80402.3 | — | — | — | 8.88 | 0.21 | 19 | — | — | — |
| LNU834_H1 | 80402.7 | — | — | — | — | — | — | 6.38 | 0.16 | 10 |
| LNU834_H1 | 80404.5 | 0.466 | 0.17 | 12 | 11.5 | 0.30 | 54 | — | — | — |
| LNU798 | 79671.4 | 0.465 | 0.09 | 12 | 9.92 | 0.07 | 32 | 6.56 | 0.04 | 13 |
| LNU798 | 79673.2 | — | — | — | — | — | — | 6.61 | 0.04 | 14 |
| LNU787 | 80546.5 | — | — | — | 8.44 | 0.19 | 13 | — | — | — |
| LNU787 | 80547.4 | — | — | — | 8.78 | 0.12 | 17 | 6.83 | 0.01 | 18 |
| LNU787 | 80547.5 | 0.484 | L | 17 | 11.8 | L | 58 | 7.34 | L | 27 |
| LNU766 | 78932.1 | 0.509 | 0.02 | 23 | 10.3 | 0.14 | 37 | 7.05 | L | 22 |
| CONT. | — | 0.415 | — | — | 7.49 | — | — | 5.79 | — | — |
| LNU884 | 80407.5 | 0.490 | 0.23 | 11 | 11.9 | 0.27 | 17 | 6.99 | 0.23 | 7 |
| LNU844 | 80341.2 | — | — | — | 12.4 | 0.26 | 23 | 6.90 | 0.25 | 6 |
| LNU791 | 77895.4 | — | — | — | 11.8 | 0.14 | 17 | 7.07 | 0.05 | 8 |
| CONT. | — | 0.440 | — | — | 10.1 | — | — | 6.53 | — | — |

Table 102:
CONT"—Control;
"Ave."—Average;
"% Incr." = % increment;
"p-val."—p-value;
L means that p-value is less than 0.01, p < 0.1 was considered as significant.

TABLE 103

Genes showing improved plant performance at nitrogen deficient conditions (T1 generation)

| Gene Name | Dry Weight [mg] Ave. | P-Val. | % Incr. | Fresh Weight [mg] Ave. | P-Val. | % Incr. |
|---|---|---|---|---|---|---|
| LNU859 | 5.75 | 0.30 | 19 | — | — | — |
| CONT. | 4.84 | — | — | — | — | — |
| LNU919 | 5.47 | 0.11 | 21 | — | — | — |
| LNU886 | — | — | — | 113.1 | 0.13 | 29 |
| LNU859 | 5.65 | 0.07 | 26 | — | — | — |
| LNU821 | — | — | — | 100.6 | 0.23 | 14 |
| CONT. | 4.50 | — | — | 88.0 | — | — |
| LNU936 | 5.53 | 0.22 | 20 | — | — | — |
| LNU786 | 5.87 | 0.02 | 27 | — | — | — |
| CONT. | 4.62 | — | — | — | — | — |

Table 103:
"CONT."—Control;
"Ave." —Average;
"% Incr." = % increment.
"p-val."—p-value;
L means that p-value is less than 0.01, p < 0.1 was considered as significant.

TABLE 104

Genes showing improved plant performance at nitrogen deficient conditions (T1 generation)

| Gene Name | Roots Coverage [cm²] Ave. | P-Val. | % Incr. | Roots Length [cm] Ave. | P-Val. | % Incr. |
|---|---|---|---|---|---|---|
| LNU818 | — | — | — | 6.65 | 0.28 | 11 |
| CONT. | — | — | — | 6.00 | — | — |
| LNU956 | 17.2 | 0.17 | 20 | — | — | — |
| CONT. | 14.3 | — | — | — | — | — |
| LNU946 | 12.3 | 0.25 | 22 | — | — | — |
| LNU887 | 12.6 | 0.22 | 25 | 7.14 | 0.16 | 13 |
| LNU786 | 13.5 | 0.03 | 34 | 7.03 | 0.19 | 11 |
| CONT. | 10.1 | — | — | 6.34 | — | — |

Table 104:
"CONT."—Control;
"Ave." —Average;
"% Incr." = % increment;
"p-val."—p-value;
L means that p-value is less than 0.01, p < 0.1 was considered as significant.

The genes listed in Tables 105-106 have improved plant relative growth rate (relative growth rate of the leaf area, root coverage and root length) when grown under limiting nitrogen growth conditions compared to control plants (T2 and T1 generations) that were grown under identical growth conditions. Plants showing fast growth rate show a better plant establishment in soil under nitrogen deficient conditions. Faster growth was observed when growth rate of leaf area, root length and root coverage was measured.

TABLE 105

Genes showing improved plant growth rate at nitrogen deficient conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU954 | 80358.5 | 0.0422 | 0.08 | 22 | 1.29 | 0.01 | 42 | 0.649 | 0.03 | 22 |
| LNU938 | 80352.1 | — | — | — | 1.48 | L | 63 | 0.640 | 0.03 | 21 |
| LNU938 | 80352.2 | — | — | — | — | — | — | 0.613 | 0.08 | 16 |
| LNU938 | 80353.1 | 0.0418 | 0.09 | 20 | 1.21 | 0.01 | 33 | 0.666 | L | 26 |
| LNU938 | 80354.1 | — | — | — | — | — | — | 0.588 | 0.28 | 11 |
| LNU938 | 80355.5 | — | — | — | 1.55 | 0.01 | 70 | 0.673 | 0.02 | 27 |
| LNU910 | 80346.1 | — | — | — | — | — | — | 0.631 | 0.14 | 19 |
| LNU910 | 80348.1 | — | — | — | — | — | — | 0.615 | 0.09 | 16 |
| LNU910 | 80350.1 | 0.0445 | 0.04 | 28 | 1.33 | 0.01 | 47 | 0.646 | 0.03 | 22 |
| LNU869 | 80083.3 | — | — | — | 1.56 | L | 72 | 0.680 | 0.03 | 28 |
| LNU869 | 80084.3 | 0.0410 | 0.15 | 18 | 1.23 | L | 35 | 0.614 | 0.11 | 16 |
| LNU869 | 80084.4 | — | — | — | 1.15 | 0.11 | 27 | — | — | — |
| LNU869 | 80085.2 | — | — | — | 1.12 | 0.21 | 23 | — | — | — |
| LNU869 | 80085.3 | 0.0444 | 0.08 | 28 | 1.66 | L | 82 | 0.673 | 0.05 | 27 |
| LNU840 | 78676.4 | 0.0428 | 0.15 | 23 | — | — | — | — | — | — |
| LNU840 | 78677.1 | — | — | — | 1.04 | 0.24 | 15 | 0.606 | 0.15 | 14 |
| LNU840 | 78763.2 | — | — | — | 1.12 | 0.13 | 24 | 0.605 | 0.24 | 14 |
| LNU840 | 78763.6 | 0.0405 | 0.23 | 17 | — | — | — | 0.598 | 0.26 | 13 |
| LNU837 | 79574.5 | — | — | — | 1.35 | 0.02 | 49 | 0.622 | 0.13 | 17 |
| LNU837 | 79574.7 | 0.0416 | 0.11 | 20 | 1.27 | L | 40 | 0.664 | 0.01 | 25 |
| LNU837 | 79575.2 | — | — | — | — | — | — | 0.589 | 0.23 | 11 |
| LNU837 | 79575.4 | 0.0420 | 0.22 | 21 | 1.13 | 0.19 | 24 | — | — | — |
| LNU771 | 80077.2 | 0.0454 | 0.02 | 31 | 1.52 | L | 68 | 0.689 | L | 30 |
| LNU771 | 80077.4 | — | — | — | — | — | — | 0.594 | 0.22 | 12 |
| LNU771 | 80078.5 | — | — | — | 1.06 | 0.21 | 17 | 0.605 | 0.15 | 14 |
| LNU771 | 80079.3 | 0.0451 | 0.07 | 30 | 1.25 | 0.06 | 38 | 0.656 | 0.08 | 24 |
| LNU771 | 80079.4 | 0.0454 | 0.02 | 31 | 1.18 | 0.08 | 30 | 0.613 | 0.12 | 16 |
| CONT. | — | 0.0347 | — | — | 0.908 | — | — | 0.530 | — | — |
| LNU964 | 80548.3 | — | — | — | — | — | — | 0.685 | 0.26 | 12 |
| LNU964 | 80552.4 | 0.0460 | 0.23 | 13 | 1.49 | 0.01 | 40 | 0.727 | 0.07 | 19 |
| LNU964 | 80552.6 | 0.0475 | 0.17 | 17 | 1.45 | 0.04 | 37 | 0.734 | 0.04 | 20 |
| LNU957 | 80437.1 | — | — | — | 1.38 | 0.06 | 30 | — | — | — |
| LNU953 | 80428.1 | — | — | — | 1.27 | 0.18 | 20 | — | — | — |
| LNU920 | 78509.5 | — | — | — | 1.27 | 0.19 | 19 | 0.703 | 0.14 | 15 |
| LNU920 | 78510.1 | — | — | — | 1.26 | 0.22 | 18 | — | — | — |
| LNU911 | 80424.2 | 0.0463 | 0.23 | 14 | 1.35 | 0.13 | 27 | — | — | — |
| LNU903 | 80417.6 | — | — | — | 1.29 | 0.18 | 21 | 0.693 | 0.18 | 14 |
| LNU901 | 80474.3 | — | — | — | 1.27 | 0.22 | 19 | 0.709 | 0.15 | 16 |
| LNU901 | 80476.4 | — | — | — | 1.27 | 0.25 | 19 | — | — | — |
| LNU897 | 80448.3 | — | — | — | 1.31 | 0.17 | 23 | — | — | — |
| LNU897 | 80449.1 | — | — | — | 1.30 | 0.17 | 22 | 0.696 | 0.17 | 14 |
| LNU892 | 80412.1 | — | — | — | 1.51 | 0.02 | 42 | 0.701 | 0.15 | 15 |
| LNU884 | 80407.1 | — | — | — | 1.81 | L | 70 | — | — | — |
| LNU872 | 77724.7 | — | — | — | — | — | — | 0.691 | 0.19 | 13 |
| LNU872 | 77725.6 | — | — | — | — | — | — | 0.704 | 0.13 | 15 |
| LNU869 | 80084.3 | — | — | — | 1.26 | 0.28 | 18 | — | — | — |
| LNU869 | 80084.4 | 0.0473 | 0.20 | 16 | 1.80 | L | 69 | 0.760 | 0.02 | 25 |
| LNU844 | 80341.2 | — | — | — | — | — | — | 0.701 | 0.16 | 15 |
| LNU844 | 80342.1 | — | — | — | 1.38 | 0.06 | 29 | — | — | — |
| LNU844 | 80344.2 | — | — | — | 1.35 | 0.09 | 27 | 0.698 | 0.18 | 14 |
| LNU834_H1 | 80402.7 | — | — | — | 1.55 | 0.01 | 46 | 0.765 | 0.02 | 25 |
| LNU773 | 80398.1 | — | — | — | 1.30 | 0.18 | 22 | — | — | — |
| LNU749 | 80793.5 | — | — | — | 1.42 | 0.05 | 33 | 0.722 | 0.08 | 18 |
| CONT. | — | 0.0407 | — | — | 1.06 | — | — | 0.610 | — | — |
| LNU956 | 80854.3 | — | — | — | 1.06 | 0.29 | 21 | — | — | — |
| LNU956 | 80856.3 | 0.0385 | 0.26 | 12 | 1.06 | 0.19 | 22 | 0.711 | 0.26 | 8 |
| CONT. | — | 0.0344 | — | — | 0.873 | — | — | 0.661 | — | — |
| LNU975 | 80624.3 | — | — | — | 0.904 | 0.17 | 16 | — | — | — |
| LNU832_H2 | 80605.6 | 0.0371 | 0.14 | 17 | 0.951 | 0.11 | 22 | 0.610 | 0.02 | 11 |
| LNU819 | 78133.3 | 0.0361 | 0.26 | 14 | 1.12 | L | 44 | — | — | — |
| LNU801 | 78585.7 | 0.0370 | 0.21 | 17 | 0.994 | 0.05 | 27 | — | — | — |
| LNU800 | 77896.2 | 0.0377 | 0.09 | 19 | 1.18 | L | 51 | — | — | — |
| LNU794 | 78522.1 | — | — | — | 1.03 | 0.06 | 31 | — | — | — |
| LNU760_H1 | 80127.2 | — | — | — | 0.896 | 0.27 | 15 | — | — | — |
| LNU760_H1 | 80127.4 | — | — | — | 1.08 | L | 37 | — | — | — |
| LNU760_H1 | 80130.1 | — | — | — | 0.909 | 0.20 | 16 | — | — | — |
| LNU760_H1 | 80130.4 | — | — | — | 0.964 | 0.05 | 23 | 0.600 | 0.05 | 10 |
| CONT. | — | 0.0317 | — | — | 0.782 | — | — | 0.548 | — | — |
| LNU971 | 78395.2 | — | — | — | — | — | — | 0.658 | 0.21 | 10 |
| LNU971 | 78395.5 | 0.0486 | 0.09 | 21 | — | — | — | — | — | — |
| LNU930 | 79772.5 | — | — | — | 1.39 | 0.04 | 26 | — | — | — |

TABLE 105-continued

Genes showing improved plant growth rate at nitrogen deficient conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU928 | 78211.4 | 0.0470 | 0.14 | 17 | 1.30 | 0.19 | 18 | 0.672 | 0.13 | 12 |
| LNU917 | 77500.1 | 0.0487 | 0.08 | 21 | 1.49 | 0.01 | 36 | — | — | — |
| LNU904 | 78987.1 | 0.0469 | 0.19 | 17 | — | — | — | — | — | — |
| LNU904 | 78987.2 | 0.0455 | 0.26 | 13 | 1.26 | 0.27 | 15 | — | — | — |
| LNU874 | 78369.1 | 0.0481 | 0.09 | 20 | — | — | — | — | — | — |
| LNU870 | 78501.1 | — | — | — | 1.45 | 0.04 | 32 | 0.659 | 0.25 | 10 |
| LNU870 | 78505.7 | 0.0478 | 0.13 | 19 | 1.28 | 0.26 | 16 | — | — | — |
| LNU867 | 79589.3 | — | — | — | 1.68 | L | 52 | 0.684 | 0.12 | 14 |
| LNU862 | 79755.9 | — | — | — | 1.52 | 0.01 | 38 | 0.702 | 0.03 | 17 |
| LNU862 | 79757.1 | 0.0463 | 0.20 | 15 | 1.51 | 0.01 | 37 | 0.696 | 0.06 | 16 |
| LNU856 | 79753.3 | 0.0495 | 0.08 | 23 | 1.47 | 0.01 | 33 | 0.693 | 0.07 | 16 |
| LNU856 | 79753.5 | 0.0453 | 0.29 | 13 | 1.31 | 0.21 | 19 | — | — | — |
| LNU852 | 79580.2 | — | — | — | — | — | — | 0.654 | 0.24 | 9 |
| LNU829 | 77912.3 | — | — | — | — | — | — | 0.658 | 0.25 | 10 |
| LNU796 | 78234.5 | 0.0455 | 0.23 | 13 | — | — | — | — | — | — |
| LNU796 | 78235.7 | — | — | — | 1.45 | 0.08 | 32 | 0.668 | 0.20 | 11 |
| LNU792 | 79161.2 | 0.0485 | 0.09 | 21 | 1.37 | 0.06 | 24 | 0.680 | 0.10 | 14 |
| LNU792 | 79215.1 | — | — | — | — | — | — | 0.665 | 0.17 | 11 |
| LNU792 | 79215.3 | — | — | — | 1.38 | 0.12 | 26 | — | — | — |
| LNU763 | 77588.1 | — | — | — | 1.26 | 0.26 | 15 | — | — | — |
| LNU763 | 77588.8 | — | — | — | — | — | — | 0.706 | 0.04 | 18 |
| LNU753 | 77141.2 | — | — | — | 1.46 | 0.07 | 32 | 0.666 | 0.21 | 11 |
| CONT. | | 0.0402 | — | — | 1.10 | — | — | 0.599 | — | — |
| LNU955 | 80432.7 | — | — | — | 1.61 | 0.01 | 78 | 0.669 | 0.22 | 19 |
| LNU953 | 80428.1 | — | — | — | 1.19 | 0.04 | 31 | — | — | — |
| LNU949 | 80557.1 | — | — | — | 1.18 | 0.05 | 30 | — | — | — |
| LNU949 | 80557.2 | 0.0476 | 0.13 | 18 | — | — | — | — | — | — |
| LNU949 | 80557.4 | — | — | — | 1.11 | 0.16 | 22 | — | — | — |
| LNU914 | 80514.5 | — | — | — | 1.09 | 0.25 | 20 | — | — | — |
| LNU901 | 80474.2 | 0.0513 | 0.06 | 27 | 1.24 | 0.03 | 37 | — | — | — |
| LNU901 | 80474.3 | — | — | — | 1.10 | 0.23 | 21 | — | — | — |
| LNU901 | 80476.4 | — | — | — | 1.27 | 0.03 | 39 | 0.632 | 0.30 | 12 |
| LNU892 | 80410.1 | — | — | — | 1.11 | 0.09 | 23 | 0.649 | 0.14 | 15 |
| LNU892 | 80414.7 | — | — | — | 1.21 | 0.05 | 34 | — | — | — |
| LNU873 | 80473.6 | — | — | — | 1.44 | L | 59 | — | — | — |
| LNU866 | 80444.6 | — | — | — | 1.12 | 0.16 | 24 | 0.643 | 0.25 | 14 |
| LNU834_H1 | 80402.1 | — | — | — | 1.11 | 0.16 | 22 | — | — | — |
| LNU834_H1 | 80402.3 | — | — | — | 1.08 | 0.20 | 19 | — | — | — |
| LNU834_H1 | 80404.5 | — | — | — | 1.40 | 0.04 | 55 | 0.656 | 0.22 | 16 |
| LNU798 | 79671.4 | — | — | — | 1.18 | 0.06 | 30 | — | — | — |
| LNU798 | 79673.2 | — | — | — | 1.08 | 0.26 | 19 | — | — | — |
| LNU787 | 80546.5 | — | — | — | — | — | — | 0.648 | 0.20 | 15 |
| LNU787 | 80547.4 | — | — | — | 1.06 | 0.21 | 16 | — | — | — |
| LNU787 | 80547.5 | 0.0478 | 0.11 | 18 | 1.41 | L | 56 | 0.686 | 0.08 | 22 |
| LNU766 | 78932.1 | 0.0482 | 0.11 | 19 | 1.23 | 0.04 | 36 | 0.653 | 0.19 | 16 |
| CONT. | | 0.0404 | — | — | 0.907 | — | — | 0.565 | — | — |
| LNU884 | 80407.5 | — | — | — | 1.42 | 0.22 | 21 | 0.633 | 0.04 | 17 |
| LNU872 | 77725.4 | — | — | — | — | — | — | 0.584 | 0.22 | 8 |
| LNU844 | 80341.2 | — | — | — | 1.47 | 0.17 | 24 | 0.591 | 0.25 | 9 |
| LNU791 | 77895.4 | — | — | — | 1.37 | 0.26 | 16 | 0.584 | 0.22 | 8 |
| CONT. | | — | — | — | 1.18 | — | — | 0.541 | — | — |

Table 105:
"CONT."—Control;
"Ave."—Average;
"% Incr." = % increment;
"p-val."—p-value;
L means that p-value is less than 0.01, p < 0.1 was considered as significant.

TABLE 106

Genes showing improved plant growth rate at nitrogen deficient conditions (T1 generation)

| Gene Name | RGR Of Roots Coverage | | | RGR Of Root Length | | |
|---|---|---|---|---|---|---|
| | Ave. | P-Val. | % Incr. | Ave. | P-Val. | % Incr. |
| LNU818 | — | — | — | 0.691 | 0.11 | 14 |
| CONT. | — | — | — | 0.606 | — | — |
| LNU956 | 2.09 | 0.13 | 20 | — | — | — |
| CONT. | 1.74 | — | — | — | — | — |
| LNU946 | 1.51 | 0.20 | 23 | — | — | — |
| LNU932 | — | — | — | 0.739 | 0.23 | 17 |
| LNU887 | 1.53 | 0.17 | 25 | 0.722 | 0.18 | 14 |
| LNU786 | 1.65 | 0.04 | 35 | 0.741 | 0.15 | 17 |
| CONT. | 1.22 | — | — | 0.635 | — | — |

Table 106:
"CONT."—Control;
"Ave." —Average;
"% Incr." = % increment;
"p-val."—p-value;
L means that p-value is less than 0.01, p < 0.1 was considered as significant.

The genes listed in Tables 107-110 improved plant NUE when grown at standard nitrogen concentration levels. These genes produced larger plant biomass (plant fresh and dry weight; leaf area, root coverage and roots length) when grown under standard nitrogen growth conditions compared to control plants that were grown under identical growth conditions in T2 (Tables 107-108) and T1 (Tables 109-110) generations. Larger plant biomass under these growth conditions indicates the high ability of the plant to better metabolize the nitrogen present in the medium. Plants producing larger root biomass have better possibilities to absorb larger amount of nitrogen from soil.

TABLE 107

Genes showing improved plant performance at standard nitrogen growth conditions (T2 generation)

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LNU938 | 80355.5 | 6.80 | 0.27 | 16 | 140.0 | 0.21 | 43 |
| LNU910 | 80348.5 | — | — | — | 129.1 | 0.21 | 32 |
| LNU910 | 80350.1 | 7.17 | 0.12 | 23 | 118.7 | 0.18 | 21 |
| LNU869 | 80083.3 | 7.10 | 0.09 | 21 | 142.9 | 0.12 | 46 |
| LNU869 | 80084.4 | 10.3 | 0.10 | 77 | 184.2 | L | 88 |
| LNU869 | 80085.3 | 8.25 | 0.01 | 41 | 158.8 | 0.02 | 63 |
| LNU771 | 80077.2 | — | — | — | 170.8 | L | 75 |
| LNU771 | 80079.3 | — | — | — | 123.8 | 0.26 | 27 |

TABLE 107-continued

Genes showing improved plant performance at standard nitrogen growth conditions (T2 generation)

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| CONT. | — | 5.85 | — | — | 97.7 | — | — |
| LNU964 | 80548.3 | 5.30 | 0.25 | 25 | 112.8 | 0.03 | 40 |
| LNU964 | 80552.4 | 7.85 | 0.04 | 86 | 162.1 | 0.06 | 101 |
| LNU964 | 80552.6 | 5.70 | 0.01 | 35 | 103.6 | 0.07 | 28 |
| LNU955 | 80432.7 | 6.63 | 0.03 | 57 | 120.4 | 0.03 | 49 |
| LNU953 | 80428.1 | 5.40 | 0.15 | 28 | — | — | — |
| LNU953 | 80429.2 | 6.83 | 0.16 | 62 | 143.8 | 0.24 | 78 |
| LNU949 | 80557.4 | 5.85 | L | 38 | 112.4 | L | 39 |
| LNU914 | 80514.5 | 5.70 | 0.16 | 35 | 115.7 | 0.18 | 43 |
| LNU901 | 80474.2 | 6.75 | 0.03 | 60 | 128.8 | L | 60 |
| LNU901 | 80474.3 | 7.58 | 0.02 | 79 | 130.8 | 0.06 | 62 |
| LNU901 | 80476.4 | — | — | — | 116.2 | 0.17 | 44 |
| LNU892 | 80410.1 | 6.50 | L | 54 | 137.1 | 0.03 | 70 |
| LNU892 | 80412.1 | 5.70 | 0.21 | 35 | — | — | — |
| LNU892 | 80414.7 | 6.03 | 0.13 | 43 | 125.5 | 0.19 | 55 |
| LNU873 | 80469.3 | 6.42 | 0.10 | 52 | 119.8 | 0.18 | 49 |
| LNU873 | 80473.6 | 4.80 | 0.20 | 14 | 96.2 | 0.24 | 19 |
| LNU866 | 80444.6 | 7.20 | 0.03 | 70 | 150.2 | 0.15 | 86 |
| LNU843 | 78963.5 | 4.60 | 0.23 | 9 | 93.2 | 0.21 | 16 |
| LNU834_H1 | 80402.1 | 6.35 | 0.14 | 50 | 116.8 | 0.08 | 45 |
| LNU834_H1 | 80402.3 | 5.88 | 0.04 | 39 | 97.9 | 0.22 | 21 |
| LNU834_H1 | 80404.5 | 6.05 | 0.05 | 43 | 113.1 | 0.03 | 40 |
| LNU798 | 79669.1 | 5.67 | 0.12 | 34 | 102.2 | 0.04 | 27 |
| LNU798 | 79671.4 | — | — | — | 132.5 | L | 64 |
| LNU798 | 79673.2 | 5.62 | 0.13 | 33 | 106.7 | 0.14 | 32 |
| LNU787 | 80546.5 | 6.68 | 0.04 | 58 | 126.0 | 0.01 | 56 |
| LNU787 | 80547.5 | 6.70 | 0.07 | 59 | 139.7 | 0.01 | 73 |
| LNU766 | 78931.1 | 6.05 | L | 43 | 117.1 | L | 45 |
| LNU766 | 78931.10 | 7.52 | L | 78 | 129.5 | 0.02 | 60 |
| LNU766 | 78932.1 | 5.47 | 0.20 | 30 | 102.8 | 0.03 | 27 |
| CONT. | — | 4.22 | — | — | 80.7 | — | — |
| LNU952 | 78218.3 | 6.10 | 0.25 | 34 | — | — | — |
| LNU952 | 78218.6 | 6.17 | 0.26 | 35 | 133.8 | 0.14 | 28 |
| LNU905 | 79674.4 | 7.12 | 0.15 | 56 | 138.1 | 0.20 | 32 |
| LNU897 | 80449.1 | 6.10 | 0.16 | 34 | — | — | — |
| LNU884 | 80407.5 | 8.55 | 0.05 | 87 | 172.8 | 0.16 | 66 |
| LNU872 | 77723.2 | — | — | — | 138.9 | 0.15 | 33 |
| LNU872 | 77724.7 | 8.20 | 0.02 | 80 | 154.9 | 0.07 | 48 |
| CONT. | — | 4.57 | — | — | 104.4 | — | — |

Table 107:
"CONT."—Control;
"Ave." —Average;
"% Incr." = % increment;
"p-val."—p-value;
L means that p-value is less than 0.01, p < 0.1 was considered as significant.

TABLE 108

Genes showing improved plant performance at standard nitrogen growth conditions (T2 generation)

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU954 | 80360.1 | 0.510 | 0.16 | 9 | — | — | — | — | — | — |
| LNU938 | 80355.5 | 0.554 | 0.05 | 19 | — | — | — | — | — | — |
| LNU910 | 80348.1 | 0.560 | 0.27 | 20 | — | — | — | — | — | — |
| LNU910 | 80348.5 | 0.586 | L | 26 | — | — | — | 6.83 | 0.26 | 9 |
| LNU910 | 80350.1 | 0.620 | 0.02 | 33 | 7.98 | 0.11 | 22 | 6.97 | L | 11 |
| LNU869 | 80083.3 | 0.603 | 0.06 | 29 | — | — | — | — | — | — |
| LNU869 | 80084.3 | 0.564 | 0.07 | 21 | — | — | — | — | — | — |
| LNU869 | 80084.4 | 0.767 | L | 65 | — | — | — | — | — | — |

TABLE 108-continued

Genes showing improved plant performance at standard nitrogen growth conditions (T2 generation)

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU869 | 80085.3 | 0.656 | L | 41 | 8.85 | L | 36 | 7.14 | L | 14 |
| LNU840 | 78676.4 | 0.527 | 0.18 | 13 | — | — | — | 6.55 | 0.19 | 5 |
| LNU840 | 78677.1 | 0.533 | 0.24 | 14 | — | — | — | — | — | — |
| LNU840 | 78763.2 | 0.540 | 0.16 | 16 | — | — | — | — | — | — |
| LNU771 | 80077.2 | 0.646 | 0.19 | 38 | 9.56 | L | 47 | 7.19 | L | 15 |
| LNU771 | 80079.3 | 0.572 | 0.19 | 23 | — | — | — | — | — | — |
| LNU771 | 80079.4 | 0.538 | 0.07 | 15 | — | — | — | — | — | — |
| CONT. | — | 0.466 | — | — | 6.52 | — | — | 6.26 | — | — |
| LNU964 | 80548.1 | 0.557 | L | 23 | 6.39 | 0.20 | 15 | 6.21 | 0.06 | 8 |
| LNU964 | 80548.3 | 0.514 | 0.02 | 14 | — | — | — | — | — | — |
| LNU964 | 80552.4 | 0.699 | 0.01 | 54 | 7.77 | 0.13 | 40 | 6.15 | 0.26 | 7 |
| LNU964 | 80552.6 | 0.500 | 0.10 | 10 | — | — | — | 6.06 | 0.28 | 6 |
| LNU955 | 80432.7 | 0.597 | 0.03 | 32 | 9.08 | 0.09 | 64 | — | — | — |
| LNU953 | 80428.1 | 0.554 | 0.03 | 22 | 7.46 | 0.07 | 35 | 6.21 | 0.01 | 8 |
| LNU953 | 80429.2 | 0.640 | 0.12 | 41 | — | — | — | — | — | — |
| LNU949 | 80557.4 | 0.612 | L | 35 | 8.01 | 0.02 | 45 | 6.43 | L | 12 |
| LNU914 | 80514.5 | 0.598 | L | 32 | — | — | — | — | — | — |
| LNU914 | 80515.6 | 0.543 | 0.09 | 20 | — | — | — | — | — | — |
| LNU901 | 80474.2 | 0.598 | 0.02 | 32 | 8.49 | 0.02 | 53 | 6.53 | 0.07 | 14 |
| LNU901 | 80474.3 | 0.605 | L | 34 | 6.52 | 0.10 | 18 | — | — | — |
| LNU901 | 80476.4 | 0.513 | 0.05 | 13 | — | — | — | 6.25 | 0.20 | 9 |
| LNU892 | 80410.1 | 0.582 | 0.07 | 29 | 7.37 | 0.01 | 33 | 6.24 | 0.04 | 9 |
| LNU892 | 80414.7 | 0.552 | 0.12 | 22 | — | — | — | — | — | — |
| LNU873 | 80469.3 | 0.540 | L | 19 | 6.46 | 0.21 | 17 | — | — | — |
| LNU873 | 80473.6 | 0.502 | 0.16 | 11 | 6.19 | 0.25 | 12 | — | — | — |
| LNU866 | 80444.6 | 0.678 | 0.13 | 50 | — | — | — | — | — | — |
| LNU834_H1 | 80402.1 | 0.597 | 0.03 | 32 | 8.21 | 0.09 | 48 | 6.67 | L | 16 |
| LNU834_H1 | 80402.3 | 0.519 | 0.03 | 15 | 6.42 | 0.10 | 16 | — | — | — |
| LNU834_H1 | 80404.5 | 0.588 | L | 30 | 7.17 | L | 30 | 6.30 | 0.21 | 10 |
| LNU798 | 79669.1 | 0.517 | 0.02 | 14 | — | — | — | — | — | — |
| LNU798 | 79671.4 | 0.681 | L | 51 | 9.55 | 0.29 | 73 | 6.63 | 0.26 | 16 |
| LNU798 | 79673.2 | 0.573 | 0.13 | 27 | 7.55 | 0.29 | 36 | 6.66 | 0.14 | 16 |
| LNU787 | 80546.5 | 0.568 | 0.01 | 26 | 7.62 | 0.19 | 38 | 6.31 | 0.24 | 10 |
| LNU787 | 80547.4 | — | — | — | 6.11 | 0.29 | 10 | 6.47 | 0.02 | 13 |
| LNU787 | 80547.5 | 0.607 | 0.06 | 34 | 8.87 | 0.03 | 60 | 6.53 | 0.02 | 14 |
| LNU766 | 78931.1 | 0.535 | 0.12 | 18 | 7.02 | 0.09 | 27 | — | — | — |
| LNU766 | 78931.10 | 0.648 | 0.03 | 43 | 8.84 | 0.01 | 60 | 6.78 | 0.03 | 18 |
| LNU766 | 78932.1 | 0.589 | 0.05 | 30 | 7.38 | 0.17 | 33 | 6.79 | 0.04 | 19 |
| CONT. | — | 0.453 | — | — | 5.53 | — | — | 5.73 | — | — |
| LNU952 | 78218.6 | 0.695 | 0.04 | 34 | 7.32 | 0.16 | 26 | — | — | — |
| LNU920 | 78507.1 | — | — | — | 7.69 | 0.24 | 33 | — | — | — |
| LNU920 | 78510.1 | — | — | — | — | — | — | 6.53 | 0.29 | 10 |
| LNU905 | 79674.4 | 0.663 | 0.16 | 28 | 8.22 | 0.07 | 42 | — | — | — |
| LNU905 | 79676.1 | 0.614 | 0.20 | 19 | 7.19 | 0.28 | 24 | — | — | — |
| LNU897 | 80449.1 | 0.620 | 0.17 | 20 | — | — | — | — | — | — |
| LNU884 | 80407.5 | 0.791 | 0.03 | 53 | 9.14 | 0.04 | 57 | 6.76 | 0.19 | 14 |
| LNU872 | 77723.2 | 0.689 | 0.15 | 33 | — | — | — | — | — | — |
| LNU872 | 77724.7 | 0.650 | 0.10 | 26 | 9.50 | 0.05 | 64 | 6.90 | 0.13 | 17 |
| LNU791 | 77895.4 | — | — | — | — | — | — | 6.62 | 0.24 | 12 |
| CONT. | — | 0.517 | — | — | 5.81 | — | — | 5.91 | — | — |

Table 108:
"CONT."—Control;
"Ave."—Average;
"% Incr." = % increment;
"p-val."—p-value;
L means that p-value is less than 0.01, p < 0.1 was considered as significant.

TABLE 109

Genes showing improved plant performance at standard nitrogen growth conditions (T1 generation)

| Gene Name | Dry Weight [mg] | | | Fresh Weight [mg] | | |
|---|---|---|---|---|---|---|
| | Ave. | P-Val. | % Incr. | Ave. | P-Val. | % Incr. |
| LNU919 | — | — | — | 139.8 | 0.19 | 15 |
| CONT. | — | — | — | 121.4 | — | — |
| LNU956 | 9.90 | 0.18 | 24 | — | — | — |
| LNU749 | 10.0 | 0.20 | 26 | — | — | — |
| CONT. | 7.97 | — | — | — | — | — |

Table 109:
"CONT."—Control;
"Ave."—Average;
"% Incr." = % increment;
"p-val."—p-value;
L means that p-value is less than 0.01, p < 0.1 was considered as significant.

TABLE 110

Genes showing improved plant performance at standard nitrogen growth conditions (T1 generation)

| Gene Name | Leaf Area [cm²] | | | Roots Coverage [cm²] | | | Roots Length [cm] | | |
|---|---|---|---|---|---|---|---|---|---|
| | Ave. | P-Val. | % Incr. | Ave. | P-Val. | % Incr. | Ave. | P-Val. | % Incr. |
| LNU886 | 0.752 | 0.19 | 14 | — | — | — | — | — | — |
| LNU821 | — | — | — | 6.89 | 0.27 | 18 | 5.89 | 0.19 | 7 |
| CONT. | 0.660 | — | — | 5.83 | — | — | 5.50 | — | — |

Table 110:
"CONT."—Control;
"Ave."—Average;
"% Incr." = % increment;
"p-val."—p-value;
L means that p-value is less than 0.01, p < 0.1 was considered as significant.

The genes listed in Tables 111-112 improved plant relative growth rate (RGR of leaf area, root length and root coverage) when grown at standard nitrogen concentration levels. These genes produced plants that grew faster than control plants when grown under standard nitrogen growth conditions. Faster growth was observed when growth rate of leaf area, root length and root coverage was measured.

TABLE 111

Genes showing improved growth rate at standard nitrogen growth conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU954 | 80360.4 | — | — | — | — | — | — | 0.583 | 0.23 | 10 |
| LNU938 | 80354.1 | — | — | — | — | — | — | 0.588 | 0.21 | 11 |
| LNU938 | 80355.5 | 0.0549 | 0.14 | 18 | — | — | — | — | — | — |
| LNU910 | 80348.1 | 0.0555 | 0.22 | 19 | — | — | — | — | — | — |
| LNU910 | 80348.5 | 0.0588 | 0.11 | 26 | — | — | — | — | — | — |
| LNU910 | 80350.1 | 0.0617 | 0.02 | 32 | 0.929 | 0.07 | 23 | 0.611 | 0.06 | 16 |
| LNU869 | 80083.3 | 0.0584 | 0.12 | 25 | — | — | — | — | — | — |
| LNU869 | 80084.3 | 0.0549 | 0.16 | 18 | — | — | — | — | — | — |
| LNU869 | 80084.4 | 0.0767 | L | 64 | 0.911 | 0.23 | 20 | — | — | — |
| LNU869 | 80085.3 | 0.0652 | L | 40 | 1.02 | L | 34 | 0.583 | 0.21 | 10 |
| LNU840 | 78677.1 | 0.0537 | 0.25 | 15 | — | — | — | — | — | — |
| LNU840 | 78763.2 | 0.0529 | 0.30 | 13 | — | — | — | — | — | — |
| LNU771 | 80077.2 | 0.0630 | 0.05 | 35 | 1.11 | L | 46 | 0.627 | 0.09 | 19 |
| LNU771 | 80079.3 | 0.0537 | 0.30 | 15 | 0.859 | 0.29 | 13 | — | — | — |
| LNU771 | 80079.4 | 0.0544 | 0.18 | 17 | — | — | — | 0.577 | 0.29 | 9 |
| CONT. | — | 0.0466 | — | — | 0.758 | — | — | 0.528 | — | — |
| LNU964 | 80548.1 | 0.0572 | 0.03 | 23 | 0.773 | 0.24 | 16 | 0.632 | 0.08 | 11 |
| LNU964 | 80548.3 | 0.0522 | 0.26 | 12 | — | — | — | — | — | — |
| LNU964 | 80552.4 | 0.0733 | L | 58 | 0.917 | 0.03 | 38 | — | — | — |

TABLE 111-continued

Genes showing improved growth rate at standard nitrogen growth conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU964 | 80552.6 | 0.0543 | 0.12 | 17 | — | — | — | — | — | — |
| LNU955 | 80432.7 | 0.0607 | 0.02 | 31 | 1.11 | L | 67 | — | — | — |
| LNU953 | 80428.1 | 0.0561 | 0.04 | 21 | 0.879 | 0.04 | 32 | — | — | — |
| LNU953 | 80429.2 | 0.0662 | L | 42 | 0.787 | 0.27 | 18 | — | — | — |
| LNU949 | 80557.4 | 0.0630 | L | 36 | 0.971 | L | 46 | 0.627 | 0.13 | 10 |
| LNU914 | 80514.5 | 0.0596 | 0.03 | 28 | — | — | — | — | — | — |
| LNU914 | 80515.6 | 0.0550 | 0.12 | 18 | — | — | — | — | — | — |
| LNU901 | 80474.2 | 0.0592 | 0.01 | 27 | 1.01 | L | 52 | — | — | — |
| LNU901 | 80474.3 | 0.0623 | L | 34 | 0.792 | 0.16 | 19 | — | — | — |
| LNU901 | 80476.4 | 0.0534 | 0.15 | 15 | — | — | — | — | — | — |
| LNU892 | 80410.1 | 0.0589 | 0.02 | 27 | 0.890 | 0.02 | 34 | 0.615 | 0.17 | 8 |
| LNU892 | 80414.7 | 0.0551 | 0.12 | 19 | — | — | — | — | — | — |
| LNU873 | 80469.3 | 0.0550 | 0.08 | 18 | 0.779 | 0.26 | 17 | — | — | — |
| LNU873 | 80473.6 | 0.0522 | 0.24 | 12 | — | — | — | — | — | — |
| LNU866 | 80444.6 | 0.0664 | L | 43 | 0.901 | 0.08 | 35 | — | — | — |
| LNU834_H1 | 80402.1 | 0.0614 | L | 32 | 0.965 | 0.01 | 45 | 0.614 | 0.21 | 8 |
| LNU834_H1 | 80402.3 | 0.0529 | 0.14 | 14 | 0.768 | 0.25 | 15 | — | — | — |
| LNU834_H1 | 80404.5 | 0.0588 | 0.01 | 27 | 0.859 | 0.03 | 29 | — | — | — |
| LNU798 | 79671.4 | 0.0701 | L | 51 | 1.12 | L | 68 | — | — | — |
| LNU798 | 79673.2 | 0.0585 | 0.05 | 26 | 0.903 | 0.10 | 36 | 0.636 | 0.17 | 12 |
| LNU787 | 80546.5 | 0.0572 | 0.03 | 23 | 0.899 | 0.06 | 35 | — | — | — |
| LNU787 | 80547.4 | — | — | — | — | — | — | 0.609 | 0.25 | 7 |
| LNU787 | 80547.5 | 0.0659 | L | 42 | 1.06 | L | 59 | 0.634 | 0.07 | 12 |
| LNU766 | 78931.1 | 0.0539 | 0.15 | 16 | 0.830 | 0.09 | 25 | — | — | — |
| LNU766 | 78931.1 | 00.0668 | L | 44 | 1.02 | L | 54 | 0.639 | 0.10 | 13 |
| LNU766 | 78932.1 | 0.0584 | 0.04 | 26 | 0.864 | 0.08 | 30 | 0.612 | 0.30 | 8 |
| CONT. | — | 0.0464 | — | — | 0.665 | — | — | 0.568 | — | — |
| LNU952 | 78218.6 | 0.0694 | 0.04 | 41 | 0.879 | 0.15 | 31 | 0.589 | 0.13 | 19 |
| LNU920 | 78507.1 | — | — | — | 0.907 | 0.20 | 36 | — | — | — |
| LNU905 | 79674.4 | 0.0658 | 0.16 | 33 | 0.960 | 0.06 | 44 | — | — | — |
| LNU905 | 79676.1 | 0.0620 | 0.15 | 26 | 0.848 | 0.22 | 27 | 0.584 | 0.12 | 18 |
| LNU897 | 80449.1 | 0.0618 | 0.17 | 25 | — | — | — | — | — | — |
| LNU884 | 80407.5 | 0.0776 | 0.01 | 57 | 1.06 | 0.02 | 58 | 0.593 | 0.21 | 19 |
| LNU872 | 77723.2 | 0.0681 | 0.07 | 38 | 0.834 | 0.26 | 25 | 0.582 | 0.26 | 17 |
| LNU872 | 77724.7 | 0.0670 | 0.03 | 36 | 1.08 | 0.03 | 61 | — | — | — |
| LNU773 | 80399.2 | — | — | — | 0.895 | 0.24 | 34 | 0.583 | 0.28 | 17 |
| CONT. | — | 0.0493 | — | — | 0.669 | — | — | 0.497 | — | — |

Table 111:
"CONT."—Control;
"Ave."—Average;
"% Incr." = % increment;
"p-val."—p-value;
L means that p-value is less than 0.01, p < 0.1 was considered as significant.

TABLE 112

Genes showing improved growth rate at standard nitrogen growth conditions (T1 generation)

| Gene Name | RGR Of Leaf Area | | | RGR Of Roots Coverage | | | RGR Of Root Length | | |
|---|---|---|---|---|---|---|---|---|---|
| | Ave. | P-Val. | % Incr. | Ave. | P-Val. | % Incr. | Ave. | P-Val. | % Incr. |
| LNU886 | — | — | — | 0.809 | 0.25 | 19 | — | — | — |
| LNU821 | — | — | — | 0.815 | 0.19 | 20 | 0.590 | 0.18 | 9 |
| CONT. | — | — | — | 0.680 | — | — | 0.540 | — | — |
| LNU956 | 0.0900 | 0.29 | 21 | — | — | — | — | — | — |
| CONT. | 0.0741 | — | — | — | — | — | — | — | — |

Table 112:
"CONT."—Control;
"Ave."—Average;
"% Incr." = % increment;
"p-val."—p-value;
L means that p-value is less than 0.01, p < 0.1 was considered as significant.

Example 17

**Evaluation of Transgenic *Arabidopsis* NUE, Yield and Plant Growth Rate Under Low or Normal Nitrogen Fertilization in Greenhouse Assay**

Assay 1: Nitrogen Use Efficiency: Seed yield plant biomass and plant growth rate at limited and optimal nitrogen concentration under greenhouse conditions—This assay follows seed yield production, the biomass formation and the rosette area growth of plants grown in the greenhouse at limiting and non-limiting nitrogen growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing nitrogen limiting conditions, which were achieved by irrigating the plants with a solution containing 1.5 mM inorganic nitrogen in the form of $KNO_3$, supplemented with 1 mM $KH_2PO_4$, 1 mM $MgSO_4$, 3.6 mM KCl, 2 mM $CaCl_2$ and microelements, while normal nitrogen levels were achieved by applying a solution of 6 mM inorganic nitrogen also in the form of $KNO_3$ with 1 mM $KH_2PO_4$, 1 mM $MgSO_4$, 2 mM $CaCl_2$ and microelements. All plants were grown in the greenhouse until mature seeds. Seeds were harvested, extracted and weight. The remaining plant biomass (the above ground tissue) was also harvested, and weighted immediately or following drying in oven at 50° C. for 24 hours.

Each construct was validated at its $T_2$ generation. Transgenic plants transformed with a construct conformed by an empty vector carrying the 35S promoter and the selectable marker was used as control.

The plants are analyzed for their overall size, growth rate, flowering, seed yield, 1,000-seed weight, dry matter and harvest index (HI-seed yield/dry matter). Transgenic plants performance was compared to control plants grown in parallel under the same conditions. Mock—transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at rsbweb (dot) nih (dot) gov/]. Images are captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, leaf blade area.

Vegetative growth rate: the relative growth rate (RGR) of leaf number [Formula VIII (described above)], rosette area (Formula IX, described above), plot coverage (Formula XI, described above) and harvest index (Formula XV) is calculated with the indicated formulas.

Seeds average weight—At the end of the experiment all seeds were collected.

The seeds were scattered on a glass tray and a picture is taken. Using the digital analysis, the number of seeds in each sample was calculated.

Dry weight and seed yield—On about day 80 from sowing, the plants were harvested and left to dry at 30° C. in a drying chamber. The biomass and seed weight of each plot were measured and divided by the number of plants in each plot. Dry weight=total weight of the vegetative portion above ground (excluding roots) after drying at 30° C. in a drying chamber; Seed yield per plant=total seed weight per plant (gr). 1000 seed weight (the weight of 1000 seeds) (gr.).

The harvest index (HI) is calculated using Formula XV as described above.

Oil percentage in seeds—At the end of the experiment all seeds from each plot were collected. Seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingier's) 1879, 232, 461) was used to create a calibration curve for the Low Resonance NMR. The content of oil of all seed samples is determined using the Low Resonance NMR (MARAN Ultra—Oxford Instrument) and its MultiQuant software package Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Statistical analyses—To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Tables 113-122 summarize the observed phenotypes of transgenic plants exogenously expressing the gene constructs using the greenhouse seed maturation (GH-SM) assays under low nitrogen (Tables 113-117) or normal nitrogen (Tables 118-122) conditions. The evaluation of each gene was performed by testing the performance of different number of events. Event with p-value <0.1 was considered statistically significant.

TABLE 113

Genes showing improved plant performance at low Nitrogen growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LNU947 | 77448.4 | 458.1 | 0.03 | 17 | — | — | — | — | — | — |
| LNU895 | 77934.1 | 416.9 | 0.10 | 6 | — | — | — | — | — | — |
| LNU895 | 77935.3 | 424.4 | 0.05 | 8 | — | — | — | — | — | — |
| LNU878 | 77252.1 | 474.4 | 0.21 | 21 | — | — | — | — | — | — |
| LNU878 | 77254.3 | 420.6 | 0.07 | 7 | — | — | — | — | — | — |
| LNU820 | 77806.2 | 431.9 | 0.02 | 10 | — | — | — | — | — | — |
| LNU820 | 77807.2 | 423.8 | 0.05 | 8 | — | — | — | — | — | — |
| LNU820 | 77809.1 | 445.6 | 0.22 | 14 | — | — | — | — | — | — |
| LNU815 | 77494.1 | 425.6 | 0.08 | 9 | — | — | — | — | — | — |
| LNU808 | 77678.3 | 456.9 | 0.03 | 17 | — | — | — | — | — | — |
| LNU803 | 77902.2 | 446.9 | L | 14 | — | — | — | — | — | — |
| LNU784 | 77612.3 | 480.0 | L | 23 | — | — | — | — | — | — |
| LNU784 | 77615.1 | 429.4 | 0.03 | 10 | — | — | — | — | — | — |
| LNU779 | 77887.1 | 428.1 | 0.03 | 9 | — | — | — | — | — | — |
| LNU774 | 77247.4 | 408.5 | 0.25 | 4 | — | — | — | — | — | — |
| CONT. | — | 391.6 | — | — | — | — | — | — | — | — |
| LNU895 | 77934.4 | 616.9 | 0.07 | 8 | 23.0 | 0.04 | −5 | 18.3 | 0.21 | −4 |
| LNU895 | 77935.4 | — | — | — | — | — | — | 18.9 | 0.30 | −1 |
| LNU890 | 78202.1 | 616.9 | 0.18 | 8 | — | — | — | — | — | — |
| LNU878 | 77251.3 | 633.1 | 0.19 | 11 | 23.5 | 0.02 | −3 | 18.0 | L | −6 |
| LNU878 | 77254.2 | 606.9 | 0.12 | 6 | — | — | — | — | — | — |
| LNU838 | 77616.2 | — | — | — | 23.5 | 0.02 | −3 | — | — | — |
| LNU838 | 77616.3 | 593.8 | 0.30 | 4 | 23.6 | 0.04 | −2 | — | — | — |
| LNU838 | 77617.2 | — | — | — | — | — | — | 18.5 | 0.02 | −3 |
| LNU838 | 77617.5 | — | — | — | 23.7 | 0.19 | −2 | — | — | — |
| LNU811 | 78179.1 | — | — | — | 23.2 | 0.26 | −4 | 18.4 | 0.01 | −4 |
| LNU808 | 77677.2 | — | — | — | — | — | — | 18.8 | 0.27 | −1 |
| LNU808 | 77678.3 | 633.8 | 0.12 | 11 | 22.7 | 0.19 | −6 | 17.4 | 0.21 | −9 |
| LNU808 | 77679.3 | — | — | — | 23.2 | 0.09 | −4 | 17.4 | L | −9 |
| LNU803 | 77901.2 | — | — | — | 23.7 | 0.06 | −2 | — | — | — |
| LNU803 | 77902.2 | 676.2 | L | 18 | — | — | — | — | — | — |
| LNU793 | 78169.2 | — | — | — | 22.9 | L | −5 | — | — | — |
| LNU784 | 77615.1 | — | — | — | 23.2 | 0.09 | −4 | — | — | — |
| LNU784 | 77615.12 | — | — | — | 23.1 | 0.15 | −4 | 17.5 | L | −8 |
| LNU775 | 77592.3 | 819.8 | 0.06 | 43 | 23.1 | 0.01 | −5 | 16.6 | L | −13 |
| LNU774 | 77246.3 | 678.1 | 0.23 | 18 | 21.4 | L | −12 | 16.6 | L | −13 |
| LNU774 | 77247.4 | 587.5 | 0.25 | 3 | 23.1 | 0.17 | −5 | 18.6 | 0.06 | −2 |
| LNU754 | 77801.2 | — | — | — | 23.1 | 0.15 | −4 | 18.2 | 0.05 | −5 |
| CONT. | — | 572.3 | — | — | 24.2 | — | — | 19.1 | — | — |

Table 113:
"CONT."—Control;
"Ave."—Average;
"% Incr." = % increment;
"p-val."—p-value;
L means that p-value is less than 0.01, p < 0.1 was considered as significant. transgenes were under the transcriptional regulation of the new At6669 promoter (SEQ ID NO: 4880). It should be noted that a negative increment (in percentages) when found in flowering or inflorescence emergence indicates drought avoidance of the plant.

TABLE 114

Genes showing improved plant performance at low Nitrogen growth conditions under regulation of At6669 promoter

| Gene Name | Event # | Leaf Blade Area [cm$^2$] | | | Leaf Number | | | Plot Coverage [cm$^2$] | | |
|---|---|---|---|---|---|---|---|---|---|---|
| | | Ave. | P-Val. | % Incr. | Ave. | P-Val. | % Incr. | Ave. | P-Val. | % Incr. |
| LNU895 | 77933.2 | — | — | — | 11.8 | 0.15 | 3 | — | — | — |
| LNU878 | 77251.3 | — | — | — | — | — | — | 107.1 | 0.24 | 19 |
| LNU878 | 77252.1 | 2.10 | 0.15 | 40 | — | — | — | 125.2 | 0.21 | 39 |
| LNU878 | 77254.3 | 1.58 | 0.04 | 5 | — | — | — | 94.6 | 0.02 | 5 |
| LNU815 | 77492.6 | — | — | — | 11.8 | 0.15 | 3 | 104.9 | 0.24 | 17 |
| LNU815 | 77495.1 | 1.62 | 0.19 | 8 | — | — | — | 99.5 | 0.28 | 11 |
| LNU808 | 77678.3 | 1.62 | 0.26 | 8 | — | — | — | 95.9 | 0.04 | 7 |
| LNU803 | 77902.2 | — | — | — | 12.2 | L | 8 | — | — | — |

TABLE 114-continued

Genes showing improved plant performance at low Nitrogen growth conditions under regulation of At6669 promoter

| Gene Name | Event # | Leaf Blade Area [cm²] Ave. | P-Val. | % Incr. | Leaf Number Ave. | P-Val. | % Incr. | Plot Coverage [cm²] Ave. | P-Val. | % Incr. |
|---|---|---|---|---|---|---|---|---|---|---|
| LNU803 | 77904.4 | 1.78 | 0.15 | 19 | — | — | — | 105.6 | L | 18 |
| LNU784 | 77615.7 | — | — | — | — | — | — | 101.6 | 0.18 | 13 |
| LNU784 | 77615.9 | 1.76 | 0.11 | 17 | — | — | — | 101.2 | 0.04 | 13 |
| LNU779 | 77887.1 | — | — | — | — | — | — | 93.5 | 0.25 | 4 |
| LNU775 | 77593.3 | — | — | — | — | — | — | 93.6 | 0.18 | 4 |
| LNU774 | 77246.3 | — | — | — | 11.8 | 0.18 | 4 | — | — | — |
| LNU774 | 77247.2 | — | — | — | 11.9 | 0.11 | 5 | — | — | — |
| LNU756 | 77581.3 | — | — | — | — | — | — | 99.9 | 0.06 | 11 |
| LNU756 | 77585.4 | 1.55 | 0.18 | 3 | — | — | — | 94.7 | 0.19 | 5 |
| CONT. | — | 1.50 | — | — | 11.4 | — | — | 89.8 | — | — |
| LNU895 | 77934.4 | 1.74 | 0.07 | 21 | — | — | — | 108.2 | 0.29 | 19 |
| LNU878 | 77251.3 | 1.56 | 0.10 | 8 | — | — | — | — | — | — |
| LNU838 | 77616.3 | 1.54 | 0.29 | 7 | — | — | — | — | — | — |
| LNU811 | 78179.1 | 1.63 | 0.02 | 13 | — | — | — | 98.9 | 0.15 | 9 |
| LNU808 | 77677.2 | 1.52 | 0.28 | 5 | — | — | — | — | — | — |
| LNU808 | 77677.3 | 1.54 | 0.28 | 7 | — | — | — | — | — | — |
| LNU808 | 77678.3 | 1.61 | 0.05 | 12 | 11.9 | 0.09 | 6 | 104.8 | 0.06 | 15 |
| LNU803 | 77902.2 | — | — | — | 12.2 | 0.15 | 8 | — | — | — |
| LNU803 | 77904.4 | — | — | — | 11.9 | 0.09 | 6 | — | — | — |
| LNU793 | 78169.2 | 1.57 | 0.11 | 9 | — | — | — | — | — | — |
| LNU784 | 77615.1 | 1.63 | 0.12 | 13 | — | — | — | 102.1 | 0.05 | 12 |
| LNU775 | 77593.1 | 1.55 | 0.22 | 8 | — | — | — | — | — | — |
| LNU774 | 77246.3 | 1.96 | 0.04 | 36 | — | — | — | 120.5 | 0.03 | 32 |
| LNU769 | 78165.2 | — | — | — | 11.8 | 0.14 | 5 | — | — | — |
| CONT. | — | 1.44 | — | — | 11.3 | — | — | 91.1 | — | — |

Table 114:
"CONT."—Control;
"Ave."—Average;
"% Incr." = % increment;
"p-val."—p-value;
L means that p-value is less than 0.01, p < 0.1 was considered as significant. The transgenes were under the transcriptional regulation of the new At6669 promoter (SEQ ID NO: 4880).

TABLE 115

Genes showing improved plant performance at low Nitrogen growth conditions under regulation of At6669 promoter

| Gene Name | Event # | RGR Of Leaf Number Ave. | P-Val. | % Incr. | RGR Of Plot Coverage [cm²/day] Ave. | P-Val. | % Incr. | RGR Of Rosette Diameter [cm/day] Ave. | P-Val. | % Incr. |
|---|---|---|---|---|---|---|---|---|---|---|
| LNU940 | 77812.1 | 0.886 | 0.08 | 17 | — | — | — | — | — | — |
| LNU878 | 77251.3 | — | — | — | 13.8 | 0.13 | 19 | — | — | — |
| LNU878 | 77252.1 | — | — | — | 16.2 | L | 39 | 0.597 | 0.03 | 17 |
| LNU820 | 77807.2 | 0.838 | 0.28 | 11 | — | — | — | — | — | — |
| LNU815 | 77492.6 | — | — | — | 13.7 | 0.16 | 17 | — | — | — |
| LNU815 | 77495.1 | — | — | — | — | — | — | 0.562 | 0.15 | 10 |
| LNU803 | 77902.2 | 0.905 | 0.04 | 19 | — | — | — | — | — | — |
| LNU803 | 77902.3 | 0.855 | 0.22 | 13 | — | — | — | — | — | — |
| LNU803 | 77904.4 | — | — | — | 13.7 | 0.14 | 18 | 0.570 | 0.09 | 11 |
| LNU784 | 77612.3 | 0.905 | 0.08 | 19 | — | — | — | — | — | — |
| LNU784 | 77615.7 | — | — | — | 13.2 | 0.27 | 13 | — | — | — |
| LNU784 | 77615.9 | — | — | — | 13.1 | 0.30 | 12 | — | — | — |
| LNU756 | 77581.3 | — | — | — | — | — | — | 0.550 | 0.28 | 7 |
| LNU756 | 77584.2 | 0.851 | 0.20 | 12 | — | — | — | — | — | — |
| LNU754 | 77805.2 | 0.863 | 0.17 | 14 | — | — | — | — | — | — |
| CONT. | — | 0.758 | — | — | 11.7 | — | — | 0.513 | — | — |
| LNU895 | 77934.4 | — | — | — | 13.3 | 0.20 | 19 | 0.542 | 0.23 | 13 |
| LNU890 | 78204.6 | 0.798 | 0.22 | 14 | — | — | — | — | — | — |
| LNU811 | 78179.1 | — | — | — | — | — | — | 0.542 | 0.23 | 13 |
| LNU803 | 77901.2 | — | — | — | — | — | — | 0.547 | 0.22 | 14 |
| LNU803 | 77902.2 | 0.841 | 0.09 | 20 | — | — | — | — | — | — |
| LNU775 | 77591.2 | 0.798 | 0.23 | 14 | — | — | — | — | — | — |
| LNU775 | 77593.1 | — | — | — | — | — | — | 0.544 | 0.23 | 13 |

TABLE 115-continued

Genes showing improved plant performance at low Nitrogen growth conditions under regulation of At6669 promoter

| Gene Name | Event # | RGR Of Leaf Number | | | RGR Of Plot Coverage [cm²/day] | | | RGR Of Rosette Diameter [cm/day] | | |
|---|---|---|---|---|---|---|---|---|---|---|
| | | Ave. | P-Val. | % Incr. | Ave. | P-Val. | % Incr. | Ave. | P-Val. | % Incr. |
| LNU774 | 77246.3 | — | — | — | 14.9 | 0.03 | 33 | 0.573 | 0.08 | 19 |
| LNU769 | 78165.1 | 0.796 | 0.23 | 13 | — | — | — | — | — | — |
| CONT. | — | 0.703 | — | — | 11.2 | — | — | 0.481 | — | — |

Table 115:
"CONT."—Control;
"Ave."—Average;
"% Incr." = % increment;
"p-val."—p-value;
L means that p-value is less than 0.01 p < 0.1 was considered as significant. The transgenes were under the transcriptional regulation of the new At6669 promoter (SEQ ID NO: 4880).

TABLE 116

Genes showing improved plant performance at low Nitrogen growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU940 | 77811.5 | 0.458 | 0.18 | 7 | — | — | — | — | — | — |
| LNU878 | 77251.3 | — | — | — | 13.4 | 0.24 | 19 | 6.05 | 0.10 | 8 |
| LNU878 | 77252.1 | — | — | — | 15.7 | 0.21 | 39 | 6.61 | 0.19 | 18 |
| LNU878 | 77254.3 | — | — | — | 11.8 | 0.02 | 5 | — | — | — |
| LNU838 | 77616.2 | 0.476 | 0.11 | 11 | — | — | — | — | — | — |
| LNU838 | 77617.2 | 0.472 | 0.07 | 10 | — | — | — | — | — | — |
| LNU820 | 77806.6 | 0.471 | 0.08 | 10 | — | — | — | — | — | — |
| LNU815 | 77492.2 | 0.484 | 0.03 | 13 | — | — | — | — | — | — |
| LNU815 | 77492.6 | — | — | — | 13.1 | 0.24 | 17 | 5.91 | 0.28 | 5 |
| LNU815 | 77495.1 | — | — | — | 12.4 | 0.28 | 11 | — | — | — |
| LNU808 | 77678.3 | — | — | — | 12.0 | 0.04 | 7 | — | — | — |
| LNU808 | 77679.3 | 0.466 | 0.11 | 9 | — | — | — | — | — | — |
| LNU803 | 77901.2 | 0.497 | 0.01 | 16 | — | — | — | — | — | — |
| LNU803 | 77904.4 | — | — | — | 13.2 | L | 18 | 6.22 | L | 11 |
| LNU784 | 77615.12 | 0.458 | 0.18 | 7 | — | — | — | — | — | — |
| LNU784 | 77615.7 | — | — | — | 12.7 | 0.18 | 13 | 5.98 | 0.17 | 6 |
| LNU784 | 77615.9 | — | — | — | 12.7 | 0.04 | 13 | 6.05 | L | 8 |
| LNU779 | 77887.1 | — | — | — | 11.7 | 0.25 | 4 | 5.78 | 0.20 | 3 |
| LNU779 | 77890.3 | 0.464 | 0.17 | 8 | — | — | — | — | — | — |
| LNU777 | 77573.3 | — | — | — | — | — | — | 6.02 | 0.14 | 7 |
| LNU775 | 77593.3 | — | — | — | 11.7 | 0.18 | 4 | — | — | — |
| LNU756 | 77581.3 | 0.469 | 0.26 | 10 | 12.5 | 0.06 | 11 | — | — | — |
| LNU756 | 77585.3 | 0.452 | 0.28 | 6 | — | — | — | — | — | — |
| LNU756 | 77585.4 | — | — | — | 11.8 | 0.19 | 5 | 5.86 | 0.03 | 4 |
| CONT. | — | 0.428 | — | — | 11.2 | — | — | 5.61 | — | — |
| LNU895 | 77934.4 | — | — | — | 13.5 | 0.29 | 19 | 6.18 | 0.14 | 11 |
| LNU878 | 77251.1 | 0.461 | 0.27 | 6 | — | — | — | — | — | — |
| LNU878 | 77251.3 | — | — | — | — | — | — | 5.84 | 0.16 | 5 |
| LNU838 | 77620.3 | 0.464 | 0.23 | 6 | — | — | — | — | — | — |
| LNU811 | 78179.1 | — | — | — | 12.4 | 0.15 | 9 | 6.09 | 0.01 | 9 |
| LNU811 | 78180.3 | 0.489 | 0.03 | 12 | — | — | — | — | — | — |
| LNU808 | 77677.5 | 0.494 | 0.06 | 13 | — | — | — | — | — | — |
| LNU808 | 77678.3 | — | — | — | 13.1 | 0.06 | 15 | 5.95 | 0.11 | 7 |
| LNU797 | 78021.2 | 0.467 | 0.17 | 7 | — | — | — | — | — | — |
| LNU797 | 78025.3 | 0.485 | 0.22 | 11 | — | — | — | — | — | — |
| LNU793 | 78169.1 | 0.474 | 0.09 | 8 | — | — | — | — | — | — |
| LNU784 | 77615.1 | — | — | — | 12.8 | 0.05 | 12 | 6.06 | 0.04 | 9 |
| LNU775 | 77593.1 | — | — | — | — | — | — | 5.84 | 0.19 | 5 |
| LNU774 | 77246.3 | — | — | — | 15.1 | 0.03 | 32 | 6.62 | 0.13 | 19 |
| LNU774 | 77247.4 | 0.481 | 0.07 | 10 | — | — | — | — | — | — |
| LNU770 | 77922.1 | 0.499 | 0.15 | 14 | — | — | — | — | — | — |

TABLE 116-continued

Genes showing improved plant performance at low Nitrogen growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU770 | 77925.3 | 0.460 | 0.27 | 5 | — | — | — | — | — | — |
| LNU761 | 78159.1 | 0.473 | 0.10 | 8 | — | — | — | — | — | — |
| CONT. | — | 0.437 | — | — | 11.4 | — | — | 5.58 | — | — |

Table 116:
"CONT."—Control;
"Ave." —Average;
"% Incr." = % increment;
"p-val."—p-value;
L means that p-value is less than 0.01, p < 0.1 was considered as significant. The transgenes were under the transcriptional regulation of the new At6669 promoter (SEQ ID NO: 4880).

TABLE 117

Genes showing improved plant performance at low Nitrogen growth conditions under regulation of At6669 promoter

| Gene Name | Event # | Seed Yield [mg] | | | 1000 Seed Weight [mg] | | |
|---|---|---|---|---|---|---|---|
| | | Ave. | P-Val. | % Incr. | Ave. | P-Val. | % Incr. |
| LNU947 | 77448.4 | — | — | — | 26.4 | 0.09 | 26 |
| LNU878 | 77252.1 | — | — | — | 25.9 | 0.08 | 23 |
| LNU878 | 77254.3 | — | — | — | 22.6 | 0.19 | 7 |
| LNU841 | 77146.1 | — | — | — | 21.7 | L | 3 |
| LNU841 | 77148.1 | — | — | — | 21.6 | 0.12 | 3 |
| LNU838 | 77616.2 | 187.7 | 0.22 | 12 | — | — | — |
| LNU820 | 77807.2 | — | — | — | 22.7 | 0.12 | 8 |
| LNU820 | 77809.1 | — | — | — | 24.4 | 0.21 | 16 |
| LNU815 | 77494.1 | — | — | — | 23.6 | 0.25 | 12 |
| LNU808 | 77678.1 | 180.2 | 0.25 | 8 | 21.5 | 0.25 | 3 |
| LNU808 | 77678.3 | — | — | — | 22.8 | L | 9 |
| LNU808 | 77679.3 | 182.7 | 0.21 | 9 | — | — | — |
| LNU803 | 77901.2 | 182.5 | 0.22 | 9 | — | — | — |
| LNU784 | 77615.1 | — | — | — | 22.7 | 0.07 | 8 |
| LNU784 | 77615.9 | — | — | — | 22.3 | 0.13 | 6 |
| LNU779 | 77887.1 | 186.2 | 0.10 | 11 | — | — | — |
| LNU779 | 77890.3 | 187.5 | 0.19 | 12 | — | — | — |
| LNU777 | 77573.3 | — | — | — | 22.1 | L | 5 |
| LNU774 | 77246.3 | — | — | — | 23.1 | 0.23 | 10 |
| LNU770 | 77922.1 | 183.6 | 0.14 | 10 | — | — | — |
| LNU756 | 77584.6 | — | — | — | 23.0 | 0.09 | 10 |
| CONT. | — | 167.4 | — | — | 21.0 | — | — |
| LNU890 | 78202.1 | — | — | — | 22.7 | 0.17 | 13 |
| LNU878 | 77254.2 | 273.8 | 0.01 | 10 | — | — | — |
| LNU878 | 77254.3 | — | — | — | 20.8 | L | 4 |
| LNU838 | 77616.3 | 262.1 | 0.13 | 5 | — | — | — |
| LNU811 | 78180.3 | 266.8 | 0.26 | 7 | — | — | — |
| LNU808 | 77678.3 | — | — | — | 20.9 | 0.03 | 4 |
| LNU803 | 77902.2 | — | — | — | 21.8 | 0.19 | 9 |
| LNU797 | 78025.2 | — | — | — | 21.4 | 0.28 | 7 |
| LNU797 | 78025.3 | 266.7 | 0.11 | 7 | — | — | — |
| LNU793 | 78169.2 | 262.4 | 0.19 | 5 | — | — | — |
| LNU775 | 77592.3 | — | — | — | 24.0 | 0.01 | 20 |
| LNU774 | 77246.3 | — | — | — | 21.0 | 0.01 | 5 |
| LNU774 | 77247.4 | 282.3 | 0.02 | 13 | — | — | — |
| CONT. | — | 249.0 | — | — | 20.0 | — | — |

Table 117:
"CONT."—Control;
"Ave." —Average;
"% Incr." = % increment;
"p-val."—p-value;
L means that p-value is less than 0.01, p < 0.1 was considered as significant. The transgenes were under the transcriptional regulation of the new At6669 promoter (SEQ ID NO: 4880).

TABLE 118

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LNU947 | 77446.1 | — | — | — | 17.1 | 0.23 | −4 | — | — | — |
| LNU947 | 77447.3 | — | — | — | 17.0 | 0.15 | −5 | — | — | — |
| LNU947 | 77448.3 | — | — | — | 17.0 | 0.15 | −5 | — | — | — |
| LNU947 | 77448.4 | 831.9 | 0.14 | 5 | 17.0 | 0.15 | −5 | — | — | — |
| LNU895 | 77935.4 | 893.8 | 0.19 | 13 | — | — | — | — | — | — |
| LNU878 | 77251.3 | 871.2 | 0.06 | 10 | 17.0 | 0.15 | −5 | — | — | — |
| LNU878 | 77252.1 | 859.4 | 0.03 | 9 | 17.0 | 0.15 | −5 | — | — | — |
| LNU878 | 77254.3 | 884.4 | L | 12 | — | — | — | — | — | — |
| LNU841 | 77148.4 | — | — | — | 17.1 | 0.23 | −4 | — | — | — |
| LNU820 | 77807.2 | 833.1 | 0.13 | 5 | — | — | — | — | — | — |
| LNU815 | 77492.2 | — | — | — | 17.0 | 0.15 | −5 | — | — | — |
| LNU808 | 77678.3 | 904.3 | 0.30 | 14 | — | — | — | — | — | — |
| LNU808 | 77679.3 | — | — | — | 17.0 | 0.15 | −5 | — | — | — |
| LNU803 | 77902.2 | 879.9 | 0.11 | 11 | — | — | — | — | — | — |
| LNU803 | 77904.4 | — | — | — | 17.0 | 0.15 | −5 | — | — | — |
| LNU784 | 77612.3 | 970.6 | 0.21 | 23 | — | — | — | — | — | — |
| LNU779 | 77889.3 | 836.2 | 0.12 | 6 | — | — | — | — | — | — |
| LNU777 | 77573.3 | 893.1 | L | 13 | 17.0 | 0.15 | −5 | — | — | — |
| LNU777 | 77574.4 | — | — | — | 17.1 | 0.23 | −4 | — | — | — |
| LNU774 | 77246.3 | — | — | — | 17.0 | 0.15 | −5 | — | — | — |
| LNU774 | 77248.2 | — | — | — | 17.0 | 0.15 | −5 | — | — | — |
| LNU756 | 77581.3 | — | — | — | 17.0 | 0.15 | −5 | — | — | — |
| LNU756 | 77584.2 | 835.7 | 0.11 | 6 | — | — | — | — | — | — |
| LNU756 | 77584.6 | 887.9 | L | 12 | — | — | — | — | — | — |
| LNU754 | 77801.2 | — | — | — | 17.0 | 0.15 | −5 | — | — | — |
| CONT. | — | 791.6 | — | — | 17.9 | — | — | — | — | — |
| LNU895 | 77934.4 | 1115.6 | 0.09 | 15 | — | — | — | — | — | — |
| LNU890 | 78202.1 | 1017.5 | 0.19 | 5 | — | — | — | — | — | — |
| LNU878 | 77251.3 | 1237.0 | 0.01 | 28 | 22.8 | L | −6 | 18.1 | L | −5 |
| LNU878 | 77252.1 | — | — | — | 23.2 | 0.21 | −5 | 17.7 | 0.08 | −7 |
| LNU878 | 77254.2 | 1026.6 | 0.24 | 6 | 23.7 | 0.03 | −3 | 18.6 | 0.28 | −2 |
| LNU878 | 77254.3 | 1068.1 | 0.02 | 10 | — | — | — | — | — | — |
| LNU841 | 77148.1 | — | — | — | — | — | — | 18.5 | 0.29 | −2 |
| LNU838 | 77616.2 | — | — | — | — | — | — | 18.7 | 0.10 | −2 |
| LNU838 | 77617.5 | — | — | — | 23.5 | L | −4 | — | — | — |
| LNU811 | 78179.1 | — | — | — | 23.6 | 0.18 | −3 | 17.9 | 0.25 | −6 |
| LNU808 | 77678.3 | — | — | — | 22.9 | L | −6 | 17.2 | 0.25 | −9 |
| LNU808 | 77679.3 | — | — | — | 23.7 | 0.02 | −3 | 18.2 | 0.07 | −4 |
| LNU803 | 77902.2 | 1035.0 | 0.07 | 7 | — | — | — | 18.2 | 0.07 | −4 |
| LNU803 | 77904.4 | — | — | — | 23.7 | 0.03 | −3 | — | — | — |
| LNU797 | 78025.2 | 1087.7 | L | 12 | — | — | — | — | — | — |
| LNU793 | 78168.1 | 1024.6 | 0.24 | 6 | — | — | — | — | — | — |
| LNU793 | 78169.2 | — | — | — | 22.1 | 0.05 | −9 | 17.3 | 0.06 | −9 |
| LNU784 | 77615.12 | — | — | — | 23.6 | 0.02 | −3 | 17.9 | 0.25 | −6 |
| LNU784 | 77615.9 | — | — | — | — | — | — | 18.2 | 0.07 | −4 |
| LNU775 | 77592.3 | 1193.1 | L | 23 | 22.7 | L | −7 | 16.6 | L | −13 |
| LNU775 | 77593.3 | — | — | — | 23.2 | 0.06 | −5 | 18.7 | 0.10 | −2 |
| LNU774 | 77246.3 | 1090.6 | L | 13 | 22.0 | L | −10 | 16.5 | L | −13 |
| LNU774 | 77247.2 | — | — | — | — | — | — | 18.8 | 0.27 | −1 |
| LNU774 | 77247.4 | — | — | — | 23.2 | 0.06 | −5 | — | — | — |
| LNU761 | 78159.1 | 1029.3 | 0.09 | 6 | — | — | — | — | — | — |
| LNU761 | 78160.7 | 1050.0 | 0.23 | 9 | — | — | — | — | — | — |
| LNU754 | 77801.2 | — | — | — | 23.1 | 0.30 | −5 | — | — | — |
| CONT. | — | 967.7 | — | — | 24.4 | — | — | 19.0 | — | — |

"CONT."—Control;
"Ave."—Average;
"% Incr." = % increment;
"p-val."—p-value;
L means that p-value is less than 0.01, p < 0.1 was considered as significant.
The transgenes were under the transcriptional regulation of the new At6669 promoter (SEQ ID NO: 4880).
It should be noted that a negative increment (in percentages) when found in flowering or inflorescence emergence indicates drought avoidance of the plant.

TABLE 119

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LNU947 | 77448.4 | — | — | — | — | — | — | 107.3 | 0.29 | 13 |
| LNU940 | 77812.1 | — | — | — | 11.6 | 0.19 | 5 | — | — | — |
| LNU895 | 77935.4 | 1.76 | 0.16 | 7 | 11.7 | 0.11 | 6 | 106.3 | 0.07 | 11 |
| LNU878 | 77251.3 | 1.95 | 0.27 | 19 | 11.8 | 0.05 | 6 | — | — | — |
| LNU878 | 77252.1 | 2.01 | 0.18 | 22 | — | — | — | 117.3 | 0.10 | 23 |
| LNU841 | 77146.2 | — | — | — | 11.9 | 0.13 | 8 | — | — | — |
| LNU820 | 77807.2 | — | — | — | 11.7 | 0.07 | 6 | — | — | — |
| LNU808 | 77677.5 | — | — | — | 12.1 | 0.20 | 9 | — | — | — |
| LNU803 | 77901.2 | 1.75 | 0.23 | 7 | — | — | — | — | — | — |
| LNU803 | 77902.2 | — | — | — | 11.9 | 0.02 | 8 | — | — | — |
| LNU803 | 77904.4 | — | — | — | 12.1 | 0.20 | 9 | — | — | — |
| LNU777 | 77573.3 | 1.85 | 0.19 | 12 | 11.6 | 0.11 | 5 | 108.5 | 0.26 | 14 |
| LNU777 | 77574.4 | — | — | — | 11.8 | 0.29 | 7 | — | — | — |
| LNU775 | 77593.3 | — | — | — | 11.6 | 0.19 | 5 | — | — | — |
| LNU774 | 77247.2 | — | — | — | 11.6 | 0.19 | 5 | — | — | — |
| LNU770 | 77922.1 | — | — | — | 11.4 | 0.30 | 3 | — | — | — |
| LNU770 | 77925.3 | — | — | — | 11.4 | 0.30 | 3 | — | — | — |
| LNU756 | 77585.3 | — | — | — | 12.1 | 0.05 | 10 | — | — | — |
| LNU754 | 77801.2 | — | — | — | — | — | — | 102.1 | 0.21 | 7 |
| LNU754 | 77802.2 | — | — | — | — | — | — | 105.1 | 0.25 | 10 |
| CONT. | — | 1.64 | — | — | 11.1 | — | — | 95.3 | — | — |
| LNU878 | 77251.3 | 1.86 | 0.03 | 21 | 11.8 | 0.10 | 8 | 115.4 | 0.03 | 23 |
| LNU878 | 77252.1 | 1.74 | 0.13 | 13 | — | — | — | 108.2 | 0.13 | 15 |
| LNU838 | 77616.3 | — | — | — | 11.2 | 0.17 | 3 | — | — | — |
| LNU838 | 77620.3 | — | — | — | 11.4 | 0.07 | 4 | — | — | — |
| LNU808 | 77679.3 | — | — | — | 11.5 | 0.05 | 5 | — | — | — |
| LNU803 | 77902.3 | — | — | — | 11.3 | 0.24 | 4 | — | — | — |
| LNU784 | 77615.1 | — | — | — | 12.0 | 0.15 | 10 | — | — | — |
| LNU775 | 77592.3 | 1.94 | 0.20 | 26 | — | — | — | 115.8 | 0.11 | 23 |
| LNU774 | 77246.3 | 2.07 | 0.02 | 34 | 12.1 | L | 11 | 132.2 | 0.09 | 41 |
| LNU774 | 77247.4 | — | — | — | 11.2 | 0.23 | 3 | — | — | — |
| CONT. | — | 1.54 | — | — | 10.9 | — | — | 94.0 | — | — |

"CONT."—Control;
"Ave."—Average;
"% Incr." = % increment;
"p-val."—p-value;
L means that p-value is less than 0.01, p < 0.1 was considered as significant.
The transgenes were under the transcriptional regulation of the new At6669 promoter (SEQ ID NO: 4880).

TABLE 120

Genes showing improved plant performance at Normal growth conditions under regulation of At6669 promoter

| Gene Name | Event # | RGR Of Leaf Number | | | RGR Of Plot Coverage [cm²/day] | | | RGR Of Rosette Diameter [cm/day] | | |
|---|---|---|---|---|---|---|---|---|---|---|
| | | Ave. | P-Val. | % Incr. | Ave. | P-Val. | % Incr. | Ave. | P-Val. | % Incr. |
| LNU947 | 77446.1 | 0.846 | 0.15 | 20 | — | — | — | — | — | — |
| LNU947 | 77448.4 | 0.879 | 0.09 | 25 | — | — | — | — | — | — |
| LNU940 | 77811.2 | 0.810 | 0.28 | 15 | — | — | — | — | — | — |
| LNU878 | 77251.1 | 0.813 | 0.28 | 16 | — | — | — | — | — | — |
| LNU878 | 77251.3 | — | — | — | 15.5 | 0.11 | 25 | — | — | — |
| LNU878 | 77252.1 | — | — | — | 15.2 | 0.12 | 23 | — | — | — |
| LNU841 | 77146.2 | 0.845 | 0.16 | 20 | — | — | — | — | — | — |
| LNU838 | 77620.3 | 0.818 | 0.24 | 16 | — | — | — | — | — | — |
| LNU820 | 77807.2 | 0.889 | 0.06 | 27 | — | — | — | — | — | — |
| LNU808 | 77677.5 | 0.854 | 0.13 | 22 | — | — | — | — | — | — |
| LNU803 | 77902.2 | 0.913 | 0.03 | 30 | — | — | — | — | — | — |
| LNU803 | 77903.1 | 0.827 | 0.21 | 18 | — | — | — | — | — | — |
| LNU779 | 77887.3 | 0.817 | 0.25 | 16 | — | — | — | — | — | — |
| LNU777 | 77574.4 | 0.843 | 0.15 | 20 | — | — | — | — | — | — |
| LNU775 | 77591.2 | 0.818 | 0.26 | 17 | — | — | — | — | — | — |
| LNU774 | 77247.2 | — | — | — | 15.9 | 0.09 | 28 | 0.632 | 0.21 | 13 |

TABLE 120-continued

Genes showing improved plant performance at Normal growth conditions under regulation of At6669 promoter

| Gene Name | Event # | RGR Of Leaf Number | | | RGR Of Plot Coverage [cm²/day] | | | RGR Of Rosette Diameter [cm/day] | | |
|---|---|---|---|---|---|---|---|---|---|---|
| | | Ave. | P-Val. | % Incr. | Ave. | P-Val. | % Incr. | Ave. | P-Val. | % Incr. |
| LNU770 | 77925.3 | 0.811 | 0.26 | 16 | — | — | — | — | — | — |
| LNU756 | 77585.3 | 0.859 | 0.12 | 22 | — | — | — | — | — | — |
| CONT. | — | 0.702 | — | — | 12.4 | — | — | 0.558 | — | — |
| LNU959 | 78222.8 | 0.790 | 0.23 | 17 | — | — | — | — | — | — |
| LNU878 | 77251.3 | — | — | — | 14.2 | 0.22 | 21 | — | — | — |
| LNU878 | 77254.2 | 0.803 | 0.16 | 19 | — | — | — | — | — | — |
| LNU811 | 78179.1 | 0.782 | 0.26 | 16 | — | — | — | — | — | — |
| LNU803 | 77901.2 | 0.820 | 0.12 | 21 | — | — | — | — | — | — |
| LNU797 | 78022.1 | 0.811 | 0.12 | 20 | — | — | — | — | — | — |
| LNU797 | 78025.3 | 0.822 | 0.13 | 22 | — | — | — | — | — | — |
| LNU793 | 78168.1 | 0.790 | 0.23 | 17 | — | — | — | — | — | — |
| LNU793 | 78169.2 | — | — | — | 14.3 | 0.28 | 22 | — | — | — |
| LNU784 | 77612.3 | 0.781 | 0.22 | 16 | — | — | — | — | — | — |
| LNU784 | 77615.1 | 0.784 | 0.25 | 16 | — | — | — | — | — | — |
| LNU775 | 77592.3 | — | — | — | 14.3 | 0.21 | 22 | — | — | — |
| LNU774 | 77246.3 | — | — | — | 16.5 | 0.03 | 40 | 0.588 | 0.20 | 16 |
| LNU774 | 77247.2 | 0.812 | 0.13 | 20 | — | — | — | — | — | — |
| LNU761 | 78159.1 | 0.775 | 0.27 | 15 | — | — | — | — | — | — |
| LNU754 | 77801.2 | 0.799 | 0.19 | 18 | — | — | — | — | — | — |
| CONT. | — | 0.675 | — | — | 11.7 | — | — | 0.508 | — | — |

"CONT."—Control;
"Ave."—Average;
"% Incr." = % increment;
"p-val."—p-value;
L means that p-value is less than 0.01, $p < 0.1$ was considered as significant.
The transgenes were under the transcriptional regulation of the new At6669 promoter (SEQ ID NO: 4880).

TABLE 121

Genes showing improved plant performance at Normal growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU947 | 77448.4 | — | — | — | 13.4 | 0.29 | 13 | — | — | — |
| LNU940 | 77812.4 | 0.500 | 0.05 | 7 | — | — | — | — | — | — |
| LNU895 | 77935.4 | — | — | — | 13.3 | 0.07 | 11 | 6.22 | 0.09 | 5 |
| LNU878 | 77252.1 | — | — | — | 14.7 | 0.10 | 23 | 6.58 | 0.21 | 12 |
| LNU838 | 77616.2 | 0.504 | 0.02 | 8 | — | — | — | — | — | — |
| LNU815 | 77492.2 | 0.482 | 0.28 | 3 | — | — | — | — | — | — |
| LNU808 | 77677.3 | 0.488 | 0.30 | 5 | — | — | — | — | — | — |
| LNU808 | 77678.1 | 0.497 | 0.05 | 6 | — | — | — | — | — | — |
| LNU803 | 77904.4 | 0.489 | 0.29 | 5 | — | — | — | — | — | — |
| LNU784 | 77615.12 | 0.505 | 0.02 | 8 | — | — | — | — | — | — |
| LNU779 | 77887.1 | 0.512 | 0.08 | 10 | — | — | — | — | — | — |
| LNU777 | 77573.3 | — | — | — | 13.6 | 0.26 | 14 | 6.41 | 0.19 | 9 |
| LNU775 | 77591.2 | 0.503 | 0.28 | 8 | — | — | — | — | — | — |
| LNU775 | 77593.3 | 0.503 | 0.03 | 8 | — | — | — | — | — | — |
| LNU775 | 77595.1 | 0.509 | 0.01 | 9 | — | — | — | — | — | — |
| LNU770 | 77922.4 | 0.499 | 0.08 | 7 | — | — | — | — | — | — |
| LNU756 | 77585.4 | 0.491 | 0.19 | 5 | — | — | — | — | — | — |
| LNU754 | 77801.2 | 0.506 | 0.26 | 8 | 12.8 | 0.21 | 7 | 6.26 | 0.07 | 6 |
| LNU754 | 77802.2 | — | — | — | 13.1 | 0.25 | 10 | — | — | — |
| CONT. | — | 0.467 | — | — | 11.9 | — | — | 5.90 | — | — |
| LNU959 | 78224.4 | 0.527 | 0.08 | 22 | — | — | — | — | — | — |
| LNU895 | 77933.2 | 0.483 | 0.07 | 12 | — | — | — | — | — | — |
| LNU890 | 78204.4 | 0.508 | 0.07 | 18 | — | — | — | — | — | — |
| LNU890 | 78204.8 | 0.519 | 0.12 | 20 | — | — | — | — | — | — |
| LNU878 | 77251.3 | — | — | — | 14.4 | 0.03 | 23 | 6.46 | 0.03 | 12 |
| LNU878 | 77252.1 | — | — | — | 13.5 | 0.13 | 15 | 6.18 | 0.08 | 7 |
| LNU878 | 77254.2 | 0.480 | 0.14 | 11 | — | — | — | — | — | — |
| LNU811 | 78176.8 | 0.481 | 0.04 | 11 | — | — | — | — | — | — |
| LNU808 | 77677.5 | 0.498 | 0.07 | 15 | — | — | — | — | — | — |

TABLE 121-continued

Genes showing improved plant performance at Normal growth conditions under regulation of At6669 promoter

| Gene Name | Event # | Harvest Index Ave. | Harvest Index P-Val. | Harvest Index % Incr. | Rosette Area [cm²] Ave. | Rosette Area [cm²] P-Val. | Rosette Area [cm²] % Incr. | Rosette Diameter [cm] Ave. | Rosette Diameter [cm] P-Val. | Rosette Diameter [cm] % Incr. |
|---|---|---|---|---|---|---|---|---|---|---|
| LNU803 | 77902.3 | 0.471 | 0.08 | 9 | — | — | — | — | — | — |
| LNU803 | 77903.1 | 0.464 | 0.21 | 7 | — | — | — | — | — | — |
| LNU793 | 78166.4 | 0.483 | 0.03 | 12 | — | — | — | — | — | — |
| LNU775 | 77592.3 | — | — | — | 14.5 | 0.11 | 23 | 6.46 | 0.27 | 12 |
| LNU775 | 77593.1 | 0.500 | 0.19 | 16 | — | — | — | — | — | — |
| LNU774 | 77246.3 | — | — | — | 16.5 | 0.09 | 41 | 6.75 | 0.03 | 17 |
| LNU769 | 78163.4 | 0.467 | 0.19 | 8 | — | — | — | — | — | — |
| LNU769 | 78165.1 | 0.481 | 0.04 | 11 | — | — | — | — | — | — |
| LNU761 | 78157.1 | 0.533 | L | 23 | — | — | — | — | — | — |
| LNU761 | 78157.6 | 0.515 | L | 19 | — | — | — | — | — | — |
| LNU761 | 78160.7 | 0.471 | 0.09 | 9 | — | — | — | — | — | — |
| LNU754 | 77801.1 | 0.490 | 0.08 | 13 | — | — | — | — | — | — |
| LNU754 | 77802.2 | 0.492 | 0.02 | 14 | — | — | — | — | — | — |
| LNU754 | 77804.1 | 0.491 | 0.20 | 14 | — | — | — | — | — | — |
| CONT. | — | 0.432 | — | — | 11.7 | — | — | 5.75 | — | — |

"CONT."—Control;
"Ave."—Average;
"% Incr." = % increment;
"p-val."—p-value;
L means that p-value is less than 0.01, p < 0.1 was considered as significant.
The transgenes were under the transcriptional regulation of the new At6669 promoter (SEQ ID NO: 4880).

TABLE 122

Genes showing improved plant performance at Normal growth conditions under regulation of At6669 promoter

| Gene Name | Event # | Seed Yield [mg] Ave. | Seed Yield [mg] P-Val. | Seed Yield [mg] % Incr. | 1000 Seed Weight [mg] Ave. | 1000 Seed Weight [mg] P-Val. | 1000 Seed Weight [mg] % Incr. |
|---|---|---|---|---|---|---|---|
| LNU947 | 77447.3 | 409.8 | 0.09 | 11 | — | — | — |
| LNU947 | 77448.4 | — | — | — | 25.7 | 0.10 | 16 |
| LNU895 | 77933.2 | — | — | — | 23.5 | 0.06 | 6 |
| LNU895 | 77935.3 | — | — | — | 23.6 | 0.27 | 6 |
| LNU878 | 77251.3 | — | — | — | 25.2 | 0.24 | 13 |
| LNU878 | 77254.3 | 414.6 | 0.21 | 12 | 25.0 | L | 12 |
| LNU820 | 77807.2 | — | — | — | 25.2 | L | 13 |
| LNU820 | 77809.1 | — | — | — | 25.3 | 0.12 | 13 |
| LNU815 | 77494.1 | — | — | — | 24.7 | 0.03 | 11 |
| LNU815 | 77495.3 | 406.0 | 0.14 | 10 | — | — | — |
| LNU808 | 77678.3 | — | — | — | 24.5 | 0.22 | 10 |
| LNU803 | 77901.2 | 395.8 | 0.20 | 7 | — | — | — |
| LNU803 | 77902.2 | — | — | — | 24.9 | L | 12 |
| LNU784 | 77612.3 | — | — | — | 23.4 | 0.04 | 5 |
| LNU784 | 77615.1 | — | — | — | 25.2 | L | 13 |
| LNU784 | 77615.9 | — | — | — | 23.1 | 0.10 | 4 |
| LNU779 | 77887.1 | 407.7 | 0.07 | 10 | 22.8 | 0.25 | 2 |
| LNU777 | 77573.3 | — | — | — | 27.4 | L | 23 |
| LNU775 | 77595.1 | 413.4 | 0.10 | 12 | — | — | — |
| LNU774 | 77246.3 | — | — | — | 24.0 | 0.02 | 8 |
| LNU774 | 77247.2 | 406.2 | 0.08 | 10 | — | — | — |
| LNU756 | 77584.6 | — | — | — | 24.5 | 0.01 | 10 |
| CONT. | — | 370.6 | — | — | 22.3 | — | — |
| LNU959 | 78224.4 | 471.4 | 0.22 | 13 | — | — | — |
| LNU895 | 77934.4 | — | — | — | 24.3 | 0.03 | 16 |
| LNU895 | 77935.3 | — | — | — | 22.6 | 0.03 | 7 |
| LNU890 | 78202.1 | — | — | — | 22.2 | 0.04 | 5 |
| LNU890 | 78204.4 | 488.9 | 0.07 | 17 | — | — | — |
| LNU890 | 78204.8 | 560.4 | 0.05 | 34 | — | — | — |
| LNU878 | 77251.3 | — | — | — | 24.3 | 0.18 | 15 |
| LNU878 | 77252.1 | — | — | — | 25.4 | 0.08 | 21 |
| LNU878 | 77254.2 | 493.1 | 0.20 | 18 | — | — | — |
| LNU878 | 77254.3 | — | — | — | 23.1 | 0.27 | 10 |
| LNU811 | 78176.8 | 478.0 | 0.29 | 14 | — | — | — |
| LNU797 | 78021.4 | 445.1 | 0.25 | 7 | — | — | — |
| LNU797 | 78025.2 | — | — | — | 25.2 | 0.06 | 20 |
| LNU797 | 78025.3 | — | — | — | 21.6 | 0.23 | 3 |
| LNU793 | 78168.1 | — | — | — | 23.3 | L | 11 |
| LNU784 | 77615.1 | — | — | — | 22.5 | 0.01 | 7 |
| LNU775 | 77592.3 | — | — | — | 26.2 | L | 25 |
| LNU774 | 77246.3 | — | — | — | 22.4 | 0.22 | 6 |
| LNU774 | 77249.1 | — | — | — | 23.1 | L | 10 |
| LNU761 | 78157.1 | 495.8 | 0.12 | 19 | — | — | — |
| LNU761 | 78157.6 | 475.0 | 0.08 | 14 | — | — | — |
| LNU761 | 78159.1 | 466.0 | 0.26 | 12 | — | — | — |
| LNU761 | 78160.7 | 493.9 | 0.01 | 18 | — | — | — |
| CONT. | — | 417.6 | — | — | 21.0 | — | — |

"CONT."—Control;
"Ave."—Average;
"% Incr." = % increment;
"p-val."—p-value;
L means that p-value is less than 0.01, p < 0.1 was considered as significant.
The transgenes were under the transcriptional regulation of the new At6669 promoter (SEQ ID NO: 4880).

Example 18

Evaluation of Transgenic *Arabidopsis* NUE, Yield and Plant Growth Rate Under Low or Normal Nitrogen Fertilization in Greenhouse Assay Assay 2: Nitrogen Use Efficiency Measured Until Bolting Stage: plant biomass and plant growth rate at limited and optimal nitrogen concentration under greenhouse conditions—This assay follows the plant biomass formation and the rosette area growth of plants grown in the greenhouse at limiting and non-limiting nitrogen growth conditions. Transgenic *Arabidopsis* seeds were sown in agar media supplemented with ½ MS medium and a selection agent (Kanamycin). The T₂ transgenic seedlings were then transplanted to 1.7 trays filled with peat and perlite in a 1:1 ratio. The trays were irrigated with a solution containing nitrogen limiting conditions, which were achieved by irrigating the plants with a solution containing 1.5 mM inorganic nitrogen in the form of $KNO_3$, supplemented with 1 mM $KH_2PO_4$, 1 mM $MgSO_4$, 3.6 mM KCl, 2 mM $CaCl_2$ and microelements, while normal nitrogen levels were achieved by applying a solution of 6 mM inorganic nitrogen also in the form of $KNO_3$ with 1 mM $KH_2PO_4$, 1 mM $MgSO_4$, 2 mM $CaCl_2$ and microelements. All plants were grown in the greenhouse until bolting stage. Plant biomass (the above ground tissue) was weight in directly after harvesting the rosette (plant fresh weight [FW]). Following plants were dried in an oven at 50° C. for 48 hours and weighted (plant dry weight [DW]).

Each construct is validated at its $T_2$ generation. Transgenic plants transformed with a construct conformed by an empty vector carrying the 35S promoter and the selectable marker was used as control.

The plants were analyzed for their overall size, growth rate, fresh weight and dry matter. Transgenic plants performance was compared to control plants grown in parallel under the same conditions. Mock—transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples. The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubes were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, leaf blade area.

Vegetative growth rate: the relative growth rate (RGR) of leaf number (Formula VIII described above), rosette area (Formula IX described above) and plot coverage (Formula XI, described above) are calculated using the indicated formulas.

Plant Fresh and Dry weight—On about day 80 from sowing, the plants were harvested and directly weight for the determination of the plant fresh weight (FW) and left to dry at 50° C. in a drying chamber for about 48 hours before weighting to determine plant dry weight (DW).

Statistical analyses—To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

The genes listed in Tables 123-124 improved plant NUE when grown at limiting nitrogen concentration levels. These genes produced larger plants with a larger photosynthetic area, biomass (fresh weight, dry weight, leaf number, rosette diameter, rosette area and plot coverage) when grown under limiting nitrogen conditions (nutrient deficiency stress) as compared to control plants grown under identical growth conditions.

TABLE 123

Genes showing improved plant biomass production at limiting nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU952 | 78218.1 | — | — | — | 112.3 | 0.05 | 26 | — | — | — |
| LNU952 | 78218.3 | — | — | — | 106.2 | 0.18 | 19 | — | — | — |
| LNU952 | 78218.6 | — | — | — | 100.0 | 0.29 | 12 | — | — | — |
| LNU952 | 78219.3 | — | — | — | 118.8 | 0.04 | 33 | — | — | — |
| LNU945 | 78998.2 | — | — | — | — | — | — | 10.9 | 0.13 | 6 |
| LNU945 | 78999.1 | — | — | — | 100.0 | 0.29 | 12 | — | — | — |
| LNU920 | 78507.1 | — | — | — | 106.2 | 0.18 | 19 | — | — | — |
| LNU920 | 78508.1 | — | — | — | 112.5 | 0.27 | 26 | — | — | — |
| LNU920 | 78508.2 | — | — | — | 112.5 | 0.05 | 26 | — | — | — |
| LNU916 | 78208.3 | — | — | — | 106.2 | 0.18 | 19 | — | — | — |
| LNU914 | 80516.2 | — | — | — | 127.7 | 0.18 | 43 | — | — | — |
| LNU911 | 80420.3 | — | — | — | 106.2 | 0.18 | 19 | — | — | — |
| LNU911 | 80420.5 | — | — | — | — | — | — | 10.4 | 0.22 | 1 |
| LNU905 | 79674.3 | — | — | — | 112.5 | 0.05 | 26 | — | — | — |
| LNU905 | 79674.4 | — | — | — | 106.2 | 0.18 | 19 | — | — | — |
| LNU905 | 79675.3 | — | — | — | 118.8 | 0.04 | 33 | — | — | — |
| LNU844 | 80342.4 | — | — | — | 106.2 | 0.18 | 19 | — | — | — |
| LNU840 | 78676.1 | — | — | — | 106.2 | 0.18 | 19 | — | — | — |

TABLE 123-continued

Genes showing improved plant biomass production at limiting nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU840 | 78676.4 | 11.2 | L | 54 | 131.2 | 0.23 | 47 | — | — | — |
| LNU840 | 78763.6 | 9.38 | 0.09 | 29 | 106.2 | 0.18 | 19 | — | — | — |
| LNU832_H2 | 80602.1 | — | — | — | 106.2 | 0.18 | 19 | — | — | — |
| LNU832_H2 | 80604.2 | — | — | — | 106.2 | 0.18 | 19 | — | — | — |
| LNU832_H2 | 80605.1 | — | — | — | 107.1 | 0.19 | 20 | 10.6 | 0.05 | 3 |
| LNU819 | 78133.3 | 8.75 | 0.06 | 20 | — | — | — | — | — | — |
| LNU801 | 78585.2 | — | — | — | 100.0 | 0.29 | 12 | — | — | — |
| LNU791 | 77893.2 | — | — | — | 106.2 | 0.18 | 19 | — | — | — |
| LNU791 | 77895.2 | — | — | — | 100.0 | 0.29 | 12 | — | — | — |
| LNU760_H1 | 80127.2 | — | — | — | 131.2 | 0.23 | 47 | — | — | — |
| CONT. | — | 7.29 | — | — | 89.6 | — | — | 10.3 | — | — |
| LNU966 | 78605.5 | 102.5 | 0.01 | 20 | 968.8 | 0.11 | 16 | 12.6 | L | 13 |
| LNU966 | 78605.7 | 94.4 | 0.14 | 10 | — | — | — | 11.5 | 0.14 | 3 |
| LNU941 | 78611.1 | — | — | — | — | — | — | 11.7 | 0.02 | 5 |
| LNU941 | 78613.1 | 105.0 | L | 23 | 1050.0 | L | 26 | — | — | — |
| LNU941 | 78613.5 | 92.5 | 0.13 | 8 | 937.5 | 0.05 | 12 | — | — | — |
| LNU941 | 78615.3 | 91.2 | 0.20 | 7 | — | — | — | 12.2 | 0.29 | 10 |
| LNU925 | 78991.5 | — | — | — | — | — | — | 12.1 | 0.24 | 8 |
| LNU925 | 78992.1 | — | — | — | — | — | — | 11.8 | 0.17 | 6 |
| LNU925 | 78992.6 | — | — | — | 951.8 | 0.04 | 14 | — | — | — |
| LNU922 | 78290.1 | — | — | — | 956.2 | 0.29 | 14 | — | — | — |
| LNM918 | 78433.1 | — | — | — | — | — | — | 11.6 | 0.06 | 4 |
| LNU918 | 78433.2 | 99.4 | 0.02 | 16 | 906.2 | 0.22 | 8 | 11.8 | 0.17 | 6 |
| LNU918 | 78433.3 | 98.1 | 0.02 | 15 | — | — | — | — | — | — |
| LNU918 | 78433.8 | — | — | — | 975.0 | 0.01 | 17 | 12.1 | L | 8 |
| LNU918 | 78434.2 | 93.1 | 0.19 | 9 | 925.0 | 0.07 | 11 | — | — | — |
| LNU915 | 78426.1 | 107.5 | 0.20 | 26 | 1025.0 | 0.03 | 23 | — | — | — |
| LNU915 | 78427.1 | 101.4 | 0.28 | 19 | 964.3 | 0.07 | 15 | — | — | — |
| LNU915 | 78428.1 | 108.1 | 0.03 | 26 | 1056.2 | L | 26 | 12.6 | L | 13 |
| LNU915 | 78428.2 | — | — | — | 931.2 | 0.29 | 11 | 11.6 | 0.07 | 4 |
| LNU909 | 78424.3 | 91.2 | 0.20 | 7 | — | — | — | 11.8 | 0.03 | 6 |
| LNU909 | 78425.4 | — | — | — | 943.8 | 0.04 | 13 | — | — | — |
| LNU909 | 78425.5 | 118.1 | 0.07 | 38 | 1062.5 | L | 27 | 12.7 | L | 14 |
| LNU909 | 78425.7 | 90.6 | 0.24 | 6 | — | — | — | — | — | — |
| LNU890 | 78202.1 | — | — | — | — | — | — | 12.4 | L | 12 |
| LNU854 | 78236.1 | 93.1 | 0.19 | 9 | — | — | — | — | — | — |
| LNU854 | 78236.3 | — | — | — | 885.7 | 0.28 | 6 | — | — | — |
| LNU854 | 78238.1 | 91.9 | 0.16 | 7 | — | — | — | 11.8 | 0.22 | 6 |
| LNU854 | 78240.1 | — | — | — | — | — | — | 11.6 | 0.23 | 4 |
| LNU849 | 78498.3 | — | — | — | 968.8 | 0.02 | 16 | — | — | — |
| LNU849 | 78498.4 | — | — | — | 1018.8 | 0.02 | 22 | — | — | — |
| LNU849 | 78499.1 | 93.8 | 0.08 | 10 | — | — | — | — | — | — |
| LNU849 | 78500.1 | — | — | — | 893.8 | 0.23 | 7 | — | — | — |
| LNU849 | 78500.3 | — | — | — | — | — | — | 12.2 | 0.29 | 10 |
| LNU830 | 78741.1 | — | — | — | 918.8 | 0.16 | 10 | — | — | — |
| LNU830 | 78741.3 | — | — | — | 925.0 | 0.18 | 11 | 11.4 | 0.15 | 3 |
| LNU830 | 78741.5 | — | — | — | — | — | — | 13.2 | 0.27 | 19 |
| LNU824 | 77826.1 | 100.0 | 0.02 | 17 | 956.2 | 0.02 | 14 | 12.6 | 0.28 | 13 |
| LNU824 | 77827.2 | 110.2 | 0.12 | 29 | 974.1 | 0.01 | 17 | 11.6 | 0.07 | 4 |
| LNU824 | 7782S.4 | — | — | — | 925.0 | 0.07 | 11 | 11.8 | 0.22 | 6 |
| LNU824 | 77829.3 | 103.1 | 0.28 | 21 | 950.0 | 0.11 | 14 | 11.5 | 0.08 | 3 |
| LNU822 | 78623.2 | 108.8 | 0.14 | 27 | 1062.5 | 0.14 | 27 | 11.9 | L | 7 |
| LNU822 | 78623.6 | 115.6 | L | 35 | 1056.2 | 0.03 | 26 | 12.1 | L | 8 |
| LNU822 | 78623.7 | — | — | — | — | — | — | 12.2 | 0.06 | 10 |
| LNU822 | 78625.7 | 91.2 | 0.19 | 7 | — | — | — | — | — | — |
| LNU813 | 77681.3 | 94.4 | 0.14 | 10 | 918.8 | 0.10 | 10 | — | — | — |
| LNU813 | 77682.3 | 97.5 | 0.02 | 14 | 881.2 | 0.30 | 5 | — | — | — |
| LNU813 | 77685.1 | — | — | — | 918.8 | 0.08 | 10 | — | — | — |
| LNU813 | 77685.2 | 95.6 | 0.19 | 12 | — | — | — | — | — | — |
| LNU806 | 78512.7 | 98.1 | 0.20 | 15 | 918.8 | 0.10 | 10 | — | — | — |
| LNU806 | 78514.2 | — | — | — | 987.5 | 0.30 | 18 | 12.8 | 0.16 | 15 |
| LNU806 | 78515.3 | 98.8 | 0.15 | 15 | — | — | — | 12.5 | 0.19 | 12 |
| LNU806 | 78515.4 | — | — | — | 950.0 | 0.05 | 14 | 12.5 | 0.19 | 12 |
| LNU806 | 78515.5 | 95.6 | 0.27 | 12 | 1037.5 | 0.12 | 24 | 12.5 | 0.25 | 12 |
| LNU802 | 80307.3 | 94.4 | 0.08 | 10 | — | — | — | — | — | — |
| LNU802 | 80309.2 | — | — | — | — | — | — | 11.5 | 0.14 | 3 |
| LNU802 | 80309.3 | 101.9 | 0.25 | 19 | 943.8 | 0.04 | 13 | 11.6 | 0.06 | 4 |
| LNU802 | 80310.1 | 93.1 | 0.12 | 9 | 975.0 | 0.01 | 17 | — | — | — |
| LNU779 | 77887.2 | 111.2 | 0.30 | 30 | 975.0 | 0.01 | 17 | 12.2 | L | 10 |
| LNU779 | 77889.3 | 90.0 | 0.29 | 5 | — | — | — | — | — | — |
| LNU761 | 78157.1 | 99.1 | 0.23 | 16 | 983.0 | 0.10 | 18 | — | — | — |
| LNU761 | 78157.6 | 96.2 | 0.06 | 13 | 925.0 | 0.07 | 11 | — | — | — |

TABLE 123-continued

Genes showing improved plant biomass production at limiting nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU761 | 78160.3 | 104.4 | 0.21 | 22 | — | — | — | 12.6 | 0.07 | 13 |
| CONT. | — | 85.5 | — | — | 835.7 | — | — | 11.1 | — | — |
| LNU970 | 78389.7 | — | — | — | — | — | — | 9.88 | 0.02 | 6 |
| LNU970 | 78389.8 | — | — | — | — | — | — | 10.2 | 0.04 | 9 |
| LNU968 | 77919.4 | — | — | — | — | — | — | 9.62 | 0.21 | 3 |
| LNU950 | 78913.4 | — | — | — | — | — | — | 9.56 | 0.22 | 3 |
| LNU934 | 79007.5 | — | — | — | — | — | — | 9.69 | 0.08 | 4 |
| LNU934 | 79008.3 | — | — | — | — | — | — | 9.56 | 0.22 | 3 |
| LNU908 | 79736.2 | — | — | — | — | — | — | 9.56 | 0.22 | 3 |
| LNU908 | 79738.5 | — | — | — | — | — | — | 9.56 | 0.22 | 3 |
| LNU843 | 78962.4 | — | — | — | — | — | — | 9.81 | 0.15 | 5 |
| LNU843 | 78963.2 | — | — | — | — | — | — | 9.62 | 0.21 | 3 |
| LNU790 | 78886.2 | — | — | — | — | — | — | 10.8 | 0.30 | 15 |
| LNU790 | 78886.3 | — | — | — | — | — | — | 9.69 | 0.24 | 4 |
| LNU790 | 78890.3 | — | — | — | — | — | — | 9.62 | 0.21 | 3 |
| CONT. | — | — | — | — | — | — | — | 9.32 | — | — |
| LNU966 | 78604.1 | 275.0 | 0.06 | 8 | 3195.8 | 0.05 | 12 | — | — | — |
| LNU966 | 78605.5 | — | — | — | — | — | — | 11.8 | 0.26 | 8 |
| LNU942 | 77243.2 | — | — | — | — | — | — | 11.6 | L | 6 |
| LNU941 | 78611.1 | 272.1 | 0.14 | 7 | 3107.1 | 0.13 | 9 | — | — | — |
| LNU941 | 78614.2 | — | — | — | — | — | — | 11.3 | 0.09 | 4 |
| LNU941 | 78615.3 | 280.0 | 0.01 | 10 | 3150.0 | L | 11 | — | — | — |
| LNU922 | 78287.3 | 276.6 | 0.19 | 8 | 3225.9 | 0.06 | 13 | 11.8 | 0.10 | 8 |
| LNU922 | 78287.5 | 275.4 | 0.25 | 8 | — | — | — | — | — | — |
| LNU922 | 78290.1 | — | — | — | 3121.4 | L | 10 | — | — | — |
| LNU922 | 78290.7 | — | — | — | 3031.2 | 0.28 | 7 | — | — | — |
| LNU915 | 78426.1 | — | — | — | 2937.5 | 0.23 | 3 | — | — | — |
| LNU915 | 78427.1 | — | — | — | — | — | — | 11.8 | 0.10 | 8 |
| LNU915 | 78428.1 | — | — | — | 3191.1 | 0.25 | 12 | 11.6 | 0.14 | 6 |
| LNU915 | 78428.2 | — | — | — | — | — | — | 11.6 | 0.01 | 6 |
| LNU909 | 78424.3 | 267.1 | 0.23 | 5 | — | — | — | — | — | — |
| LNU909 | 78425.5 | 266.9 | 0.13 | 5 | 3088.4 | 0.01 | 9 | — | — | — |
| LNU909 | 78425.7 | 273.1 | 0.02 | 7 | 3031.2 | 0.09 | 7 | — | — | — |
| LNU868 | 77621.5 | — | — | — | — | — | — | 11.5 | 0.02 | 5 |
| LNU854 | 78237.2 | — | — | — | — | — | — | 11.8 | 0.26 | 8 |
| LNU854 | 78238.1 | — | — | — | 3093.8 | 0.11 | 9 | — | — | — |
| LNU830 | 78741.3 | — | — | — | — | — | — | 11.3 | 0.18 | 3 |
| LNU830 | 78741.5 | — | — | — | — | — | — | 11.2 | 0.23 | 2 |
| LNU824 | 77826.1 | 266.2 | 0.16 | 4 | — | — | — | — | — | — |
| LNU824 | 77827.3 | 266.2 | 0.11 | 4 | 3000.0 | 0.07 | 6 | — | — | — |
| LNU824 | 77829.3 | — | — | — | 2987.5 | 0.09 | 5 | 11.6 | 0.27 | 6 |
| LNU822 | 78623.7 | — | — | — | 3032.1 | 0.04 | 7 | — | — | — |
| LNU822 | 78625.2 | — | — | — | 3012.5 | 0.06 | 6 | — | — | — |
| LNU813 | 77681.3 | — | — | — | — | — | — | 11.6 | 0.02 | 6 |
| LNU813 | 77681.4 | — | — | — | — | — | — | 11.6 | 0.09 | 6 |
| LNU806 | 78514.2 | — | — | — | — | — | — | 12.1 | 0.10 | 10 |
| LNU806 | 78515.3 | — | — | — | 3031.2 | 0.04 | 7 | 11.6 | 0.02 | 6 |
| LNU806 | 78515.5 | — | — | — | 2992.9 | 0.08 | 5 | — | — | — |
| LNU759 | 77236.8 | — | — | — | 2950.0 | 0.18 | 4 | — | — | — |
| LNU751 | 77477.1 | — | — | — | — | — | — | 12.0 | 0.25 | 10 |
| LNU751 | 77480.1 | — | — | — | 3118.8 | 0.20 | 10 | — | — | — |
| CONT. | — | 255.1 | — | — | 2842.4 | — | — | 10.9 | — | — |
| LNU948 | 78378.1 | 83.1 | 0.02 | 17 | — | — | — | — | — | — |
| LNU948 | 78380.2 | 84.8 | 0.02 | 19 | — | — | — | — | — | — |
| LNU921 | 79063.2 | 78.6 | 0.16 | 10 | 628.6 | 0.22 | 12 | — | — | — |
| LNU888 | 78771.1 | 84.4 | 0.06 | 18 | — | — | — | 12.2 | L | 9 |
| LNU888 | 78772.7 | — | — | — | — | — | — | 11.8 | 0.06 | 5 |
| LNU881 | 78372.2 | 79.4 | 0.04 | 11 | 650.0 | 0.07 | 16 | — | — | — |
| LNU857 | 78867.1 | 77.2 | 0.11 | 8 | 627.7 | 0.15 | 12 | — | — | — |
| LNU816 | 78958.4 | 78.8 | 0.12 | 11 | 618.8 | 0.22 | 10 | — | — | — |
| LNU816 | 78958.5 | 91.2 | L | 28 | 693.8 | 0.02 | 23 | — | — | — |
| LNU816 | 78958.7 | 90.0 | L | 26 | 718.8 | 0.01 | 28 | — | — | — |
| LNU809 | 79168.2 | — | — | — | 618.8 | 0.19 | 10 | — | — | — |
| LNU809 | 79168.3 | 79.4 | 0.15 | 11 | 618.8 | 0.19 | 10 | 11.5 | 0.23 | 3 |
| LNU807 | 79248.1 | — | — | — | 625.0 | 0.15 | 11 | — | — | — |
| LNU788 | 78516.1 | 86.7 | L | 22 | 660.7 | 0.05 | 17 | — | — | — |
| LNU788 | 78517.2 | 76.2 | 0.14 | 7 | 637.5 | 0.11 | 13 | — | — | — |
| LNU788 | 78518.1 | 87.5 | L | 23 | 693.8 | 0.02 | 23 | — | — | — |
| LNU783 | 79178.2 | 80.0 | 0.03 | 12 | 650.0 | 0.07 | 16 | — | — | — |
| LNU778 | 78941.1 | 81.9 | 0.02 | 15 | 637.5 | 0.10 | 13 | — | — | — |
| LNU778 | 78944.2 | — | — | — | — | — | — | 11.5 | 0.28 | 3 |
| LNU762 | 79329.2 | 78.1 | 0.10 | 10 | 612.5 | 0.24 | 9 | — | — | — |

TABLE 123-continued

Genes showing improved plant biomass production at limiting nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU752 | 78153.10 | 92.5 | 0.04 | 30 | 700.0 | 0.03 | 24 | 11.6 | 0.30 | 4 |
| LNU752 | 78155.2 | 82.2 | 0.11 | 15 | — | — | — | — | — | — |
| CONT. | — | 71.2 | — | — | 562.5 | — | — | 11.2 | — | — |
| LNU977 | 78032.1 | 162.5 | 0.16 | 11 | — | — | — | 11.6 | 0.08 | 2 |
| LNU977 | 78033.1 | 167.5 | 0.29 | 15 | — | — | — | — | — | — |
| LNU958 | 77687.7 | 165.0 | 0.19 | 13 | — | — | — | — | — | — |
| LNU958 | 77689.2 | 178.8 | 0.02 | 22 | 1450.0 | 0.21 | 12 | — | — | — |
| LNU933 | 78897.1 | 168.1 | 0.19 | 15 | — | — | — | — | — | — |
| LNU907 | 78872.8 | 162.1 | 0.17 | 11 | — | — | — | — | — | — |
| LNU882 | 78973.1 | — | — | — | — | — | — | 11.8 | 0.10 | 4 |
| LNU880 | 78196.1 | 180.6 | 0.01 | 24 | 1503.6 | 0.13 | 16 | — | — | — |
| LNU880 | 78197.4 | 167.9 | 0.08 | 15 | — | — | — | — | — | — |
| LNU880 | 78200.6 | 197.9 | L | 35 | 1456.2 | 0.24 | 13 | 11.6 | 0.19 | 2 |
| LNU871 | 78195.4 | — | — | — | — | — | — | 12.2 | L | 7 |
| LNU848 | 77909.2 | 170.0 | 0.06 | 16 | — | — | — | — | — | — |
| LNU848 | 77909.3 | 178.1 | 0.14 | 22 | 1450.0 | 0.23 | 12 | — | — | — |
| LNU847 | 78967.2 | 197.5 | 0.02 | 35 | 1543.8 | 0.09 | 19 | 12.2 | 0.22 | 8 |
| LNU847 | 78967.4 | — | — | — | — | — | — | 11.9 | L | 5 |
| LNU846 | 78436.2 | — | — | — | — | — | — | 12.4 | 0.09 | 9 |
| LNU846 | 78438.2 | 184.4 | 0.13 | 26 | — | — | — | 11.9 | 0.23 | 5 |
| LNU846 | 78439.2 | — | — | — | — | — | — | 11.6 | 0.21 | 2 |
| LNU846 | 78439.4 | — | — | — | — | — | — | 12.1 | 0.08 | 6 |
| LNU845 | 78917.3 | 194.2 | 0.10 | 33 | 1520.8 | 0.19 | 18 | — | — | — |
| LNU845 | 78917.6 | 173.1 | 0.16 | 18 | — | — | — | — | — | — |
| LNU835 | 78186.2 | 204.4 | 0.27 | 40 | 1506.2 | 0.21 | 16 | — | — | — |
| LNU828 | 77598.3 | 193.8 | 0.29 | 33 | — | — | — | 12.2 | 0.11 | 8 |
| LNU823 | 78122.2 | 178.1 | 0.02 | 22 | — | — | — | — | — | — |
| LNU823 | 78136.4 | 166.2 | 0.12 | 14 | — | — | — | — | — | — |
| LNU823 | 78139.1 | 174.5 | 0.03 | 19 | — | — | — | — | — | — |
| LNU814 | 78953.2 | 179.4 | 0.02 | 23 | 1500.0 | 0.13 | 16 | — | — | — |
| LNU814 | 78953.3 | 177.5 | 0.02 | 21 | — | — | — | 11.9 | 0.05 | 5 |
| LNU814 | 78954.1 | — | — | — | — | — | — | 12.1 | 0.23 | 6 |
| LNU814 | 78955.4 | 188.8 | L | 29 | 1493.8 | 0.14 | 15 | — | — | — |
| LNU772 | 78938.1 | — | — | — | — | — | — | 12.0 | 0.03 | 6 |
| LNU772 | 78940.2 | — | — | — | — | — | — | 11.8 | 0.17 | 4 |
| LNU757 | 77485.4 | 210.6 | 0.02 | 44 | 1612.5 | 0.06 | 25 | — | — | — |
| CONT. | — | 146.2 | — | — | 1293.4 | — | — | 11.4 | — | — |
| LNU972 | 78907.1 | — | — | — | — | — | — | 11.7 | 0.08 | 6 |
| LNU972 | 78908.2 | — | — | — | — | — | — | 11.9 | 0.05 | 9 |
| LNU972 | 78909.3 | — | — | — | — | — | — | 11.9 | 0.03 | 9 |
| LNU972 | 78910.2 | — | — | — | 3500.9 | 0.13 | 21 | — | — | — |
| LNU961 | 79143.3 | 350.0 | 0.04 | 16 | 3556.2 | 0.07 | 23 | 11.6 | 0.14 | 5 |
| LNU961 | 79145.3 | — | — | — | 3562.5 | 0.02 | 23 | 11.8 | 0.15 | 8 |
| LNU958 | 77687.2 | — | — | — | — | — | — | 12.7 | 0.25 | 16 |
| LNU958 | 77687.5 | — | — | — | — | — | — | 12.1 | 0.02 | 10 |
| LNU958 | 77689.1 | — | — | — | 3200.0 | 0.20 | 10 | 12.2 | L | 12 |
| LNU958 | 77689.2 | — | — | — | — | — | — | 11.6 | 0.28 | 5 |
| LNU948 | 78379.4 | — | — | — | — | — | — | 12.1 | 0.04 | 10 |
| LNU948 | 78380.2 | 380.6 | 0.04 | 27 | 3618.8 | 0.01 | 25 | 12.3 | 0.05 | 12 |
| LNU948 | 78380.3 | 358.1 | 0.24 | 19 | 3618.8 | 0.12 | 25 | — | — | — |
| LNU921 | 79061.1 | — | — | — | 3163.4 | 0.26 | 9 | — | — | — |
| LNU921 | 79063.2 | — | — | — | — | — | — | 12.0 | 0.14 | 9 |
| LNU921 | 79064.3 | — | — | — | — | — | — | 11.4 | 0.28 | 4 |
| LNU913 | 78592.4 | — | — | — | — | — | — | 11.9 | 0.20 | 9 |
| LNU913 | 78593.1 | — | — | — | — | — | — | 12.1 | 0.03 | 10 |
| LNU913 | 78593.6 | — | — | — | — | — | — | 12.0 | 0.14 | 9 |
| LNU912 | 78403.2 | — | — | — | — | — | — | 12.4 | L | 13 |
| LNU912 | 78404.1 | 342.5 | 0.28 | 14 | — | — | — | 11.7 | 0.08 | 6 |
| LNU888 | 78772.1 | — | — | — | — | — | — | 11.9 | 0.05 | 9 |
| LNU888 | 78772.2 | — | — | — | — | — | — | 11.8 | 0.07 | 8 |
| LNU888 | 78772.7 | — | — | — | — | — | — | 11.6 | 0.12 | 6 |
| LNU881 | 78372.2 | — | — | — | — | — | — | 12.5 | 0.06 | 14 |
| LNU881 | 78373.1 | 344.4 | 0.04 | 15 | — | — | — | 12.0 | 0.14 | 9 |
| LNU881 | 78373.2 | — | — | — | — | — | — | 12.3 | 0.05 | 12 |
| LNU881 | 78374.1 | 343.3 | 0.27 | 14 | — | — | — | — | — | — |
| LNU823 | 78136.1 | 353.8 | 0.01 | 18 | 3318.8 | 0.09 | 15 | — | — | — |
| LNU823 | 78136.4 | — | — | — | — | — | — | 12.4 | 0.04 | 13 |
| LNU823 | 78137.3 | — | — | — | — | — | — | 11.5 | 0.27 | 5 |
| LNU823 | 78139.1 | 397.1 | 0.08 | 32 | — | — | — | — | — | — |
| LNU816 | 78957.1 | — | — | — | — | — | — | 11.6 | 0.12 | 6 |
| LNU816 | 78958.4 | — | — | — | — | — | — | 11.9 | 0.03 | 9 |
| LNU816 | 78958.7 | — | — | — | — | — | — | 12.8 | 0.04 | 16 |

TABLE 123-continued

Genes showing improved plant biomass production at limiting nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU809 | 79168.3 | — | — | — | — | — | — | 11.6 | 0.14 | 5 |
| LNU809 | 79169.2 | — | — | — | 3212.5 | 0.19 | 11 | 11.6 | 0.14 | 5 |
| LNU782 | 77441.1 | 350.0 | 0.17 | 16 | — | — | — | — | — | — |
| LNU782 | 77444.10 | — | — | — | — | — | — | 11.6 | 0.14 | 5 |
| LNU782 | 77444.9 | — | — | — | — | — | — | 12.1 | 0.08 | 10 |
| LNU772 | 78937.4 | 335.6 | 0.13 | 12 | 3468.8 | 0.05 | 20 | — | — | — |
| LNU772 | 78938.1 | 433.1 | L | 44 | 3181.2 | 0.23 | 10 | 13.0 | 0.08 | 18 |
| LNU772 | 78940.2 | — | — | — | — | — | — | 11.8 | 0.15 | 8 |
| LNU762 | 79329.2 | — | — | — | — | — | — | 11.9 | 0.20 | 9 |
| LNU762 | 79330.3 | — | — | — | 3287.5 | 0.12 | 13 | — | — | — |
| LNU757 | 77481.1 | — | — | — | — | — | — | 11.9 | 0.04 | 8 |
| LNU757 | 77483.2 | — | — | — | — | — | — | 11.6 | 0.29 | 6 |
| LNU757 | 77483.3 | — | — | — | — | — | — | 12.3 | 0.01 | 12 |
| LNU757 | 77485.4 | 346.9 | 0.08 | 15 | — | — | — | — | — | — |
| CONT. | — | 300.5 | — | — | 2898.0 | — | — | 11.0 | — | — |
| LNU933 | 78897.1 | — | — | — | — | — | — | 12.8 | L | 5 |
| LNU882 | 78973.1 | — | — | — | — | — | — | 12.9 | 0.18 | 6 |
| LNU871 | 78191.1 | — | — | — | 1093.8 | 0.19 | 7 | — | — | — |
| LNU871 | 78191.3 | 163.1 | 0.27 | 10 | 1112.5 | 0.11 | 8 | — | — | — |
| LNU871 | 78195.4 | — | — | — | — | — | — | 13.1 | L | 7 |
| LNU865 | 79761.7 | — | — | — | 1162.5 | 0.02 | 13 | 13.1 | L | 8 |
| LNU847 | 78967.4 | — | — | — | — | — | — | 13.3 | 0.22 | 9 |
| LNU835 | 78189.1 | — | — | — | — | — | — | 13.1 | 0.12 | 8 |
| LNU828 | 77597.3 | 165.6 | 0.24 | 11 | 1131.2 | 0.18 | 10 | — | — | — |
| LNU795 | 79521.6 | — | — | — | 1112.5 | 0.29 | 8 | — | — | — |
| LNU766 | 78931.2 | — | — | — | — | — | — | 12.7 | 0.17 | 4 |
| LNU766 | 78932.1 | — | — | — | 1100.0 | 0.20 | 7 | — | — | — |
| CONT. | — | 148.6 | — | — | 1026.5 | — | — | 12.2 | — | — |
| LNU975 | 80622.1 | — | — | — | — | — | — | 10.5 | 0.01 | 8 |
| LNU975 | 80624.5 | — | — | — | — | — | — | 10.7 | L | 10 |
| LNU975 | 80625.5 | — | — | — | — | — | — | 10.2 | L | 5 |
| LNU971 | 78391.1 | 9.38 | 0.16 | 22 | — | — | — | — | — | — |
| LNU971 | 78391.6 | — | — | — | — | — | — | 10.1 | 0.03 | 4 |
| LNU971 | 78395.1 | — | — | — | 131.2 | 0.12 | 17 | 10.1 | 0.30 | 3 |
| LNU971 | 78395.2 | 10.7 | 0.04 | 39 | 135.7 | 0.09 | 21 | — | — | — |
| LNU964 | 80552.8 | — | — | — | — | — | — | 10.0 | 0.26 | 3 |
| LNU960 | 78599.4 | — | — | — | — | — | — | 10.1 | 0.11 | 4 |
| LNU960 | 78600.3 | — | — | — | — | — | — | 10.2 | 0.05 | 5 |
| LNU957 | 80435.3 | — | — | — | — | — | — | 10.1 | 0.03 | 4 |
| LNU957 | 80437.6 | — | — | — | — | — | — | 10.3 | L | 6 |
| LNU957 | 80437.8 | 10.0 | 0.26 | 30 | — | — | — | — | — | — |
| LNU955 | 80432.1 | — | — | — | — | — | — | 10.1 | 0.30 | 3 |
| LNU953 | 80427.1 | 8.75 | 0.23 | 14 | — | — | — | — | — | — |
| LNU953 | 80428.1 | — | — | — | — | — | — | 10.1 | 0.08 | 3 |
| LNU953 | 80429.1 | — | — | — | — | — | — | 10.0 | 0.26 | 3 |
| LNU949 | 80553.7 | — | — | — | — | — | — | 10.3 | 0.12 | 6 |
| LNU949 | 80557.4 | 8.75 | 0.23 | 14 | — | — | — | — | — | — |
| LNU946 | 80648.1 | — | — | — | — | — | — | 10.2 | 0.05 | 5 |
| LNU946 | 80648.2 | 10.0 | 0.02 | 30 | — | — | — | — | — | — |
| LNU946 | 80650.2 | 9.29 | 0.21 | 21 | — | — | — | — | — | — |
| LNU944 | 79781.2 | — | — | — | — | — | — | 9.94 | 0.27 | 2 |
| LNU944 | 79781.6 | — | — | — | — | — | — | 10.1 | 0.03 | 4 |
| LNU930 | 79771.1 | — | — | — | — | — | — | 10.0 | 0.13 | 3 |
| LNU928 | 78213.1 | — | — | — | — | — | — | 10.1 | 0.30 | 3 |
| LNU917 | 77496.2 | — | — | — | — | — | — | 10.2 | 0.05 | 5 |
| LNU917 | 77500.2 | — | — | — | 137.5 | 0.24 | 22 | 10.1 | 0.11 | 4 |
| LNU917 | 77500.4 | — | — | — | 137.5 | 0.24 | 22 | — | — | — |
| LNU917 | 77500.6 | — | — | — | — | — | — | 10.6 | L | 8 |
| LNU906 | 79219.5 | — | — | — | — | — | — | 10.2 | 0.18 | 4 |
| LNU904 | 78986.5 | — | — | — | — | — | — | 9.94 | 0.27 | 2 |
| LNU904 | 78987.2 | — | — | — | — | — | — | 10.2 | 0.18 | 4 |
| LNU903 | 80417.4 | 10.6 | 0.03 | 38 | — | — | — | — | — | — |
| LNU901 | 80474.1 | — | — | — | 126.8 | 0.13 | 13 | — | — | — |
| LNU901 | 80474.5 | — | — | — | — | — | — | 10.4 | 0.18 | 6 |
| LNU899 | 79765.4 | 9.38 | 0.16 | 22 | 131.2 | 0.12 | 17 | — | — | — |
| LNU899 | 79765.5 | — | — | — | — | — | — | 10.2 | 0.18 | 4 |
| LNU899 | 79766.3 | — | — | — | — | — | — | 10.0 | 0.26 | 3 |
| LNU897 | 80445.2 | 11.9 | 0.23 | 54 | 150.0 | L | 33 | 11.1 | L | 13 |
| LNU897 | 80448.4 | — | — | — | — | — | — | 10.1 | 0.08 | 3 |
| LNU892 | 80410.1 | — | — | — | 125.0 | 0.17 | 11 | — | — | — |
| LNU892 | 80414.2 | 12.0 | L | 55 | — | — | — | — | — | — |
| LNU892 | 80414.5 | — | — | — | — | — | — | 10.3 | L | 6 |

TABLE 123-continued

Genes showing improved plant biomass production at limiting nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU884 | 80405.3 | — | — | — | — | — | — | 10.5 | 0.26 | 8 |
| LNU884 | 80407.1 | — | — | — | — | — | — | 10.5 | L | 8 |
| LNU884 | 80408.2 | — | — | — | 137.5 | 0.24 | 22 | 10.1 | 0.11 | 4 |
| LNU874 | 78366.3 | 10.0 | 0.26 | 30 | — | — | — | 10.1 | 0.03 | 4 |
| LNU874 | 78370.1 | — | — | — | 162.5 | 0.27 | 44 | — | — | — |
| LNU874 | 78370.3 | — | — | — | 133.9 | 0.17 | 19 | — | — | — |
| LNU874 | 78370.7 | — | — | — | — | — | — | 10.2 | 0.18 | 4 |
| LNU873 | 80469.1 | — | — | — | 125.0 | 0.17 | 11 | 10.6 | L | 8 |
| LNU870 | 78505.1 | 8.75 | 0.23 | 14 | 131.2 | 0.12 | 17 | — | — | — |
| LNU870 | 78505.5 | 11.2 | 0.14 | 46 | — | — | — | 10.1 | 0.30 | 3 |
| LNU867 | 79590.3 | — | — | — | — | — | — | 9.94 | 0.27 | 2 |
| LNU866 | 80443.2 | — | — | — | — | — | — | 10.3 | 0.12 | 6 |
| LNU862 | 79758.5 | 11.2 | 0.14 | 46 | 156.2 | L | 39 | 11.1 | L | 13 |
| LNU856 | 79753.3 | — | — | — | — | — | — | 9.94 | 0.27 | 2 |
| LNU856 | 79753.9 | 8.66 | 0.27 | 13 | — | — | — | 9.94 | 0.27 | 2 |
| LNU852 | 79580.2 | 9.38 | 0.16 | 22 | — | — | — | — | — | — |
| LNU831 | 79331.7 | — | — | — | 131.2 | 0.12 | 17 | 10.2 | 0.24 | 5 |
| LNU831 | 79333.1 | 8.75 | 0.23 | 14 | — | — | — | — | — | — |
| LNU831 | 79335.2 | — | — | — | — | — | — | 10.4 | L | 7 |
| LNU829 | 77912.3 | — | — | — | — | — | — | 10.4 | L | 6 |
| LNU829 | 77914.1 | — | — | — | — | — | — | 10.6 | 0.11 | 9 |
| LNU825 | 77716.4 | — | — | — | — | — | — | 10.1 | 0.08 | 3 |
| LNU825 | 77717.4 | 10.0 | 0.26 | 30 | — | — | — | — | — | — |
| LNU817 | 80596.1 | — | — | — | — | — | — | 10.3 | L | 6 |
| LNU817 | 80596.2 | 9.38 | 0.16 | 22 | 125.0 | 0.17 | 11 | — | — | — |
| LNU817 | 80598.1 | — | — | — | 125.0 | 0.17 | 11 | — | — | — |
| LNU817 | 80599.2 | 8.75 | 0.23 | 14 | — | — | — | 10.1 | 0.11 | 4 |
| LNU805 | 80783.2 | — | — | — | — | — | — | 10.0 | 0.26 | 3 |
| LNU805 | 80784.1 | — | — | — | — | — | — | 10.2 | 0.05 | 5 |
| LNU800 | 77896.1 | — | — | — | — | — | — | 10.0 | 0.26 | 3 |
| LNU800 | 77896.4 | — | — | — | 137.5 | 0.24 | 22 | 10.2 | 0.18 | 4 |
| LNU800 | 77900.7 | 8.75 | 0.23 | 14 | — | — | — | — | — | — |
| LNU799 | 78672.5 | — | — | — | — | — | — | 10.4 | 0.18 | 6 |
| LNU799 | 78672.7 | — | — | — | 162.5 | 0.08 | 44 | — | — | — |
| LNU799 | 78674.2 | 9.38 | 0.16 | 22 | — | — | — | — | — | — |
| LNU799 | 78674.5 | — | — | — | 150.0 | 0.13 | 33 | 10.2 | 0.05 | 5 |
| LNU796 | 78235.5 | — | — | — | — | — | — | 10.1 | 0.11 | 4 |
| LNU794 | 78522.1 | — | — | — | 131.2 | 0.12 | 17 | 10.4 | 0.03 | 6 |
| LNU794 | 78524.1 | 10.0 | 0.02 | 30 | — | — | — | — | — | — |
| LNU794 | 78524.5 | — | — | — | — | — | — | 10.2 | 0.24 | 5 |
| LNU794 | 78525.2 | — | — | — | — | — | — | 10.1 | 0.11 | 4 |
| LNU792 | 79161.2 | — | — | — | — | — | — | 10.6 | L | 8 |
| LNU792 | 79162.2 | — | — | — | — | — | — | 10.3 | L | 6 |
| LNU792 | 79215.1 | — | — | — | — | — | — | 10.2 | 0.18 | 4 |
| LNU778 | 78943.5 | — | — | — | — | — | — | 10.5 | 0.01 | 8 |
| LNU778 | 78944.5 | 11.9 | L | 54 | 137.5 | 0.01 | 22 | — | — | — |
| LNU773 | 80399.1 | — | — | — | — | — | — | 10.4 | 0.08 | 7 |
| LNU771 | 80077.2 | — | — | — | 125.0 | 0.17 | 11 | — | — | — |
| LNU763 | 77588.2 | — | — | — | — | — | — | 10.2 | 0.24 | 5 |
| LNU763 | 77588.6 | 10.0 | 0.26 | 30 | 125.0 | 0.17 | 11 | 10.4 | 0.08 | 7 |
| LNU758 | 79739.10 | 10.6 | 0.03 | 38 | 150.0 | 0.13 | 33 | 11.2 | 0.12 | 15 |
| LNU758 | 79739.5 | — | — | — | — | — | — | 10.2 | 0.02 | 4 |
| LNU758 | 79741.2 | — | — | — | — | — | — | 10.1 | 0.11 | 4 |
| LNU753 | 77141.2 | — | — | — | 125.0 | 0.17 | 11 | — | — | — |
| LNU753 | 77143.3 | — | — | — | — | — | — | 9.94 | 0.27 | 2 |
| LNU753 | 77144.1 | 9.38 | 0.16 | 22 | 131.2 | 0.12 | 17 | 10.2 | 0.24 | 5 |
| LNU753 | 77144.2 | — | — | — | — | — | — | 10.0 | 0.26 | 3 |
| LNU749 | 80792.2 | — | — | — | 125.0 | 0.17 | 11 | 10.0 | 0.26 | 3 |
| CONT. | — | 7.70 | — | — | 112.5 | — | — | 9.75 | — | — |
| LNU976 | 78364.1 | — | — | — | — | — | — | 12.9 | 0.12 | 6 |
| LNU968 | 77919.4 | — | — | — | 1231.2 | 0.03 | 8 | — | — | — |
| LNU963 | 78385.1 | — | — | — | — | — | — | 12.8 | 0.07 | 6 |
| LNU950 | 78911.3 | — | — | — | 1212.5 | 0.08 | 6 | — | — | — |
| LNU934 | 79007.3 | — | — | — | — | — | — | 12.8 | 0.07 | 6 |
| LNU934 | 79008.3 | 122.1 | 0.15 | 5 | — | — | — | — | — | — |
| LNU908 | 79736.2 | 134.4 | 0.28 | 16 | 1312.5 | 0.10 | 15 | — | — | — |
| LNU893 | 77154.4 | — | — | — | — | — | — | 13.4 | L | 10 |
| LNU885 | 78416.5 | 125.0 | 0.05 | 8 | 1300.0 | 0.05 | 14 | — | — | — |
| LNU858 | 79587.2 | — | — | — | — | — | — | 12.6 | 0.06 | 4 |
| LNU790 | 78886.2 | — | — | — | — | — | — | 12.6 | 0.22 | 4 |
| LNU790 | 78890.1 | 134.4 | 0.06 | 16 | 1237.5 | 0.07 | 8 | 12.6 | 0.18 | 4 |
| CONT. | — | 116.2 | — | — | 1141.1 | — | — | 12.1 | — | — |

TABLE 123-continued

Genes showing improved plant biomass production at limiting nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU947 | 77448.4 | — | — | — | — | — | — | 12.7 | 0.03 | 6 |
| LNU947 | 77449.1 | — | — | — | — | — | — | 12.4 | 0.22 | 3 |
| LNU940 | 77811.6 | — | — | — | — | — | — | 12.6 | 0.13 | 5 |
| LNU900 | 78851.3 | — | — | — | — | — | — | 12.4 | 0.22 | 3 |
| LNU898 | 78981.3 | — | — | — | — | — | — | 12.3 | 0.26 | 2 |
| LNU898 | 78983.4 | — | — | — | — | — | — | 12.9 | 0.09 | 7 |
| LNU898 | 78985.1 | — | — | — | 1393.8 | 0.16 | 14 | — | — | — |
| LNU894 | 78282.3 | — | — | — | — | — | — | 12.4 | 0.22 | 3 |
| LNU894 | 78283.7 | — | — | — | — | — | — | 12.9 | 0.03 | 8 |
| LNU846 | 78436.2 | — | — | — | 1368.8 | 0.04 | 12 | — | — | — |
| LNU846 | 78438.2 | — | — | — | — | — | — | 12.4 | 0.22 | 3 |
| LNU846 | 78439.4 | — | — | — | 1393.8 | 0.02 | 14 | 12.9 | 0.03 | 8 |
| LNU820 | 77806.2 | 227.0 | 0.06 | 37 | 1410.7 | 0.11 | 15 | — | — | — |
| LNU820 | 77807.2 | — | — | — | — | — | — | 12.5 | 0.11 | 4 |
| LNU820 | 77809.1 | — | — | — | 1413.4 | 0.26 | 16 | — | — | — |
| LNU815 | 77492.2 | 193.1 | 0.05 | 17 | 1343.8 | 0.21 | 10 | — | — | — |
| LNU815 | 77492.6 | — | — | — | 1331.2 | 0.12 | 9 | — | — | — |
| LNU815 | 77494.1 | — | — | — | 1337.5 | 0.07 | 10 | 12.9 | 0.03 | 8 |
| LNU814 | 78953.2 | — | — | — | — | — | — | 12.3 | 0.26 | 2 |
| LNU814 | 78955.4 | — | — | — | — | — | — | 12.5 | 0.08 | 4 |
| LNU811 | 78179.1 | — | — | — | 1412.5 | 0.03 | 16 | 12.8 | 0.28 | 7 |
| LNU811 | 78180.3 | — | — | — | 1300.0 | 0.19 | 6 | — | — | — |
| LNU797 | 78022.1 | — | — | — | — | — | — | 12.5 | 0.25 | 4 |
| LNU793 | 78166.4 | — | — | — | 1325.0 | 0.23 | 8 | — | — | — |
| LNU759 | 77236.2 | — | — | — | — | — | — | 12.3 | 0.26 | 2 |
| LNU756 | 77581.3 | — | — | — | — | — | — | 12.8 | 0.25 | 6 |
| LNU756 | 77584.6 | — | — | — | 1285.7 | 0.28 | 5 | — | — | — |
| LNU751 | 77477.1 | — | — | — | 1416.1 | 0.09 | 16 | — | — | — |
| LNU751 | 77478.4 | — | — | — | — | — | — | 12.4 | 0.22 | 3 |
| LNU751 | 77480.1 | — | — | — | — | — | — | 12.6 | 0.04 | 5 |
| CONT. | — | 165.1 | — | — | 1221.4 | — | — | 12.0 | — | — |
| LNU972 | 78909.3 | — | — | — | 1531.2 | 0.28 | 5 | 12.4 | 0.09 | 5 |
| LNU972 | 78910.2 | — | — | — | 1506.2 | 0.28 | 4 | — | — | — |
| LNU965 | 78360.5 | — | — | — | — | — | — | 12.2 | 0.13 | 4 |
| LNU961 | 79143.2 | — | — | — | 1568.8 | 0.30 | 8 | — | — | — |
| LNU961 | 79145.3 | — | — | — | 1525.0 | 0.14 | 5 | — | — | — |
| LNU943 | 78407.2 | — | — | — | — | — | — | 12.1 | 0.26 | 3 |
| LNU943 | 78407.4 | — | — | — | 1581.2 | 0.02 | 9 | — | — | — |
| LNU926 | 78858.8 | — | — | — | — | — | — | 12.1 | 0.26 | 3 |
| LNU913 | 78593.1 | — | — | — | — | — | — | 12.4 | 0.09 | 5 |
| LNU896 | 78979.5 | — | — | — | 1531.2 | 0.11 | 5 | — | — | — |
| LNU876 | 79596.2 | — | — | — | 1525.0 | 0.18 | 5 | — | — | — |
| LNU864 | 79339.2 | 195.8 | 0.20 | 7 | 1617.0 | 0.08 | 11 | — | — | — |
| LNU833 | 78184.1 | — | — | — | — | — | — | 12.1 | 0.26 | 3 |
| LNU804 | 78950.4 | — | — | — | 1537.5 | 0.13 | 6 | — | — | — |
| LNU789 | 78891.6 | — | — | — | 1766.7 | 0.30 | 22 | — | — | — |
| LNU789 | 78893.3 | — | — | — | 1500.0 | 0.30 | 3 | — | — | — |
| LNU768 | 77881.3 | 194.4 | 0.26 | 6 | 1537.5 | 0.21 | 6 | — | — | — |
| LNU768 | 77883.4 | 198.1 | 0.13 | 8 | 1581.2 | 0.02 | 9 | — | — | — |
| LNU764 | 78926.1 | 214.4 | 0.28 | 17 | 1618.8 | 0.07 | 11 | 12.4 | 0.17 | 5 |
| CONT. | — | 183.8 | — | — | 1453.6 | — | — | 11.7 | — | — |

"CONT."—Control;
"Ave."—Average;
"% Incr." = % increment;
"p-val."—p-value;
L means that p-value is less than 0.01, p < 0.1 was considered as significant.

TABLE 124

Genes showing improved plant biomass production at limiting nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU952 | 78218.1 | 49.8 | 0.02 | 19 | 6.23 | 0.02 | 19 | 4.62 | 0.02 | 12 |
| LNU952 | 78218.3 | 45.0 | 0.24 | 7 | 5.62 | 0.24 | 7 | 4.37 | 0.09 | 6 |
| LNU952 | 78218.6 | 46.3 | 0.24 | 11 | 5.79 | 0.24 | 11 | 4.33 | 0.22 | 5 |
| LNU952 | 78219.3 | 47.1 | 0.08 | 12 | 5.88 | 0.08 | 12 | 4.51 | 0.04 | 9 |
| LNU945 | 78998.2 | 45.8 | 0.20 | 9 | 5.72 | 0.20 | 9 | 4.45 | 0.12 | 8 |
| LNU920 | 78507.1 | 52.9 | 0.08 | 26 | 6.62 | 0.08 | 26 | 4.94 | 0.06 | 20 |
| LNU920 | 78507.2 | 45.8 | 0.25 | 9 | 5.73 | 0.25 | 9 | 4.35 | 0.11 | 6 |
| LNU920 | 78508.1 | 51.6 | L | 23 | 6.45 | L | 23 | 4.72 | L | 15 |
| LNU920 | 78508.2 | 53.6 | L | 28 | 6.70 | L | 28 | 4.84 | L | 18 |
| LNU916 | 78208.3 | 50.8 | 0.02 | 21 | 6.35 | 0.02 | 21 | 4.63 | L | 12 |
| LNU914 | 80514.5 | 46.2 | 0.15 | 10 | 5.78 | 0.15 | 10 | 4.36 | 0.15 | 6 |
| LNU914 | 80516.2 | 50.4 | 0.14 | 20 | 6.29 | 0.14 | 20 | 4.71 | L | 14 |
| LNU914 | 80516.4 | — | — | — | — | — | — | 4.50 | 0.03 | 9 |
| LNU911 | 80420.3 | 46.2 | 0.12 | 10 | 5.77 | 0.12 | 10 | 4.36 | 0.09 | 6 |
| LNU911 | 80424.2 | 46.3 | 0.12 | 10 | 5.78 | 0.12 | 10 | 4.43 | 0.05 | 7 |
| LNU905 | 79674.3 | 47.4 | 0.08 | 13 | 5.92 | 0.08 | 13 | 4.51 | 0.09 | 9 |
| LNU905 | 79674.4 | — | — | — | — | — | — | 4.40 | 0.08 | 7 |
| LNU905 | 79675.3 | 51.5 | L | 23 | 6.44 | L | 23 | 4.65 | L | 13 |
| LNU844 | 80342.3 | — | — | — | — | — | — | 4.27 | 0.27 | 4 |
| LNU844 | 80342.4 | — | — | — | — | — | — | 4.32 | 0.29 | 5 |
| LNU840 | 78676.1 | 49.2 | 0.02 | 17 | 6.15 | 0.02 | 17 | 4.71 | L | 14 |
| LNU840 | 78676.4 | 52.9 | 0.09 | 26 | 6.62 | 0.09 | 26 | 4.74 | 0.05 | 15 |
| LNU840 | 78763.6 | 46.7 | 0.10 | 11 | 5.83 | 0.10 | 11 | 4.45 | 0.04 | 8 |
| LNU834_H1 | 80402.7 | 47.6 | 0.21 | 14 | 5.95 | 0.21 | 14 | 4.47 | 0.23 | 8 |
| LNU832_H2 | 80604.2 | 48.2 | 0.06 | 15 | 6.03 | 0.06 | 15 | 4.58 | 0.11 | 11 |
| LNU819 | 78133.3 | — | — | — | — | — | — | 4.56 | 0.02 | 11 |
| LNU801 | 78585.2 | 45.6 | 0.29 | 9 | 5.70 | 0.29 | 9 | 4.42 | 0.20 | 7 |
| LNU791 | 77893.1 | 54.0 | 0.01 | 29 | 6.74 | 0.01 | 29 | 4.86 | L | 18 |
| LNU791 | 77893.2 | 48.8 | 0.03 | 16 | 6.09 | 0.03 | 16 | 4.52 | 0.04 | 10 |
| LNU760_H1 | 80127.2 | 51.7 | 0.17 | 23 | 6.47 | 0.17 | 23 | 4.65 | 0.05 | 13 |
| CONT. | — | 41.9 | — | — | 5.24 | — | — | 4.12 | — | — |
| LNU966 | 78605.5 | 81.2 | 0.03 | 38 | 10.2 | 0.03 | 38 | 5.22 | 0.05 | 15 |
| LNU966 | 78605.7 | 72.2 | L | 22 | 9.03 | L | 22 | 4.94 | 0.01 | 9 |
| LNU941 | 78611.1 | 67.9 | L | 15 | 8.48 | L | 15 | 4.67 | 0.22 | 3 |
| LNU941 | 78613.1 | 75.3 | 0.03 | 27 | 9.41 | 0.03 | 27 | 5.10 | L | 13 |
| LNU941 | 78615.3 | 75.2 | L | 27 | 9.40 | L | 27 | 5.03 | L | 11 |
| LNU925 | 78992.1 | 77.2 | 0.26 | 31 | 9.65 | 0.26 | 31 | 5.18 | 0.21 | 15 |
| LNU925 | 78992.6 | 62.1 | 0.26 | 5 | 7.76 | 0.26 | 5 | — | — | — |
| LNU918 | 78433.1 | — | — | — | — | — | — | 4.73 | 0.23 | 5 |
| LNU918 | 78433.2 | 69.7 | 0.21 | 18 | 8.72 | 0.21 | 18 | 4.90 | 0.23 | 8 |
| LNU918 | 78433.3 | 70.2 | L | 19 | 8.78 | L | 19 | 4.85 | 0.02 | 7 |
| LNU918 | 78434.2 | 65.6 | 0.02 | 11 | 8.21 | 0.02 | 11 | 4.82 | 0.03 | 6 |
| LNU915 | 78426.1 | 71.3 | L | 21 | 8.91 | L | 21 | 5.05 | L | 12 |
| LNU915 | 78427.1 | 69.8 | 0.29 | 18 | 8.73 | 0.29 | 18 | — | — | — |
| LNU915 | 78428.1 | 78.8 | L | 33 | 9.85 | L | 33 | 5.14 | L | 14 |
| LNU915 | 78428.2 | 66.3 | 0.27 | 12 | 8.28 | 0.27 | 12 | — | — | — |
| LNU909 | 78424.3 | 69.3 | 0.29 | 17 | 8.66 | 0.29 | 17 | — | — | — |
| LNU909 | 78425.4 | — | — | — | — | — | — | 5.10 | 0.05 | 13 |
| LNU909 | 78425.5 | 81.3 | 0.25 | 38 | 10.2 | 0.25 | 38 | 5.29 | 0.20 | 17 |
| LNU909 | 78425.7 | 67.8 | 0.14 | 15 | 8.48 | 0.14 | 15 | 4.83 | 0.15 | 7 |
| LNU890 | 78202.1 | 74.4 | L | 26 | 9.30 | L | 26 | 4.84 | 0.08 | 7 |
| LNU854 | 78236.1 | 62.9 | 0.14 | 6 | 7.86 | 0.14 | 6 | 4.67 | 0.22 | 3 |
| LNU854 | 78238.1 | 68.7 | L | 16 | 8.59 | L | 16 | 4.74 | 0.11 | 5 |
| LNU849 | 78498.4 | 72.6 | L | 23 | 9.08 | L | 23 | 4.93 | 0.09 | 9 |
| LNU849 | 78499.1 | 69.3 | 0.04 | 17 | 8.66 | 0.04 | 17 | 4.84 | 0.29 | 7 |
| LNU830 | 78741.5 | 79.8 | 0.17 | 35 | 9.98 | 0.17 | 35 | 5.18 | 0.20 | 15 |
| LNU830 | 78742.8 | 63.8 | 0.20 | 8 | 7.97 | 0.20 | 8 | — | — | — |
| LNU824 | 77826.1 | 82.9 | 0.20 | 40 | 10.4 | 0.20 | 40 | 5.40 | 0.11 | 19 |
| LNU824 | 77827.3 | 64.6 | 0.20 | 9 | 8.08 | 0.20 | 9 | — | — | — |
| LNU824 | 77828.4 | 69.4 | 0.04 | 18 | 8.68 | 0.04 | 18 | 4.73 | 0.11 | 5 |
| LNU824 | 77829.3 | 73.8 | 0.05 | 25 | 9.22 | 0.05 | 25 | 4.97 | 0.10 | 10 |
| LNU822 | 78623.2 | 82.2 | 0.27 | 39 | 10.3 | 0.27 | 39 | 5.29 | 0.22 | 17 |
| LNU822 | 78623.6 | 87.8 | L | 49 | 11.0 | L | 49 | 5.56 | 0.04 | 23 |
| LNU822 | 78623.7 | 74.0 | 0.21 | 25 | 9.26 | 0.21 | 25 | 4.96 | 0.14 | 10 |
| LNU822 | 78625.2 | 75.9 | 0.29 | 28 | 9.48 | 0.29 | 28 | 5.12 | 0.25 | 13 |
| LNU813 | 77682.3 | 77.3 | 0.16 | 31 | 9.66 | 0.16 | 31 | 5.20 | L | 15 |
| LNU806 | 78514.2 | 87.1 | 0.02 | 47 | 10.9 | 0.02 | 47 | 5.61 | L | 24 |
| LNU806 | 78515.3 | 69.3 | L | 17 | 8.66 | L | 17 | 4.75 | 0.10 | 5 |
| LNU806 | 78515.4 | — | — | — | — | — | — | 4.87 | 0.26 | 8 |
| LNU806 | 78515.5 | 76.4 | L | 29 | 9.55 | L | 29 | 4.98 | L | 10 |
| LNU802 | 80307.3 | 65.9 | 0.03 | 12 | 8.24 | 0.03 | 12 | 4.68 | 0.20 | 3 |

TABLE 124-continued

Genes showing improved plant biomass production at limiting nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU802 | 80309.2 | 67.0 | 0.27 | 13 | 8.38 | 0.27 | 13 | — | — | — |
| LNU802 | 80309.3 | 67.3 | 0.09 | 14 | 8.41 | 0.09 | 14 | 4.81 | 0.04 | 6 |
| LNU802 | 80310.1 | 67.1 | 0.08 | 14 | 8.39 | 0.08 | 14 | 4.81 | 0.14 | 6 |
| LNU779 | 77887.2 | 77.0 | 0.03 | 30 | 9.63 | 0.03 | 30 | 5.09 | 0.11 | 13 |
| LNU761 | 78157.6 | 67.8 | 0.15 | 15 | 8.48 | 0.15 | 15 | 4.79 | 0.28 | 6 |
| LNU761 | 78159.1 | 66.3 | 0.08 | 12 | 8.29 | 0.08 | 12 | 4.75 | 0.08 | 5 |
| LNU761 | 78160.3 | 84.0 | 0.07 | 42 | 10.5 | 0.07 | 42 | 5.44 | 0.02 | 20 |
| CONT. | — | 59.1 | — | — | 7.38 | — | — | 4.52 | — | — |
| LNU976 | 78364.1 | 45.6 | L | 47 | 5.71 | L | 47 | 4.19 | L | 25 |
| LNU976 | 78364.2 | 34.1 | 0.22 | 10 | 4.27 | 0.22 | 10 | — | — | — |
| LNU976 | 78364.5 | — | — | — | — | — | — | 3.50 | 0.26 | 4 |
| LNU970 | 78388.1 | 36.2 | 0.02 | 17 | 4.52 | 0.02 | 17 | 3.63 | 0.03 | 8 |
| LNU970 | 78389.7 | 33.4 | 0.27 | 8 | 4.18 | 0.27 | 8 | 3.62 | 0.06 | 8 |
| LNU970 | 78389.8 | 44.2 | 0.03 | 42 | 5.52 | 0.03 | 42 | 4.00 | L | 19 |
| LNU968 | 77919.4 | 36.5 | 0.01 | 18 | 4.57 | 0.01 | 18 | 3.66 | 0.02 | 9 |
| LNU963 | 78383.4 | 36.6 | 0.07 | 18 | 4.57 | 0.07 | 18 | 3.65 | 0.27 | 9 |
| LNU950 | 78913.4 | 39.1 | 0.12 | 26 | 4.89 | 0.12 | 26 | 3.74 | 0.18 | 11 |
| LNU950 | 78915.2 | 35.7 | 0.03 | 15 | 4.46 | 0.03 | 15 | 3.66 | 0.04 | 9 |
| LNU949 | 80553.5 | 37.5 | 0.22 | 21 | 4.69 | 0.22 | 21 | 3.74 | 0.21 | 11 |
| LNU949 | 80553.8 | 39.6 | 0.01 | 28 | 4.95 | 0.01 | 28 | 3.69 | 0.16 | 10 |
| LNU934 | 79007.5 | 33.2 | 0.27 | 7 | 4.16 | 0.27 | 7 | — | — | — |
| LNU934 | 79008.1 | 33.9 | 0.14 | 9 | 4.24 | 0.14 | 9 | 3.64 | 0.15 | 8 |
| LNU902 | 79606.5 | 38.2 | 0.03 | 23 | 4.77 | 0.03 | 23 | 3.77 | 0.10 | 12 |
| LNU875 | 78413.4 | 36.3 | 0.29 | 17 | 4.54 | 0.29 | 17 | 3.68 | 0.22 | 9 |
| LNU873 | 80473.4 | — | — | — | — | — | — | 3.73 | 0.27 | 11 |
| LNU843 | 78962.4 | 37.7 | L | 22 | 4.71 | L | 22 | 3.67 | 0.02 | 9 |
| LNU843 | 78963.2 | 36.3 | 0.11 | 17 | 4.53 | 0.11 | 17 | 3.68 | 0.08 | 9 |
| LNU790 | 78886.2 | 40.8 | L | 31 | 5.10 | L | 31 | 3.72 | 0.08 | 11 |
| LNU790 | 78886.3 | 35.0 | 0.04 | 13 | 4.38 | 0.04 | 13 | 3.67 | 0.07 | 9 |
| LNU790 | 78889.2 | — | — | — | — | — | — | 3.59 | 0.07 | 7 |
| LNU767 | 79146.1 | 41.6 | 0.09 | 34 | 5.20 | 0.09 | 34 | 3.85 | 0.15 | 15 |
| LNU767 | 79146.2 | 36.5 | 0.01 | 18 | 4.57 | 0.01 | 18 | 3.72 | L | 11 |
| CONT. | — | 31.0 | — | — | 3.88 | — | — | 3.36 | — | — |
| LNU941 | 78613.1 | 107.3 | 0.04 | 19 | 13.4 | 0.04 | 19 | 6.23 | 0.02 | 11 |
| LNU941 | 78614.2 | 111.8 | 0.01 | 24 | 14.0 | 0.01 | 24 | 6.25 | 0.02 | 12 |
| LNU941 | 78615.3 | 102.4 | 0.13 | 13 | 12.8 | 0.13 | 13 | 6.03 | 0.15 | 8 |
| LNU918 | 78433.3 | — | — | — | — | — | — | 5.92 | 0.16 | 6 |
| LNU915 | 78427.1 | 104.1 | 0.06 | 15 | 13.0 | 0.06 | 15 | 5.92 | 0.17 | 6 |
| LNU915 | 78428.1 | 101.4 | 0.24 | 12 | 12.7 | 0.24 | 12 | — | — | — |
| LNU909 | 78425.5 | 99.4 | 0.26 | 10 | 12.4 | 0.26 | 10 | — | — | — |
| LNU868 | 77621.5 | — | — | — | — | — | — | 6.06 | 0.25 | 8 |
| LNU854 | 78237.2 | 114.2 | L | 26 | 14.3 | L | 26 | 6.00 | 0.20 | 7 |
| LNU849 | 78498.3 | — | — | — | — | — | — | 6.09 | 0.10 | 9 |
| LNU849 | 78498.4 | 105.0 | 0.05 | 16 | 13.1 | 0.05 | 16 | 5.99 | 0.10 | 7 |
| LNU830 | 78741.3 | — | — | — | 12.3 | 0.26 | 9 | — | — | — |
| LNU830 | 78741.5 | 107.9 | 0.09 | 19 | 13.5 | 0.09 | 19 | 6.26 | 0.02 | 12 |
| LNU813 | 77682.3 | — | — | — | — | — | — | 5.88 | 0.28 | 5 |
| LNU813 | 77685.1 | 109.6 | 0.02 | 21 | 13.7 | 0.02 | 21 | 6.28 | 0.12 | 12 |
| LNU806 | 78514.2 | 100.4 | 0.28 | 11 | 12.6 | 0.28 | 11 | 5.86 | 0.29 | 5 |
| LNU806 | 78515.3 | 100.7 | 0.13 | 11 | 12.6 | 0.13 | 11 | 5.93 | 0.15 | 6 |
| LNU806 | 78515.5 | 101.9 | 0.15 | 13 | 12.7 | 0.15 | 13 | 5.96 | 0.11 | 6 |
| LNU780 | 77489.4 | — | — | — | — | — | — | 6.04 | 0.24 | 8 |
| CONT. | — | 90.5 | — | — | 11.3 | — | — | 5.60 | — | — |
| LNU948 | 78378.1 | 74.9 | 0.04 | 20 | 9.36 | 0.04 | 20 | 5.02 | 0.18 | 8 |
| LNU948 | 78380.2 | 67.9 | 0.07 | 9 | 8.49 | 0.07 | 9 | 4.84 | 0.22 | 5 |
| LNU921 | 79063.2 | 64.6 | 0.28 | 4 | 8.07 | 0.28 | 4 | — | — | — |
| LNU889 | 79601.4 | 67.5 | 0.08 | 8 | 8.44 | 0.08 | 8 | 4.83 | 0.19 | 4 |
| LNU888 | 78771.1 | 75.6 | 0.22 | 21 | 9.45 | 0.22 | 21 | 5.13 | 0.29 | 11 |
| LNU881 | 78372.2 | 71.0 | 0.07 | 14 | 8.87 | 0.07 | 14 | 4.95 | 0.07 | 7 |
| LNU857 | 78867.2 | 69.8 | 0.27 | 12 | 8.72 | 0.27 | 12 | 4.95 | 0.27 | 7 |
| LNU857 | 78870.1 | — | — | — | — | — | — | 4.77 | 0.22 | 3 |
| LNU816 | 78958.5 | 75.0 | L | 20 | 9.37 | L | 20 | 5.17 | L | 12 |
| LNU816 | 78958.7 | 76.6 | 0.03 | 23 | 9.58 | 0.03 | 23 | 5.22 | L | 13 |
| LNU809 | 79168.2 | 72.6 | 0.24 | 16 | 9.07 | 0.24 | 16 | 4.98 | 0.20 | 8 |
| LNU809 | 79168.3 | 67.9 | 0.26 | 9 | 8.49 | 0.26 | 9 | — | — | — |
| LNU807 | 79248.1 | 66.3 | 0.13 | 6 | 8.28 | 0.13 | 6 | 4.81 | 0.10 | 4 |
| LNU807 | 79250.2 | 65.0 | 0.22 | 4 | 8.13 | 0.22 | 4 | — | — | — |
| LNU795 | 79525.1 | 70.5 | 0.01 | 13 | 8.82 | 0.01 | 13 | — | — | — |
| LNU795 | 79525.5 | 66.0 | 0.15 | 6 | 8.25 | 0.15 | 6 | 4.80 | 0.11 | 4 |
| LNU788 | 78516.1 | 76.3 | 0.07 | 22 | 9.54 | 0.07 | 22 | 5.11 | 0.30 | 10 |
| LNU788 | 78517.2 | 66.7 | 0.07 | 7 | 8.34 | 0.07 | 7 | 4.86 | 0.06 | 5 |

TABLE 124-continued

Genes showing improved plant biomass production at limiting nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU788 | 78518.1 | 89.3 | 0.11 | 43 | 11.2 | 0.11 | 43 | 5.59 | L | 21 |
| LNU778 | 78941.1 | 72.6 | 0.15 | 16 | 9.07 | 0.15 | 16 | 4.94 | 0.16 | 7 |
| LNU778 | 78944.2 | 70.0 | 0.01 | 12 | 8.75 | 0.01 | 12 | 4.90 | 0.16 | 6 |
| LNU752 | 78153.10 | 75.8 | 0.26 | 22 | 9.48 | 0.26 | 22 | 5.24 | 0.16 | 13 |
| LNU752 | 78155.2 | 64.9 | 0.29 | 4 | 8.11 | 0.29 | 4 | 4.83 | 0.26 | 4 |
| CONT. | — | 62.3 | — | — | 7.79 | — | — | 4.63 | — | — |
| LNU977 | 78032.1 | 89.1 | 0.28 | 11 | — | — | — | — | — | — |
| LNU933 | 78897.1 | — | — | — | — | — | — | 5.57 | 0.24 | 6 |
| LNU880 | 78197.2 | 85.7 | 0.28 | 7 | — | — | — | — | — | — |
| LNU871 | 78195.4 | 90.4 | 0.07 | 12 | 11.3 | 0.11 | 10 | 5.46 | 0.23 | 4 |
| LNU848 | 77906.2 | — | — | — | — | — | — | 5.58 | 0.06 | 6 |
| LNU847 | 78967.2 | 87.7 | 0.07 | 9 | 11.0 | 0.14 | 7 | 5.39 | 0.20 | 2 |
| LNU846 | 78438.2 | — | — | — | — | — | — | 5.53 | 0.12 | 5 |
| LNU846 | 78439.2 | — | — | — | — | — | — | 5.52 | 0.22 | 5 |
| LNU846 | 78439.4 | 105.8 | L | 32 | 13.2 | L | 29 | 6.04 | L | 15 |
| LNU828 | 77598.3 | 96.6 | 0.17 | 20 | 12.1 | 0.20 | 18 | 5.85 | 0.10 | 11 |
| LNU823 | 78122.2 | 90.5 | 0.25 | 13 | — | — | — | 5.62 | 0.30 | 7 |
| LNU772 | 78938.1 | 105.8 | 0.14 | 32 | 13.2 | 0.15 | 29 | 6.10 | 0.26 | 16 |
| LNU757 | 77485.4 | 93.2 | L | 16 | 11.7 | 0.01 | 14 | 5.63 | 0.08 | 7 |
| CONT. | — | 80.4 | — | — | 10.2 | — | — | 5.26 | — | — |
| LNU972 | 78907.1 | 79.1 | 0.15 | 21 | 9.89 | 0.15 | 21 | 5.43 | 0.24 | 9 |
| LNU972 | 78908.2 | 77.3 | 0.06 | 18 | 9.66 | 0.06 | 18 | 5.40 | L | 8 |
| LNU972 | 78909.3 | 88.0 | 0.12 | 35 | 11.0 | 0.12 | 35 | 5.78 | 0.09 | 16 |
| LNU961 | 79143.3 | 78.3 | 0.01 | 20 | 9.79 | 0.01 | 20 | 5.51 | L | 10 |
| LNU961 | 79143.4 | 72.6 | 0.13 | 11 | 9.07 | 0.13 | 11 | 5.42 | 0.05 | 9 |
| LNU961 | 79145.3 | 79.1 | 0.01 | 21 | 9.89 | 0.01 | 21 | 5.38 | L | 8 |
| LNU961 | 79145.6 | 70.6 | 0.24 | 8 | 8.83 | 0.24 | 8 | 5.14 | 0.19 | 3 |
| LNU958 | 77687.2 | 87.1 | L | 33 | 10.9 | L | 33 | 5.75 | L | 15 |
| LNU958 | 77687.5 | 83.6 | L | 28 | 10.5 | L | 28 | 5.72 | L | 15 |
| LNU958 | 77689.1 | 84.4 | L | 29 | 10.6 | L | 29 | 5.76 | L | 16 |
| LNU958 | 77689.2 | 76.8 | 0.15 | 17 | 9.59 | 0.15 | 17 | 5.37 | 0.22 | 8 |
| LNU948 | 78378.1 | 83.1 | L | 27 | 10.4 | L | 27 | 5.66 | L | 13 |
| LNU948 | 78379.4 | 77.8 | 0.19 | 19 | 9.73 | 0.19 | 19 | — | — | — |
| LNU948 | 78380.2 | 84.5 | L | 29 | 10.6 | L | 29 | 5.64 | L | 13 |
| LNU948 | 78380.3 | 71.6 | 0.27 | 9 | 8.95 | 0.27 | 9 | 5.21 | 0.09 | 5 |
| LNU921 | 79063.2 | 82.4 | L | 26 | 10.3 | L | 26 | 5.53 | L | 11 |
| LNU921 | 79064.2 | — | — | — | — | — | — | 5.25 | 0.05 | 5 |
| LNU921 | 79064.3 | 74.3 | 0.14 | 14 | 9.28 | 0.14 | 14 | 5.34 | 0.07 | 7 |
| LNU913 | 78592.1 | 79.5 | L | 22 | 9.94 | L | 22 | 5.36 | 0.01 | 7 |
| LNU913 | 78592.3 | 77.5 | 0.14 | 18 | 9.69 | 0.14 | 18 | 5.39 | 0.21 | 8 |
| LNU913 | 78592.4 | 86.6 | L | 32 | 10.8 | L | 32 | 5.73 | 0.07 | 15 |
| LNU913 | 78593.1 | 86.4 | L | 32 | 10.8 | L | 32 | 5.63 | L | 13 |
| LNU913 | 78593.6 | 92.6 | L | 42 | 11.6 | L | 42 | 5.96 | L | 20 |
| LNU912 | 78401.3 | — | — | — | — | — | — | 5.25 | 0.18 | 5 |
| LNU912 | 78403.2 | 83.9 | 0.06 | 28 | 10.5 | 0.06 | 28 | 5.70 | 0.06 | 14 |
| LNU912 | 78404.1 | 80.3 | L | 23 | 10.0 | L | 23 | 5.44 | L | 9 |
| LNU889 | 79601.4 | 76.4 | 0.03 | 17 | 9.55 | 0.03 | 17 | 5.42 | L | 9 |
| LNU889 | 79602.4 | — | — | — | — | — | — | 5.27 | 0.21 | 6 |
| LNU881 | 78372.2 | 91.4 | L | 40 | 11.4 | L | 40 | 5.88 | L | 18 |
| LNU881 | 78373.1 | 73.9 | 0.14 | 13 | 9.24 | 0.14 | 13 | — | — | — |
| LNU881 | 78373.2 | 91.7 | L | 40 | 11.5 | L | 40 | 5.96 | 0.01 | 19 |
| LNU823 | 78136.4 | 87.2 | L | 33 | 10.9 | L | 33 | 5.68 | 0.05 | 14 |
| LNU816 | 78957.1 | 76.3 | 0.04 | 17 | 9.54 | 0.04 | 17 | 5.42 | 0.02 | 9 |
| LNU816 | 78958.4 | 86.4 | L | 32 | 10.8 | L | 32 | 5.60 | L | 12 |
| LNU816 | 78958.7 | 96.1 | 0.02 | 47 | 12.0 | 0.02 | 47 | 6.27 | 0.01 | 26 |
| LNU809 | 79168.3 | 77.9 | 0.14 | 19 | 9.74 | 0.14 | 19 | 5.46 | 0.18 | 9 |
| LNU809 | 79169.2 | 78.2 | 0.17 | 20 | 9.77 | 0.17 | 20 | 5.32 | 0.21 | 7 |
| LNU783 | 79176.3 | 74.1 | 0.14 | 13 | 9.26 | 0.14 | 13 | — | — | — |
| LNU783 | 79176.6 | 77.0 | 0.03 | 18 | 9.62 | 0.03 | 18 | 5.44 | 0.08 | 9 |
| LNU783 | 79178.4 | 70.3 | 0.27 | 7 | 8.79 | 0.27 | 7 | 5.54 | L | 11 |
| LNU782 | 77441.1 | 84.1 | L | 29 | 10.5 | L | 29 | 5.45 | L | 9 |
| LNU782 | 77444.10 | 73.5 | 0.15 | 12 | 9.19 | 0.15 | 12 | 5.17 | 0.23 | 4 |
| LNU782 | 77444.9 | 91.8 | 0.07 | 40 | 11.5 | 0.07 | 40 | 6.19 | 0.03 | 24 |
| LNU772 | 78937.4 | — | — | — | — | — | — | 5.22 | 0.26 | 5 |
| LNU772 | 78938.1 | 96.4 | L | 47 | 12.1 | L | 47 | 6.07 | L | 22 |
| LNU772 | 78938.2 | 73.9 | 0.12 | 13 | 9.23 | 0.12 | 13 | 5.29 | 0.02 | 6 |
| LNU772 | 78940.2 | 78.9 | 0.04 | 21 | 9.87 | 0.04 | 21 | 5.43 | 0.12 | 9 |
| LNU762 | 79329.2 | 80.9 | L | 24 | 10.1 | L | 24 | 5.50 | L | 10 |
| LNU757 | 77481.1 | — | — | — | — | — | — | 5.12 | 0.23 | 3 |
| LNU757 | 77483.3 | 74.8 | 0.05 | 14 | 9.34 | 0.05 | 14 | 5.40 | L | 8 |
| CONT. | — | 65.4 | — | — | 8.18 | — | — | 4.99 | — | — |

TABLE 124-continued

Genes showing improved plant biomass production at limiting nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU907 | 78872.1 | — | — | — | — | — | — | 5.68 | 0.11 | 9 |
| LNU907 | 78872.3 | — | — | — | — | — | — | 5.32 | 0.21 | 2 |
| LNU882 | 78973.1 | 78.8 | L | 10 | 9.85 | L | 10 | 5.48 | L | 5 |
| LNU882 | 78973.4 | 85.5 | 0.23 | 20 | 10.7 | 0.23 | 20 | 5.74 | 0.17 | 10 |
| LNU871 | 78195.4 | 77.2 | L | 8 | 9.66 | L | 8 | 5.37 | 0.07 | 3 |
| LNU865 | 79761.7 | 80.8 | L | 13 | 10.1 | L | 13 | 5.49 | 0.14 | 5 |
| LNU847 | 78968.3 | — | — | — | — | — | — | 5.41 | 0.07 | 4 |
| LNU845 | 78917.3 | 75.2 | 0.29 | 5 | 9.40 | 0.29 | 5 | 5.34 | 0.11 | 2 |
| LNU835 | 78186.2 | 76.3 | 0.10 | 7 | 9.54 | 0.10 | 7 | — | — | — |
| LNU835 | 78189.1 | 73.5 | 0.26 | 3 | 9.19 | 0.26 | 3 | 5.34 | 0.27 | 2 |
| LNU807 | 79250.1 | 81.1 | 0.15 | 13 | 10.1 | 0.15 | 13 | 5.50 | L | 6 |
| LNU766 | 78931.1 | — | — | — | — | — | — | 5.31 | 0.28 | 2 |
| LNU766 | 78931.2 | — | — | — | — | — | — | 5.49 | 0.26 | 5 |
| LNU766 | 78932.1 | 88.4 | 0.16 | 24 | 11.1 | 0.16 | 24 | 5.78 | 0.16 | 11 |
| CONT. | — | 71.6 | — | — | 8.94 | — | — | 5.21 | — | — |
| LNU975 | 80622.1 | 62.2 | 0.11 | 26 | 7.78 | 0.11 | 26 | 4.99 | 0.19 | 11 |
| LNU975 | 80624.5 | 56.3 | L | 14 | 7.04 | L | 14 | 4.62 | 0.14 | 3 |
| LNU971 | 78395.1 | 57.1 | L | 15 | 7.14 | L | 15 | 4.82 | L | 7 |
| LNU971 | 78395.2 | 60.4 | L | 22 | 7.55 | L | 22 | 5.02 | L | 12 |
| LNU964 | 80548.6 | — | — | — | — | — | — | 4.58 | 0.26 | 2 |
| LNU960 | 78600.3 | 60.4 | 0.06 | 22 | 7.55 | 0.06 | 22 | 4.91 | 0.03 | 9 |
| LNU957 | 80437.8 | 52.0 | 0.13 | 5 | 6.50 | 0.13 | 5 | 4.70 | 0.07 | 5 |
| LNU955 | 80432.4 | 53.8 | 0.07 | 9 | 6.72 | 0.07 | 9 | 4.58 | 0.28 | 2 |
| LNU953 | 80427.1 | — | — | — | — | — | — | 4.76 | 0.29 | 6 |
| LNU949 | 80553.7 | 55.9 | L | 13 | 6.99 | L | 13 | 4.64 | 0.15 | 3 |
| LNU949 | 80553.8 | 55.1 | 0.09 | 11 | 6.89 | 0.09 | 11 | 4.74 | 0.02 | 5 |
| LNU949 | 80557.4 | — | — | — | — | — | — | 4.94 | 0.21 | 10 |
| LNU946 | 80648.2 | 52.2 | 0.24 | 5 | 6.52 | 0.24 | 5 | — | — | — |
| LNU944 | 79781.6 | 53.2 | 0.03 | 8 | 6.65 | 0.03 | 8 | 4.68 | 0.02 | 4 |
| LNU928 | 78213.1 | 53.7 | 0.28 | 9 | 6.71 | 0.28 | 9 | 4.67 | 0.05 | 4 |
| LNU917 | 77500.4 | — | — | — | — | — | — | 4.79 | 0.27 | 7 |
| LNU917 | 77500.6 | — | — | — | — | — | — | 4.82 | 0.06 | 7 |
| LNU906 | 79219.1 | — | — | — | — | — | — | 4.61 | 0.15 | 3 |
| LNU906 | 79219.6 | — | — | — | — | — | — | 4.69 | 0.08 | 4 |
| LNU904 | 78987.3 | — | — | — | — | — | — | 4.68 | 0.19 | 4 |
| LNU901 | 80474.1 | 57.2 | L | 16 | 7.15 | L | 16 | 4.77 | L | 6 |
| LNU901 | 80474.5 | 53.2 | 0.04 | 8 | 6.65 | 0.04 | 8 | 4.66 | 0.04 | 4 |
| LNU901 | 80476.5 | 59.5 | 0.16 | 20 | 7.44 | 0.16 | 20 | 4.81 | 0.17 | 7 |
| LNU899 | 79765.4 | — | — | — | — | — | — | 4.75 | 0.13 | 6 |
| LNU899 | 79766.2 | 52.3 | 0.17 | 6 | 6.54 | 0.17 | 6 | — | — | — |
| LNU899 | 79766.3 | 55.1 | 0.02 | 11 | 6.89 | 0.02 | 11 | — | — | — |
| LNU897 | 80445.2 | 69.1 | L | 40 | 8.63 | L | 40 | 5.15 | L | 15 |
| LNU892 | 80410.1 | 54.1 | 0.17 | 9 | 6.77 | 0.17 | 9 | — | — | — |
| LNU892 | 80414.5 | 53.5 | 0.02 | 8 | 6.68 | 0.02 | 8 | 4.63 | 0.09 | 3 |
| LNU884 | 80405.3 | 58.0 | L | 17 | 7.25 | L | 17 | 4.74 | L | 6 |
| LNU874 | 78366.3 | 61.6 | L | 24 | 7.70 | L | 24 | 5.05 | L | 12 |
| LNU874 | 78370.1 | 56.4 | L | 14 | 7.05 | L | 14 | 4.80 | 0.25 | 7 |
| LNU874 | 78370.3 | 56.6 | L | 14 | 7.08 | L | 14 | 4.82 | L | 7 |
| LNU873 | 80469.3 | 53.2 | 0.28 | 8 | 6.65 | 0.28 | 8 | — | — | — |
| LNU873 | 80473.3 | 55.1 | 0.09 | 11 | 6.88 | 0.09 | 11 | 4.62 | 0.14 | 3 |
| LNU873 | 80473.6 | 54.4 | 0.10 | 10 | 6.79 | 0.10 | 10 | 4.68 | 0.24 | 4 |
| LNU870 | 78501.1 | — | — | — | — | — | — | 4.70 | 0.03 | 5 |
| LNU870 | 78505.5 | 53.7 | 0.15 | 9 | 6.72 | 0.15 | 9 | 4.64 | 0.12 | 3 |
| LNU867 | 79590.4 | 61.1 | 0.13 | 23 | 7.63 | 0.13 | 23 | 4.89 | L | 9 |
| LNU867 | 79590.7 | 58.6 | L | 18 | 7.32 | L | 18 | 4.93 | 0.13 | 10 |
| LNU866 | 80443.2 | 52.9 | 0.04 | 7 | 6.62 | 0.04 | 7 | — | — | — |
| LNU862 | 79755.6 | — | — | — | — | — | — | 4.69 | 0.28 | 4 |
| LNU862 | 79757.1 | 54.9 | 0.16 | 11 | 6.87 | 0.16 | 11 | 4.82 | 0.27 | 7 |
| LNU862 | 79758.3 | — | — | — | — | — | — | 4.69 | 0.09 | 4 |
| LNU862 | 79758.5 | 70.4 | L | 42 | 8.80 | L | 42 | 5.41 | L | 20 |
| LNU856 | 79753.3 | 55.3 | L | 12 | 6.91 | L | 12 | 4.79 | L | 7 |
| LNU831 | 79331.7 | 67.1 | 0.08 | 35 | 8.38 | 0.08 | 35 | 5.18 | L | 15 |
| LNU829 | 77912.3 | 58.6 | 0.23 | 18 | 7.33 | 0.23 | 18 | 4.98 | 0.22 | 11 |
| LNU829 | 77914.2 | 55.7 | 0.25 | 13 | 6.96 | 0.25 | 13 | 4.78 | L | 6 |
| LNU817 | 80599.2 | 53.0 | 0.03 | 7 | 6.62 | 0.03 | 7 | — | — | — |
| LNU800 | 77896.1 | 59.7 | L | 21 | 7.46 | L | 21 | 4.84 | 0.06 | 8 |
| LNU800 | 77896.4 | 53.7 | 0.05 | 8 | 6.71 | 0.05 | 8 | 4.76 | 0.16 | 6 |
| LNU799 | 78672.7 | 57.7 | 0.03 | 17 | 7.21 | 0.03 | 17 | 4.84 | 0.11 | 8 |
| LNU799 | 78674.5 | 60.7 | 0.08 | 23 | 7.59 | 0.08 | 23 | 4.94 | 0.13 | 10 |
| LNU794 | 78522.1 | 61.8 | 0.18 | 25 | 7.73 | 0.18 | 25 | 4.81 | 0.15 | 7 |
| LNU794 | 78524.1 | — | — | — | — | — | — | 4.95 | 0.30 | 10 |

TABLE 124-continued

Genes showing improved plant biomass production at limiting nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU794 | 78524.5 | 58.6 | 0.24 | 18 | 7.33 | 0.24 | 18 | 4.93 | 0.20 | 10 |
| LNU794 | 78525.2 | 56.8 | L | 15 | 7.10 | L | 15 | 4.72 | L | 5 |
| LNU792 | 79161.2 | 51.6 | 0.28 | 4 | 6.45 | 0.28 | 4 | — | — | — |
| LNU778 | 78944.5 | 63.7 | L | 29 | 7.96 | L | 29 | 5.16 | L | 15 |
| LNU773 | 80399.1 | 57.2 | 0.01 | 16 | 7.16 | 0.01 | 16 | 4.79 | 0.23 | 7 |
| LNU763 | 77588.6 | 64.2 | L | 30 | 8.02 | L | 30 | 4.83 | 0.05 | 8 |
| LNU758 | 79739.10 | 63.0 | 0.15 | 27 | 7.88 | 0.15 | 27 | — | — | — |
| LNU753 | 77141.2 | 56.3 | L | 14 | 7.03 | L | 14 | 4.77 | L | 6 |
| LNU753 | 77143.3 | 57.6 | 0.02 | 16 | 7.19 | 0.02 | 16 | 4.79 | 0.07 | 7 |
| LNU753 | 77144.1 | 56.0 | L | 13 | 7.00 | L | 13 | 4.80 | L | 7 |
| LNU749 | 80792.2 | — | — | — | — | — | — | 4.76 | 0.17 | 6 |
| LNU749 | 80792.3 | 54.1 | 0.09 | 9 | 6.76 | 0.09 | 9 | 4.66 | 0.07 | 4 |
| CONT. | — | 49.5 | — | — | 6.19 | — | — | 4.49 | — | — |
| LNU970 | 78390.3 | 101.4 | 0.22 | 8 | 12.7 | 0.22 | 8 | — | — | — |
| LNU893 | 77154.4 | 105.3 | 0.09 | 12 | 13.2 | 0.09 | 12 | 5.96 | 0.18 | 6 |
| LNU885 | 78416.5 | — | — | — | — | — | — | 6.04 | 0.24 | 7 |
| LNU790 | 78890.1 | 121.6 | L | 29 | 15.2 | L | 29 | 6.42 | 0.01 | 14 |
| CONT. | — | 94.1 | — | — | 11.8 | — | — | 5.64 | — | — |
| LNU947 | 77448.4 | 104.8 | L | 33 | 13.1 | L | 31 | 5.95 | L | 12 |
| LNU940 | 77811.6 | 90.4 | 0.27 | 15 | — | — | — | — | — | — |
| LNU940 | 77813.1 | 96.4 | 0.01 | 23 | 12.0 | L | 21 | 5.73 | 0.03 | 8 |
| LNU900 | 78851.3 | 94.7 | 0.07 | 20 | 11.8 | 0.09 | 19 | 5.60 | 0.10 | 6 |
| LNU898 | 78983.4 | 96.3 | 0.10 | 23 | 12.0 | 0.13 | 21 | 5.81 | 0.05 | 10 |
| LNU894 | 78283.4 | 85.5 | 0.25 | 9 | 10.7 | 0.28 | 7 | 5.49 | 0.25 | 4 |
| LNU894 | 78283.7 | 102.3 | L | 30 | 12.8 | L | 28 | 5.96 | L | 13 |
| LNU846 | 78436.2 | 87.5 | 0.26 | 11 | 10.9 | 0.30 | 10 | — | — | — |
| LNU846 | 78439.4 | 103.6 | 0.07 | 32 | 13.0 | 0.09 | 30 | 6.04 | 0.08 | 14 |
| LNU820 | 77807.2 | 89.2 | 0.22 | 14 | 11.2 | 0.26 | 12 | — | — | — |
| LNU820 | 77809.1 | 86.5 | 0.15 | 10 | 10.8 | 0.15 | 8 | — | — | — |
| LNU815 | 77492.6 | 85.2 | 0.22 | 8 | 10.7 | 0.23 | 7 | — | — | — |
| LNU815 | 77494.1 | 103.8 | 0.02 | 32 | 13.0 | 0.03 | 30 | 5.94 | L | 12 |
| LNU814 | 78953.2 | 84.6 | 0.25 | 8 | 10.6 | 0.27 | 6 | — | — | — |
| LNU811 | 78176.8 | 86.8 | 0.22 | 10 | 10.9 | 0.24 | 9 | — | — | — |
| LNU811 | 78179.1 | 97.6 | 0.22 | 24 | 12.2 | 0.25 | 22 | 5.78 | 0.25 | 9 |
| LNU811 | 78180.3 | 85.4 | 0.21 | 9 | 10.7 | 0.22 | 7 | — | — | — |
| LNU797 | 78025.3 | — | — | — | — | — | — | 5.59 | 0.16 | 6 |
| LNU793 | 78168.1 | 87.7 | 0.11 | 11 | 11.0 | 0.10 | 10 | — | — | — |
| LNU793 | 78169.1 | 85.3 | 0.21 | 8 | 10.7 | 0.21 | 7 | — | — | — |
| LNU769 | 78163.4 | 85.6 | 0.23 | 9 | 10.7 | 0.25 | 7 | — | — | — |
| LNU756 | 77581.3 | 90.6 | 0.06 | 15 | 11.3 | 0.05 | 14 | 5.51 | 0.18 | 4 |
| LNU751 | 77478.3 | 90.0 | 0.10 | 14 | 11.3 | 0.12 | 13 | — | — | — |
| CONT. | — | 78.6 | — | — | 9.97 | — | — | 5.30 | — | — |
| LNU965 | 78360.5 | 112.4 | 0.02 | 20 | 14.0 | 0.06 | 18 | — | — | — |
| LNU943 | 78407.2 | 110.0 | 0.10 | 17 | 13.8 | 0.15 | 15 | — | — | — |
| LNU913 | 78593.1 | 115.2 | 0.01 | 23 | 14.4 | 0.04 | 21 | 6.19 | 0.07 | 8 |
| LNU833 | 78184.1 | 101.4 | 0.07 | 8 | 12.7 | 0.09 | 6 | 5.85 | 0.14 | 2 |
| LNU764 | 78926.1 | 103.8 | 0.01 | 11 | 13.0 | L | 9 | 5.97 | 0.18 | 4 |
| CONT. | — | 93.7 | — | — | 11.9 | — | — | 5.75 | — | — |

"CONT."—Control;
"Ave."—Average;
"% Incr." = % increment;
"p-val."—p-value;
L means that p-value is less than 0.01, p < 0.1 was considered as significant.

The genes listed in Table 125 improved plant NUE when grown at limiting nitrogen concentration levels. These genes produced faster developing plants when grown under limiting nitrogen growth conditions, compared to control plants, grown under identical conditions as measured by growth rate of leaf number, rosette diameter and plot coverage.

TABLE 125

Genes showing improved rosette growth performance at limiting nitrogen growth conditions

| Gene Name | Event # | RGR Of Leaf Number | | | RGR Of Plot Coverage [cm²/day] | | | RGR Of Rosette Diameter [cm/day] | | |
|---|---|---|---|---|---|---|---|---|---|---|
| | | Ave. | P-Val. | % Incr. | Ave. | P-Val. | % Incr. | Ave. | P-Val. | % Incr. |
| LNU952 | 78218.1 | — | — | — | 5.74 | 0.18 | 17 | 0.354 | 0.12 | 13 |
| LNU952 | 78219.3 | — | — | — | — | — | — | 0.345 | 0.23 | 10 |
| LNU945 | 78998.2 | — | — | — | — | — | — | 0.347 | 0.20 | 10 |
| LNU920 | 78507.1 | — | — | — | 6.13 | 0.06 | 25 | 0.377 | 0.03 | 20 |
| LNU920 | 78508.1 | — | — | — | 5.90 | 0.10 | 20 | — | — | — |
| LNU920 | 78508.2 | — | — | — | 6.12 | 0.05 | 25 | 0.372 | 0.02 | 18 |
| LNU916 | 78208.3 | — | — | — | 5.84 | 0.15 | 19 | 0.349 | 0.19 | 11 |
| LNU914 | 80516.2 | — | — | — | 5.79 | 0.15 | 18 | 0.356 | 0.09 | 13 |
| LNU914 | 80516.4 | — | — | — | — | — | — | 0.344 | 0.24 | 10 |
| LNU911 | 80424.2 | — | — | — | — | — | — | 0.349 | 0.16 | 11 |
| LNU905 | 79674.3 | — | — | — | 5.56 | 0.28 | 13 | 0.349 | 0.21 | 11 |
| LNU905 | 79675.3 | — | — | — | 6.01 | 0.08 | 23 | 0.369 | 0.03 | 17 |
| LNU840 | 78676.1 | — | — | — | 5.78 | 0.15 | 18 | 0.368 | 0.04 | 17 |
| LNU840 | 78676.4 | — | — | — | 6.08 | 0.06 | 24 | 0.346 | 0.21 | 10 |
| LNU834_H1 | 80402.7 | — | — | — | 5.61 | 0.26 | 14 | 0.348 | 0.20 | 11 |
| LNU832_H2 | 80605.1 | — | — | — | — | — | — | 0.348 | 0.22 | 11 |
| LNU819 | 78133.3 | — | — | — | — | — | — | 0.342 | 0.26 | 9 |
| LNU791 | 77893.1 | — | — | — | 6.26 | 0.04 | 28 | 0.381 | 0.01 | 21 |
| LNU791 | 77893.2 | — | — | — | 5.77 | 0.16 | 18 | 0.357 | 0.09 | 14 |
| LNU760_H1 | 80127.2 | — | — | — | 6.04 | 0.08 | 23 | 0.358 | 0.09 | 14 |
| CONT. | — | — | — | — | 4.90 | — | — | 0.314 | — | — |
| LNU966 | 78604.1 | 0.819 | 0.23 | 12 | 9.03 | 0.03 | 29 | — | — | — |
| LNU966 | 78605.5 | 0.839 | 0.15 | 15 | 9.63 | L | 38 | 0.374 | 0.25 | 11 |
| LNU966 | 78605.7 | — | — | — | 8.64 | 0.04 | 24 | 0.375 | 0.23 | 11 |
| LNU941 | 78611.1 | 0.833 | 0.13 | 14 | 8.08 | 0.16 | 16 | — | — | — |
| LNU941 | 78613.1 | — | — | — | 8.95 | 0.02 | 28 | 0.381 | 0.17 | 13 |
| LNU941 | 78613.5 | — | — | — | 8.12 | 0.22 | 16 | — | — | — |
| LNU941 | 78615.3 | 0.812 | 0.28 | 11 | 8.86 | 0.02 | 27 | 0.376 | 0.22 | 11 |
| LNU925 | 78992.1 | — | — | — | 9.16 | 0.02 | 31 | 0.385 | 0.16 | 14 |
| LNU925 | 78992.6 | — | — | — | — | — | — | 0.371 | 0.29 | 10 |
| LNU922 | 78290.1 | 0.833 | 0.18 | 14 | 8.73 | 0.05 | 25 | — | — | — |
| LNU918 | 78433.1 | 0.805 | 0.22 | 10 | — | — | — | — | — | — |
| LNU918 | 78433.2 | — | — | — | 8.28 | 0.13 | 18 | — | — | — |
| LNU918 | 78433.3 | — | — | — | 8.35 | 0.08 | 20 | — | — | — |
| LNU918 | 78433.8 | 0.841 | 0.08 | 15 | — | — | — | — | — | — |
| LNU918 | 78434.2 | — | — | — | 7.84 | 0.27 | 12 | 0.375 | 0.22 | 11 |
| LNU915 | 78426.1 | — | — | — | 8.47 | 0.07 | 21 | 0.375 | 0.24 | 11 |
| LNU915 | 78427.1 | — | — | — | 8.24 | 0.14 | 18 | — | — | — |
| LNU915 | 78428.1 | 0.880 | 0.03 | 21 | 9.41 | L | 35 | — | — | — |
| LNU915 | 78428.2 | 0.812 | 0.20 | 11 | 7.87 | 0.26 | 13 | — | — | — |
| LNU909 | 78424.3 | 0.832 | 0.12 | 14 | 8.23 | 0.13 | 18 | — | — | — |
| LNU909 | 78425.4 | 0.802 | 0.26 | 10 | 8.36 | 0.11 | 20 | — | — | — |
| LNU909 | 78425.5 | 0.858 | 0.09 | 18 | 9.77 | L | 40 | 0.390 | 0.15 | 16 |
| LNU909 | 78425.7 | — | — | — | 8.12 | 0.16 | 16 | — | — | — |
| LNU890 | 78202.1 | 0.871 | 0.05 | 19 | 8.89 | 0.02 | 27 | — | — | — |
| LNU854 | 78238.1 | — | — | — | 8.07 | 0.18 | 16 | — | — | — |
| LNU854 | 78240.1 | — | — | — | 8.49 | 0.10 | 22 | 0.383 | 0.24 | 14 |
| LNU849 | 78498.4 | — | — | — | 8.44 | 0.06 | 21 | — | — | — |
| LNU849 | 78499.1 | — | — | — | 8.31 | 0.10 | 19 | — | — | — |
| LNU849 | 78500.3 | — | — | — | 8.66 | 0.07 | 24 | 0.380 | 0.24 | 13 |
| LNU830 | 78741.3 | — | — | — | 8.18 | 0.15 | 17 | 0.378 | 0.22 | 12 |
| LNU830 | 78741.5 | 0.917 | 0.05 | 26 | 9.41 | L | 35 | 0.379 | 0.22 | 12 |
| LNU824 | 77826.1 | 0.877 | 0.07 | 20 | 9.81 | L | 40 | 0.403 | 0.06 | 20 |
| LNU824 | 77828.4 | — | — | — | 8.21 | 0.13 | 17 | — | — | — |
| LNU824 | 77829.3 | — | — | — | 8.66 | 0.04 | 24 | — | — | — |
| LNU822 | 78623.2 | — | — | — | 9.81 | L | 40 | 0.398 | 0.13 | 18 |
| LNU822 | 78623.6 | 0.809 | 0.27 | 11 | 10.5 | L | 50 | 0.418 | 0.02 | 24 |
| LNU822 | 78623.7 | 0.817 | 0.23 | 12 | 8.88 | 0.03 | 27 | 0.379 | 0.20 | 13 |
| LNU822 | 78625.2 | 0.828 | 0.28 | 13 | 9.05 | 0.03 | 29 | 0.381 | 0.23 | 13 |
| LNU822 | 78625.7 | — | — | — | 8.20 | 0.16 | 17 | — | — | — |
| LNU813 | 77682.3 | — | — | — | 9.07 | 0.02 | 30 | 0.399 | 0.07 | 18 |
| LNU806 | 78514.2 | — | — | — | 10.4 | L | 48 | 0.428 | L | 27 |
| LNU806 | 78515.3 | — | — | — | 8.21 | 0.12 | 18 | — | — | — |
| LNU806 | 78515.4 | 0.876 | 0.04 | 20 | 8.08 | 0.17 | 16 | — | — | — |
| LNU806 | 78515.5 | 0.895 | 0.05 | 23 | 8.97 | 0.02 | 28 | — | — | — |

TABLE 125-continued

Genes showing improved rosette growth performance at limiting nitrogen growth conditions

| Gene Name | Event # | RGR Of Leaf Number | | | RGR Of Plot Coverage [cm²/day] | | | RGR Of Rosette Diameter [cm/day] | | |
|---|---|---|---|---|---|---|---|---|---|---|
| | | Ave. | P-Val. | % Incr. | Ave. | P-Val. | % Incr. | Ave. | P-Val. | % Incr. |
| LNU802 | 80307.3 | — | — | — | 7.86 | 0.26 | 13 | — | — | — |
| LNU802 | 80309.2 | — | — | — | 7.87 | 0.28 | 13 | — | — | — |
| LNU802 | 80309.3 | — | — | — | 8.00 | 0.21 | 15 | — | — | — |
| LNU802 | 80310.1 | — | — | — | 8.08 | 0.17 | 16 | — | — | — |
| LNU779 | 77887.2 | 0.822 | 0.18 | 13 | 9.09 | 0.01 | 30 | 0.377 | 0.23 | 12 |
| LNU761 | 78157.6 | 0.828 | 0.20 | 13 | 8.18 | 0.14 | 17 | — | — | — |
| LNU761 | 78159.1 | — | — | — | 7.91 | 0.25 | 13 | — | — | — |
| LNU761 | 78160.3 | 0.848 | 0.12 | 16 | 9.99 | L | 43 | 0.410 | 0.03 | 22 |
| CONT. | — | 0.730 | — | — | 6.99 | — | — | 0.337 | — | — |
| LNU976 | 78364.1 | — | — | — | 5.53 | L | 48 | 0.334 | 0.01 | 27 |
| LNU970 | 78388.1 | — | — | — | 4.43 | 0.15 | 18 | — | — | — |
| LNU970 | 78389.8 | 0.669 | 0.27 | 14 | 5.28 | L | 41 | 0.299 | 0.20 | 13 |
| LNU968 | 77919.4 | — | — | — | 4.44 | 0.15 | 19 | — | — | — |
| LNU963 | 78383.4 | — | — | — | 4.46 | 0.14 | 19 | — | — | — |
| LNU962 | 78635.8 | 0.666 | 0.27 | 13 | — | — | — | — | — | — |
| LNU950 | 78913.4 | — | — | — | 4.81 | 0.03 | 29 | 0.297 | 0.24 | 13 |
| LNU950 | 78915.2 | — | — | — | 4.35 | 0.20 | 16 | — | — | — |
| LNU949 | 80553.5 | — | — | — | 4.56 | 0.11 | 22 | 0.299 | 0.23 | 14 |
| LNU949 | 80553.8 | — | — | — | 4.80 | 0.03 | 28 | — | — | — |
| LNU949 | 80557.4 | — | — | — | 4.25 | 0.30 | 14 | — | — | — |
| LNU934 | 79008.1 | — | — | — | — | — | — | 0.297 | 0.22 | 13 |
| LNU908 | 79738.5 | 0.670 | 0.28 | 14 | — | — | — | — | — | — |
| LNU902 | 79606.5 | — | — | — | 4.51 | 0.12 | 21 | — | — | — |
| LNU875 | 78413.4 | — | — | — | 4.40 | 0.19 | 18 | — | — | — |
| LNU873 | 80473.4 | — | — | — | 4.40 | 0.20 | 18 | 0.300 | 0.21 | 14 |
| LNU843 | 78962.4 | — | — | — | 4.61 | 0.08 | 23 | — | — | — |
| LNU843 | 78963.2 | — | — | — | 4.35 | 0.20 | 16 | — | — | — |
| LNU790 | 78886.2 | 0.697 | 0.16 | 18 | 4.94 | 0.02 | 32 | — | — | — |
| LNU790 | 78886.3 | 0.677 | 0.27 | 15 | 4.25 | 0.28 | 14 | 0.292 | 0.30 | 11 |
| LNU790 | 78889.2 | 0.686 | 0.21 | 17 | — | — | — | — | — | — |
| LNU787 | 80547.7 | 0.721 | 0.09 | 22 | — | — | — | — | — | — |
| LNU767 | 79146.1 | 0.695 | 0.20 | 18 | 5.12 | L | 37 | 0.302 | 0.17 | 15 |
| LNU767 | 79146.2 | — | — | — | 4.43 | 0.15 | 19 | 0.300 | 0.18 | 14 |
| CONT. | — | 0.589 | — | — | 3.74 | — | — | 0.263 | — | — |
| LNU966 | 78605.5 | 0.819 | 0.20 | 17 | — | — | — | — | — | — |
| LNU941 | 78614.2 | — | — | — | 13.8 | 0.19 | 23 | — | — | — |
| LNU922 | 78287.3 | 0.798 | 0.26 | 14 | — | — | — | — | — | — |
| LNU915 | 78428.2 | 0.807 | 0.26 | 15 | — | — | — | — | — | — |
| LNU854 | 78237.2 | — | — | — | 14.2 | 0.14 | 27 | — | — | — |
| LNU830 | 78741.5 | — | — | — | 13.3 | 0.28 | 19 | — | — | — |
| LNU813 | 77685.1 | — | — | — | 13.6 | 0.21 | 22 | — | — | — |
| LNU751 | 77477.1 | 0.878 | 0.07 | 25 | — | — | — | — | — | — |
| CONT. | — | 0.702 | — | — | 11.2 | — | — | — | — | — |
| LNU948 | 78378.1 | — | — | — | 10.5 | 0.04 | 22 | — | — | — |
| LNU888 | 78771.1 | — | — | — | 10.7 | 0.05 | 25 | 0.481 | 0.05 | 24 |
| LNU881 | 78372.2 | — | — | — | 9.74 | 0.19 | 13 | — | — | — |
| LNU857 | 78867.2 | — | — | — | 9.70 | 0.23 | 13 | — | — | — |
| LNU816 | 78958.5 | — | — | — | 10.9 | 0.02 | 26 | 0.481 | 0.02 | 24 |
| LNU816 | 78958.7 | — | — | — | 10.4 | 0.05 | 21 | 0.449 | 0.10 | 16 |
| LNU809 | 79168.2 | — | — | — | 10.1 | 0.15 | 17 | — | — | — |
| LNU809 | 79168.3 | — | — | — | 9.60 | 0.28 | 11 | 0.430 | 0.26 | 11 |
| LNU807 | 79248.1 | — | — | — | — | — | — | 0.430 | 0.24 | 11 |
| LNU795 | 79525.1 | — | — | — | 9.66 | 0.24 | 12 | — | — | — |
| LNU795 | 79525.5 | — | — | — | — | — | — | 0.429 | 0.23 | 11 |
| LNU788 | 78516.1 | — | — | — | 10.8 | 0.02 | 25 | 0.454 | 0.14 | 17 |
| LNU788 | 78518.1 | — | — | — | 12.2 | L | 41 | 0.466 | 0.04 | 20 |
| LNU783 | 79178.2 | — | — | — | — | — | — | 0.446 | 0.19 | 15 |
| LNU778 | 78941.1 | — | — | — | 10.0 | 0.15 | 16 | — | — | — |
| LNU778 | 78944.2 | — | — | — | 9.86 | 0.16 | 14 | 0.432 | 0.22 | 12 |
| LNU752 | 78153.10 | — | — | — | 11.1 | 0.03 | 29 | 0.503 | 0.01 | 30 |
| CONT. | — | — | — | — | 8.61 | — | — | 0.388 | — | — |
| LNU933 | 78897.1 | 0.890 | 0.12 | 17 | — | — | — | — | — | — |
| LNU882 | 78975.3 | 0.863 | 0.23 | 13 | — | — | — | — | — | — |
| LNU880 | 78196.1 | — | — | — | — | — | — | 0.490 | 0.30 | 9 |
| LNU880 | 78200.6 | — | — | — | 12.0 | 0.15 | 21 | 0.502 | 0.18 | 11 |
| LNU848 | 77906.2 | — | — | — | 11.6 | 0.24 | 17 | — | — | — |
| LNU848 | 77907.4 | 0.866 | 0.18 | 14 | — | — | — | — | — | — |
| LNU847 | 78967.2 | 0.892 | 0.13 | 17 | — | — | — | — | — | — |
| LNU847 | 78967.4 | 0.858 | 0.23 | 13 | — | — | — | — | — | — |
| LNU846 | 78436.2 | 0.938 | 0.04 | 23 | — | — | — | — | — | — |
| LNU846 | 78438.2 | — | — | — | — | — | — | 0.502 | 0.16 | 11 |

TABLE 125-continued

Genes showing improved rosette growth performance at limiting nitrogen growth conditions

| Gene Name | Event # | RGR Of Leaf Number | | | RGR Of Plot Coverage [cm²/day] | | | RGR Of Rosette Diameter [cm/day] | | |
|---|---|---|---|---|---|---|---|---|---|---|
| | | Ave. | P-Val. | % Incr. | Ave. | P-Val. | % Incr. | Ave. | P-Val. | % Incr. |
| LNU846 | 78439.4 | 0.852 | 0.26 | 12 | 13.1 | 0.02 | 32 | 0.506 | 0.13 | 12 |
| LNU828 | 77598.3 | 0.876 | 0.16 | 15 | 12.0 | 0.14 | 21 | 0.512 | 0.11 | 14 |
| LNU814 | 78953.3 | 0.885 | 0.15 | 16 | — | — | — | — | — | — |
| LNU814 | 78955.4 | 0.865 | 0.23 | 13 | — | — | — | — | — | — |
| LNU772 | 78937.4 | 0.849 | 0.29 | 11 | — | — | — | — | — | — |
| LNU772 | 78938.1 | — | — | — | 13.0 | 0.04 | 31 | 0.500 | 0.21 | 11 |
| LNU772 | 78940.2 | 0.861 | 0.26 | 13 | — | — | — | — | — | — |
| LNU757 | 77485.4 | — | — | — | 11.6 | 0.23 | 17 | — | — | — |
| LNU750 | 78863.2 | — | — | — | — | — | — | 0.493 | 0.23 | 9 |
| CONT. | — | 0.762 | — | — | 9.91 | — | — | 0.451 | — | — |
| LNU972 | 78907.1 | — | — | — | 9.59 | 0.11 | 22 | — | — | — |
| LNU972 | 78908.2 | 0.810 | 0.24 | 14 | 9.30 | 0.17 | 18 | 0.443 | 0.13 | 13 |
| LNU972 | 78909.3 | 0.862 | 0.08 | 22 | 10.8 | 0.01 | 38 | 0.481 | 0.02 | 23 |
| LNU961 | 79143.3 | — | — | — | 9.64 | 0.10 | 23 | 0.455 | 0.07 | 16 |
| LNU961 | 79143.4 | — | — | — | — | — | — | 0.438 | 0.18 | 12 |
| LNU961 | 79145.3 | 0.801 | 0.27 | 13 | 9.44 | 0.14 | 20 | 0.443 | 0.13 | 13 |
| LNU961 | 79145.6 | 0.806 | 0.26 | 14 | — | — | — | — | — | — |
| LNU958 | 77687.2 | 0.893 | 0.05 | 26 | 10.5 | 0.02 | 33 | 0.492 | L | 26 |
| LNU958 | 77687.5 | — | — | — | 9.85 | 0.06 | 25 | 0.448 | 0.10 | 14 |
| LNU958 | 77689.1 | — | — | — | 10.2 | 0.03 | 30 | 0.479 | 0.02 | 22 |
| LNU958 | 77689.2 | — | — | — | 9.40 | 0.15 | 20 | 0.440 | 0.17 | 12 |
| LNU948 | 78378.1 | 0.810 | 0.26 | 14 | 10.0 | 0.04 | 28 | 0.472 | 0.02 | 20 |
| LNU948 | 78379.4 | — | — | — | 9.34 | 0.17 | 19 | 0.437 | 0.20 | 12 |
| LNU948 | 78380.2 | 0.836 | 0.14 | 18 | 10.1 | 0.04 | 29 | 0.443 | 0.14 | 13 |
| LNU921 | 79063.2 | 0.889 | 0.04 | 25 | 10.1 | 0.04 | 28 | 0.445 | 0.12 | 14 |
| LNU921 | 79064.3 | 0.806 | 0.28 | 14 | — | — | — | 0.433 | 0.23 | 11 |
| LNU913 | 78592.1 | — | — | — | 9.58 | 0.11 | 22 | — | — | — |
| LNU913 | 78592.3 | 0.798 | 0.29 | 13 | 9.17 | 0.22 | 17 | — | — | — |
| LNU913 | 78592.4 | — | — | — | 10.4 | 0.02 | 32 | 0.454 | 0.09 | 16 |
| LNU913 | 78593.1 | 0.831 | 0.16 | 17 | 10.4 | 0.02 | 32 | 0.452 | 0.08 | 16 |
| LNU913 | 78593.6 | — | — | — | 11.1 | L | 42 | 0.482 | 0.01 | 23 |
| LNU912 | 78401.3 | — | — | — | — | — | — | 0.431 | 0.28 | 10 |
| LNU912 | 78403.2 | — | — | — | 10.1 | 0.04 | 28 | 0.462 | 0.05 | 18 |
| LNU912 | 78404.1 | 0.806 | 0.25 | 14 | 9.74 | 0.08 | 24 | 0.441 | 0.16 | 13 |
| LNU889 | 79601.4 | — | — | — | 9.11 | 0.23 | 16 | 0.433 | 0.23 | 11 |
| LNU889 | 79602.4 | 0.802 | 0.29 | 13 | 9.30 | 0.19 | 18 | — | — | — |
| LNU888 | 78772.2 | 0.804 | 0.30 | 13 | — | — | — | — | — | — |
| LNU881 | 78372.2 | 0.833 | 0.15 | 18 | 10.9 | L | 39 | 0.471 | 0.02 | 20 |
| LNU881 | 78373.1 | 0.846 | 0.12 | 19 | — | — | — | — | — | — |
| LNU881 | 78373.2 | 0.831 | 0.20 | 17 | 10.8 | 0.01 | 37 | 0.466 | 0.04 | 19 |
| LNU823 | 78136.4 | 0.856 | 0.10 | 21 | 10.5 | 0.02 | 34 | 0.466 | 0.04 | 19 |
| LNU816 | 78957.1 | — | — | — | 9.02 | 0.27 | 15 | — | — | — |
| LNU816 | 78958.4 | — | — | — | 10.5 | 0.01 | 34 | 0.455 | 0.07 | 16 |
| LNU816 | 78958.7 | — | — | — | 11.3 | L | 44 | 0.497 | L | 27 |
| LNU809 | 79168.3 | — | — | — | 9.38 | 0.17 | 19 | 0.456 | 0.07 | 16 |
| LNU809 | 79169.2 | — | — | — | 9.42 | 0.15 | 20 | 0.444 | 0.13 | 13 |
| LNU783 | 79176.3 | — | — | — | 9.01 | 0.27 | 15 | — | — | — |
| LNU783 | 79176.6 | — | — | — | 9.33 | 0.16 | 19 | 0.445 | 0.13 | 14 |
| LNU783 | 79178.4 | — | — | — | — | — | — | 0.462 | 0.04 | 18 |
| LNU782 | 77441.1 | 0.884 | 0.07 | 25 | 10.1 | 0.04 | 29 | 0.428 | 0.28 | 9 |
| LNU782 | 77444.10 | 0.812 | 0.23 | 15 | — | — | — | — | — | — |
| LNU782 | 77444.2 | 0.798 | 0.29 | 13 | — | — | — | — | — | — |
| LNU782 | 77444.9 | — | — | — | 10.9 | L | 39 | 0.509 | L | 30 |
| LNU772 | 78938.1 | 0.945 | 0.02 | 33 | 11.7 | L | 49 | 0.506 | L | 29 |
| LNU772 | 78940.2 | — | — | — | 9.42 | 0.14 | 20 | — | — | — |
| LNU762 | 79329.2 | — | — | — | 9.70 | 0.09 | 23 | 0.440 | 0.15 | 12 |
| LNU757 | 77481.1 | 0.857 | 0.09 | 21 | — | — | — | — | — | — |
| LNU757 | 77483.2 | 0.820 | 0.21 | 16 | — | — | — | — | — | — |
| LNU757 | 77483.3 | 0.832 | 0.16 | 17 | — | — | — | 0.447 | 0.12 | 14 |
| CONT. | — | 0.708 | — | — | 7.85 | — | — | 0.391 | — | — |
| LNU882 | 78973.4 | — | — | — | 10.2 | 0.09 | 18 | 0.449 | 0.25 | 8 |
| LNU807 | 79250.1 | — | — | — | 9.82 | 0.18 | 14 | — | — | — |
| LNU766 | 78932.1 | — | — | — | 10.6 | 0.04 | 22 | — | — | — |
| CONT. | — | — | — | — | 8.64 | — | — | 0.416 | — | — |
| LNU975 | 80622.1 | — | — | — | 7.90 | L | 28 | 0.416 | 0.05 | 16 |
| LNU975 | 80624.5 | 0.743 | 0.20 | 19 | 7.02 | 0.14 | 14 | — | — | — |
| LNU971 | 78395.1 | — | — | — | 7.01 | 0.16 | 14 | — | — | — |
| LNU971 | 78395.2 | — | — | — | 7.28 | 0.06 | 18 | 0.400 | 0.13 | 12 |
| LNU960 | 78599.4 | 0.725 | 0.28 | 17 | — | — | — | — | — | — |
| LNU960 | 78600.3 | — | — | — | 7.49 | 0.03 | 22 | 0.400 | 0.13 | 12 |
| LNU957 | 80435.3 | 0.723 | 0.30 | 16 | — | — | — | — | — | — |

TABLE 125-continued

Genes showing improved rosette growth performance at limiting nitrogen growth conditions

| Gene Name | Event # | RGR Of Leaf Number | | | RGR Of Plot Coverage [cm²/day] | | | RGR Of Rosette Diameter [cm/day] | | |
|---|---|---|---|---|---|---|---|---|---|---|
| | | Ave. | P-Val. | % Incr. | Ave. | P-Val. | % Incr. | Ave. | P-Val. | % Incr. |
| LNU955 | 80432.3 | 0.735 | 0.24 | 18 | — | — | — | — | — | — |
| LNU955 | 80432.4 | — | — | — | 6.83 | 0.25 | 11 | — | — | — |
| LNU953 | 80429.1 | 0.722 | 0.30 | 16 | — | — | — | — | — | — |
| LNU949 | 80553.7 | — | — | — | 6.94 | 0.19 | 13 | — | — | — |
| LNU949 | 80557.4 | — | — | — | 7.12 | 0.12 | 16 | 0.396 | 0.19 | 11 |
| LNU928 | 78212.1 | 0.818 | 0.04 | 31 | — | — | — | — | — | — |
| LNU928 | 78213.1 | — | — | — | 6.82 | 0.25 | 11 | — | — | — |
| LNU923 | 77603.3 | — | — | — | — | — | — | 0.391 | 0.24 | 9 |
| LNU917 | 77500.4 | — | — | — | 6.91 | 0.25 | 12 | — | — | — |
| LNU906 | 79219.5 | 0.743 | 0.21 | 19 | — | — | — | — | — | — |
| LNU904 | 78987.2 | 0.775 | 0.11 | 25 | — | — | — | — | — | — |
| LNU901 | 80476.5 | — | — | — | 7.41 | 0.04 | 20 | — | — | — |
| LNU899 | 79765.4 | — | — | — | 6.88 | 0.22 | 12 | 0.395 | 0.18 | 10 |
| LNU899 | 79766.2 | — | — | — | — | — | — | 0.390 | 0.28 | 9 |
| LNU897 | 80445.2 | — | — | — | 8.64 | L | 40 | 0.431 | 0.01 | 20 |
| LNU892 | 80410.1 | — | — | — | — | — | — | 0.393 | 0.23 | 10 |
| LNU884 | 80405.3 | — | — | — | 7.35 | 0.04 | 19 | — | — | — |
| LNU884 | 80407.1 | — | — | — | 7.09 | 0.13 | 15 | — | — | — |
| LNU884 | 80408.2 | — | — | — | 7.12 | 0.15 | 16 | — | — | — |
| LNU884 | 80408.4 | — | — | — | 7.10 | 0.13 | 15 | 0.395 | 0.21 | 10 |
| LNU874 | 78366.3 | — | — | — | 7.47 | 0.03 | 21 | 0.402 | 0.11 | 12 |
| LNU874 | 78370.1 | — | — | — | 7.03 | 0.13 | 14 | — | — | — |
| LNU874 | 78370.3 | — | — | — | 7.05 | 0.12 | 15 | 0.398 | 0.15 | 11 |
| LNU874 | 78370.7 | 0.727 | 0.28 | 17 | — | — | — | — | — | — |
| LNU873 | 80469.1 | 0.771 | 0.12 | 24 | — | — | — | — | — | — |
| LNU873 | 80473.3 | — | — | — | 6.91 | 0.19 | 12 | — | — | — |
| LNU873 | 80473.6 | — | — | — | 6.88 | 0.21 | 12 | 0.400 | 0.13 | 12 |
| LNU870 | 78501.1 | — | — | — | — | — | — | 0.398 | 0.15 | 11 |
| LNU870 | 78505.1 | — | — | — | — | — | — | 0.401 | 0.14 | 12 |
| LNU867 | 79589.3 | — | — | — | — | — | — | 0.389 | 0.27 | 9 |
| LNU867 | 79590.3 | 0.746 | 0.22 | 20 | — | — | — | — | — | — |
| LNU867 | 79590.4 | — | — | — | 7.30 | 0.07 | 18 | — | — | — |
| LNU867 | 79590.7 | — | — | — | 7.30 | 0.05 | 19 | 0.405 | 0.10 | 13 |
| LNU866 | 80442.2 | 0.734 | 0.25 | 18 | — | — | — | — | — | — |
| LNU866 | 80443.2 | 0.752 | 0.17 | 21 | — | — | — | — | — | — |
| LNU866 | 80444.6 | — | — | — | 6.87 | 0.24 | 12 | 0.391 | 0.26 | 9 |
| LNU862 | 79757.1 | — | — | — | — | — | — | 0.391 | 0.26 | 9 |
| LNU862 | 79758.3 | — | — | — | — | — | — | 0.392 | 0.22 | 10 |
| LNU862 | 79758.5 | — | — | — | 8.82 | L | 43 | 0.459 | L | 28 |
| LNU856 | 79753.3 | — | — | — | 6.80 | 0.26 | 10 | — | — | — |
| LNU856 | 79753.5 | 0.742 | 0.21 | 19 | — | — | — | — | — | — |
| LNU831 | 79331.7 | — | — | — | 8.43 | L | 37 | 0.428 | 0.01 | 20 |
| LNU831 | 79335.2 | 0.783 | 0.10 | 26 | — | — | — | — | — | — |
| LNU829 | 77912.3 | — | — | — | 7.24 | 0.07 | 18 | 0.399 | 0.16 | 11 |
| LNU829 | 77914.1 | 0.774 | 0.11 | 24 | — | — | — | — | — | — |
| LNU829 | 77914.2 | — | — | — | 6.90 | 0.21 | 12 | 0.398 | 0.15 | 11 |
| LNU817 | 80598.1 | — | — | — | 6.81 | 0.28 | 11 | — | — | — |
| LNU800 | 77896.1 | — | — | — | 7.38 | 0.04 | 20 | — | — | — |
| LNU799 | 78672.5 | 0.725 | 0.29 | 17 | — | — | — | — | — | — |
| LNU799 | 78672.7 | — | — | — | 7.09 | 0.11 | 15 | — | — | — |
| LNU799 | 78674.2 | — | — | — | 7.03 | 0.15 | 14 | — | — | — |
| LNU799 | 78674.5 | — | — | — | 7.50 | 0.02 | 22 | 0.406 | 0.10 | 13 |
| LNU796 | 78235.5 | 0.755 | 0.16 | 21 | — | — | — | — | — | — |
| LNU794 | 78522.1 | — | — | — | 7.67 | 0.02 | 25 | — | — | — |
| LNU794 | 78524.1 | — | — | — | 7.85 | 0.01 | 28 | 0.399 | 0.18 | 11 |
| LNU794 | 78524.5 | — | — | — | 7.30 | 0.06 | 19 | 0.392 | 0.24 | 9 |
| LNU794 | 78525.2 | — | — | — | 7.14 | 0.09 | 16 | — | — | — |
| LNU792 | 79161.2 | 0.778 | 0.11 | 25 | — | — | — | — | — | — |
| LNU792 | 79162.2 | 0.720 | 0.30 | 16 | — | — | — | — | — | — |
| LNU778 | 78943.5 | 0.778 | 0.10 | 25 | — | — | — | — | — | — |
| LNU778 | 78944.1 | 0.841 | 0.03 | 35 | — | — | — | — | — | — |
| LNU778 | 78944.5 | — | — | — | 8.11 | L | 32 | 0.432 | L | 21 |
| LNU773 | 80399.1 | — | — | — | 6.96 | 0.16 | 13 | — | — | — |
| LNU771 | 80077.2 | — | — | — | 6.83 | 0.28 | 11 | 0.403 | 0.12 | 13 |
| LNU763 | 77588.6 | — | — | — | 7.62 | 0.02 | 24 | — | — | — |
| LNU763 | 77589.3 | 0.725 | 0.28 | 16 | — | — | — | — | — | — |
| LNU758 | 79739.10 | — | — | — | 7.84 | L | 27 | 0.400 | 0.17 | 12 |
| LNU753 | 77141.2 | — | — | — | 6.90 | 0.20 | 12 | — | — | — |
| LNU753 | 77143.3 | — | — | — | 7.23 | 0.06 | 17 | — | — | — |
| LNU753 | 77144.1 | — | — | — | 6.88 | 0.21 | 12 | 0.387 | 0.29 | 8 |
| CONT. | — | 0.622 | — | — | 6.16 | — | — | 0.358 | — | — |

TABLE 125-continued

Genes showing improved rosette growth performance at limiting nitrogen growth conditions

| Gene Name | Event # | RGR Of Leaf Number | | | RGR Of Plot Coverage [cm²/day] | | | RGR Of Rosette Diameter [cm/day] | | |
|---|---|---|---|---|---|---|---|---|---|---|
| | | Ave. | P-Val. | % Incr. | Ave. | P-Val. | % Incr. | Ave. | P-Val. | % Incr. |
| LNU790 | 78890.1 | — | — | — | 14.8 | 0.04 | 29 | 0.510 | 0.25 | 13 |
| CONT. | | — | — | — | 11.5 | — | — | 0.452 | — | — |
| LNU947 | 77448.4 | — | — | — | 12.6 | 0.02 | 32 | — | — | — |
| LNU940 | 77813.1 | — | — | — | 12.1 | 0.06 | 26 | 0.470 | 0.21 | 13 |
| LNU900 | 78851.3 | — | — | — | 11.3 | 0.19 | 18 | — | — | — |
| LNU898 | 78983.4 | — | — | — | 11.7 | 0.11 | 23 | 0.468 | 0.23 | 13 |
| LNU894 | 78283.7 | — | — | — | 12.4 | 0.04 | 29 | — | — | — |
| LNU846 | 78439.4 | — | — | — | 12.5 | 0.03 | 31 | 0.468 | 0.23 | 13 |
| LNU815 | 77494.1 | — | — | — | 12.7 | 0.02 | 33 | — | — | — |
| LNU811 | 78179.1 | — | — | — | 11.8 | 0.10 | 24 | — | — | — |
| LNU756 | 77581.3 | — | — | — | 11.0 | 0.27 | 15 | — | — | — |
| LNU751 | 77477.4 | 0.941 | 0.11 | 18 | — | — | — | — | — | — |
| LNU751 | 77478.3 | — | — | — | 11.1 | 0.23 | 16 | — | — | — |
| CONT. | | 0.800 | — | — | 9.56 | — | — | 0.415 | — | — |
| LNU965 | 78360.5 | — | — | — | 13.7 | 0.11 | 20 | 0.534 | 0.16 | 10 |
| LNU943 | 78407.2 | — | — | — | 13.4 | 0.16 | 17 | — | — | — |
| LNU913 | 78593.1 | — | — | — | 14.0 | 0.07 | 23 | — | — | — |
| CONT. | | — | — | — | 11.4 | — | — | 0.487 | — | — |

"CONT."—Control;
"Ave."—Average;
"% Incr." = % increment;
"p-val."—p-value;
L means that p-value is less than 0.01, p < 0.1 was considered as significant.

The genes listed in Tables 126-127 improved plant NUE when grown at standard nitrogen concentration levels. These genes produced larger plants with a larger photosynthetic area and increased biomass (fresh weight, dry weight, leaf number, rosette diameter, rosette area and plot coverage) when grown under standard nitrogen conditions as compared to control plants grown under identical growth conditions.

TABLE 126

Genes showing improved plant biomass production at standard nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU966 | 78605.5 | — | — | — | — | — | — | 12.1 | 0.07 | 5 |
| LNU941 | 78611.1 | — | — | — | 3018.8 | 0.07 | 7 | — | — | — |
| LNU941 | 78613.1 | — | — | — | 2987.5 | 0.15 | 5 | 11.9 | 0.30 | 2 |
| LNU941 | 78614.2 | — | — | — | 3137.5 | L | 11 | — | — | — |
| LNU941 | 78615.3 | — | — | — | — | — | — | 13.1 | L | 13 |
| LNU925 | 78991.7 | — | — | — | — | — | — | 12.6 | 0.03 | 8 |
| LNU925 | 78992.1 | 230.6 | 0.28 | 4 | 3031.2 | 0.21 | 7 | 12.2 | 0.28 | 6 |
| LNU925 | 78992.6 | — | — | — | 2957.1 | 0.17 | 4 | — | — | — |
| LNU922 | 78290.1 | — | — | — | 2943.8 | 0.27 | 4 | 12.9 | 0.11 | 11 |
| LNU918 | 78433.3 | 238.6 | 0.23 | 8 | — | — | — | — | — | — |
| LNU918 | 78433.8 | — | — | — | 3156.2 | 0.06 | 11 | — | — | — |
| LNU918 | 78434.2 | — | — | — | — | — | — | 12.5 | 0.19 | 8 |
| LNU915 | 78426.1 | 236.2 | 0.25 | 7 | — | — | — | 12.4 | 0.04 | 7 |
| LNU915 | 78428.1 | 242.5 | 0.30 | 10 | 3131.2 | 0.13 | 11 | 12.3 | 0.06 | 6 |
| LNU915 | 78428.2 | — | — | — | — | — | — | 12.1 | 0.05 | 5 |
| LNU909 | 78424.3 | 236.2 | 0.16 | 7 | — | — | — | 12.9 | L | 12 |
| LNU909 | 78425.4 | — | — | — | — | — | — | 12.6 | L | 9 |
| LNU909 | 78425.7 | — | — | — | — | — | — | 12.4 | L | 7 |
| LNU890 | 78202.1 | — | — | — | — | — | — | 12.3 | 0.01 | 6 |
| LNU854 | 78238.1 | — | — | — | — | — | — | 12.0 | 0.15 | 4 |
| LNU849 | 78498.4 | — | — | — | — | — | — | 12.4 | 0.10 | 7 |
| LNU849 | 78499.1 | — | — | — | 2981.2 | 0.27 | 5 | — | — | — |
| LNU849 | 78500.3 | 234.4 | 0.16 | 6 | — | — | — | — | — | — |
| LNU830 | 78741.3 | — | — | — | — | — | — | 12.0 | 0.11 | 4 |
| LNU830 | 78741.5 | — | — | — | — | — | — | 12.1 | 0.07 | 5 |
| LNU824 | 77826.1 | 235.6 | 0.11 | 6 | — | — | — | 12.6 | 0.16 | 9 |
| LNU822 | 78623.2 | — | — | — | 2943.8 | 0.22 | 4 | 12.8 | 0.01 | 11 |
| LNU822 | 78623.6 | — | — | — | 2937.5 | 0.25 | 4 | 11.9 | 0.30 | 2 |
| LNU822 | 78625.2 | — | — | — | — | — | — | 11.9 | 0.17 | 3 |

TABLE 126-continued

Genes showing improved plant biomass production at standard nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU822 | 78625.7 | — | — | — | — | — | — | 12.1 | 0.05 | 5 |
| LNU813 | 77682.3 | — | — | — | — | — | — | 12.7 | 0.19 | 9 |
| LNU806 | 78515.4 | — | — | — | — | — | — | 12.9 | L | 12 |
| LNU806 | 78515.5 | — | — | — | — | — | — | 12.2 | 0.15 | 6 |
| LNU802 | 80310.1 | 239.4 | 0.07 | 8 | — | — | — | — | — | — |
| LNU779 | 77887.2 | — | — | — | — | — | — | 12.1 | 0.17 | 4 |
| LNU779 | 77887.3 | — | — | — | — | — | — | 12.6 | 0.12 | 8 |
| LNU761 | 78159.1 | — | — | — | — | — | — | 11.9 | 0.29 | 3 |
| LNU761 | 78160.3 | 235.0 | 0.19 | 6 | — | — | — | 12.5 | 0.08 | 8 |
| CONT. | — | 221.4 | — | — | 2832.1 | — | — | 11.6 | — | — |
| LNU976 | 78364.1 | — | — | — | — | — | — | 9.75 | 0.11 | 5 |
| LNU976 | 78364.2 | — | — | — | — | — | — | 9.75 | 0.11 | 5 |
| LNU976 | 78364.5 | — | — | — | — | — | — | 9.69 | 0.22 | 5 |
| LNU843 | 78962.4 | — | — | — | — | — | — | 9.56 | 0.25 | 3 |
| LNU790 | 78890.3 | — | — | — | — | — | — | 9.81 | 0.28 | 6 |
| CONT. | — | — | — | — | — | — | — | 9.27 | — | — |
| LNU966 | 78605.5 | — | — | — | — | — | — | 11.9 | 0.02 | 8 |
| LNU941 | 78613.1 | 403.2 | 0.03 | 14 | 5655.4 | 0.16 | 19 | 11.5 | 0.15 | 4 |
| LNU941 | 78614.2 | — | — | — | 5047.3 | 0.24 | 6 | 12.1 | 0.04 | 10 |
| LNU941 | 78615.3 | 377.9 | 0.24 | 7 | — | — | 8 | — | — | — |
| LNU915 | 78427.1 | — | — | — | 5133.3 | 0.12 | 8 | — | — | — |
| LNU915 | 78428.1 | 373.8 | 0.27 | 5 | 5237.5 | 0.21 | 10 | — | — | — |
| LNU915 | 78428.2 | — | — | — | 5231.2 | 0.17 | 10 | — | — | — |
| LNU854 | 78238.1 | — | — | — | 5087.5 | 0.15 | 7 | 11.9 | 0.02 | 8 |
| LNU849 | 78499.1 | — | — | — | — | — | — | 11.4 | 0.17 | 4 |
| LNU849 | 78500.1 | — | — | — | — | — | — | 11.8 | 0.06 | 7 |
| LNU830 | 78741.5 | — | — | — | — | — | — | 12.3 | L | 12 |
| LNU830 | 78742.6 | — | — | — | — | — | — | 11.8 | 0.02 | 7 |
| LNU813 | 77681.4 | — | — | — | — | — | — | 11.5 | 0.15 | 4 |
| LNU806 | 78514.2 | — | — | — | 5231.2 | 0.08 | 10 | 11.4 | 0.26 | 4 |
| LNU806 | 78515.3 | — | — | — | — | — | — | 11.5 | 0.27 | 4 |
| LNU780 | 77489.4 | — | — | — | — | — | — | 11.6 | 0.15 | 5 |
| LNU751 | 77477.4 | — | — | — | — | — | — | 11.4 | 0.23 | 3 |
| LNU751 | 77480.1 | — | — | — | — | — | — | 11.6 | 0.18 | 5 |
| CONT. | — | 354.5 | — | — | 4755.4 | — | — | 11.0 | — | — |
| LNU948 | 78376.3 | 240.0 | L | 32 | 2737.5 | L | 49 | — | — | — |
| LNU948 | 78378.1 | 226.2 | 0.03 | 24 | 2212.5 | 0.13 | 20 | 11.8 | 0.05 | 5 |
| LNU921 | 79063.2 | — | — | — | — | — | — | 12.1 | L | 8 |
| LNU921 | 79064.2 | 257.5 | 0.02 | 41 | 2868.8 | L | 56 | — | — | — |
| LNU921 | 79064.3 | 286.2 | L | 57 | 3000.0 | L | 63 | 11.8 | 0.23 | 6 |
| LNU912 | 78402.3 | 231.9 | 0.04 | 27 | 2581.2 | 0.04 | 40 | — | — | — |
| LNU912 | 78405.2 | — | — | — | — | — | — | 12.3 | 0.19 | 10 |
| LNU889 | 79599.1 | 237.5 | 0.07 | 30 | 2681.2 | 0.04 | 46 | 12.1 | 0.18 | 8 |
| LNU889 | 79602.4 | — | — | — | — | — | — | 11.9 | 0.30 | 7 |
| LNU881 | 78373.1 | 231.2 | 0.02 | 27 | 2643.8 | L | 44 | — | — | — |
| LNU881 | 78373.2 | 259.4 | 0.06 | 42 | 3143.8 | 0.03 | 71 | 11.9 | 0.13 | 6 |
| LNU881 | 78374.1 | — | — | — | — | — | — | 12.0 | 0.01 | 7 |
| LNU865 | 79761.2 | 267.5 | L | 47 | 3018.8 | L | 64 | 12.0 | 0.10 | 7 |
| LNU865 | 79761.4 | 227.5 | 0.06 | 25 | 2618.8 | 0.17 | 42 | 12.0 | L | 7 |
| LNU865 | 79761.7 | 281.2 | L | 54 | 3112.5 | L | 69 | — | — | — |
| LNU857 | 78868.2 | — | — | — | — | — | — | 11.6 | 0.12 | 3 |
| LNU831 | 79331.2 | — | — | — | — | — | — | 11.7 | 0.14 | 5 |
| LNU831 | 79333.1 | 265.0 | 0.04 | 45 | 3087.5 | L | 68 | — | — | — |
| LNU831 | 79333.2 | 258.5 | L | 42 | 2945.8 | L | 60 | — | — | — |
| LNU816 | 78957.1 | 242.5 | L | 33 | 2956.2 | L | 61 | — | — | — |
| LNU816 | 78958.5 | — | — | — | — | — | — | 11.9 | 0.03 | 6 |
| LNU816 | 78958.7 | — | — | — | — | — | — | 11.9 | 0.13 | 6 |
| LNU809 | 79168.5 | 229.4 | 0.23 | 26 | 2550.0 | 0.02 | 38 | — | — | — |
| LNU807 | 79248.1 | — | — | — | — | — | — | 11.9 | 0.18 | 7 |
| LNU807 | 79250.1 | — | — | — | — | — | — | 11.6 | 0.12 | 3 |
| LNU795 | 79521.6 | — | — | — | — | — | — | 11.4 | 0.27 | 2 |
| LNU795 | 79525.1 | 203.1 | 0.21 | 11 | — | — | — | — | — | — |
| LNU795 | 79525.4 | 265.6 | L | 46 | 2950.0 | L | 60 | — | — | — |
| LNU788 | 78516.1 | 225.6 | 0.03 | 24 | 2437.5 | 0.03 | 32 | — | — | — |
| LNU788 | 78517.1 | — | — | — | — | — | — | 12.4 | 0.08 | 11 |
| LNU788 | 78517.2 | — | — | — | — | — | — | 11.9 | 0.03 | 6 |
| LNU788 | 78518.1 | 238.8 | 0.17 | 31 | 2331.2 | 0.07 | 27 | 12.4 | 0.04 | 11 |
| LNU788 | 78520.4 | — | — | — | — | — | — | 11.9 | 0.01 | 7 |
| LNU783 | 79178.4 | — | — | — | — | — | — | 11.8 | 0.23 | 6 |
| LNU778 | 78944.1 | — | — | — | — | — | — | 11.8 | 0.02 | 6 |
| LNU778 | 78944.2 | — | — | — | — | — | — | 11.8 | 0.05 | 5 |
| LNU762 | 79328.3 | — | — | — | — | — | — | 12.2 | 0.11 | 9 |

TABLE 126-continued

Genes showing improved plant biomass production at standard nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU762 | 79329.2 | — | — | — | — | — | — | 11.8 | 0.02 | 6 |
| LNU752 | 78153.1 | 264.4 | L | 45 | 3043.8 | L | 65 | 12.1 | L | 8 |
| LNU752 | 78155.2 | — | — | — | — | — | — | 12.0 | 0.10 | 7 |
| CONT. | — | 182.3 | — | — | 1841.3 | — | — | 11.2 | — | — |
| LNU977 | 77991.4 | — | — | — | 4112.5 | 0.14 | 10 | — | — | — |
| LNU977 | 78033.1 | 365.0 | 0.24 | 19 | 4481.2 | 0.24 | 20 | — | — | — |
| LNU880 | 78196.1 | 342.5 | 0.02 | 12 | 4043.8 | 0.02 | 9 | — | — | — |
| LNU880 | 78197.4 | — | — | — | 3981.2 | 0.03 | 7 | — | — | — |
| LNU871 | 78191.1 | 319.4 | 0.24 | 5 | — | — | — | — | — | — |
| LNU871 | 78191.3 | 326.2 | 0.20 | 7 | 4243.8 | L | 14 | — | — | — |
| LNU848 | 77906.2 | — | — | — | 4100.0 | 0.29 | 10 | — | — | — |
| LNU848 | 77909.2 | — | — | — | 3987.5 | 0.08 | 7 | — | — | — |
| LNU848 | 77909.5 | — | — | — | 4031.2 | 0.09 | 8 | — | — | — |
| LNU846 | 78438.1 | 322.1 | 0.18 | 5 | — | — | — | — | — | — |
| LNU845 | 78920.1 | — | — | — | 4000.0 | 0.02 | 7 | — | — | — |
| LNU828 | 77600.4 | 331.9 | 0.23 | 9 | 4100.0 | 0.07 | 10 | — | — | — |
| LNU823 | 78122.2 | 321.2 | 0.19 | 5 | 3918.8 | 0.10 | 5 | — | — | — |
| LNU823 | 78136.1 | 327.5 | 0.28 | 7 | — | — | — | — | — | — |
| LNU823 | 78136.4 | 320.8 | 0.30 | 5 | — | — | — | — | — | — |
| LNU823 | 78137.3 | — | — | — | — | — | — | 12.3 | 0.11 | 6 |
| LNU772 | 78937.4 | — | — | — | — | — | — | 11.9 | 0.03 | 3 |
| LNU772 | 78938.1 | 331.9 | 0.06 | 9 | — | — | — | 12.8 | 0.01 | 10 |
| LNU757 | 77481.1 | — | — | — | 4098.2 | 0.13 | 10 | — | — | — |
| LNU757 | 77485.2 | 335.6 | 0.19 | 10 | 4081.2 | 0.28 | 10 | — | — | — |
| LNU757 | 77485.4 | 338.1 | 0.02 | 11 | 4250.0 | 0.08 | 14 | — | — | — |
| LNU750 | 78863.2 | — | — | — | — | — | — | 11.9 | 0.23 | 2 |
| CONT. | — | 305.5 | — | — | 3722.0 | — | — | 11.6 | — | — |
| LNU972 | 78907.1 | 386.2 | 0.29 | 7 | 5068.8 | 0.04 | 10 | 11.9 | 0.02 | 6 |
| LNU972 | 78909.3 | — | — | — | — | — | — | 12.5 | 0.29 | 11 |
| LNU961 | 79143.3 | — | — | — | — | — | — | 11.6 | 0.24 | 2 |
| LNU961 | 79145.3 | 396.9 | 0.24 | 9 | 5556.2 | L | 20 | — | — | — |
| LNU961 | 79145.8 | — | — | — | 5037.5 | 0.05 | 9 | — | — | — |
| LNU958 | 77687.2 | — | — | — | — | — | — | 12.4 | L | 9 |
| LNU958 | 77687.5 | — | — | — | — | — | — | 12.5 | 0.05 | 11 |
| LNU958 | 77689.1 | — | — | — | — | — | — | 12.0 | 0.02 | 6 |
| LNU958 | 77689.2 | — | — | — | 5093.8 | 0.04 | 10 | — | — | — |
| LNU948 | 78379.4 | — | — | — | — | — | — | 12.1 | L | 7 |
| LNU948 | 78380.2 | — | — | — | 5275.0 | 0.16 | 14 | 12.3 | L | 9 |
| LNU921 | 79063.2 | — | — | — | — | — | — | 12.5 | L | 11 |
| LNU921 | 79064.3 | — | — | — | — | — | — | 11.9 | 0.05 | 5 |
| LNU913 | 78592.1 | — | — | — | — | — | — | 12.1 | L | 7 |
| LNU913 | 78592.3 | — | — | — | — | — | — | 12.4 | 0.16 | 9 |
| LNU913 | 78592.4 | — | — | — | — | — | — | 13.1 | 0.26 | 16 |
| LNU913 | 78593.6 | — | — | — | — | — | — | 13.1 | L | 16 |
| LNU912 | 78403.2 | — | — | — | — | — | — | 12.0 | 0.02 | 6 |
| LNU912 | 78404.1 | 406.9 | L | 12 | 5300.0 | 0.07 | 15 | — | — | — |
| LNU888 | 78772.7 | — | — | — | — | — | — | 12.3 | 0.02 | 9 |
| LNU881 | 78372.2 | — | — | — | 5393.8 | 0.19 | 17 | — | — | — |
| LNU881 | 78373.1 | 406.2 | L | 12 | 5431.2 | L | 18 | — | — | — |
| LNU881 | 78373.2 | — | — | — | — | — | — | 12.6 | 0.08 | 11 |
| LNU881 | 78374.1 | 398.0 | L | 10 | 5265.2 | L | 14 | 12.4 | 0.06 | 9 |
| LNU881 | 78374.4 | — | — | — | 5157.1 | 0.03 | 12 | — | — | — |
| LNU823 | 78136.1 | — | — | — | 5000.0 | 0.06 | 8 | — | — | — |
| LNU823 | 78136.4 | 391.2 | 0.03 | 8 | 5093.8 | 0.03 | 10 | — | — | — |
| LNU823 | 78137.3 | 390.3 | 0.24 | 8 | 5273.2 | 0.01 | 14 | — | — | — |
| LNU816 | 78957.1 | — | — | — | 5250.0 | 0.12 | 14 | 12.1 | 0.18 | 7 |
| LNU816 | 78958.7 | — | — | — | — | — | — | 12.7 | 0.28 | 12 |
| LNU809 | 79168.3 | — | — | — | — | — | — | 11.9 | 0.24 | 6 |
| LNU782 | 77441.1 | — | — | — | — | — | — | 12.2 | 0.04 | 8 |
| LNU782 | 77443.3 | — | — | — | 4943.8 | 0.12 | 7 | — | — | — |
| LNU782 | 77444.9 | — | — | — | — | — | — | 12.6 | 0.20 | 12 |
| LNU772 | 78937.4 | — | — | — | 4962.5 | 0.08 | 8 | — | — | — |
| LNU772 | 78938.1 | 387.5 | 0.16 | 7 | — | — | — | 12.4 | L | 9 |
| LNU772 | 78940.2 | — | — | — | — | — | — | 12.6 | 0.04 | 12 |
| LNU762 | 79330.3 | — | — | — | 5019.6 | 0.22 | 9 | — | — | — |
| LNU757 | 77481.1 | — | — | — | — | — | — | 12.5 | 0.05 | 11 |
| LNU757 | 77483.2 | — | — | — | — | — | — | 11.8 | 0.14 | 5 |
| LNU757 | 77485.2 | — | — | — | 4937.5 | 0.13 | 7 | — | — | — |
| LNU757 | 77485.4 | — | — | — | — | — | — | 12.2 | 0.04 | 8 |
| CONT. | — | 362.5 | — | — | 4614.3 | — | — | 11.3 | — | — |
| LNU933 | 78900.5 | — | — | — | 2568.8 | 0.23 | 6 | — | — | — |
| LNU907 | 78872.3 | — | — | — | 2850.0 | 0.08 | 17 | — | — | — |

TABLE 126-continued

Genes showing improved plant biomass production at standard nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU907 | 78872.8 | — | — | — | 2662.5 | 0.04 | 9 | — | — | — |
| LNU882 | 78973.4 | — | — | — | — | — | — | 13.8 | 0.11 | 8 |
| LNU871 | 78195.4 | 286.2 | 0.13 | 13 | 2625.0 | 0.21 | 8 | — | — | — |
| LNU865 | 79761.2 | 271.9 | 0.25 | 7 | — | — | — | — | — | — |
| LNU857 | 78867.2 | — | — | — | 2622.3 | 0.08 | 8 | — | — | — |
| LNU848 | 77909.3 | — | — | — | — | — | — | 13.2 | 0.08 | 4 |
| LNU847 | 78967.4 | — | — | — | 2687.5 | 0.30 | 10 | — | — | — |
| LNU835 | 78186.6 | — | — | — | 2731.2 | 0.29 | 12 | — | — | — |
| LNU835 | 78187.2 | — | — | — | 2706.2 | 0.12 | 11 | — | — | — |
| LNU835 | 78189.1 | — | — | — | 2637.5 | 0.06 | 8 | — | — | — |
| LNU828 | 77600.4 | — | — | — | 2718.8 | 0.05 | 12 | — | — | — |
| LNU807 | 79250.1 | — | — | — | — | — | — | 13.3 | 0.12 | 4 |
| LNU798 | 79671.4 | — | — | — | — | — | — | 13.1 | 0.20 | 2 |
| LNU795 | 79521.3 | 295.6 | 0.03 | 17 | 2650.0 | 0.05 | 9 | — | — | — |
| LNU795 | 79525.4 | — | — | — | 2556.2 | 0.24 | 5 | — | — | — |
| LNU766 | 78931.2 | — | — | — | — | — | — | 13.1 | 0.20 | 2 |
| LNU766 | 78932.1 | 291.9 | 0.03 | 15 | 2937.5 | L | 21 | 13.3 | 0.03 | 4 |
| LNU752 | 78153.1 | — | — | — | 2662.5 | 0.04 | 9 | — | — | — |
| LNU750 | 78863.3 | — | — | — | 2650.0 | 0.13 | 9 | — | — | — |
| CONT. | — | 253.4 | — | — | 2433.9 | — | — | 12.8 | — | — |
| LNU976 | 78364.1 | — | — | — | 3637.5 | 0.27 | 11 | — | — | — |
| LNU976 | 78364.2 | — | — | — | — | — | — | 12.2 | 0.14 | 3 |
| LNU970 | 78389.8 | 276.2 | 0.11 | 12 | 3700.0 | L | 13 | — | — | — |
| LNU968 | 77917.3 | — | — | — | 3470.5 | 0.12 | 6 | — | — | — |
| LNU967 | 79001.1 | — | — | — | 3493.8 | 0.14 | 7 | — | — | — |
| LNU967 | 79002.4 | 258.1 | 0.07 | 5 | 3511.6 | 0.24 | 8 | — | — | — |
| LNU963 | 78383.4 | 255.0 | 0.22 | 4 | 3668.8 | L | 12 | — | — | — |
| LNU963 | 78384.2 | 268.8 | 0.02 | 9 | 3493.8 | 0.11 | 7 | — | — | — |
| LNU950 | 78915.2 | 263.1 | 0.06 | 7 | 3581.2 | 0.06 | 10 | — | — | — |
| LNU934 | 79007.5 | — | — | — | — | — | — | 12.2 | 0.09 | 3 |
| LNU908 | 79734.4 | — | — | — | 3443.8 | 0.14 | 6 | 12.1 | 0.29 | 2 |
| LNU908 | 79736.2 | — | — | — | 3525.0 | 0.18 | 8 | — | — | — |
| LNU908 | 79736.4 | 258.1 | 0.21 | 5 | — | — | — | — | — | — |
| LNU902 | 79604.2 | 256.2 | 0.24 | 4 | 3600.0 | 0.11 | 10 | — | — | — |
| LNU902 | 79604.4 | — | — | — | — | — | — | 12.5 | 0.03 | 5 |
| LNU902 | 79606.1 | — | — | — | 3518.8 | 0.05 | 8 | — | — | — |
| LNU885 | 78416.1 | — | — | — | 3481.2 | 0.08 | 7 | — | — | — |
| LNU885 | 78416.5 | — | — | — | 3437.5 | 0.14 | 5 | — | — | — |
| LNU885 | 78419.3 | 261.9 | 0.04 | 6 | 3475.0 | 0.15 | 7 | — | — | — |
| LNU885 | 78420.1 | 265.6 | 0.01 | 8 | 3718.8 | L | 14 | — | — | — |
| LNU879 | 77799.2 | — | — | — | 3481.2 | 0.08 | 7 | — | — | — |
| LNU879 | 77799.3 | 259.4 | 0.24 | 5 | — | — | — | — | — | — |
| LNU875 | 78413.4 | — | — | — | — | — | — | 12.4 | 0.07 | 4 |
| LNU875 | 78415.1 | — | — | — | 3562.5 | 0.24 | 9 | — | — | — |
| LNU858 | 79584.2 | — | — | — | 3625.0 | 0.15 | 11 | — | — | — |
| LNU858 | 79585.1 | 263.3 | 0.02 | 7 | 3747.3 | 0.05 | 15 | — | — | — |
| LNU858 | 79586.3 | 275.0 | 0.28 | 12 | — | — | — | 12.4 | 0.22 | 4 |
| LNU790 | 78889.2 | — | — | — | — | — | — | 12.5 | 0.16 | 5 |
| LNU790 | 78890.1 | 268.1 | 0.11 | 9 | 3662.5 | 0.08 | 12 | — | — | — |
| LNU790 | 78890.3 | — | — | — | 3400.0 | 0.25 | 4 | 12.6 | 0.07 | 6 |
| LNU767 | 79146.1 | — | — | — | — | — | — | 12.3 | 0.06 | 4 |
| LNU767 | 79146.2 | 263.1 | 0.02 | 7 | 3506.2 | 0.08 | 7 | 12.3 | 0.18 | 4 |
| CONT. | — | 246.0 | — | — | 3262.5 | — | — | 11.9 | — | — |
| LNU947 | 77446.1 | 318.8 | 0.02 | 8 | 3731.2 | 0.11 | 5 | — | — | — |
| LNU947 | 77447.3 | 318.1 | 0.02 | 8 | 3737.5 | 0.03 | 5 | 12.5 | 0.07 | 4 |
| LNU940 | 77812.4 | — | — | — | 3737.5 | 0.03 | 5 | — | — | — |
| LNU900 | 78851.3 | 317.5 | 0.11 | 8 | 3800.0 | 0.03 | 7 | — | — | — |
| LNU900 | 78852.5 | — | — | — | 3678.6 | 0.11 | 3 | — | — | — |
| LNU900 | 78854.3 | 314.4 | 0.09 | 7 | — | — | — | — | — | — |
| LNU898 | 78981.3 | 322.1 | 0.01 | 9 | 3873.2 | 0.11 | 9 | 12.4 | 0.14 | 3 |
| LNU898 | 78983.4 | 325.6 | 0.01 | 10 | 3843.8 | L | 8 | 12.4 | 0.05 | 3 |
| LNU898 | 78985.1 | 308.1 | 0.14 | 5 | 3750.0 | 0.07 | 5 | — | — | — |
| LNU898 | 78985.4 | — | — | — | 3656.2 | 0.18 | 3 | — | — | — |
| LNU894 | 78282.3 | — | — | — | 3750.0 | 0.07 | 5 | 12.6 | 0.20 | 5 |
| LNU894 | 78283.4 | 316.2 | 0.13 | 7 | 3718.8 | 0.18 | 5 | — | — | — |
| LNU894 | 78283.7 | 322.5 | 0.10 | 9 | 3775.0 | 0.16 | 6 | 12.8 | L | 6 |
| LNU846 | 78436.2 | 323.8 | L | 10 | 3825.0 | 0.02 | 8 | — | — | — |
| LNU820 | 77807.2 | 325.0 | 0.19 | 10 | 3737.5 | 0.05 | 5 | — | — | — |
| LNU815 | 77492.2 | — | — | — | 3712.5 | 0.06 | 4 | — | — | — |
| LNU815 | 77492.6 | 315.6 | 0.24 | 7 | 3818.8 | 0.10 | 7 | 12.5 | 0.07 | 4 |
| LNU815 | 77494.1 | — | — | — | — | — | — | 13.1 | 0.14 | 9 |
| LNU815 | 77495.3 | — | — | — | — | — | — | 12.5 | 0.02 | 4 |

TABLE 126-continued

Genes showing improved plant biomass production at standard nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU814 | 78953.2 | — | — | — | — | — | — | 12.7 | 0.09 | 5 |
| LNU814 | 78953.3 | 311.9 | 0.13 | 6 | — | — | — | — | — | — |
| LNU814 | 78955.4 | — | — | — | — | — | — | 12.6 | 0.14 | 4 |
| LNU811 | 78176.1 | — | — | — | 3775.0 | 0.02 | 6 | — | — | — |
| LNU811 | 78176.8 | — | — | — | — | — | — | 12.4 | 0.05 | 3 |
| LNU797 | 78025.2 | — | — | — | 3916.1 | L | 10 | — | — | — |
| LNU797 | 78025.3 | — | — | — | 3812.5 | 0.05 | 7 | — | — | — |
| LNU793 | 78166.4 | 303.8 | 0.29 | 3 | — | — | — | — | — | — |
| LNU793 | 78167.2 | — | — | — | — | — | — | 12.4 | 0.14 | 3 |
| LNU793 | 78169.1 | — | — | — | — | — | — | 12.5 | 0.27 | 4 |
| LNU780 | 77489.4 | — | — | — | 3689.6 | 0.28 | 4 | — | — | — |
| LNU776 | 79747.1 | — | — | — | 3834.5 | 0.28 | 8 | — | — | — |
| LNU769 | 78163.8 | 308.1 | 0.27 | 5 | — | — | — | — | — | — |
| LNU769 | 78165.2 | 327.5 | 0.13 | 11 | 3681.2 | 0.13 | 4 | — | — | — |
| LNU759 | 77236.2 | — | — | — | 3632.1 | 0.30 | 2 | — | — | — |
| LNU759 | 77236.8 | 312.5 | 0.06 | 6 | 3825.0 | 0.08 | 8 | — | — | — |
| LNU751 | 77477.1 | — | — | — | 3806.2 | L | 7 | — | — | — |
| LNU751 | 77478.3 | 308.1 | 0.14 | 5 | — | — | — | — | — | — |
| CONT. | — | 294.8 | — | — | 3555.4 | — | — | 12.0 | — | — |
| LNU972 | 78907.1 | — | — | — | 4868.8 | 0.04 | 12 | — | — | — |
| LNU943 | 78407.1 | — | — | — | — | — | — | 12.4 | 0.13 | 3 |
| LNU943 | 78407.2 | — | — | — | — | — | — | 12.2 | 0.29 | 2 |
| LNU913 | 78592.1 | — | — | — | — | — | — | 12.4 | 0.03 | 3 |
| LNU913 | 78592.4 | 432.5 | 0.25 | 17 | 4681.2 | 0.21 | 8 | — | — | — |
| LNU864 | 79339.2 | — | — | — | 4718.8 | 0.12 | 9 | — | — | — |
| LNU850 | 78638.7 | — | — | — | 4837.5 | 0.05 | 11 | — | — | — |
| LNU768 | 77883.4 | — | — | — | 4587.5 | 0.30 | 6 | — | — | — |
| CONT. | — | 368.8 | — | — | 4341.1 | — | — | 12.0 | — | — |

"CONT."—Control;
"Ave."—Average;
"% Incr." = % increment;
"p-val."—p-value;
L means that p-value is less than 0.01, p < 0.1 was considered as significant.

TABLE 127

Genes showing improved plant biomass production at standard nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU966 | 78604.1 | 87.4 | 0.28 | 11 | 10.9 | 0.28 | 11 | 5.52 | 0.28 | 7 |
| LNU966 | 78605.5 | 87.3 | 0.17 | 11 | 10.9 | 0.17 | 11 | — | — | — |
| LNU941 | 78615.3 | 87.8 | 0.29 | 12 | 11.0 | 0.29 | 12 | — | — | — |
| LNU918 | 78434.2 | — | — | — | — | — | — | 5.48 | 0.19 | 6 |
| LNU915 | 78426.1 | 91.7 | 0.26 | 17 | 11.5 | 0.26 | 17 | 5.74 | 0.21 | 11 |
| LNU915 | 78428.1 | 94.7 | 0.03 | 20 | 11.8 | 0.03 | 20 | 5.69 | 0.06 | 10 |
| LNU909 | 78424.3 | 96.2 | 0.24 | 22 | 12.0 | 0.24 | 22 | 5.78 | 0.11 | 12 |
| LNU830 | 78741.5 | — | — | — | — | — | — | 5.51 | 0.24 | 7 |
| LNU824 | 77826.1 | 87.0 | 0.18 | 11 | 10.9 | 0.18 | 11 | — | — | — |
| LNU822 | 78623.7 | 91.8 | 0.28 | 17 | 11.5 | 0.28 | 17 | 5.61 | 0.29 | 8 |
| LNU806 | 78515.4 | 86.7 | 0.19 | 10 | 10.8 | 0.19 | 10 | 5.49 | 0.17 | 6 |
| LNU806 | 78515.5 | 100.9 | 0.19 | 28 | 12.6 | 0.19 | 28 | 5.96 | 0.27 | 15 |
| CONT. | — | 78.6 | — | — | 9.83 | — | — | 5.17 | — | — |
| LNU976 | 78364.1 | 42.6 | L | 44 | 5.33 | L | 44 | 4.05 | L | 24 |
| LNU976 | 78364.5 | 35.5 | 0.01 | 20 | 4.44 | 0.01 | 20 | 3.64 | 0.02 | 11 |
| LNU970 | 78388.1 | 35.7 | 0.02 | 21 | 4.46 | 0.02 | 21 | 3.70 | 0.15 | 13 |
| LNU970 | 78389.2 | — | — | — | — | — | — | 3.39 | 0.16 | 3 |
| LNU970 | 78389.8 | 36.1 | 0.18 | 22 | 4.81 | L | 30 | 3.80 | L | 16 |
| LNU970 | 78390.3 | — | — | — | — | — | — | 3.41 | 0.10 | 4 |
| LNU968 | 77918.3 | 33.3 | 0.15 | 13 | 4.17 | 0.15 | 13 | 3.46 | 0.26 | 6 |
| LNU968 | 77919.4 | 35.9 | L | 21 | 4.49 | L | 21 | 3.64 | L | 11 |
| LNU963 | 78383.4 | 32.2 | 0.07 | 9 | 4.03 | 0.07 | 9 | 3.43 | 0.18 | 5 |
| LNU963 | 78385.1 | 34.1 | 0.20 | 15 | 4.26 | 0.20 | 15 | 3.53 | 0.21 | 8 |
| LNU950 | 78913.4 | — | — | — | — | — | — | 3.46 | 0.29 | 6 |
| LNU949 | 80557.4 | 33.2 | 0.15 | 12 | 4.15 | 0.15 | 12 | 3.51 | 0.23 | 7 |
| LNU934 | 79007.5 | 32.9 | 0.10 | 11 | 4.11 | 0.10 | 11 | — | — | — |

TABLE 127-continued

Genes showing improved plant biomass production at standard nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU934 | 79008.1 | 32.7 | 0.22 | 10 | 4.09 | 0.22 | 10 | 3.48 | 0.20 | 6 |
| LNU902 | 79606.5 | — | — | — | — | — | — | 3.77 | 0.26 | 15 |
| LNU843 | 78962.4 | 33.8 | 0.24 | 14 | 4.23 | 0.24 | 14 | — | — | — |
| LNU790 | 78886.3 | 31.7 | 0.19 | 7 | 3.96 | 0.19 | 7 | 3.39 | 0.16 | 4 |
| LNU790 | 78890.1 | 35.0 | L | 18 | 4.38 | L | 18 | 3.62 | L | 10 |
| LNU787 | 80547.3 | 31.4 | 0.21 | 6 | 3.92 | 0.21 | 6 | 3.43 | 0.07 | 5 |
| LNU785 | 79616.8 | 35.5 | 0.01 | 20 | 4.43 | 0.01 | 20 | 3.49 | 0.02 | 7 |
| LNU767 | 79146.1 | 35.0 | 0.27 | 18 | 4.38 | 0.27 | 18 | — | — | — |
| LNU767 | 79146.2 | 33.5 | 0.03 | 13 | 4.18 | 0.03 | 13 | 3.49 | 0.02 | 7 |
| CONT. | — | 29.6 | — | — | 3.70 | — | — | 3.27 | — | — |
| LNU941 | 78613.1 | 105.6 | 0.15 | 14 | 13.2 | 0.15 | 13 | 6.16 | 0.13 | 7 |
| LNU915 | 78428.1 | — | — | — | — | — | — | 6.18 | 0.26 | 7 |
| LNU909 | 78425.4 | — | — | — | — | — | — | 6.08 | 0.25 | 6 |
| LNU830 | 78741.3 | 123.8 | 0.21 | 34 | 16.5 | 0.01 | 41 | 6.88 | L | 19 |
| LNU830 | 78741.5 | 127.1 | L | 38 | 15.9 | L | 36 | 6.74 | 0.01 | 17 |
| LNU830 | 78742.6 | 103.8 | 0.23 | 12 | 13.0 | 0.25 | 11 | 6.03 | 0.29 | 5 |
| LNU813 | 77681.4 | 115.6 | 0.16 | 25 | 14.4 | 0.18 | 24 | 6.63 | 0.03 | 15 |
| CONT. | — | 92.4 | — | — | 11.7 | — | — | 5.76 | — | — |
| LNU948 | 78376.3 | 94.8 | 0.03 | 23 | 11.9 | 0.03 | 23 | 5.98 | 0.17 | 11 |
| LNU948 | 78378.1 | 103.6 | 0.11 | 34 | 13.0 | 0.11 | 34 | 6.04 | 0.15 | 12 |
| LNU921 | 79063.2 | 93.0 | 0.02 | 20 | 11.6 | 0.02 | 20 | 5.65 | 0.14 | 5 |
| LNU921 | 79064.2 | 97.5 | L | 26 | 12.2 | L | 26 | 6.27 | L | 16 |
| LNU921 | 79064.3 | 109.9 | L | 42 | 13.7 | L | 42 | 6.10 | L | 13 |
| LNU889 | 79599.1 | 91.9 | 0.01 | 19 | 11.5 | 0.01 | 19 | 5.75 | 0.05 | 7 |
| LNU889 | 79602.4 | 86.1 | 0.08 | 11 | 10.8 | 0.08 | 11 | 5.58 | 0.29 | 3 |
| LNU888 | 78771.1 | 84.6 | 0.27 | 9 | 10.6 | 0.27 | 9 | — | — | — |
| LNU881 | 78372.2 | 94.2 | L | 22 | 11.8 | L | 22 | 5.94 | L | 10 |
| LNU881 | 78373.1 | 95.7 | 0.03 | 24 | 12.0 | 0.03 | 24 | 5.81 | 0.04 | 8 |
| LNU881 | 78373.2 | 108.9 | 0.08 | 41 | 13.6 | 0.08 | 41 | 6.31 | 0.14 | 17 |
| LNU881 | 78374.1 | 95.8 | 0.03 | 24 | 12.0 | 0.03 | 24 | 5.93 | 0.01 | 10 |
| LNU865 | 79761.2 | 129.8 | L | 68 | 16.2 | L | 68 | 6.89 | L | 28 |
| LNU865 | 79761.4 | 111.1 | L | 44 | 13.9 | L | 44 | 6.58 | 0.03 | 22 |
| LNU865 | 79761.7 | 95.8 | 0.23 | 24 | 12.0 | 0.23 | 24 | 5.92 | 0.12 | 10 |
| LNU831 | 79333.1 | 93.5 | 0.11 | 21 | 11.7 | 0.11 | 21 | 5.88 | 0.12 | 9 |
| LNU816 | 78957.1 | 101.1 | 0.27 | 31 | 12.6 | 0.27 | 31 | 6.04 | 0.02 | 12 |
| LNU816 | 78958.5 | 100.6 | 0.09 | 30 | 12.6 | 0.09 | 30 | 5.99 | 0.03 | 11 |
| LNU816 | 78958.7 | 95.0 | L | 23 | 11.9 | L | 23 | 5.82 | 0.02 | 8 |
| LNU809 | 79168.3 | 84.4 | 0.14 | 9 | 10.5 | 0.14 | 9 | 5.72 | 0.07 | 6 |
| LNU809 | 79169.5 | 87.1 | 0.20 | 13 | 10.9 | 0.20 | 13 | 5.67 | 0.14 | 5 |
| LNU795 | 79525.1 | 92.3 | 0.07 | 19 | 11.5 | 0.07 | 19 | 5.85 | 0.02 | 8 |
| LNU795 | 79525.4 | 92.7 | 0.20 | 20 | 11.6 | 0.20 | 20 | — | — | — |
| LNU795 | 79525.5 | — | — | — | — | — | — | 5.61 | 0.17 | 4 |
| LNU788 | 78516.1 | 110.6 | 0.06 | 43 | 13.8 | 0.06 | 43 | 6.25 | L | 16 |
| LNU788 | 78517.1 | 97.7 | L | 26 | 12.2 | L | 26 | 5.88 | 0.01 | 9 |
| LNU788 | 78518.1 | 125.2 | 0.06 | 62 | 15.6 | 0.06 | 62 | 6.62 | L | 23 |
| LNU783 | 79178.2 | 85.4 | 0.15 | 10 | 10.7 | 0.15 | 10 | 5.58 | 0.24 | 3 |
| LNU783 | 79178.4 | 84.9 | 0.22 | 10 | 10.6 | 0.22 | 10 | 5.95 | 0.02 | 10 |
| LNU778 | 78944.1 | 109.0 | 0.16 | 41 | 13.6 | 0.16 | 41 | 6.16 | 0.18 | 14 |
| LNU778 | 78944.2 | 87.1 | 0.06 | 13 | 10.9 | 0.06 | 13 | 5.61 | 0.22 | 4 |
| LNU762 | 79328.3 | 86.0 | 0.15 | 11 | 10.7 | 0.15 | 11 | — | — | — |
| LNU762 | 79330.3 | 82.6 | 0.26 | 7 | 10.3 | 0.26 | 7 | — | — | — |
| LNU752 | 78153.1 | — | — | — | — | — | — | 6.16 | 0.22 | 14 |
| LNU752 | 78155.2 | 84.2 | 0.23 | 9 | 10.5 | 0.23 | 9 | 5.69 | 0.11 | 5 |
| CONT. | — | 77.4 | — | — | 9.67 | — | — | 5.40 | — | — |
| LNU882 | 78973.4 | 105.5 | 0.10 | 7 | 13.2 | 0.10 | 7 | 6.07 | 0.11 | 4 |
| LNU848 | 77906.2 | 112.2 | 0.07 | 13 | 14.0 | 0.07 | 13 | 6.37 | L | 9 |
| LNU846 | 78439.4 | 120.8 | 0.20 | 22 | 15.1 | 0.20 | 22 | 6.53 | L | 12 |
| LNU823 | 78122.2 | — | — | — | — | — | — | 6.04 | 0.19 | 3 |
| LNU823 | 78137.3 | 109.4 | 0.19 | 10 | 13.7 | 0.19 | 10 | — | — | — |
| LNU814 | 78955.4 | — | — | — | — | — | — | 5.99 | 0.28 | 2 |
| LNU772 | 78938.1 | 122.1 | L | 23 | 15.3 | L | 23 | 6.48 | 0.11 | 11 |
| LNU757 | 77485.4 | 103.0 | 0.28 | 4 | 12.9 | 0.28 | 4 | — | — | — |
| CONT. | — | 99.0 | — | — | 12.4 | — | — | 5.84 | — | — |
| LNU972 | 78907.1 | 77.6 | 0.27 | 10 | 9.69 | 0.27 | 10 | — | — | — |
| LNU972 | 78909.3 | 87.4 | L | 23 | 10.9 | L | 23 | 5.90 | 0.09 | 13 |
| LNU961 | 79143.4 | — | — | — | — | — | — | 5.57 | 0.20 | 7 |
| LNU961 | 79145.3 | 80.9 | 0.10 | 14 | 10.1 | 0.10 | 14 | 5.50 | 0.20 | 5 |
| LNU958 | 77687.2 | 86.2 | 0.08 | 22 | 10.8 | 0.08 | 22 | — | — | — |
| LNU958 | 77687.5 | 88.0 | 0.05 | 24 | 11.0 | 0.05 | 24 | 6.04 | 0.05 | 16 |
| LNU958 | 77689.1 | 81.8 | L | 16 | 10.2 | L | 16 | 5.53 | 0.02 | 6 |
| LNU948 | 78378.1 | 84.7 | 0.28 | 20 | 10.6 | 0.28 | 20 | 5.76 | 0.24 | 10 |
| LNU948 | 78379.4 | 75.6 | 0.14 | 7 | 9.45 | 0.14 | 7 | — | — | — |
| LNU948 | 78380.2 | 81.3 | 0.25 | 15 | 10.2 | 0.25 | 15 | 5.54 | 0.16 | 6 |

TABLE 127-continued

Genes showing improved plant biomass production at standard nitrogen growth conditions

| | | Plot Coverage [cm²] | | | Rosette Area [cm²] | | | Rosette Diameter [cm] | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| LNU921 | 79063.2 | 83.6 | 0.19 | 18 | 10.4 | 0.19 | 18 | — | — | — |
| LNU921 | 79064.3 | 83.6 | L | 18 | 10.5 | L | 18 | 5.65 | 0.02 | 8 |
| LNU913 | 78592.1 | 90.3 | 0.03 | 28 | 11.3 | 0.03 | 28 | 5.91 | L | 13 |
| LNU913 | 78592.3 | 83.4 | 0.03 | 18 | 10.4 | 0.03 | 18 | 5.58 | 0.15 | 7 |
| LNU913 | 78592.4 | 90.8 | L | 28 | 11.4 | L | 28 | 5.79 | 0.03 | 11 |
| LNU913 | 78593.1 | 85.4 | L | 21 | 10.7 | L | 21 | 5.68 | L | 9 |
| LNU913 | 78593.6 | 95.2 | L | 35 | 11.9 | L | 35 | 5.88 | L | 13 |
| LNU912 | 78403.2 | 81.4 | L | 15 | 10.2 | L | 15 | 5.70 | L | 9 |
| LNU912 | 78404.1 | 80.8 | 0.17 | 14 | 10.1 | 0.17 | 14 | — | — | — |
| LNU889 | 79599.1 | 74.2 | 0.29 | 5 | 9.28 | 0.29 | 5 | — | — | — |
| LNU889 | 79601.4 | 75.9 | 0.16 | 7 | 9.49 | 0.16 | 7 | 5.46 | 0.14 | 5 |
| LNU889 | 79602.4 | 74.8 | 0.21 | 6 | 9.35 | 0.21 | 6 | 5.43 | 0.14 | 4 |
| LNU881 | 78372.2 | 86.7 | 0.08 | 22 | 10.8 | 0.08 | 22 | 5.84 | L | 12 |
| LNU881 | 78373.2 | 92.0 | L | 30 | 11.5 | L | 30 | 5.81 | L | 11 |
| LNU881 | 78374.1 | 79.5 | 0.14 | 12 | 9.94 | 0.14 | 12 | — | — | — |
| LNU823 | 78136.4 | 80.5 | 0.01 | 14 | 10.1 | 0.01 | 14 | 5.50 | 0.03 | 5 |
| LNU816 | 78957.1 | 86.7 | 0.03 | 22 | 10.8 | 0.03 | 22 | 5.78 | 0.11 | 11 |
| LNU816 | 78958.7 | 96.7 | L | 37 | 12.1 | L | 37 | 6.13 | L | 17 |
| LNU809 | 79168.3 | 80.8 | 0.14 | 14 | 10.1 | 0.14 | 14 | 5.48 | 0.12 | 5 |
| LNU809 | 79169.2 | 80.4 | 0.01 | 14 | 10.1 | 0.01 | 14 | 5.48 | 0.04 | 5 |
| LNU782 | 77441.1 | 87.6 | 0.04 | 24 | 10.9 | 0.04 | 24 | 5.72 | 0.02 | 10 |
| LNU782 | 77444.2 | 76.2 | 0.26 | 8 | 9.53 | 0.26 | 8 | — | — | — |
| LNU782 | 77444.9 | 87.9 | 0.19 | 24 | 11.0 | 0.19 | 24 | 5.66 | 0.07 | 8 |
| LNU772 | 78937.4 | 75.5 | 0.14 | 7 | 9.44 | 0.14 | 7 | — | — | — |
| LNU772 | 78938.1 | 99.5 | L | 41 | 12.4 | L | 41 | 6.35 | 0.03 | 22 |
| LNU772 | 78940.2 | 85.8 | L | 21 | 10.7 | L | 21 | 5.86 | L | 12 |
| LNU762 | 79329.2 | 75.6 | 0.24 | 7 | 9.45 | 0.24 | 7 | — | — | — |
| CONT. | — | 70.8 | — | — | 8.85 | — | — | 5.22 | — | — |
| LNU882 | 78973.1 | 89.3 | L | 19 | 11.2 | L | 19 | 5.94 | 0.20 | 12 |
| LNU882 | 78973.4 | 92.0 | 0.02 | 23 | 11.5 | 0.02 | 23 | 5.91 | L | 11 |
| LNU871 | 78195.4 | 78.1 | 0.18 | 4 | 9.77 | 0.18 | 4 | 5.45 | 0.24 | 3 |
| LNU865 | 79761.2 | 83.8 | 0.11 | 12 | 10.5 | 0.11 | 12 | 5.69 | 0.06 | 7 |
| LNU865 | 79761.7 | 87.1 | 0.23 | 16 | 10.9 | 0.23 | 16 | 5.89 | 0.21 | 11 |
| LNU857 | 78867.1 | 84.7 | 0.17 | 13 | 10.6 | 0.17 | 13 | 5.79 | 0.20 | 9 |
| LNU835 | 78186.2 | 84.2 | L | 12 | 10.5 | L | 12 | 5.78 | 0.02 | 9 |
| LNU807 | 79250.1 | 81.1 | 0.08 | 8 | 10.1 | 0.08 | 8 | — | — | — |
| LNU798 | 79671.4 | 88.0 | 0.03 | 17 | 11.0 | 0.03 | 17 | 5.72 | 0.08 | 8 |
| LNU795 | 79525.4 | 80.8 | 0.09 | 8 | 10.1 | 0.09 | 8 | 5.48 | 0.18 | 3 |
| LNU766 | 78931.2 | 84.1 | 0.07 | 12 | 10.5 | 0.07 | 12 | 5.71 | L | 8 |
| LNU766 | 78932.1 | 94.9 | 0.14 | 27 | 11.9 | 0.14 | 27 | 5.91 | 0.06 | 11 |
| CONT. | — | 74.9 | — | — | 9.36 | — | — | 5.30 | — | — |
| LNU976 | 78362.2 | — | — | — | — | — | — | 6.38 | 0.08 | 6 |
| LNU976 | 78364.2 | 116.5 | 0.10 | 14 | 14.6 | 0.08 | 12 | 6.57 | 0.02 | 10 |
| LNU970 | 78389.8 | 140.6 | L | 38 | 17.6 | L | 36 | 6.84 | L | 14 |
| LNU970 | 78390.3 | 119.1 | 0.06 | 16 | 14.9 | 0.05 | 15 | 6.53 | 0.11 | 9 |
| LNU963 | 78383.1 | — | — | — | — | — | — | 6.31 | 0.12 | 5 |
| LNU963 | 78383.3 | — | — | — | — | — | — | 6.28 | 0.22 | 5 |
| LNU963 | 78384.2 | 119.9 | 0.05 | 17 | 15.0 | 0.03 | 16 | 6.38 | 0.07 | 6 |
| LNU934 | 79007.5 | 127.0 | 0.17 | 24 | 15.9 | 0.19 | 23 | — | — | — |
| LNU902 | 79606.1 | 110.6 | 0.29 | 8 | 13.8 | 0.30 | 7 | 6.32 | 0.11 | 5 |
| LNU885 | 78416.1 | 110.6 | 0.28 | 8 | 13.8 | 0.28 | 7 | 6.28 | 0.16 | 5 |
| LNU885 | 78419.3 | 111.5 | 0.24 | 9 | 13.9 | 0.24 | 8 | 6.42 | 0.24 | 7 |
| LNU879 | 77799.2 | — | — | — | — | — | — | 6.25 | 0.29 | 4 |
| LNU858 | 79586.3 | 113.6 | 0.22 | 11 | 14.2 | 0.24 | 10 | 6.41 | 0.06 | 7 |
| LNU858 | 79587.2 | — | — | — | — | — | — | 6.29 | 0.16 | 5 |
| LNU790 | 78890.1 | 119.7 | 0.08 | 17 | 15.0 | 0.08 | 16 | 6.50 | 0.14 | 8 |
| CONT. | — | 102.2 | — | — | 12.9 | — | — | 5.99 | — | — |
| LNU947 | 77446.1 | 89.3 | 0.29 | 7 | 11.2 | 0.29 | 7 | — | — | — |
| LNU947 | 77447.3 | 96.7 | 0.01 | 16 | 12.1 | 0.01 | 16 | 5.74 | 0.16 | 6 |
| LNU947 | 77448.4 | 125.6 | L | 50 | 15.7 | L | 50 | 6.93 | 0.09 | 28 |
| LNU940 | 77812.4 | 95.1 | 0.04 | 14 | 11.9 | 0.04 | 14 | 5.79 | 0.05 | 7 |
| LNU940 | 77813.1 | 106.9 | L | 28 | 13.4 | L | 28 | 6.02 | L | 11 |
| LNU900 | 78851.3 | 101.5 | 0.03 | 21 | 12.7 | 0.03 | 21 | 5.85 | 0.07 | 8 |
| LNU900 | 78854.3 | 95.3 | 0.05 | 14 | 11.9 | 0.05 | 14 | 6.01 | 0.07 | 11 |
| LNU898 | 78983.4 | 104.6 | L | 25 | 13.1 | L | 25 | 6.00 | 0.02 | 11 |
| LNU898 | 78985.1 | 97.5 | 0.30 | 16 | 12.2 | 0.30 | 16 | — | — | — |
| LNU898 | 78985.4 | 92.5 | 0.09 | 10 | 11.6 | 0.09 | 10 | 5.65 | 0.18 | 4 |
| LNU894 | 78283.7 | 106.3 | 0.28 | 27 | 13.3 | 0.28 | 27 | — | — | — |
| LNU846 | 78439.4 | 114.8 | 0.19 | 37 | 14.4 | 0.19 | 37 | 6.41 | 0.17 | 18 |
| LNU820 | 77807.2 | 100.2 | L | 20 | 12.5 | L | 20 | 6.00 | L | 11 |
| LNU815 | 77494.1 | 113.0 | L | 35 | 14.1 | L | 35 | 6.26 | L | 15 |
| LNU815 | 77495.3 | 91.5 | 0.07 | 9 | 11.4 | 0.07 | 9 | 5.77 | 0.13 | 6 |
| LNU814 | 78953.2 | 100.2 | 0.12 | 20 | 12.5 | 0.12 | 20 | 5.94 | 0.19 | 10 |

TABLE 127-continued

Genes showing improved plant biomass production at standard nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU814 | 78953.3 | 97.3 | 0.23 | 16 | 12.2 | 0.23 | 16 | 5.79 | 0.22 | 7 |
| LNU811 | 78176.3 | — | — | — | — | — | — | 5.66 | 0.18 | 4 |
| LNU811 | 78176.8 | 95.2 | 0.21 | 14 | 11.9 | 0.21 | 14 | — | — | — |
| LNU811 | 78179.1 | 119.1 | 0.09 | 42 | 14.9 | 0.09 | 42 | 6.49 | 0.17 | 20 |
| LNU797 | 78021.4 | — | — | — | — | — | — | 5.70 | 0.10 | 5 |
| LNU797 | 78025.3 | 100.3 | 0.15 | 20 | 12.5 | 0.15 | 20 | 5.96 | 0.08 | 10 |
| LNU793 | 78166.4 | — | — | — | — | — | — | 5.96 | 0.27 | 10 |
| LNU793 | 78168.1 | 97.7 | 0.02 | 17 | 12.2 | 0.02 | 17 | 5.88 | 0.08 | 8 |
| LNU793 | 78169.2 | 97.8 | 0.04 | 17 | 12.2 | 0.04 | 17 | 5.80 | 0.07 | 7 |
| LNU769 | 78163.8 | — | — | — | — | — | — | 5.78 | 0.08 | 6 |
| LNU756 | 77581.3 | 98.6 | 0.26 | 18 | 12.3 | 0.26 | 18 | 5.89 | 0.20 | 9 |
| LNU751 | 77478.3 | 95.4 | 0.02 | 14 | 11.9 | 0.02 | 14 | — | — | — |
| CONT. | — | 83.7 | — | — | 10.5 | — | — | 5.43 | — | — |
| LNU972 | 78909.3 | 122.2 | 0.04 | 11 | 15.3 | 0.04 | 11 | — | — | — |
| LNU943 | 78407.2 | 123.5 | 0.23 | 12 | 15.4 | 0.23 | 12 | — | — | — |
| LNU913 | 78592.1 | 121.9 | 0.05 | 11 | 15.2 | 0.05 | 11 | 6.47 | 0.10 | 4 |
| LNU913 | 78593.1 | 134.7 | 0.15 | 22 | 16.8 | 0.15 | 22 | 6.91 | L | 11 |
| LNU864 | 79339.2 | 118.0 | 0.13 | 7 | 14.7 | 0.13 | 7 | — | — | — |
| LNU833 | 78184.1 | 117.7 | 0.11 | 7 | 14.7 | 0.11 | 7 | 6.52 | 0.18 | 5 |
| LNU764 | 78926.1 | 116.1 | 0.16 | 5 | 14.5 | 0.16 | 5 | — | — | — |
| LNU764 | 78929.1 | 118.2 | 0.07 | 7 | 14.8 | 0.07 | 7 | — | — | — |
| CONT. | — | 110.3 | — | — | 13.8 | — | — | 6.21 | — | — |

"CONT."—Control;
"Ave."—Average;
"% Incr." = % increment;
"p-val."—p-value;
L means that p-value is less than 0.01, p < 0.1 was considered as significant.

The genes listed in Table 128 improved plant NUE when grown at standard nitrogen concentration levels. These genes produced faster developing plants when grown under limiting nitrogen growth conditions, compared to control plants, grown under identical growth conditions, as measured by growth rate of leaf number, rosette diameter and plot coverage.

TABLE 128

Genes showing improved rosette growth performance at standard nitrogen growth conditions

| Gene Name | Event # | RGR Of Leaf Number | | | RGR Of Plot Coverage [cm²/day] | | | RGR Of Rosette Diameter [cm/day] | | |
|---|---|---|---|---|---|---|---|---|---|---|
| | | Ave. | P-Val. | % Incr. | Ave. | P-Val. | % Incr. | Ave. | P-Val. | % Incr. |
| LNU941 | 78613.5 | 0.870 | 0.22 | 18 | — | — | — | — | — | — |
| LNU941 | 78615.3 | 0.902 | 0.14 | 23 | — | — | — | — | — | — |
| LNU922 | 78290.1 | 0.916 | 0.11 | 25 | — | — | — | — | — | — |
| LNU918 | 78433.8 | 0.889 | 0.16 | 21 | — | — | — | — | — | — |
| LNU918 | 78434.2 | 0.864 | 0.27 | 18 | — | — | — | — | — | — |
| LNU915 | 78426.1 | — | — | — | 11.0 | 0.28 | 18 | 0.454 | 0.29 | 16 |
| LNU915 | 78428.1 | — | — | — | 11.4 | 0.19 | 22 | — | — | — |
| LNU915 | 78428.2 | 0.871 | 0.20 | 19 | — | — | — | — | — | — |
| LNU909 | 78424.3 | 0.919 | 0.09 | 25 | 11.4 | 0.19 | 23 | 0.463 | 0.23 | 18 |
| LNU909 | 78425.4 | 0.881 | 0.19 | 20 | — | — | — | — | — | — |
| LNU849 | 78498.4 | 0.880 | 0.19 | 20 | — | — | — | — | — | — |
| LNU830 | 78741.3 | 0.859 | 0.25 | 17 | — | — | — | — | — | — |
| LNU830 | 78741.5 | 0.851 | 0.29 | 16 | — | — | — | — | — | — |
| LNU822 | 78623.2 | 0.859 | 0.28 | 17 | — | — | — | — | — | — |
| LNU813 | 77682.3 | 0.862 | 0.27 | 17 | — | — | — | — | — | — |
| LNU806 | 78515.4 | 0.921 | 0.10 | 25 | — | — | — | — | — | — |
| LNU806 | 78515.5 | — | — | — | 12.0 | 0.09 | 30 | 0.460 | 0.27 | 18 |
| LNU779 | 77887.3 | 0.887 | 0.16 | 21 | — | — | — | — | — | — |
| CONT. | — | 0.734 | — | — | 9.29 | — | — | 0.391 | — | — |
| LNU976 | 78364.1 | — | — | — | 5.11 | L | 43 | 0.312 | 0.02 | 22 |
| LNU976 | 78364.5 | — | — | — | 4.32 | 0.07 | 21 | 0.297 | 0.07 | 17 |
| LNU970 | 78388.1 | — | — | — | 4.32 | 0.07 | 21 | — | — | — |
| LNU970 | 78389.8 | — | — | — | 4.21 | 0.12 | 18 | 0.293 | 0.10 | 15 |

TABLE 128-continued

Genes showing improved rosette growth performance at standard nitrogen growth conditions

| Gene Name | Event # | RGR Of Leaf Number | | | RGR Of Plot Coverage [cm²/day] | | | RGR Of Rosette Diameter [cm/day] | | |
|---|---|---|---|---|---|---|---|---|---|---|
| | | Ave. | P-Val. | % Incr. | Ave. | P-Val. | % Incr. | Ave. | P-Val. | % Incr. |
| LNU968 | 77918.3 | — | — | — | 4.01 | 0.28 | 13 | — | — | — |
| LNU968 | 77919.4 | — | — | — | 4.37 | 0.06 | 23 | — | — | — |
| LNU963 | 78385.1 | — | — | — | 4.07 | 0.22 | 14 | — | — | — |
| LNU949 | 80553.8 | — | — | — | 4.22 | 0.12 | 19 | 0.286 | 0.20 | 12 |
| LNU949 | 80557.4 | — | — | — | 4.05 | 0.24 | 14 | 0.282 | 0.25 | 11 |
| LNU902 | 79606.5 | — | — | — | 4.36 | 0.09 | 23 | 0.288 | 0.21 | 13 |
| LNU843 | 78962.4 | — | — | — | 4.08 | 0.20 | 15 | — | — | — |
| LNU790 | 78890.1 | — | — | — | 4.16 | 0.14 | 17 | 0.284 | 0.22 | 11 |
| LNU785 | 79616.8 | — | — | — | 4.26 | 0.09 | 20 | — | — | — |
| LNU767 | 79146.1 | — | — | — | 4.20 | 0.14 | 18 | — | — | — |
| LNU767 | 79146.2 | — | — | — | 4.01 | 0.27 | 13 | — | — | — |
| CONT. | — | — | — | — | 3.56 | — | — | 0.255 | — | — |
| LNU918 | 78433.1 | 0.818 | 0.28 | 15 | — | — | — | — | — | — |
| LNU854 | 78238.1 | 0.816 | 0.30 | 15 | — | — | — | — | — | — |
| LNU849 | 78500.1 | 0.819 | 0.29 | 15 | — | — | — | — | — | — |
| LNU830 | 78741.3 | — | — | — | 15.4 | 0.09 | 35 | 0.615 | 0.12 | 24 |
| LNU830 | 78741.5 | — | — | — | 15.3 | 0.11 | 34 | — | — | — |
| LNU813 | 77681.4 | — | — | — | 14.3 | 0.21 | 25 | — | — | — |
| LNU780 | 77489.4 | — | — | — | 14.3 | 0.23 | 25 | — | — | — |
| CONT. | — | 0.712 | — | — | 11.5 | — | — | 0.497 | — | — |
| LNU948 | 78376.3 | — | — | — | 13.9 | 0.13 | 26 | 0.579 | 0.29 | 15 |
| LNU948 | 78378.1 | — | — | — | 15.2 | 0.04 | 38 | — | — | — |
| LNU948 | 78380.3 | 0.791 | 0.04 | 41 | — | — | — | — | — | — |
| LNU921 | 79061.1 | 0.796 | 0.05 | 42 | — | — | — | — | — | — |
| LNU921 | 79063.2 | — | — | — | 13.8 | 0.14 | 25 | — | — | — |
| LNU921 | 79064.2 | — | — | — | 14.4 | 0.06 | 31 | 0.632 | 0.06 | 25 |
| LNU921 | 79064.3 | — | — | — | 16.4 | L | 49 | 0.597 | 0.16 | 18 |
| LNU921 | 79065.1 | 0.781 | 0.05 | 39 | — | — | — | — | — | — |
| LNU912 | 78401.4 | — | — | — | — | — | — | 0.582 | 0.27 | 15 |
| LNU912 | 78402.3 | 0.711 | 0.23 | 27 | — | — | — | — | — | — |
| LNU912 | 78405.2 | 0.905 | 0.01 | 61 | — | — | — | — | — | — |
| LNU889 | 79599.1 | 0.863 | 0.03 | 54 | 13.8 | 0.14 | 25 | — | — | — |
| LNU889 | 79601.4 | 0.686 | 0.28 | 22 | — | — | — | — | — | — |
| LNU888 | 78771.1 | 0.699 | 0.25 | 25 | — | — | — | — | — | — |
| LNU881 | 78372.2 | 0.740 | 0.22 | 32 | 13.4 | 0.18 | 22 | — | — | — |
| LNU881 | 78373.1 | 0.688 | 0.24 | 23 | 14.6 | 0.06 | 33 | 0.584 | 0.22 | 16 |
| LNU881 | 78373.2 | — | — | — | 16.3 | 0.01 | 48 | 0.639 | 0.06 | 27 |
| LNU881 | 78374.1 | — | — | — | 13.9 | 0.13 | 26 | — | — | — |
| LNU881 | 78374.4 | 0.725 | 0.16 | 29 | — | — | — | — | — | — |
| LNU865 | 79759.4 | 0.829 | 0.03 | 48 | — | — | — | — | — | — |
| LNU865 | 79761.2 | — | — | — | 19.3 | L | 76 | 0.680 | 0.01 | 35 |
| LNU865 | 79761.4 | — | — | — | 16.5 | L | 50 | 0.663 | 0.02 | 31 |
| LNU865 | 79761.7 | — | — | — | 14.1 | 0.12 | 28 | 0.583 | 0.25 | 16 |
| LNU857 | 78866.1 | 0.755 | 0.09 | 35 | — | — | — | — | — | — |
| LNU857 | 78867.1 | 0.789 | 0.08 | 41 | — | — | — | — | — | — |
| LNU857 | 78868.2 | 0.717 | 0.21 | 28 | — | — | — | — | — | — |
| LNU857 | 78870.1 | 0.704 | 0.25 | 25 | — | — | — | — | — | — |
| LNU831 | 79331.2 | 0.720 | 0.21 | 28 | — | — | — | — | — | — |
| LNU831 | 79331.5 | 0.704 | 0.24 | 25 | — | — | — | — | — | — |
| LNU831 | 79333.1 | — | — | — | 14.1 | 0.11 | 28 | 0.615 | 0.11 | 22 |
| LNU831 | 79333.2 | — | — | — | 13.4 | 0.25 | 21 | — | — | — |
| LNU816 | 78957.1 | — | — | — | 15.2 | 0.05 | 38 | 0.603 | 0.15 | 20 |
| LNU816 | 78958.2 | 0.692 | 0.25 | 23 | — | — | — | — | — | — |
| LNU816 | 78958.4 | 0.768 | 0.10 | 37 | — | — | — | — | — | — |
| LNU816 | 78958.5 | — | — | — | 14.8 | 0.05 | 35 | 0.576 | 0.28 | 14 |
| LNU816 | 78958.7 | — | — | — | 13.7 | 0.14 | 25 | — | — | — |
| LNU809 | 79167.2 | 0.762 | 0.08 | 36 | — | — | — | — | — | — |
| LNU809 | 79168.5 | 0.831 | 0.03 | 48 | — | — | — | — | — | — |
| LNU807 | 79248.1 | 0.773 | 0.10 | 38 | — | — | — | — | — | — |
| LNU807 | 79250.1 | 0.688 | 0.26 | 23 | — | — | — | — | — | — |
| LNU795 | 79521.6 | 0.766 | 0.07 | 37 | — | — | — | — | — | — |
| LNU795 | 79525.1 | — | — | — | 13.3 | 0.21 | 21 | — | — | — |
| LNU795 | 79525.4 | — | — | — | 14.1 | 0.11 | 28 | 0.606 | 0.15 | 20 |
| LNU788 | 78516.1 | — | — | — | 16.2 | L | 47 | 0.594 | 0.17 | 18 |
| LNU788 | 78517.1 | — | — | — | 14.3 | 0.08 | 30 | — | — | — |
| LNU788 | 78517.2 | — | — | — | 13.3 | 0.25 | 21 | — | — | — |
| LNU788 | 78518.1 | — | — | — | 17.8 | L | 62 | 0.575 | 0.29 | 14 |
| LNU788 | 78520.4 | 0.791 | 0.07 | 41 | — | — | — | — | — | — |
| LNU783 | 79178.2 | 0.720 | 0.19 | 28 | — | — | — | — | — | — |
| LNU783 | 79178.4 | — | — | — | — | — | — | 0.587 | 0.21 | 16 |
| LNU778 | 78944.1 | — | — | — | 16.3 | 0.01 | 48 | 0.593 | 0.21 | 18 |
| LNU778 | 78944.2 | 0.719 | 0.23 | 28 | — | — | — | — | — | — |

TABLE 128-continued

Genes showing improved rosette growth performance at standard nitrogen growth conditions

| Gene Name | Event # | RGR Of Leaf Number | | | RGR Of Plot Coverage [cm²/day] | | | RGR Of Rosette Diameter [cm/day] | | |
|---|---|---|---|---|---|---|---|---|---|---|
| | | Ave. | P-Val. | % Incr. | Ave. | P-Val. | % Incr. | Ave. | P-Val. | % Incr. |
| LNU762 | 79326.1 | 0.697 | 0.29 | 24 | — | — | — | — | — | — |
| LNU752 | 78151.2 | 0.686 | 0.26 | 22 | — | — | — | — | — | — |
| LNU752 | 78153.1 | 0.684 | 0.28 | 22 | 15.3 | 0.05 | 39 | 0.618 | 0.12 | 22 |
| CONT. | — | 0.561 | — | — | 11.0 | — | — | 0.504 | — | — |
| LNU846 | 78439.4 | — | — | — | 15.1 | 0.13 | 22 | — | — | — |
| LNU814 | 78955.5 | 0.958 | 0.09 | 17 | — | — | — | — | — | — |
| LNU772 | 78938.1 | — | — | — | 15.1 | 0.13 | 22 | — | — | — |
| LNU757 | 77483.2 | 0.925 | 0.19 | 13 | — | — | — | — | — | — |
| CONT. | — | 0.818 | — | — | 12.4 | — | — | — | — | — |
| LNU972 | 78907.1 | 0.923 | 0.01 | 20 | — | — | — | — | — | — |
| LNU972 | 78909.3 | — | — | — | 10.4 | 0.06 | 23 | 0.484 | 0.08 | 16 |
| LNU961 | 79143.3 | 0.835 | 0.26 | 8 | — | — | — | — | — | — |
| LNU961 | 79143.4 | — | — | — | — | — | — | 0.458 | 0.28 | 10 |
| LNU958 | 77687.2 | — | — | — | 10.2 | 0.09 | 21 | — | — | — |
| LNU958 | 77687.5 | — | — | — | 10.5 | 0.05 | 24 | 0.491 | 0.06 | 17 |
| LNU958 | 77689.1 | — | — | — | 9.75 | 0.21 | 15 | — | — | — |
| LNU948 | 78378.1 | — | — | — | 9.85 | 0.21 | 17 | 0.469 | 0.19 | 12 |
| LNU948 | 78380.2 | — | — | — | 9.66 | 0.26 | 14 | — | — | — |
| LNU921 | 79063.2 | — | — | — | 10.0 | 0.15 | 18 | — | — | — |
| LNU921 | 79064.3 | — | — | — | 9.89 | 0.17 | 17 | — | — | — |
| LNU913 | 78592.1 | — | — | — | 10.8 | 0.04 | 27 | 0.471 | 0.16 | 13 |
| LNU913 | 78592.3 | 0.874 | 0.09 | 13 | 10.1 | 0.12 | 19 | — | — | — |
| LNU913 | 78592.4 | 0.887 | 0.14 | 15 | 10.8 | 0.03 | 27 | 0.462 | 0.24 | 10 |
| LNU913 | 78593.1 | — | — | — | 10.2 | 0.09 | 21 | — | — | — |
| LNU913 | 78593.6 | 0.923 | 0.04 | 20 | 11.2 | 0.01 | 33 | 0.460 | 0.25 | 10 |
| LNU912 | 78403.2 | 0.846 | 0.22 | 10 | 9.68 | 0.24 | 15 | 0.471 | 0.17 | 13 |
| LNU912 | 78404.1 | — | — | — | 9.60 | 0.27 | 14 | — | — | — |
| LNU888 | 78772.1 | 0.847 | 0.26 | 10 | — | — | — | — | — | — |
| LNU888 | 78772.7 | 0.877 | 0.14 | 14 | — | — | — | — | — | — |
| LNU881 | 78372.2 | — | — | — | 10.1 | 0.12 | 20 | 0.467 | 0.19 | 12 |
| LNU881 | 78373.2 | 0.856 | 0.21 | 11 | 11.0 | 0.02 | 31 | 0.466 | 0.19 | 11 |
| LNU881 | 78374.1 | 0.890 | 0.08 | 16 | — | — | — | — | — | — |
| LNU823 | 78136.4 | — | — | — | 9.63 | 0.26 | 14 | — | — | — |
| LNU816 | 78957.1 | — | — | — | 10.3 | 0.09 | 22 | 0.472 | 0.16 | 13 |
| LNU816 | 78958.7 | — | — | — | 11.5 | L | 36 | 0.500 | 0.03 | 20 |
| LNU809 | 79168.3 | 0.844 | 0.26 | 10 | 9.74 | 0.22 | 15 | — | — | — |
| LNU809 | 79169.2 | — | — | — | 9.59 | 0.27 | 13 | — | — | — |
| LNU782 | 77441.1 | — | — | — | 10.4 | 0.07 | 23 | — | — | — |
| LNU782 | 77444.9 | — | — | — | 10.4 | 0.08 | 22 | — | — | — |
| LNU772 | 78938.1 | — | — | — | 11.9 | L | 41 | 0.524 | L | 25 |
| LNU772 | 78940.2 | — | — | — | 10.2 | 0.10 | 21 | 0.482 | 0.09 | 15 |
| LNU757 | 77481.1 | 0.911 | 0.05 | 18 | — | — | — | — | — | — |
| LNU757 | 77483.3 | 0.841 | 0.29 | 9 | — | — | — | — | — | — |
| LNU757 | 77485.4 | 0.925 | 0.01 | 20 | — | — | — | — | — | — |
| CONT. | — | 0.770 | — | — | 8.45 | — | — | 0.418 | — | — |
| LNU882 | 78973.1 | — | — | — | 10.8 | 0.06 | 21 | 0.469 | 0.09 | 14 |
| LNU882 | 78973.4 | — | — | — | 11.1 | 0.03 | 24 | 0.456 | 0.16 | 11 |
| LNU865 | 79761.2 | — | — | — | 10.0 | 0.24 | 13 | 0.461 | 0.12 | 12 |
| LNU865 | 79761.7 | — | — | — | 10.4 | 0.13 | 17 | 0.466 | 0.10 | 14 |
| LNU857 | 78867.1 | — | — | — | 10.3 | 0.17 | 15 | 0.459 | 0.15 | 12 |
| LNU848 | 77909.3 | — | — | — | 10.2 | 0.21 | 15 | — | — | — |
| LNU835 | 78186.2 | — | — | — | 10.1 | 0.23 | 13 | 0.461 | 0.12 | 13 |
| LNU828 | 77598.3 | — | — | — | 10.3 | 0.18 | 15 | — | — | — |
| LNU807 | 79248.5 | 0.998 | 0.24 | 14 | — | — | — | — | — | — |
| LNU798 | 79671.4 | — | — | — | 10.7 | 0.06 | 20 | 0.450 | 0.22 | 10 |
| LNU766 | 78931.2 | — | — | — | 10.0 | 0.24 | 13 | 0.444 | 0.30 | 8 |
| LNU766 | 78932.1 | — | — | — | 11.3 | 0.02 | 26 | 0.456 | 0.18 | 11 |
| LNU752 | 78153.1 | 1.02 | 0.16 | 17 | — | — | — | 0.410 | — | — |
| CONT. | — | 0.873 | — | — | 8.92 | — | — | 0.410 | — | — |
| LNU976 | 78364.2 | — | — | — | — | — | — | 0.579 | 0.14 | 15 |
| LNU970 | 78389.8 | — | — | — | 17.5 | 0.01 | 38 | 0.578 | 0.14 | 15 |
| LNU970 | 78390.3 | — | — | — | 14.8 | 0.25 | 17 | 0.560 | 0.28 | 11 |
| LNU963 | 78384.2 | — | — | — | 15.0 | 0.20 | 19 | — | — | — |
| LNU934 | 79007.5 | — | — | — | 15.5 | 0.14 | 23 | — | — | — |
| LNU924 | 77608.3 | — | — | — | — | — | — | 0.558 | 0.30 | 11 |
| LNU902 | 79604.4 | 0.894 | 0.11 | 19 | — | — | — | — | — | — |
| LNU790 | 78890.1 | — | — | — | 14.7 | 0.26 | 16 | — | — | — |
| LNU790 | 78890.3 | 0.881 | 0.16 | 17 | — | — | — | — | — | — |
| LNU767 | 79146.1 | 0.862 | 0.21 | 15 | — | — | — | — | — | — |
| CONT. | — | 0.750 | — | — | 12.6 | — | — | 0.503 | — | — |
| LNU947 | 77447.3 | — | — | — | 11.7 | 0.23 | 15 | — | — | — |
| LNU947 | 77448.4 | — | — | — | 15.2 | L | 50 | 0.552 | L | 28 |

TABLE 128-continued

Genes showing improved rosette growth performance at standard nitrogen growth conditions

| Gene Name | Event # | RGR Of Leaf Number | | | RGR Of Plot Coverage [cm²/day] | | | RGR Of Rosette Diameter [cm/day] | | |
|---|---|---|---|---|---|---|---|---|---|---|
| | | Ave. | P-Val. | % Incr. | Ave. | P-Val. | % Incr. | Ave. | P-Val. | % Incr. |
| LNU940 | 77812.4 | — | — | — | 11.7 | 0.25 | 15 | — | — | — |
| LNU940 | 77813.1 | — | — | — | 13.0 | 0.03 | 28 | 0.482 | 0.18 | 12 |
| LNU900 | 78851.3 | — | — | — | 12.2 | 0.11 | 21 | — | — | — |
| LNU900 | 78854.3 | — | — | — | 11.6 | 0.26 | 14 | 0.511 | 0.04 | 19 |
| LNU898 | 78983.4 | — | — | — | 12.7 | 0.05 | 26 | 0.482 | 0.17 | 12 |
| LNU898 | 78985.1 | — | — | — | 12.0 | 0.17 | 18 | 0.480 | 0.21 | 12 |
| LNU894 | 78282.3 | — | — | — | 12.0 | 0.20 | 18 | — | — | — |
| LNU894 | 78283.4 | 0.909 | 0.18 | 16 | 12.4 | 0.11 | 22 | — | — | — |
| LNU894 | 78283.7 | — | — | — | 12.8 | 0.07 | 27 | 0.485 | 0.28 | 13 |
| LNU846 | 78438.2 | — | — | — | — | — | — | 0.476 | 0.26 | 11 |
| LNU846 | 78439.4 | — | — | — | 13.8 | 0.01 | 36 | 0.499 | 0.13 | 16 |
| LNU820 | 77807.2 | — | — | — | 12.2 | 0.11 | 21 | 0.502 | 0.06 | 17 |
| LNU815 | 77492.6 | — | — | — | 12.5 | 0.11 | 23 | 0.479 | 0.28 | 11 |
| LNU815 | 77494.1 | — | — | — | 13.8 | L | 36 | 0.510 | 0.04 | 19 |
| LNU815 | 77495.3 | — | — | — | — | — | — | 0.476 | 0.23 | 11 |
| LNU814 | 78953.2 | — | — | — | 12.1 | 0.13 | 20 | 0.490 | 0.13 | 14 |
| LNU814 | 78953.3 | — | — | — | 11.8 | 0.23 | 16 | — | — | — |
| LNU811 | 78176.8 | — | — | — | 11.6 | 0.25 | 15 | — | — | — |
| LNU811 | 78179.1 | — | — | — | 14.2 | L | 41 | 0.517 | 0.05 | 20 |
| LNU797 | 78025.3 | — | — | — | 12.2 | 0.14 | 20 | 0.487 | 0.16 | 13 |
| LNU793 | 78166.4 | — | — | — | 12.1 | 0.15 | 19 | 0.479 | 0.24 | 11 |
| LNU793 | 78168.1 | — | — | — | 12.1 | 0.13 | 19 | 0.493 | 0.11 | 15 |
| LNU793 | 78169.2 | — | — | — | 11.9 | 0.19 | 17 | — | — | — |
| LNU769 | 78163.4 | — | — | — | — | — | — | 0.488 | 0.20 | 14 |
| LNU769 | 78163.8 | — | — | — | — | — | — | 0.480 | 0.22 | 12 |
| LNU756 | 77581.3 | — | — | — | 12.1 | 0.14 | 20 | 0.483 | 0.19 | 12 |
| LNU751 | 77477.1 | 0.878 | 0.25 | 12 | — | — | — | — | — | — |
| LNU751 | 77477.4 | 0.914 | 0.19 | 16 | — | — | — | — | — | — |
| LNU751 | 77478.3 | — | — | — | 11.7 | 0.23 | 15 | — | — | — |
| CONT. | — | 0.786 | — | — | 10.1 | — | — | 0.430 | — | — |
| LNU913 | 78593.1 | — | — | — | 16.7 | 0.09 | 23 | — | — | — |
| LNU896 | 78978.1 | 0.887 | 0.26 | 14 | — | — | — | — | — | — |
| CONT. | — | 0.777 | — | — | 13.6 | — | — | — | — | — |

"CONT."—Control;
"Ave."—Average;
"% Incr." = % Increment;
"p-val."—p-value;
L means that p-value is less than 0.01, p < 0.1 was considered as significant.

Example 19

Evaluation of Transgenic *Brachypodium* NUE and Yield Under Low or Normal Nitrogen Fertilization in Greenhouse Assay Assay 1: Nitrogen Use Efficiency Measured Plant Biomass and Yield at Limited and Optimal Nitrogen Concentration Under Greenhouse Conditions Until Heading—

This assay follows the plant biomass formation and growth (measured by height) of plants which are grown in the greenhouse at limiting and non-limiting (e.g., normal) nitrogen growth conditions. Transgenic *Brachypodium* seeds were sown in peat plugs. The $T_1$ transgenic seedlings were then transplanted to 27.8×11.8×8.5 cm trays filled with peat and perlite in a 1:1 ratio. The trays were irrigated with a solution containing nitrogen limiting conditions, which were achieved by irrigating the plants with a solution containing 3 mM inorganic nitrogen in the form of $NH_4NO_3$, supplemented with 1 mM $KH_2PO_4$, 1 mM $MgSO_4$, 3.6 mM KCl, 2 mM $CaCl_2$ and microelements, while normal nitrogen levels were achieved by applying a solution of 6 mM inorganic nitrogen also in the form of $NH_4NO_3$ with 1 mM $KH_2PO_4$, 1 mM $MgSO_4$, 2 mM $CaCl_2$, 3.6 mM KCl and microelements. All plants were grown in the greenhouse until heading. Plant biomass (the above ground tissue) was weighted right after harvesting the shoots (plant fresh weight [FW]). Following, plants were dried in an oven at 70° C. for 48 hours and weighed (plant dry weight [DW]).

Figure 9B:
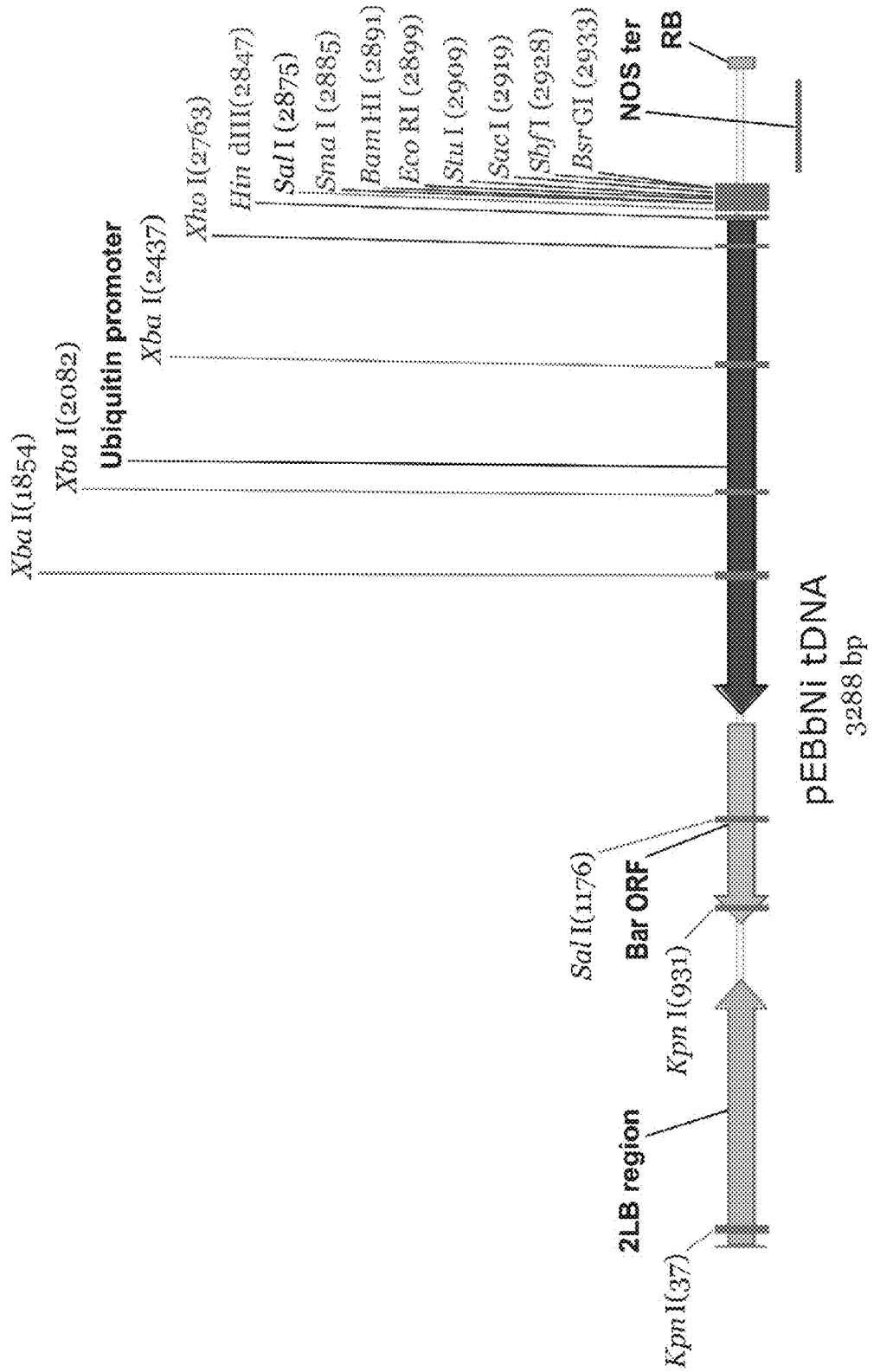

Each construct was validated at its $T_1$ generation. Transgenic plants transformed with a construct conformed by an empty vector carrying the BASTA selectable marker were used as control (FIG. 9B).

The plants were analyzed for their overall size, fresh weight and dry matter. Transgenic plants performance was compared to control plants grown in parallel under the same conditions. Mock—transgenic plants with no gene and no promoter at all, were used as control (FIG. 9B).

The experiment was planned in blocks and nested randomized plot distribution within them. For each gene of the invention five independent transformation events were analyzed from each construct.

Phenotyping

Plant Fresh and Dry shoot weight—In Heading assays when heading stage has completed (about day 30 from sowing), the plants were harvested and directly weighed for the determination of the plant fresh weight on semi-analytical scales (0.01 gr) (FW) and left to dry at 70° C. in a drying chamber for about 48 hours before weighting to determine plant dry weight (DW).

Time to Heading—In both Seed Maturation and Heading assays heading was defined as the full appearance of the first spikelet in the plant. The time to heading occurrence is defined by the date the heading is completely visible. The time to heading occurrence date was documented for all plants and then the time from planting to heading was calculated.

Leaf thickness—In Heading assays when minimum 5 plants per plot in at least 90% of the plots in an experiment have been documented at heading, measurement of leaf thickness was performed using a micro-meter on the second leaf below the flag leaf.

Plant Height—In both Seed Maturation and Heading assays once heading was completely visible, the height of the first spikelet was measured from soil level to the bottom of the spikelet.

Tillers number—In Heading assays manual count of tillers was preformed per plant after harvest, before weighing.

Example 20

Evaluation of Transgenic *Brachypodium* NUE and Yield Under Low or Normal Nitrogen Fertilization in Greenhouse Assay Assay 2: Nitrogen Use Efficiency Measured Plant Biomass and Yield at Limited and Optimal Nitrogen Concentration Under Greenhouse Conditions Until Seed Maturation—

This assay follows the plant biomass and yield production of plants that were grown in the greenhouse at limiting and non-limiting nitrogen growth conditions. Transgenic *Brachypodium* seeds were sown in peat plugs. The $T_1$ transgenic seedlings were then transplanted to 27.8×11.8×8.5 cm trays filled with peat and perlite in a 1:1 ratio. The trays were irrigated with a solution containing nitrogen limiting conditions, which were achieved by irrigating the plants with a solution containing 3 mM inorganic nitrogen in the form of $NH_4NO_3$, supplemented with 1 mM $KH_2PO_4$, 1 mM $MgSO_4$, 3.6 mM KCl, 2 mM $CaCl_2$ and microelements, while normal nitrogen levels were achieved by applying a solution of 6 mM inorganic nitrogen also in the form of $NH_4NO_3$ with 1 mM $KH_2PO_4$, 1 mM $MgSO_4$, 2 mM $CaCl_2$, 3.6 mM KCl and microelements. All plants were grown in the greenhouse until seed maturation. Each construct was validated at its $T_1$ generation. Transgenic plants transformed with a construct conformed by an empty vector carrying the BASTA selectable marker were used as control (FIG. 9B).

The plants were analyzed for their overall biomass, fresh weight and dry matter, as well as a large number of yield and yield components related parameters. Transgenic plants performance was compared to control plants grown in parallel under the same conditions. Mock—transgenic plants with no gene and no promoter at all (FIG. 9B). The experiment was planned in blocks and nested randomized plot distribution within them. For each gene of the invention five independent transformation events were analyzed from each construct.

Phenotyping

Plant Fresh and Dry vegetative weight—In Seed Maturation assays when maturity stage has completed (about day 80 from sowing), the plants were harvested and directly weighed for the determination of the plant fresh weight (FW) and left to dry at 70° C. in a drying chamber for about 48 hours before weighting to determine plant dry weight (DW).

Spikelets Dry weight (SDW)—In Seed Maturation assays when maturity stage has completed (about day 80 from sowing), the spikelets were separated from the biomass, left to dry at 70° C. in a drying chamber for about 48 hours before weighting to determine spikelets dry weight (SDW).

Grain Yield per Plant—In Seed Maturation assays after drying of spikelets for SDW, spikelets were run through production machine, then through cleaning machine, until seeds were produced per plot, then weighed and Grain Yield per Plant was calculated.

Grain Number—In Seed Maturation assays after seeds per plot were produced and cleaned, the seeds were run through a counting machine and counted.

1000 Seed Weight—In Seed Maturation assays after seed production, a fraction was taken from each sample (seeds per plot; ~0.5 gr), counted and photographed. 1000 seed weight was calculated.

Harvest Index—In Seed Maturation assays after seed production, harvest index was calculated by dividing grain yield and vegetative dry weight.

Time to Heading—In both Seed Maturation and Heading assays heading was defined as the full appearance of the first spikelet in the plant. The time to heading occurrence is defined by the date the heading is completely visible. The time to heading occurrence date was documented for all plants and then the time from planting to heading was calculated.

Leaf thickness—In Heading assays when minimum 5 plants per plot in at least 90% of the plots in an experiment have been documented at heading, measurement of leaf thickness was performed using a micro-meter on the second leaf below the flag leaf.

Grain filling period—In Seed Maturation assays maturation was defined by the first color-break of spikelet+stem on the plant, from green to yellow/brown.

Plant Height—In both Seed Maturation and Heading assays once heading was completely visible, the height of the first spikelet was measured from soil level to the bottom of the spikelet.

Tillers number—In Heading assays manual count of tillers was preformed per plant after harvest, before weighing.

Number of reproductive heads per plant—In Heading assays manual count of heads per plant was performed.

Statistical analyses—To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (5436 sequences)

SEQ ID NO: 1 - DNA, 2406 bp, Hordeum vulgare
gaagacaaagagacggcacgcacccgcacccgcagctctttgccgcgtttacccgcctcaccgacgctagggtttcgatccgtgccggcgtccgcgggaggcgtgcttgccagccagagatggaggtggagcgtctcctggacctggccgtcgattacggcttcgaccgcgacttcgccgtagccgccctctcccgcctcgtccacctctacggagagggtggccaagatttcattactgtggagaactgtggcgatgattttattgctgcattggctgatgcaacacaacctactgatgactgggatgacctcaatgcaatagagactgaagcttgtggcaatttgaatgaaatgatgaggaagggtgtaaatgatgaaaaaggaggagttgttcttgatacccctttgttcaaaagggcagactcctccagtaaacataatccgaaagattttgacatatttaatgaaacaaacacccaccatgataatcccgtgggtacccagaagaaggcacaaaccagaaactctaaagctcagacaagaagctcaacaaaatctactgcattgctctttgtgttccaaaacaatgttttgaaggtgaccaaagcaaccaagagatatgaatcaacaactctaacttcaaatagagagggacagccaaatgcatgtctttggaagagaggaattctgagttatgagcagctttcttctctagatgacatcaatttggcaaatgctgtcatctttggcaacaaaagttttaggcccctgcagtatgaagcttgtagtgctgcactggataataaagactgttttatacttatgccaacaggtggtggcaaaagcttgtgttatcagctccctgcaacattgcatccaggtgttactgttgttgtgtgtccattactgtcacttattcaggatcaggtggttgctttaaccttcaagtttgggatacaagcagcattcttgaattctcagcaaacttctgcacaggcatctgcagttatccaggagcttagaaatggcacaccttctttcaaacttctgtatgtcacacctgaaagaatggctggaaactattccttcatggagatcctcaaaggcttacaccagaggggattgctagcaagatttgtgattgatgaagcacactgtgtaagtcaatggggacatgactttcgtccagattaccgaggcttaggatgcctcaaacagcacttccctagagtcccaatcatggctctaactgcaacagcaactgaagctgtccgtaaggacgtcctcaataccttgaggatcccaaacgctttggtacttaagaggagctttgacagacacaacctcaactacatggtgattggcaagactagaactccccagatgcagctgggtgatttactgaaagagcgtttcatgaacatgtctggcattgtgtattgtctctcgaagaatgaatgtgcggacactgccaagttcttgagggagaagtacaagataaaatgtgctcattaccatgctggcttggcggcccgtcagcgaagcagcgtccaagaaaagtggcacagaggagaggtcaaagttatttgtgctacaatagccttcggcatggggattgacaagcctgacgtgcgctttgttgtccacaacacgctgtcgaaatcgatagaaagctactatcaggagtctgggcgggctggaagagacgatcttccagcgcattgtgtggtgttatatcagaagaaagacttcagccgcattgtgtgcatgctgaggagtgctgaaaacttcaagagtgaaaccttcaaggttgcaatggaccaagcaaagaaaatgcaggcatattgcgagctgaagactgagtgtcgcagggagactcttctgggtcactttggcgaacagttcaacagtcaaaggtgtaaagatggcccaagcccctgtgacatctgcctgaaggaagcttcgcgagggcactaagaaagtgttggtcttaactccatgatggcttggaacttagaagctgtgttcctacagaaacagtacaagctttgtgatgcacactgtccctggacttatgttcaggctttacgatcagtgcagaggacaggagggggttatcttgcgcaggatcgtgggattttaccttgtagctcttcactgcatatataagcgcataacccttttatgtttctcctctcggttcgttgaagtcttattaattgcataaagatgttaagagctgtttaagtctacattcttaccatattcgcagtcatcaatgtcaggtattttcctatggagcaatgctatgctagactttgtaaattttacttaggtgtgggattttcgtttcctaaccccacacaaaggaatcatgttctatgcaaaaaaaaaaaaaaaatac

SEQ ID NO: 2 - DNA, 821 bp, Hordeum vulgare
tctcaatatctcatcagtcatcaccaatggcgcgctccagagcctcgaccatgtcatcgccggtgcaccgcctgctgatcgtggccgccgcggcggcgctcgtctcggcgtgtgcggcggacccggagccggtgcaggacttctgcgtggcggcggtcaccaacggctcggccgaccatccgtcgtacccggggttcccgtgcaagccggcgtcggcggtggtctccgacgacttcttcttcgccgggctggcgaagtctggcgccgccgaggcggccgatagcccgttcgggtccagcgtgacgccgggcaacgtggcggccttcccggggctcaacacgctcggcgtctccatcaaccgcgtcgacctcgcccccggcggcgtcaacccgctgcacagccacccgcgcgccgccgagctcgtgcacgtcgtcgccggccagatgctcgtcggcttcgtcagcacggcggggaccttctactccaaggtggtgcgggagggggagagcttcgtcatcccgcgcggcctggtgcacttccagttcaacaccgggaaggaggccgccagggcggtgaccgtgttcaacagccagctccccggcgtcgtgctcgccgcgccgtcgctgttcggggcggacccggagatccccgacgccgtcctcgccaagagcttccaggtcgacggcgagatcatcaagctcctcaagtccaagttccggaattgatggcgggacatgaatacttcacgtcgaagctgcctgctgttgttaccttgattggtttattgttatacatacactgtacaccagtaaatacggaca

SEQ ID NO: 3 - DNA, 1230 bp, Hordeum vulgare
agtggatccaaagcctctcctgcacctcgcgatcgagactccattcattcctagaagaagactgatcacctcctcggctcattctacccggccgatcggacgcgcaggcgccggattaatccctccgtgtccgcggcaatggagagcgtggagggaaacggcaccggccgcgggaacctgcagctcgtggtgtcggagctgtgccgcatccaggagctggtgcggcagctggagctgcacctgcacgcgccggacacctccgtcgacctatgccgcgccctcaccgctcagatcttcgcgctcaccgacaggtccatcggcttcgtcgccgccgcacattcctccgacgccccgacgacgccctccagcacgtccagctccctcagcggcgtctccgaccagcctttcaggaccaacaccaagaagaggaaggcgacggcgaggtggacgagccaggtgagggtgagtgcggccggcggcgcggaggggcctggcgacgacggccacagctggaggaagtacgggcagaaggacatcctcggcgccaagcacccgagggcgtactaccgctgcacccaccgcaactcgcagggctgcaccgccaccaagcaggtgcagcgcgccgacgaggaccccgtgctcttcgacgtcgtctaccacggccagcacacctgcaggccgacaggcggcggcggcggcggcaggaggccgccgacgaaccaacacaacccgcacgcggagagcctgctgcagagcctcagagccggcctggccgtggacgccgatcacggcggcctgaacaccagcgtctgtgtctcacctccgatgacgtcgccgtcgatggcctcgcctgtggcgtctggctccaacgggggtccgaccatgtcgccgtacccggccggcgcgtacacggagtggccgttggacggcgacctccaggaggtggtgtcggtgttcacagccgtgtcagccccgagcatggactaccttttcgagttcgacccgaccttcgacgttgatgcgcccaacttcttcatgtgaggacgacgaacagagcatatctgaatagacgaagacccgagctttaggatatctgaatagtgtagcttgttcccttctttctttcttttcttctacagttttctttggttaggttttgttgatttattttgtaaggaaagcggaaaaaaaataaggtgttgaaattcgataatcaaaaaaaaaaaaaaa

SEQ ID NO: 4 - DNA, 2377 bp, Hordeum vulgare
gacccacccctcccactcccccctccttctttctttcccctcctcccctcttgtcgccatcaaccaagaacgtactggaaggaaggaagaaagaggagcaagaaccgagataggatcgtctctcctcttccccggcctcttaacgagaacgcagagtctcttttgaatctttgtggcagcggacaggccttctttaaccatgtgctccggcccgcgcaagccgtcgaccccgccgctggcggcgccggcgcccaaggattccggggccatggcctcgctcctcctcgagctggccgcggcggacgacgtggtggagttcaggcgggttgtcgaggaggagaaggcgtgccttgatgctgcggcctcgtggtatggcccgtcggcggttggcctgggccggctcggcgcggagagccggacgccggccatggtcgccgcgctctacgggagcacggccgtgctggcgcacgcgctgtccgtcgcgccgggcgaggcctgccgcgcgtccgacacggacggcgccaccgcgctccatatggctgcggctggtggcgcggcgaacgcggttgcggccacgcacctgctgctcgccgcgggggcctccacggaggcgctctcggtgtccgggctccgcgccggggacctgctcccgcgcgccgcgggcgtggctgagaagcctctacgcctgctgctcaagtctcccgccgtgtcaccctcctcgtcgcccaagaagtccgcctcgccgccggcgacggtggctgccgcgcaggagcccaggaaggagtacccgccggacctcacgctgccggacctcaagagcgggctcttcagcaccgacgagttccgtatgtacagcttcaaggtgaagccctgctcccgcgcctactcccatgactggaccgagtgccccttcgtgcaccccggcgagaacgcgcgccgccgcgacccgcgccgctactcctacagctgcgtgccctgcccggagttccgcaagggcgggtcgtgccgcaagggcgacggctgcgagtacgcgcacggcgtcttcgagtgctggctccacccggcgcagtaccggacgcgcctctgcaaggacgaggtcggctgcgcgcgccgcatctgcttcttcgcccacaggcgcgacgagctccgctccgtcaacccctccgccgtctccgtcggcatgatgcagccggtgtccccgcgctcctcgccccccaacgggatggacatggggatgctcagccccgcggggtggccctcgtcgccggccagccggctcaagacggcgcgggagctcgacttcgacctggagatgctcgcgctggaccagtaccagcagaagctgttcgacaaggtgtccaacaacgcgcactcgccgagggcgagctggggcgcgcccaacggcggcctcggctcgccgcgcgcggccgcagggtcgcccgccagaaacatgccggactacaccgacctgctcggctccatggacccggccatgctctcccagctccacgcgctctcacttaaacaggcgggcgacatgtcgccgtacagctccatgccggacacgcagctgcacatgccgacctcgccgatggtgggcgcgaacaactcgttcggcctcgaccactccatggccaaggccatcatgacctcccgcgcctccgcgttcgccaagcgtagccagagcttcatcgaccgcggcgcgcgcgccccggccgcgcgctccctcatgtcgccggcgacgatcggcgagccatccatgctgacagactggggctctcccagcggcggcggcaatcttgactggggctcacccggcggcaagctggactggggcatgcagggagacgagctgcacaagttccgcaagtcggcgtccttcgggttccgcgggcagtccgccatgccggcggcctccgcagccacctcggccgaacccgacgtctcatgggtgaactctcttgtcaaggatggccacacaggcgaccattttccgcagtggctggagcaggagcagatggtggcctgatcccaccccgtcgacgacgatcgatcgatcactggctcatagcgtctagctgaccaaagttctttccttcaaatttttttccacccttttttatctgcttaatttgattcatatgagatggttctttattagtacatatatgctgttcacaaaaaaataatattgctcatcagcaatatcagcatggatgcccaaagggagccttaggttgattaagaacagccacaatattttacctctttttcccccctttcccttcggtttataaatagctgtatacaagaattccatcaagagtttatttacttgatatctatacatactttgagaccagcaagatttgttttg

SEQ ID NO: 5 - DNA, 972 bp, Hordeum vulgare
cggggatcaatcaagccaaagagaaaggatggcatcaggcttgcaagtgtttggccagccagcatctaccgatgttgccagggttctgacatgcctctttgagaagaatttggagttcgatcttgtccgcattgacacattcaagagggagcacaggcttcctgagttcattaggctgcgggatccaagtggacaagtgacattcaagcatggtgacaagactcttgttgatccaagggctatttgccggtacctctgtacccagttcccaaaccagggaaacaggaacctctatgggactggttctctggaacgggcctcaatagaacagtggctgcaagcagaggctcagaacttcaaccctcccagctcggccctcgtgtttcagctggcatttgctcctgttttggaaatccctcaagaccacatggtcattgcagagaatgagaggaagcttcagcaagtcctcaacgtctacgatgaaatactctcgaagaacgagtacctggctggcgatgagttcaccctggctgacctctgtcaccttccggactcgcagtacattgtgagctcggagagggggatgaagctcttcacctccaggaaaaatgtggcgaggtggttcgaccaaatctcgagccgcaagacgtgggagcaggttgtcaagatgcaaatggagcatcctggcgcgttcgagtagcgccttggtggtcgcaagcaagtgtcgagctcatatcgaagagctctctacgtttatcgatcttattttcatgtgttctttcgtcatcgttgctacttgtgctgtcgtcgtttactgaatccccatcaacgttgtcttgtgaaccagaataatatgacgcctgtttgtgatgtattgtgtacatcggctgcttaaaatgcttttgcccttgtccactgaataaaaccatatgtatgttttatcaggtgtatatttcactagtttcattttca

SEQ ID NO: 6 - DNA, 1261 bp, Hordeum vulgare
acatgctcgctcgtcgggactcgggagtaccgacgaatcctcgccgcttgccgatcagaagtcgcgacgagctcacctaatattccacctctccccagaggccacccaacctaccacatggctgtatgtataatactgtactccactgcagcagaagcgaggtgctcgtgaagtcgacgtgatatccagtccagtggccgatccgtgatccgtgttggagagagcgagggagagaagatgcggccgcggctggtgctcttcggcgactcaatcaccgagcagtcctttgcctccggcggctggggcgccgccctcgcggagcacttcgcgaggcaggcggatgtggtgctgcgcgggctcagcgggtacaacacgcgctgggcgctgaaggtgctggacagagccatggagggggcggccgacggaggcgcggacccggcggcggtgacggtgttcttcggcgccaacgacgccaccctgcccgaccaggcgcaggcgcaccagaacgtcccgctcggggagtaccaggacaacctacgcgcgatttgcgcctacttcaagaataagtggccctccgctgccgtcatactcatcacccctccaccgatccacgagccggcaaggattcgagacatatatggagataatgacccttcaagacagcctgaaagaaccaatgaagctgctggcacttatgcacaggcgtgcatagctgttgctaaagaattgggtcatccagttatagacatctggacgctgatgcagcaatttcctgattggcaaacatctgcattaagtgacgggctacatttcaccccgtccgggaacaaaattttgttcgacgaggtgctgaagacactggaaagtgttggtttcagccagcacagtctccggtccgatctccctctcttccatgaaattgaccccaaggacccgctgaaagcctttgaaatttgaagaaggtattcgccgcatggttctgaaaacaagctatgcttggtttggtgactgatgtgctctgtaacatagatatattgtgctgatgatctatgtcagcaatgctcgtgacttgttttgaagatgttgcatgtattgaaggcaagtgaaaatgagggaaaaaataaatggacttcttctgctgttcgtttcttacggtgcagattgttctgcaaactggattgtgatactagcactgcaggactgttttttcttttctttcagaggaaactgatgctatatgaatttttatcaattctatatg

SEQ ID NO: 7 - DNA, 1239 bp, Hordeum vulgare
aaaagtcaaacgagatcagtgaatcctacggctattccagcccctgaacctgaaccctcccccctttccgtgccatactgcaaagcgcaaggcaccttttcgcttccgcccctctccttccttctccccctccgccgcctgctcgccgtcctccgatccgccgcccccgtccgtctccatgggtctcctctccaacaggatcgggaaggagagcctgaaggcgggggatcacatctactcgtggagggccgcgtgggtctacgcgcatcacggaatatacgtgggcgatgataaggtgattcattttacccgaggaagggaccaagaggtcggaacaggaacggtcattgattttcttcttgtgagttcgggccctaataggagcagcacaccatgcttggtatgcagcagcgatgaagttaccgccgccacggagacaaatggtgtgacttcctcttgcctcagctgtttcctgtcagggggtgctctctaccgtttcgagtatgatgtcaacccagcacttttccttgccaaagtacgaggagggacctgcacgcttgcggccactgattccgacgaggtggttgtccgacgtgccaagtacttgttgagcaatggtttcaggtgctacagcctcttcaagaacaactgtgaggactttgcgatatactgcaagactggtctgcttgtggccgagggtaacgtcgggctcgggcagagtgggcaggctgtctccatcattggcggtcctcttgctgctgtggtttcgacgcctttccgcctagtaaccacgaacatctacggaatggcagtgatggctgtcggggtgtactgtgttagcaggtatgcaggtgacattggcaaccgccgagacgtgctgaaggtagaggtggaggagctgacggccgggctcgcaagcggacggattcgtgcggcgaacatcactcagctggcaactccgggacaagtccaggctccggcggtgaccacactcgttgctgcttagaatgcagcaccgatgttgtaaaatatggagatgtatacatcaccatcaccattgctatatttaccacctgttcaaaccttctaaaactgtgccgagattgaacttcccgttcagcaatggctgtgggacgagtgttgtatctgccaccaacgtgtctggtttgtctagtattgtatgaagattgaagactgctgcgtgtttgctccaatttgtaccaagatttccgctttctg

SEQ ID NO: 8 - DNA, 1369 bp, Hordeum vulgare
ctcataatcttgagattttcttcttttgttttatttttctttcttggtaggagtaacaatagttttggctctcctcctttctctctccctgtatccaaggagagaaatccagaggcgaagcttcagggtttgtaaattttccggatctaatcaactaacccaaaaaagcaaaaaaagaaaccatgagccacttcgccgccatgaagagccccgtcccggtcgccgccgccgccgccaccgacgcgaagagcccactcttctgccccaagccgcgccgcccggtcgcacccctccggtgccaccagagcagcaactccgacgcgggcgccggcatggatctgctcgacctactcctgtcaaagggcgacgagagcaatctttcggcggcgtccccgcagccgcctctgttctgcggctcgcctccgcggcgggcctcgaacccggtggtgcacgacagccggttcggcatggactgtccgtccagtcccctgccgtggtggccggtgatgtcgccagccaccccagcgccggtggtggtccgtcctaccccacgcccggcgggaccgccgatgtcgccccgttccgcagcagggtgcgctcgcgtgttccagccagccgtccgcgttgagggttttgactgcctcgacggcggccgtagcggccgtggccatggcatcgccgccatggtctagatgcacatacaacatcgaataaccaggaaatcttctcccctcggtagtggcaaaaagctttggagggagagagatgagagtgaggagatgagtgagaggagcaagcttaagtccgaaatttaacccctaaaaactatataatccatcaatcaaatcccataagtataatgagtctaggtaattttaccacaaatctttttgtatgtaaataaatttcaggttcagatgcaggtgcccttcttgtaaatttgggagctctagtttggggggatggggtagaaatctagagggttggatgagggacacagagggcacaagaaacacaaaagtttagccctcttgtatgaatcaattttttcatgagtccctttgccttccttgtggattagtcaattcaattaggttggagggaggggttgggaattagttaggtacctgtcctagttcatctgtcatcatgcttatttttggtttatgatggaattgtttttgtccatgcaaccaagaaatccatggccaagcaaaggccatggagatgtgtacaaaagagtggccacaagaagagaagagaagtgaagagagagcagctaggttttaagtcaagtcaatgagtgagttgtgtgagaggcatgaatgaatgatgtatcgttttctctgtatatgtaatatatcgtttc

SEQ ID NO: 9 - DNA, 1597 bp, Hordeum vulgare
cgccccctgctataaagcgccggacggccccggcttctactaacttttgcttcgccgtcgacgtgaaccctcgtagcttgcttgcttgcttgccgctttgcttcggagtgtagcttgtcagctggtggtggtggtggtgtgatggagctgcaggggctggggaggtactggggcgtgggcgggaggaggtgcggggcgtgcgctgggtcgccggccgcggtgcactgccggacgtgcgatggccgcagaggcggaggggacggggcgtacctgtgtgcggggtgcgacgccgggcacgcgcgggcggggcacgagagggtgtgggtctgcgaggtgtgcgagctcgcaccggccgcggtcacctgcaaggccgacgccgccgcgctctgcgctgcgtgcgacgcggacatccaccacgccaacccgctggcgcgccgtcacgagcgcgtccccgtgctgcccatcgggtcctcgtcgcctgaggggcaggagcaggacgcgttcgtgatgtcgttcggcggctcggtggacggggagaagcaggacgccgtggtgaacctgaacgacgctctggaggccggccccgacgggaaggagaacgtgaagctggacttcctgttcgcggacatgatggaccctttcttcggctccgagctcccgcgcttcccgcacgctgacagcgttgtccccagcggtggcgcggtggaactggacttcggtggcgttgccgccgccgcagccgtcgtttccaacccgtcctacagctcctacacggcggcgtcgatcggtggaagcggctcctcgtcggaggtcggcttggtgccggacgcgatctgtggccgaggcggcggcatcatcgagctggacttcgcacagtccaaggccgcgtatctgccgtacacccccacgcctagccacagtactgtctcctcggtggatgttgggcctgtgccggagcggagcgaaagcgccgtcgcggcggcgacgccggcgatgggggaggggagggaggcgcgtttgatgcggtaccgcgagaagcgcaagaaccggcggtttgagaagaccatccggtacgcgtcccggaaggcctacgccgagagccggccgcgcgtcaagggccgcttcgccaagcgcgccgacgacgccgacgccgacgccgtcgcagcggccacgatcaccgcgccgcgtccctgcgtgctcgacttcagcggctacggcgtggtgcccaccttctgaggcggcgcctaacttcgtgtcctgcttcctccggcgaacgtgccggctgcgtgcctaattaacccggcgcggcatggccggcacgagcgcgccgacgtgcatgcgtcgtgttccctcttgtataattgcatgtaatgtttttcgagctggctgatcgctggctggagtggagtatactgctcgacatgcatgcgcgcacgcatgtttcgctagaactagaatagaataatgcagatagttctagctgactagtctacctgtacccttttctgggctagcttgatgggaaattatgctagggcgacgtaacgtctttgctggaacagctagttctagtttgagatagaggaggttctaccac

SEQ ID NO: 10 - DNA, 515 bp, Hordeum vulgare
ccactctatcccggcccgttctacttagctagcgtcagccttcttcctcgagctcatccaccatgggcgactcctcatcatcctcggcttcctacatcagaatggtgcaccatctgatagagaagtgcatttgcttcaacctgaacaaggaggggtgcatggaggccctggagaagcatgccaagatcaacccggtcgtcacttctactgtgtggaaagagctggagaaggaaaacaaggagttcttcgagtcctacaacaaggaccgggtggagaggaacatcgaggcggagacgatggagcggatccagaagatgctcaccgacgcggctgcctccaaaagctccgacgatgacgagggctagaaggctgctgctactacttatctccaagctcatgcgcatgcatcacctctagctaattaattgtatgaacatcatgtcgtccgttaattggatccggtattatgtctaggggggtcgaatttattaattgaacctagctcataacagacc

SEQ ID NO: 11 - DNA, 2517 bp, Hordeum vulgare
cggacggcgccagggtccaggccttcttcgcagagatggaggcggccatccgcgggcacccgctatgggccgacgccacccaccaggagatcgaccacgcgctcgaggggctcgagaagtacatcatgaccaagctgttcgaccgcaccttcgcgtcgtcgccggaggacgccgcggccgacgccgaggtctcggacaagatcggcctcctgcagcgctttgtcaggcctcatcacctcgacatacccaagctcctcaacaacgaggcttcctggctgattgcagttaaagaactacagaagattaattccttcaaatcaccgcgggataagcttctctgtatgatgagctgttgccaagtcatcaataacttgctgctaaacgtgtccatgtcgaatgaccgaacaccatctggcgctgatgaattccttcccattctcatttatattaccatcaaggccaatcctcctcagctgcactcaaatctaaagtttgttcagctcttcagaagagaaactaagcttgtttcggaagtcgaatactatctcacaaacctcatttcagcaaagatgtttataattaatgttaatggccagtcgctatcaatggaagaaactgagtttcagaagcatatggaatctgcaaaactaggtaatcaaatgtctgttgctagccctagtagtccacaagggttggctacatctacaaggggattacagaagcaaattgatgcagaaggtttcaaattccctttcatggactcagaaatcgaaaatttgacgccagaggaactcaagcagttgcatggactctacaggaagacagtgaccaaatatacactgttgtctaaagccttgagaaagttatccatagatgaggatcagctgcttgcatcagtagatgattcatgaactgatgcagagattattatttgtgccacttgaccgtttgaacaaaaacaaggcaggtggaggagattacatacgtcttgcaagtgtcaaaacatgctatcaagacctggagccgcattcatgttaatcttgtcctcattgttcccaataagcccaactctttggaaacaatatcaaagttcaagatatattccaggaggtaccaaacaatgagaaacaaatctattatcacctggtaatcgatgattggatgaatgggtttatcaactcactggcagctaatgaagcagcagatcagcagcagctcaaggcagagcgaacgaagcagcagatcagcagcagctcaaggcagtatctgttcttggatctggatgatactggggaagaagcaagtagttgacaatcagtctgggaagtagatacctttgagagaaatttgtgttgtacaacaaaactgggacacaagcttccatttgagtttctgaagattgatatgaagaaccttctccttgacttgttatcgcaactccaccagcagaaacggccactacctgtcaattgtgagccagcaccagcgacattaacatcatacctgccaattgtgagcttggcatcaacaacattaatatcatcctcaagataaaaagcatgcagatcagaacatctaatcccattggccgctagaaagggaaagttcaattctggcctgccatgtcgtcatggcagtcctcatgggcgaagaggatcctgcccgctgcgatgtcgtagacgaatcgcgtgtccacctgctgcatcgtgccggtgatggtgatgtgctcgctcggcatcacggtaaggcaggcgtcatgttgggtgaggatgaagagctgctgtggctgaagcacgaggtcatcgtccaagtgcagcgtcaccgtcggcaggtgcttggaggcggcctgggtcgcgccgtggaagcagacgtggtactcatcacgctccactttcggcagccctagcctcctgatatgctcttccacggcctgcaccaggaggtcgtacgcgggcttgataatcatcgtcatgcccgtcccaggatcgatcacggaacgctggaccacctgtcgtcatgcaatttgtggcgctggaataactccctgatcctgccatgtggcaggctcagtcgtagcccgtcgacactgacgcctgtgaggccgacgaagtagggtctgaactccgggtcggtcatgcgcttgtagaggatcttggtgctcctcatgtgccccgtggccgacacgtcggcgccgaaccggaggaagccgtgcatgtttggatgcctgggcccaaggaggcagtaggagaagcggtcgccgtgcccgtgctggtggagctgagtccagatgagggacggtttctgtttgcccaggccgaggacaccggcgagcactccgtggttgttgaaccgtggtggaacaacaaaattcataatatcaaatgtagagaaacataacaaaatatatataatgtattacattcttgtaaaagccgaaccttttaagtttgatcatatttgtagagaaacataacaaaattcataatatcaaatctgcacgatcaaattcatcatgaa

SEQ ID NO: 12 - DNA, 1919 bp, Hordeum vulgare
ggcgcgcacacacacaggccaatcaatccatcaatccaaggtcagacaatggcggttccgacgccgcagcggcgtctcctggcctgcgcggcgacgctgctcctcgccctcgccttgtcctcgtcgtgcgccgtggccaactacgcggggccgatcaagacggtggtggtggtggtgatggagaaccggtcgttcgaccacatgctggggtggatgaagcggctgaacccgacgatcgacggcgtgacgggcgccgagtggaacccggcgaacgcgtcggacccgtcgtcgggccggcgcgtctacttcggggacggcgcgcagttcgtggacccggacccgggccactcgtaccaggagatccggcagcagatcttcggctccgacgacgcgtccggcccgccccggatgaacgggttcgtgcagcaggcggcctccatcggcggcggcaacatgaccgacgccgtgatgaacggcttcgcgcccgacagcgtcgccgtgtaccgggagctggtgtcccagttcgccgtctgcgaccggtggttcgcgtccgtgccctcctccacccagcccaaccgcctcttcgtccactccggcacctccggcggcgccaccagcaacaaccccgagttgctggccagggggtacccgcagcggaccatcttcgacaacgtgcacgacgcgggcctctccttcggcgtctacttccaggacgtgccggcggtgctcttctaccgcaacctgcgcaagctcaagtacatcctcaacttccaccccttccacaacgcgttccgcgaccacgcccgccgcggctccctccccaactacgccgtcatcgagcagcactacatggactccaaggaccaccccgccaacgacgaccacccttcacacgacgtctaccagggccagatgttcgtcaaggagatctatgagacgcttcgcgccagcccacagtggaacgagacgctcatggtcctcacctatgatgagcatggcgggttcttcgaccatgtgcccacccctgttgacggtgtgccgagccccgacgacattgttggcccgccgccgtataacttcacgttcaacaggttgggggtgcgtgtcccggccatcttgatctctccatggattgagaagggaacagttgtgcatgggccgaacggaaatccaacttcgacgtcgcaattcgagcactcgtcgatccccgcaaccgtgaagaagctgttcaatctgccacaggatttcctgaccaaaagggacgcgtgggctgggaccttcgaaggagtagtgcaaaccagaactgaaccaaggacagactgcccagagcaactcccgatgccgacgaggatccggcagacggaggcgaacgaggaggcgaagctgagctcgttccagcaggagatcgtgcagctggcggcggtgctgaacggggatcaccagctgagcagcctgcaggagaggatcagggagaggatgaacgtgagggaaggcacctcctacatgaggtcggccgtgcggcgcttcttcgaggccggcatgtcggccaagaggatgggcctcgccgacgacgagcagatcgtcaagatgaggccctcccttaccaccaggatcacctcctcccctgcagatcaagatgatagtccgtagagagcacacatgcatatatacataggtcgaaattggtgtttgggatcatcaaaattagtggcactacacatacatagaggatcgatacggtgtgtgcttgtagcgtagccagtacgatatggtgtgctcgtgctacatgtaatggaagcgctgtaggatggatggatgaatggattcgttatgcatgggccgtggaaaatgaaacattggtaccatggtatactttacaagcaatgaggagatcgacgaatgctcgtattgtgacatgc

SEQ ID NO: 13 - DNA, 2714 bp, Hordeum vulgare
acccccccacctcttctctctactactaaatctctcctctttcctcctcctctgctccgccgccgccgccgccaccgccacagccacagccagcccccctcctcctcatcccccaatctcacgcgcggcgcggccgtcgtctcccccctctcctcccccctcgtcgcggcgaatcgatcctgctcccccccgtccgctccgcagcagtctcgggtttttgaggagtgcaggttgtataataccgaggctcagttgtttgcatctgctgcatagaggagtttctttttgtaacctgactacaccattcgatgggttccaagaggagttgtcttctgatcacttactccccggagatagtagatggcgtgcctttgtatgtgtcatctaattgcctgcctgttaaagcttccaagtatgaacctgctggtcattctttccatgcggtggcactgaagcttcgtggtctcgacgagaaagaagacactgaaactgatgaccgcagtgtgtcatcagatgacaagagccaagatttttctgctggttcagataacttcagcagcaaaggaaagaagaagtctggttctggaagtcaacaacaagatcactatgcattgctcgggctgggcaacttgcggttcttggccactgaagatcagattcgtaagagttaccgtgacatggctcttaagcatcatccagacaagcaggctgctcttcttctccacgagacaacagaggcagcaaagcaggcaaagaaggatgagatagagagccattttaaggccatacaggaagcttatgaggtcctcatggatcctaccaagagaaggatttttgactcaacggatgagtttgatgatgatatcccaacagactgtgcaccgcaagacttcttcaaggtctttggcccagccttcatgaggaatggccgttggtctgttagccagccgattccttctttgggagatgattctactcctgtagtggatgttgaccagttctacaatttctggtataacttcaagagctggagggaattcccacatgaagatgagtatgacttggagcaagctgagtctcgtgaacataagagatggatggagaggcagaatgctaagatacaagaaaaggctaaaaaggtagaatatacgcgagtacgtaatcttgttgacaatgcctacaggaaagaccctaggatccagaggagaaaggaggaggagaaggctgagaaacagaggagaaaggaggcaaaatacatggccaagaaactgcaggaggaggaagctgcaagggctgcagaagaagaaaggaagaggaaagaagaggaggcgaaggtagctgcagcagctgctctcaatcaaaagaagttgaaggaaaaggagaagaagttgctacgcaaagagaaatctcgtctgcgcacacttgtggcaccagtagttgcagagcccagcttcagtctgtcagcggatgatgttgaaacagtatgcacatcacatgatgttgaacatttgaagaaactctgtgatattatggaggacaaggatacagctgaaaaggccaggttgctgaggggtgcactgaacaaagaagaaaactcctcgaatacctcaaaagaagagaaaattcatgccaatggtgtggcgggttctactccaaaatccacagccccacaaggccctccaaaatccacagccccacaagtcattacactaggcaactatgagaaaaaagagaaaccatggggaaaggaagagattgaattgcttaggaaagcaatacagaagtatccgaagggaacttccaggaggtgggaggttgtttcagagtttattggtaccggtagatctgttgaagagattctgaaggccacgaaaaccgttcttctgcagaagccagactctactaaagcttttgactcattccttgagaaacgtaaagcagctccatctattgtatcgcctctttccacaagagatggtactgaaccatccaagccggctggtggctcaaccttgggagctggcagtgagccatccaaggcagctgaacaacctgctgccagcagcagtcagacagccaatgagaaaactggtgctgatcctgtccccgaagaggcaccttctgcaacagatccagatgcctggtcagaggctcaggtgctggcccttgttcaagctttgaaggcgtttcccaaggatgcaaaccaaagatgggagcgagtagctactgctgtccctggtaaaacagtggtgcagtgcaagaaaaaggtttcgtcaatgaggtcgaacttccggaccaagaaggcggagtagaacagaccaccactgaggccacacaagaagattggtcgattgccttttgaagaccccagggcttgcttccttgctgctgactttctgggttgtttcgtcaagactcagctggtttgttacgaggagcaagtcctgaagtcgctgatgatcgaggcacctattgagagagagagagagaaagatagaagcttagatcaaaattttgagttatggaaaattacctaccttatgatttatcacaatgatgttccccctgcatacagtaatacttctacctgatgcctgctattggttacgaatttatgctgacgttattcttgttacgctagtcattgtctcttaagatatctggcgacgtatggatctgtgcaagtcgagtatcggttttgctatcttgttctc

SEQ ID NO: 14 - DNA, 1417 bp, Hordeum vulgare
ccatggcccagtgataaatatacagcggagaaagcaagtaatatcggccatctcttttccaagtgcagaggcaaagttgtgcacgagacacctgcagagggaaccgggaaggagggcgcgcgtgcggcatcgaccaactgcagcgcagcggcgtcgtcccgtccgtggtgccaggactagaagacacaatggaaggaagcatccacggctcatcagagaaaagggttgcggtggtgaccggagggaatcgggggatggggctggagatatgccggcagctggcggagcacggggtcaccgtcgtcttgacggcgagggacgggaagcggggtgctgaggcagcagaaaggctccgagaggaagggctatcggatatcgtgtttcatcagctggagatcagcgagcccgccagtgccgctgatctagctgctttcatcaagggcaagttcggcaagcttgacatattggtaaacaatgcaggagtgctcggggtgacgactgatgtcggtgacccagcaactcttcagcagacgcttgcaggcaaggatgggatggagagagccgaatggctgaggcaacggaccacgcagaccacccaggatgcagaggactgcctgaggatcaactaccacggcaacaagaccgtcacggacgccctcctgccgctcctccgctcctcctccgacggcagagtcgtcaacgtaacctcagcctgggggctgctcaggtatttcagtggcgaggagctccggcgggagctggacgacgtcgacaacctcacgacgcagcggctcgacaagatgtcggccctgttcctcgaggacctgggcaagggcaatggcgccctggagcgccgcgggtggccggctgacacggtgtatgcggcctacatggcgtccaaggcgctggtgtgcgcctacaccagggtgatcgccagggaggagggcgccgcgctgcgggtcaactgcgtgcaccccggctacgtcgtcaccgggatgaacgactacaccggcgtcctcaccgccgcggagggagccgccgccgcggttgcagttgcactggcggagaaggggggcgtcaccggcgcctacttcgatcgcactgaactgggagcgtcctttgtgtgatttctccgtggagcagttgctagcttgctatctttttcaataaagttcagtctacttaatattacttgatctttgcaataacacagtggcatgagttggtccagatatcaagaattatgttctgttcactatttttctctctctcttagaactacactctccgagtctccgttcactattataagatgtttagcttttataaaatcggatgtatgtacacgcattttagtgtgtgttctctcatttcagtcatgtatagtccatattaaaatattcaaaatattttagaa

SEQ ID NO: 15 - DNA, 2492 bp, Hordeum vulgare
gacgacttccttcccacctcgccgcaaaccaccgcttcggtttctgcggccaccacccccgcatcccccggcaatcgcggcagcgaggaagggagcgtgctcgccgtcgcgccgccgacgcgtagcgcggtgtgaatgaatggtgcggcctcttggccttctcgtggatctgaatgagctcttccttctggggcggtgaggagtagacggacggacgggcggttcccgaaatggcggtgtcggccaaggagcgcaagctgagtaggctcggaagtggtcaggcggcaaacgggggaggaggcgggagcttcggcgcgaggggcagtcaccggtcttcggcggcggggggacggcggcggctgtttgcggtgttcttcgcgttcctctgcgccggcgcggtggtcttcggcggcgtgcacgtcattggagcgtcctttcggccggtgctcatgacggcttggccgtcggcgaccctgaatgccctctcctcggagcgacgggtgcagcaagctggaggaaacagtgccggcaccgtttcaccctctgtccaaatccggcacgccgtcgttctgccggaccatgttctcgtaatcctcggtgacggatcatcgctgccagctcctgggcattttgagtgcctctactccactgccaactcaacgcagctacgtcgtcgtcccctctcggtcgctgcattgccagatgaacccagcctcgtgcattgccctgccgcaccgccagggatggctgtgtccctatcgctgtcccagtcgcctccggtgacaccattccagtgggatcagctcgtgtacaccgcacttcttgacagccgggataactccaccgttgtgtttgccaaagggatgaacctccgtccaggccggctcggtgtgccatcacggtatgagtgcgtctttggccgggacctgtcgaagcccaagttcgttgtcacctcccctgtggtttctgctgctcaggagacattccggtgtgtgacacctgtccgcattcgccggtacctcaggatgacagctgatggaaacagcaacaggaacagtgatgggaagcccatgttggtctccatcaggactaagggccgggggagctctacactcccctcaatcgcgcaaccagagccacttcctcggtataacaggcatcggcatacaaggcatcggcggcagcagaaagcacactcaatgtgtgtgtgcaccatgctgcgcaaccaagctcggttcctgcgggaatggatcatctaccactcccatatcggagtgcaacggtggttcatctatgataacaacagcgatgacggcatcgaggaagtccttggttccatggatccatccgcatacaatgcgacacgccacttgtggccttggatgaaatcccaggaggctggatttgcacattgtgcactcagggctcgggagagctgcgagtgggtggggttcatcgacatcgatgagttccttcacttccctggcaaccaaactctacaagatgttctccggaattactcaagcaggccaaggattggtgaactcaggactgcatgccacagctttggtccatcaggtcggactaagattcctaagaaaggcgtcacaacaggctacacctgccggctggctgcaccggagcggcacaagtcaattgtcaggccagacgcattgaacccatcactgatcaacgtggtgcaccatttccatctgaaggaagggatgaagtatgcaaatgtcggtcagggagtaatgctgatcaatcactacaaataccaagtctgggaggtgttcaaagagaagttcgccggccgtgtggcaacttatgttgccgattggcaggatgaggagaacgttggatccagggacagggcgccaggtctagggaccaaacccgtggaaccggaggattggccgcgtcggttctgtgaagtatatgacactggtttgaaagattttgtgcacaaagaattcatagatccacagagtggaagtcttccatggtagatgggtaagcacggtatttgatcagcacagcacagcacatggtacatgacaacggagagaaaaacagataacgaaagaagaaacacgaaattaagttaggtggtagagtgggttttgctctttggtatatttttagaccttgttgttaggtttgctgtccttaatttagaagcatcatttttttttcactgatcattactatctaagagagaaatgattcttttgtagatacagataagtaaaacagttcactgttgaaagagagaatgcatagagtgactttgtctccctgagtctttgtctgatcttactgtgggtgcgagcaactaaaattatagtgcttatttttttcatccccaatctgaaatctgcaagcaaattcgttattatggagtgatgcggacaaaagatggcgcaccttgcttgatgtagtcctgaaagaatatttgacttttcaacaagaagggtaatctatgccgcctg

SEQ ID NO: 16 - DNA, 3163 bp, Hordeum vulgare
ctctctctccctccctctctccagcctagcgttttcttgctccgtaaagctgaaaactgctccaggtccaagaaaaaagccacctttatctcccccctttccttgccggctcgctccggacggcggtgacggtggtgggctctgcctcttcttgaggcgcttctccggagcatttgctggcccggctcggggctgctcggaccccggaggctgtgggagcggttggcggcggaggggcgtcgatctcggccggatctcggcgaatgcccgccgcggggcgctccggtggaccggggcaggtcaacattatgacggggaggaggaagctgcatgtggtgactttggcgatcttgtgtttctggtcatctgctggggtctgcaaagcacaaacagtggatttcaagcctgccgacagctacctggttgactgtgggtctgccaagggcaccacggttctcgggaggaacttcgctgccgatggggcatctccggtgaccgtgtccacctcccaagatatccttgccggcacctcggccaacggggtgtcttcgttcgacaacccggtgctttaccagaccgcccgcatcttcacgagcccgtcatcctatacttttcctatccagaagcaggggcggcattttgttcgtctctacttctaccccttcatctaccagacttatgatctctccaccgccaagttcaccgtgtcgacccaagatgtgctcctgctcagcgatttccagcagccggacaagacggcccctctgttcaaggaatactctttgaacatcacccgtgaccagcttgtcatttccttcaagccgtcaaacggaattgcattcatcaacgcaattgaggtggtttctgttccagatgatctcatagccgatgtagccaatatggtcaaccctgtgcagcagtacagcggtttgactacacagtcactggagacggtgtatcgtgtcaacatgggtggtccgaaggtcttcccaagcaatgacaccctctcgaggacttggcagaaggatcagaagtacatactgaaccccagtgtgaccaaaactgctcaatatggcaaggctatcaactacaggaatggcggggcaactccactgacggccccagatattgtgtacagtacagctacggaattggctgcttcaaacacatccaacgcacttttcaacatgacatggcagtttgatgtggatgcaggctttagctatctgataagatttcacttctgtgatatagtcagcaaggcattgaaccagctctacttcaatgcatatgtgggaggcttctttgcacagcatgatcttgatctctcagagcaatcagtgaatcaactggctacagctatctatgttgatgtggttctttcttccaatgatgcatctagcaagctcagcatcagtattggtccatccactttgaacaatgcattgcctgatgggattctgaatggccttgagattatgaagatgggcagtggctctggttctgctttcactgttgggaataatggttcaaacaaaaagttgcccataattattggctcagtccttggggttgttgggcttctgataatcatccttgtcgtggtactgctttgccggaggaagaagaccgatgacaagcagcactccaagacctggatgcctttctctatcaatgggctcacgtctctcagtacaggaagtagaacttcttatggtactacactaacatcaggcctgaatggaagctatggatatcgcttcgccttcaatgtgctccaagaagcaacaaacaattttgatgagaactgggtcattggagtcggaggttttgggaaagtctacaagggagcgttgagggatgacacaaaggttgctgtgaagcgaggaaaccccaagtctcagcaaggtctcaacgagttccggaccgagatcgaactcctttcacgtctgcgtcaccgtcacctggtgtctctgattgggtactgtgatgaaaggaatgagatgatcttggtctacgagtacatggagaacgggaccgtcaagagccacctatatggttcagacaacccctcactcaactggaagcagcgcctggagatctgcattggagcagcaagggggctacactatcttcacactggttctgcaaaggccattatccaccgtgatgtcaagtctgcaaacatcttgcttgatgagaatctccttgccaaagtcgctgactttgggctgtcaaagactgggcccgagctggatcaaactcatgtcagcactgcagtgaagggtagctttgggtaccttgaccctgaatactttcggagacagcagctgactgagaagtcagatgtctactccttcggcgttgtcatgctggaggtgctctgcgcgaggccggtgattgacccttcgctcccaagggaaatggtgaacttggcagagtggggaatgaagtggcagaagagaggggagctgcatcagatcgttgaccagaagctttccggcgcgatcaggccggactctctaaggaagttcggcgagacggtggagaagtgcctggcggactacggcgtggagcggccgtcgatgggggacgtgctctggaacttggagtatgtcctgcagctccaggacgcggattcttcgaccgtgtcggacgtgaacagcatgaaccggatcgtcgacctgtcgtcgcaggttcagcacgtcggtgccatggagagcatcagcgtgacgatggcggaggacggagcttcgcacgagcctgaccacgacctctccgacgtgtcgatgagcagggttttctctcagctgatcaaagccgaggggaggtgaaaacgcgcctgatgatctgtagggtaccgttaggggtgtgagcaagccttggattttttttcttttcttgttgaagtttacctgaaacgtgtcacgtgtaattggttgtttcatcccttgtaattgtgtactgaactacggtttcgatttctgatggccttacccagttctgtgggcacacgatttagcagatataggcatcttcttgtatggaatctactgtatttggctgtggccatatttatgtaccgatgatgatgatccggctaaacgctggattttggagccggtgcactctcctctcttgtgtggtagtaacaaaattatca

SEQ ID NO: 17 - DNA, 771 bp, Hordeum vulgare
cagctcgccacttaagcagcaaaccaggtgcggtgcagagagagaaggaagaaggaagcaagggcaggagctaggggctgcgatcgatggcgtcggcggctagcaggaaggcgccgtcgctggtggtggcggcgagcgtgggcgccgtggaggcgctcaaggaccaggcgggcctgtgccgctggggctacccgctccgctcgctctaccgacacgccgccgccgcgcccagggtccgcgccctttccgcctcgctctccgaggccgccgccgccgccaccgctccccggccggcctctttgtcggcggaggacacgaagctgcgcaaggcacaccacctcgtctgctgggggcccaactgagctccttttcaccgcctcatgcctccatcggcaccacatgagcctacagaagtacagtagctgatgaacgcctttgtgtgtcaatggtgttggcaagaggaacggaacggaaggctgattggttcgccggagaaagcagaggcgtcattgcgtgcagcgccggtgaaccgctccggcctcggtggaggcggacgggccatggccggacggttcatcaacgctgcactcaacggcacctctgcggctcttcctcctcttcgtcttgcccagtaggatagcttccgtagacgcaagcaggaatcatggcttagcttttgaaaccgggagatccccattatttgtactgactagtaagcttggcgacgacgccggttgtactgcagtggagaactgaccaacgtttgttgta

SEQ ID NO: 18 - DNA, 1078 bp, Hordeum vulgare
ccgccgccgccgccctcctcctccgtcagcctcgccccggagcagcgcgtcattggcggcggaggccgtgtaaacccataaagttctgttttaagcgcacattgaactttatggacatatctcaggagcaacaacaagattttggtgtgctactaaagcagggggctgaaggaagggtatttgtttccacatttgttggacgaaaatgcgtaatcaaagagcgcttttcaaagaagtaccgacacccattgctggactcaaagctgactctaaagcgcttaaatgctgaagctagatgcatgacaaaagcaagacggcttggtgtacctacaccagttctgtatgctgtggaccctcttccacatacattaacctttgagtatgtggatggcttgtgcgtcaaagatattcttattggatttgggtcaaatgggataaatgaagaacgtcttaatgacattgccacacagatagggaatgcagttggcaaactacacgacggaggtcttgttcatggtgatttgacaacttcaaatatgatgatcaagagcagcaccaatcaactggttcttattgattttggtctgagctttacatcaactattcccgaggacaaggcagtggacctatatgttcttgagagagccttgatttcaatgcattcttcatgtggtgatgtgatggagaagatcctcgcagcgtaccgaaaagcttcaaggcagtggtgcgccactacgaacaagctagctcaagtcaggcaacggggcagaaagcgaacaatggtcgggtaaaacttgacccggagttactgaatgctacaaatttgaacctgcaacaccatccattgtgttagtttgcaccatagcgactcagcggaattggctcttgtagaattgaaatggacgtcaagtgaatcatttgtaacagtacttggttgtacttccgttaggaatcatatactgtatctcctaactctttaactctactttgttggatggtcgttttgtattgagagaggcatgcggtgaaatgtgaatcgaagcaatttattaaaattattacaactagcgtgttctct

SEQ ID NO: 19 - DNA, 2053 bp, Hordeum vulgare
cccccgcccccgaccacgtcctccgcctccggccatcctacgccagataatcgacgccgccgcctcccccttccatcccgtatcgccgcaaccagctcgacctcgccccactgtctcgccgctgcccagctcgccgccgactagctcccgaagctcaaaacgaggccttgggcaggcgcccttttcgctctatcccagggccggccccgatggcttgtgcggcttacagcatcaggggccatctcaagcttgccacggggcacggcctggccagtagtcacctgtgcggcggccggaagccttcgctatcttgccctgtttctcgggcatggagcagcaatgtctccactgatgcagcccagcgcgtcgacccccgttctcatttggctgtccggagttcagaaagatggcccccaatcccaaaagcttcgccggcggacggggccgtcgttgctgaagagaggataactgtactcgtcattggcggtggaggaagggagcatgcactctgttatgctttgacccgttcgccttcttgcgagacagttttatgcgcccctggcaatgctggtattgctcaatccagggatgcgttctgtataccggacttggacatttccagcagtgattctgttatatcgttctgccgcaagaggggagtgggaatggtggtagtgggtcctgaaggccctctcgttgcgggccttgcgaatgaccttgtcaaagctgggataccgacatttggtccgtcgtccgaggctgcagcattagaaggatcaaaggactttatgaagaggttgtgtgataagtacaatatccccactgctcagtatcacacattctcagatgctgcaaaagctaaagagtacatcaaggatcaaggggcccctattgttgttaaagctgatggattggcagctggaaagggtgtcgttgttgctatgactttggatgaggccttcgaagcaataaactctatgatggttgacgagtcatttggttctgctggttcgcgggtcgtcattgaggagtatctggagggcgaagaagcctctttctttgcattagtagatggtgaaaatgctttgccacttgaatcagcacaggatcacaagagagttggtgatggtgatactggtccaaacacgggtggtatgggtgcatactcccctgcgccaatagtcaccgaagagcttaagagcgtgataatggaaactataattattccaactgttaaaggtatggctgctgaaggatgcaagtttgttggtgtattatatgccgggcttatgatagagaagaagtctgggctgcctaagcttattgaatataatgtgcgattcggggatcctgaatgccaggttctgatgatgagattggagtctgatcttgcacaggtcctgctatccgcatgcagaggggaactgggcaaggtttcgctgacctggtcacctgaaatcgcgatggtggttgtgatggcgagcgaaggataccctggctcttataagaagggaaccgtaataaaaaacattgacaaggccgagcaggtttctccagctgtcaagatattccatgctggaacagctttggatggagatggcaatcttgtagctgttggaggccgggttcttggcgtcactgcaaagggtaaggacatcgaagaagcgaggtcaagagcgtacgatgcggtagatgtcgtcgactggccagaaggattcttcaggcgagatatcggctggagggcactgaaacaggagcagacggctaactactgattagtccggttttcctgaatctggggtgagcttccagcgtcaagtgaaatgaagacagtagaatcttcattgttgtggttgcggaattgacaggagcattgctcctcctgtcgaacatgagcatcccttgaccatggtttggctccgaaccatttgtagcagtcttgtgttttcctcaaggcgggcaacgtgtcaagttcaattgtctcttgaggtgcaataatctcaccgactaactattttctagtgaacataaccatgtaggctcttcataagca

SEQ ID NO: 20 - DNA, 1264 bp, Hordeum vulgare
ggtgcctttgatcagtccatcccatctcaccaccgttcactgccacaatggcttccgagggcttcgccgcgcccgtcgtcgtggacgactgccggggcgtgctgttggtgtacagcgacggggccatagtgcgcggggacgcgccgggcttcgccacgccggtgcgggacgacggcactgtggagtggaaggacgccgagttcgacgcgccccgcgggctgggactccggctatacaggccgtgccagcggaaccagctcctgccggtgttcttttactaccacggcggcggcttctgcatcggctcgcgcacctggcccaactgccagaactactgcctccgcctcgccgccgagctcgacgccgtcgtggtcgccccggactaccgcctcgcccccgagaaccgcctccccgcggccatcgacgacggcgccgcggctctcctctggctggcctcgcaggcctgccccgccggcgacacatggctgaccgaggccgccgacttcactcgggtgtttatctccggcgactccgcggggggcaccatcgcccaccacctggccgtgcgtttcggctccgcggccgggcgctctgagctgggcaacgtccgcgtcaggggctacgtccaactcatgcccttcttcggcggcacggaacggacgaggtccgaggcggagtgccccgacgacgcgttcctcaaccgcccgctcaatgaccgctactggcgcctctcgctgcctcccggcgccacggtcgaccacccggtctccaacccgttcggaccggacagcccggcgctggaggcggtggagctggccccgacgctcgtggtggtcgggggccgcgacatcctccgtgacagggccgtggactacgcggccaggctgcgggcgatggggaagccggtgggggtgagggagttcgaggggcagcagcacggcttcttcaccatcgacccatggtccgcctcgtccgcggagctcatgcgcgcgctcaagcgcttcatagacaccgacggacacttcgactagacccgttccatcgcctccaccattttcctcaactcgtcaatgtgacattgtgtctttctgctccttttgcgttgccatgggatactctagattttttttttttttttgggatatgggatactctagaatctgtttcgtcctgtcgtcgtttgcctcgggatcacaatgtaagagcatctttgctaaaatctttacctaataataataaagagactatcgttttcgttgaaaaa

SEQ ID NO: 21 - DNA, 1491 bp, Hordeum vulgare
tcgtcaaaagagaagagagaaagaatggcatggcggcatgtacgcactagccacacagtcccggagcggcatgaaagctgggagccccagcactaatgccagcaaaaggcagggggagagcggcatgcccacacgccacgccctccgcacctgctcgacccatcgatccgctagctataaagcacgccaccggagcgtgtgtcctccacactactgccagcctgcttgcttgcttcctaccagctgcctcccgccatctccatcgatcacttgctgccatggccgtgaacgacaccaagctggccgacgccgagaacccgggcacgatgtgccgcgccatcgactccgactccgacgtcgacttcgccggccgcgccaactggctgcgcgcggcggtgctgggcgccaacgacgggctggtgtccacggcgtcgctcatgctgggcgtgggcgccgtgaagcacgaggtgcgcgccatggtgatctccgggttcgcgggcctgctggcgggggcctgcagcatggccatcggggagttcgtgtccgtctgctcccagcgcgacgtggagatcgcgcagctcgaccgcgacggcaagcgcggcggcgacgaggagagggcgctgcccagcccgatccaggcggcggcggcctcggccctcgccttctccgtgggcgcgctgctgccgctgctggcggccgggttcatcgtcggctacaagctgcgggtggccgtggtggtggccgtggcgacgctggcgctggcggcgttcggggtcgtcggggccgtgctggggagggcgcccgtggtgaggtcctccgcccgggtcgtcgtcggcgggctggccgccatggggctcaccttcggcctcatgcggctcttccgggccagcggcatatgacgtgcgcgcatgcggtcgatggacgagttttttcttgttgatcgtcgtctcgtccatgcatgctttccccgtgaccctacgtacgtacgtggtgccaacgtcttcttccccggccggccggctgatgacctgacgtccgtgcatggaatgtgcatgccccgccgtccgtgtgcgtctctcttcttccctagttgattctctgctgcttaattctcactctctctctatactgctatcactagtctttgcatcatgcatgcatgccacgctgatgtaacattggccagctgctgctgcatgcatgctatagtagtatttttactcgtgccatattattgtaaggttaccagtagcacgtacctactagtacttgattgggaggtggaagaaggtgacaaggttgttgcaagaaaggcaagctatatatatgtaagctaattattaatttgagtttccatgcaagtcaagccgtgtcatggatatgttcattgttcaagtaatcttgattgattaattagctatatatatcttgagaacaatatcagcagtgtggcagcgcaggcaaagaatcaggttgtacatatgctactaa

SEQ ID NO: 22 - DNA, 950 bp, Hordeum vulgare
agatagatctaagcggctcagagccagacaccagcttccatggcaggaggaatcggaggagttgggggaggaacagggggagaggactccttggctcgcagggcctggaggcagtacctgctccagctgcagcgccacccactccgcaccaagatgatcactgctgggttcctcgcaggcatcagtgactccgtggcgcagaagctctctggatatcagaagattgagaagcgccgcctcctgctcaagatgatatttgggtttgcatatggtggcccatttgggcatttcctgcataaaatgttggattatatctttaaagggaagaaggataccaaaactgtagctaagaaggtgttgctggagcagatcacttcctcaccctggaacaatttactcttcttattctattatggatatgttgttgagaagaggcctttcaaggaggtgaaaattagggtgaagaaacagtatctgtcagtgcaattgtctgcttggatgttttggccagtagttggttggataaaccatcagtacgtgcctttgcagtttcgggtgattgtccacagctttgttgcatgttgctgggggatatttctcaaccttcgcgccagagcgatgtctttgaagcagtcatagacatttagttggtgtataacactccatcatggttcaaacttggccggagaacaaggatggtgtttgctatgtaatataccgttgattgtcctagggtatttaaatagttagaggatttcgatacttgtttgcaatcaagttgcagatttgtttgtcaccgcatgggaggccgcttatctgatttctctgctggcaccatttaagctttgtgactgaaacgtatctgacttgtattagctatggatttatggggtctacttttgggagcaaataatggttttgggtcttttacaactgtgcccctaaccgac

SEQ ID NO: 23 - DNA, 3305 bp, Hordeum vulgare
ggcgtgcgtgtgcgtcacagtcgctctccttctcctccggctagttcctcctcccttcctccctcgctcaagctcatcccctcccctgcttccccccctcttcccattcccaagccccgattcacacccgcaactgacgccatgagaggggaacccgacctacatagcccccgctagcctctccgccgcaagaatccgcggccttcttccacgctcccgtccgtgcaagaaagatgcggccgtcatggggggatctcgccgtcgtctggtgctgcttcttgctcctcctgctcctccctttcctgtcccatggcaaggacatgcccctgggctccaccctcacgccgggcggcaactcggcggcgtgggcctcgcccaactccaccttctccctcgccttcgcgccgtccccgacctccccgtcgctcttcgtcgccgcggtcacctacgccggcggcatctccatctggtccgcgggcgccggcgcgcccgtcgactcggggggctcgctcctcctctcctccaccggcgacctgcagctggtcaacggctccggcgccgtgctctggtcgtccggcaccgccggccggggcgtctccgcggccgccctccaggagagcggcagcctcgtgctcaagaactccacgggcggcgccgtgtggcagtccttcgaccacccgacggacaccgtggtcatgtcccagaacttcgcgtccggcatgaacctcacctccggctcctacgtcttcgccgtcgaccgggccaccggcaacctcacactcaagtgggccaacgccggctccgccaccgtcacctacttcaacaagggctataactccaccttcaccgccaacaggacgctcagctccccaacgctcacgatgcagaccaacggcatcgtctccctcaccgacggcacgctcaacgcacccgtcgtcgtcgcctacagcagcaactacggcgagagcggcgacatgctgcgcttcgtgcgcctcgactcggacggcaacttccgcgcctacagcgccgggcgcggcagcggcacggccaccgagcagtggtccgcggtggcggaccagtgcgaggtgttcggctactgcggcaacatgggcgtgtgcggctacaacggcacgtcgccggtgtgcgggtgcccgtcgcggaacttccagctcaacgacgcctccaacccccgaagcgggtgcaggcgcaaggtcgagctccagaactgcccgggcaactccaccatgctccagctcgacaacacgcagttcctcacctacacgccggagataaccaccgagcagttcttcgtcggcatcaccgcgtgccgcctcaactgcctctccggcagctcctgcgttgcctccaccgcgctctccgacggctccggcctctgcttcctcaaggtgtccaacttcgtcagcgcgtaccagtcggcgtcgctccccagcacgtccttcgtgaaggtctgcttccccggcgatcccaacccgcccgtcagcgccggcagcacgtcctcctcgcggtcctccggcctccgcgggtgggtcgtggccctggtcgtcctcggcgtggtgtccgggctggtcctcgccgagtgggcgctgtggtgggtgttctgccggaacagcccgaagtacgggccggcgtcggcgcagtacgcgctgctggagtacgcgtccggcgcgccggtgcagttctcgtaccgcgagctgcagagatcaaccaaggggttcaaggagaagctgggcgccggcgggttcggcgccgtgtaccgcggcgtgctggcgaaccggacggtggtggccgtgaagcagctggaggggatcgagcagggggagaagcagttccggatggaggtggccaccatcagcagcacgcaccacctcaacctggtccgcctcatcggcttctgctccgagggccggcaccggctgctcgtctacgagttcatgaagaacggctcgctcgactccttcctcttcggcgccggcagcaacagtaacgacagcggcaaggcgatgtcgtgggcgacgcggttcgcggtggcggtgggcacggcgcgaggcatcacgtacctgcacgaggagtgccgggacaccatcgtgcactgcgacatcaagccggagaacatcctcctcgacgagcagcacaacgccaaggtgtccgacttcgggctcgccaagctcatcaaccccaaggaccaccggcaccggacgctcaccagcgtgcgcggcaccagggggtacctggcgccggagtggctggccaacctgcccatcaccgtcaagtcggacgtgtacagctacgggatggtcctgctggagacggtgagcgggcaccggaacttcgacatctcggaggagacgaaccggaagaagttctcggtgtgggcgtacgacgagtacgagaaggggaacatcctgccgatcgtggaccggcggctcgccggagaggaggtggacatggcgcaggtggagcgcgcgctgcaggtgagcttctggtgcatccaggagcagccgtcgcagcggccgagcatggggaaggtggtgcagatgctggaggggatcatggagctggagcggccgccgccgcccaagtcgtcggacagcttcatgacggtgaccacggccaccacgggcggctccgccagcggcgtcagcagcagcgtggcgtccacgttcgcctcgtcggtggcggcgccgccggcgcccgtgccgtcgccgaacgtcgagcaggagatgtccgtggggcggtcggcatccgcccggacccgcgagatcgcgtcgctgccgctgcgctcgtcggagccatacatgacaatgtagtaacaagtgctgctgatcttccgtgctttgatcgaagggaaactacgccggtcagcgagcaagttagggaattggtagggtgatctgctttctgctatgcttggtggagcatggaagctgctcttgtcttcagagtggctgtgagatttggcatacttgagagtgaaatgtgagccagccaaatcacccacaatttgtaagtaatagaactagtccaaacacagacaatgcgggactcgtcgtaatttgtacgtacaaataattgaaatttgtagcatggagggcagacttggtggtgcatttcggatgcaggatcggtgatgctgaccgcgctctgtgttggtgctcaattcatatgattctgggctccgatgattgtcattagtggtagcagtgccttggtggtatggcactggcagttttagttggcaccactgggcagctggatgattgtcatcagtctaagcagacttgtcc

SEQ ID NO: 24 - DNA, 1931 bp, Hordeum vulgare
agattcttcctatgccaaagagcgtgggaggagaggaatccactcccgaagattcctcgtcccctcccgctccggccggcagcggccaccaacaacacaagacaagatccccctcccctcccctccagccgccgccactgtaccactagcagtagcagtgagcaaagatttgatttttgcttctcgccggccatagaccaaaacaagaagaggaataagatagggcgatggggatcccgagcccgagcgacgaggtggtccaaatccggcacggggacgcggcgggggacccgaccgtggtcaccgtgagctgccccgacaagaccggcctgggctgcgacctctgccgcctcgtcctcctcttcggcctcaacgtcctcaagggcgacatgagcaccgacggccgctggtgctacatcgtgctctggctcgccgcctcgccgccgccccgggcccgtaccgtcgcctgggacctcctcaaggaccgcatcgtccagctctgccccgtccccgcgcccttcggcgtagacaccgcatacctcgccgccgcaggcctcgcgcttgccgacggggagccccaggtcttcctgctcaagttctgctgctacgaccggataggcctcctccacgacgtgacatgcgtgctgtgtgagatggagctcacaattaggagggtcaaggtctccaccacgcccgacggcagagtcatggaccttttcttcatcaccgatgctagggaacttctacacacaaagagcaggagggaagaggcctatgaaaagttgcagagcgtcttaggcgactcggtgacgagttgcgaaatagaatcagcgacacaagacatgtcttcttgcctccaagcatccgcgttgttgccgcctcttgtccttgaacaaatgttcagcgaggtggatgtcgtagatgagcaatcgaaccgctcacggtccgacagtagactgtcggtcacgatggacaactccctcagccctgtgcacaccctgattcagatccagtgcggtgaccacaagggcctcctgtacgacatcatgagaacggtcaaggactgcaacatccaggtctcgtatggccggttctacgcgggccagaagggccggtgcgaggtggatctgttcgctgtgcagtcggacgggaagaagatcctcgaccagcagaagcagaggacgatgtgctctcgactgaggacggagctgctgcggccactccgcgtggcgctggtgaaccggggtcccgacgcggagctgctggtggcgaacccggtggaggtgtctggcaagggcaggccgctggtgttctacgatatcacgctcgcgctcaagaacctccatagacgggtcttcttggccgagatcgggcggcacatggtgaacgatcgggagtgggaggtgtacagggtgcacctgggcgaggacgaccacgagctctcgtgctcggtgcggagcaagatcgtcgacagcgtcaccaacatgctcatgggctgggactgacttactggtcattgtcttgcaaaagacagagaccggtttaatttgtttgttttgtgtaatgtaggtgccatcgactcagttgtacataggcagggatgttgatggctgctgctgcttctgtttgtaaattaaagtggtttcaggttgtttttcactgcctagttaggtcatgctgcatcagtctgaaatactacgattgcctagttaagtgttgttgttaggcaatgatggtgcatagacctgtgttcttgggtctcaagcatgtagtctatctttgcccagctaagctggtgtactaggattagctagtgattaccacaatagggcaatgcttgctgattttattatttttacatataggggccgtccatacaagctttacacttttgtgatgcaataacaaaggccgtgctcctgtcgtgatgc

SEQ ID NO: 25 - DNA, 1467 bp, Hordeum vulgare
cccccacgccaacccaaccacgaggacaacacgccgagatgcagcgcgcggcggcctccctcgcctcctcccgctcagcggccgcctgggcgtgcacctccaccacctcgcgccatgccggcaccggcgcctcctactacgcgcgccgcgacgccgtcgtgcctctccgaattcgcggtcaggaacagccgcccgccgccctccccatgtccctgtcgctgctctcgcggagacggccagcgcggacggcaaaggcggcggctgctgcggcggagctgaccccgtcggcggacgaggtggccgcgggcggcggcattgccggcacggtgcagctcggcgccatgatcgtcgcatggtacctcctcaacatctacttcaacatctacaacaagcaggtcctccaggtgctgccattgccgctcccctacaccatcaccgccttccagctcgccttcggctcgctcgtcatcttcttcatgtgggccgctaggctccaccccgtgcccaagctctccgccgcacagctggccaagatcgcgccgctggccgccgggcacatgctgggcacggtgttcaccaacatgagcctgggcaaggtggccgtctccttcacgcacaccgtcaaggcgtcggagcccttcttcaccgtcctgctctccgccttcttcctcggcgaggtgccgtcgccgctggtgctgggctcgctggtgcccatcgtcggcggcgtcgccctggcgtcgctgaccgaggtctctttcaactgggccggattctggagcgccatggcgtcgaatctgctcaaccagaccaggaatgtgctcagcaagcggctcctcggcggcgaagaggaggagttcatggacgacataaacctcttctcggtgatcacagtgctgtccttcctgctgtccgtccctctgatgctctttgcagaaggggtcaagttctccccagcgttcctccagagcaccggcctgaacctgcaggagctgtgcgtgagggcggcactggccggcctctgcttccatggctaccagaagctgtcgtacatgatcctggcgagggtgtcgcccgtgacccactccgtggccaactgcgtcaagcgagtggtggtcatcgtctcttccgtcctcttcttccggacgcccatctcccctgtcaatgcactggggactggtgcagcactggcgggagtttacctgtactccaggctcaagaaaacgaagcccaagagttgatgaagatgttttttccctgttccagatacaggtttttgatatagaagactaggtcgagaaaatgtattgagatagtaggttgtacagaacttgccacagcccgtagtacacctgtactacagcctacagcagcttctttcaatagtggccagaccaaacttttggtcttgaagatttgtaacatcctctcctgaataatggcaaatctcctaacaaatgcattatgctc

SEQ ID NO: 26 - DNA, 2456 bp, Hordeum vulgare
gagcgcgcagccacacctacccgttcggcaaagatgaagctcgggtgttctcggtttcttttgtcttgccatgttcttctctgcctttcggcgatttgggtgccggccacggccgatgtgccggtagcccaccttaccggctgccaggccaagtgcggcgaggttgacatcccattcccgttcggcatcggcgagcagtgcgcgttgcaccgcggctttaacatcaactgcacgaccgtcaatggcatcctcaagccttttgcgggatatgtcgaggtgaccaaaatctccgtgccagacggcaaggcctggataaacgccacgaccatgtcgtggcggtgctatgatgtggccactgacactatgagctaccaaaacgaaggcctggacctcagaaatacacctttctgggtatcggaggtggataacaaaattatcgtcatcgggtgtaatactctcgcttatatgaggaggctttccgtgcagtacgtaataggttgctcgtccatatgcgaagacgttaccctcgagaacgacaaatgctctggtgccggctgctgccaagccgatgtcccgaaaggcgtacggtattataacggctatttcaacacaaactacaacgcgaccaaaaggtgcagcttcatggcagtgatggaaaaggcagctttcaagttcaacaccagctataccgaatccacggtgttttgggatacatacaatgggacagttccacttgtcctggactggctggcatggccgtcgacttgcgacgtagctcagaacatgagctcctacgcatgcgccagcacccatagtgagtgtgtaaattccaccatcgacgagccaggttatcgttgcacgtgcgctgttggatacaaaggcaacccttatgtccagaacggatgccaagatattgacgagtgccttgaagatgctactctctgcgtctctggaagtggaacctgcacgaacacggcagggaattacacctgctcatgtccccgagggaaggattgggcgaatggcagttgtcaatcccattttcctgtgatacctgtcgtaggtacaactgttggactagtcgtcttagtgattgttttagcctgtgcgtgcatgatccaagagagaagaaaactacaaaagatgaagcgggactactttcggcagcatggtggtctaatattatttgaggagatgaggtcaaagcaaggtattacatttaaaatcttcacagaggaagaactacagcaagccacgaacaggtttagtgagcaacaagtattgggtcaagggggctatgggactgtgtacaagggggttcttgagggcaacgtggaagtagcggtgaagagatgcaagaccgtcgacgagcaacaaaagaaagaatttggtaaagagatgctgatcttgtctgaggtcaaccataaaaacattgtgaagctcctcgggtgttgcctcgaagtggaagtccctatgttggtatacgagtttgtcccaaacggcaccctcttccagctcatacacggtaaccatggcctacgtatctccttggctactcgcttggggatcgcccatgagtccgctgacgcgctcgcctaccttcactcatcggcttcgacaccaatcctccatggtgatgtcaagtcctccaatattcttcttgacagggatcacaaagctaaagtagctgactttggcgcctccatcctggcaccaactgataagtcacaattcatcacacttgtacatggtacatgcgggtatctcgatcctgagtacatgcaaaccaacctgctgacagacaagagtgacgtgtacagctttggggttgttcttttggagctgcttacgggcaagttgccatttaatttcagtcaagatgtcgctgcccgcgagaagagcttatcgatgatgtttatgtatgcgatgaaggtgaataagcttgaggaaatcttggatgatgatatcaagaacgaggagagcacagaaattattgaagaggcggcggagctagcgatgcggtgcttagagatgtgtggtgacaataggccatcgatgaaggaagttgcggagaagcttgatagtctgaggaaggtgatgcaacatccatgggtgcagcgaaaccctgaagagatggaatgcctacttggggagccctcgtcaatggtcagctcgacgataacaagtgctgaatatttcagcatcgagaagaaagctgttaatggtctgcagtcaggtcgttaagtaatcacactattgccttgctttgtttattttgtattcaaaagcaaaaaagtcagttgcatcaaaaatagaataaacagtcaattgttatagctaccattatgttactgttcattttaccaattatacatctacagtttcagtgtttatatggttatgtatcttctgaaaaagtgtggatatatgtgatttattatttcttaaattatgca

SEQ ID NO: 27 - DNA, 1755 bp, Hordeum vulgare
ggcctccgtccctcgctcgcgctcgcgcctataatattcgtcgttcgggtagggggtcgttccgtccacgcttcacgcgggctgttccttattgttggccggaaatggcgggggagcaccagggcgcgggcgccggcttctggctgccggacgagttcctcgacgacgacttcttctccgacgagaaggcggcggcggcggcggctgctgcggcgggcgcggccaggagcgacagcgacgacgaggacgcggggctcggcggtctctcgcgccgcgtggccggcctcgactgcgacgccggcgaccgcgccgttcccaaggcggaggtgatgtccgggtctccgcagtccacgctctgcgtgctgcaggcttcaggggaggacagccccaccggcggcgcctcgcaggtcagctcgccgccgtcctcgccgctggagcagcagccggccgacccatgggacctgctgcacgaggcggccgggcaggtggcccgcctgcgcgtcgacagcatccccgtgcctgtggttaaccctgctcccatccatggcgccgccgtcgcgccgccggcgaggaacccctctccgccgccgctgcttccgtccccgaagcccgtcggcccttaccagtacccgcccaacaactcgttcgcccagcgccaggctcaagtcgctcgttttcatctcctgaagcagcagcagctgatgaagcaccagagggagcagcagctggccatggctgcggccatggcgtggggctccgccgacgtcgggccgctcggcctgaacccctcggcctggccgccgctgcagaatcccccgcaccacgctcctccgtccgcggccggcatgcgcgccgtgttcctcaccccgcccggagcgaagcgggagtgcaccggcaccggcgtgttcatcccccggcaggccggcgcgcccgccgagcccaggaagaaaccaagctgctcgacggttcttctcccggcgcgcgtcgtgcaggctctcaatctcaacgtcgaggacctcggcgcccgcccgtgctaccccgggaccttcgttcttgatcacgacgcgctggtgagccggagcaacgcgatgcaggcgagccagaagcgcgagcacaatgccaatgccaatgccgatgccgccgccgcgcactcgccgccgctcgccgtggcctgcgaggtcaatctcccgcaggagtggacgtactgagatgcgtgttgccgctctcaagcgtcgttggtctccccccgttttcatggattactatctaatactattacttatttctgttatcatcgatggttagcgctaggtagatgttagctagaggtaggacgcggtggcagtagcatcagcgttaggtgttcttttgtgcgtggtgatatattggttattttggaggatggttggtgatggacggacggacgcagacgaccaacagagagaagaacgatgaaaaatccgtggcttccgtaggttgttgttgggggaaacaataagcggttcctacaagaaagaaagaagaaatctgggaggtatggtgctgcctgctggtagttgtaaggtggacgatgattgggaaaatatcatcggctgtttggaaaggtgtcatcgctgtaagatataaggaagaaagaaataagagctccatgtttccattagcgccttgttgcagttccacttcagtctcttgtgtgtgcgtcccttttggcatcgcccggttgcttcgtgaataaggaaccccccttctgtaagg

SEQ ID NO: 28 - DNA, 3222 bp, Hordeum vulgare
ggccgccctgccattccacagtccccgcacaaagccagccagtgcgtaccgacgcttcccccacagcctggactggagccgccgtacttttcactctctcgtcggctccctccctcgttcccgggtctcagctctcaagtctcaactcccagttctcctcctcctccccctggccctcgcccgcacgctgctcgctcgatcgtcgcctacctagtacctaccataccatcacacctaccgcccctctctcccactgtctctctcgtccgcaccgtcagacccccccgcgcccgcgatcgaccccgcgccgcccgcacgctcccgaatcctcagccgccggacgcctccttccgacgaagcgaagcaggccgcctcgggctctccgccaccgcgtcctcctccctccgcactgcgccggccgctgctggattggcgtggagatccacctgggcctgtttctcctgctgcctgatatcagccagactgatcagtggtcatatcgaatacaaagttttcttgtatgttttgttagcatgcaaaagatggttcccatgggttcggaatgagggactacactatctagaaatggatgaaacaccaactagttctgggcgatctgaagctacttcatgtgaacctagttggtggccgccagactttttggagaagatagaatctgttgccttagcaagggaacaagaagttttggctgaaaaagaatcccgattcaatctgtcaaattcaaagtcctcatcctggaaggcttctcagttactgtggtcaactggaacttattcagggtttattccaaatggtttctattcgatcatcccggataaaaagctgaaggagattttcccaacaataccatcactaaacgaccttcaaagtcttgaagcagatgggcttaagcctgaaataattgtcgtagatgctgaaaaggataagaagattttcatgttgaagcagcttagtggcgcacttgtgaaaggattgaacaatccagctctagtgataaagaagatagcaggtttggtttttgactgcttcaagggccaaaactctgatgcaagcccaggaagagcttcaaccgaagatattcacttcttcggaaatagaggaccacaacttcttgggcagataaggcatggatcatgccgaccccgagctatcctatttaaagttcttgccgatgctgttggccttgagagtaaactcgttgtgggtctacctgatgacggtgcagttggatttgtggactcctacaaacatatgtctgtggtagttccgctgaattctatggagctacttgttgaccttatgcgatttcccggccagttgattcctttttcagccaaggccatctttatatcacatatctctgctgcgggtgagagcgattcagctgaaaatgactcgtgtgattctcccctggagcccaacagccctctatatggattatctgataaagttgaagctgaaggaaccgaagcttcatcaaatctatctggacgttcattgcgtaatacaatgttgagatcgagaacattttcagaggggaaattaagcacatcatgtagtgagccaaacatcgcaaatgccttctggaggcgaagccagaggagaggagttgctgaggaacctcgtggtgctagttcaagtcctgagcatccattaatgagggcaaagggaagatctatacttggtggtgaccggcaatcatttcaagaatacaccgatagagttacattaagatcagatgatcagggggccactagtacacctaaccctcgaagaataagacgaagaagcattagcatcacacctgagattggagatgacattgtgagggcagttcgggctatgaatgaaacactaaagcagaatcgcctccaaagggatcatgttaatgatggttcatgttcatttattggggaggataaaaccaatgcaaatgactgcccaaataatgatgataaatctgggacgaacaatggcttgagaaaccgagctggttctactcagaaggctatgtcattgcctacttctcctcatgactatgggggtgaaatttctgaaacaaacaataattgtgattttataagcgaagagaagatggtattcgcatggaacaaggttttgcaaagctccccttttaataagcctttatcgcctttccaagagtggaacatagatttctctgagcttacaattggtacacgggttggaataggattctttggagaggttttccgtggtatatggaatggcactgatgttgccatcaaagtatttctggagcaggatctcacgactgaaaacatggaagatttttgcaatgagatatacatcctgagccggctgcggcatccaaatgtaatattgtttcttggggcatgcatggtacctccgcacctgtcaatggttactgaatatatggaaatgggatcactgtactatcttatccatatgagtggtcagaaaaagaaactcagctggcgcaggaggctgaaaattattcgtgatatatgcaggggattgatgtgcatacaccgcatgaagatagttcacagggacctgaaaagtgccaactgtctggtgaacaagtattggactgtcaagatatgtgactttggcctctctcgagcgatgacagatagtcctatgactgataactcctctgctggcacaccagaatggatggcccctgagctcataaggaacgaacccttctcagaaaaatgtgacattttcagccttggtgtgataatgtgggagctctgcacattgagacgcccatgggatgggatcgccccagttcaagtggtgtatgcagttactgaagggtcggggcttgaaattccagaagggcctcttggcaagttaattgcagattgctgggcagagccccaagatcggccgagctgccaggagatcctcactcgcttgctcgactgcgagtacgctgagagctgagagcctgaaacgaacctggtgaatgcttcactcccaacctcccagtgccttcagaggtggaaccgtttctctgtataaaacttgtaaaaatctagcccgttgatcctgcagaccggcaaggatatacatatattaaactcttgtatttcggctgtatatcggcgaccctttctttcaaatttgtaaaggaaaaattctctccttttaatagaagaatgttgcagggctaaggctaactccaacgca

SEQ ID NO: 29 - DNA, 1526 bp, Hordeum vulgare
gaggttgggaaaaagggcgaggtcgcgtcccgctcatccacttggctctgctcgcatcttccttgtcgattccatttcggttccccttgccttgctaagggaagggaagggaagggaagggatccggacggcgatggggcaggacgggcagatccgccgcgacagggtcatcatcgacacggatcccggcatcgatgacagcatgacgatcctaatggcttttggagaaccaagtgtggagatcattgggctgacaaccatattcggcaatgtcactacagagtatgctacacgcaatgcgctcttgctgtgtgagagagcagggcatcctgaggttccagtagcagagggcagccctgagcctcttaagggaggagagccacgcgttgctgactttgttcatggatccgatggtcttggtaatttgtctcttcctgcacctaccagtaagaaggttgaggaaagtgctgccgagttcatggttaataaggtctctcagtttcctggagagatatctgtacttgcattgggacccctgacaaatgtcgcattggccatcaaaagggactcgtcatttgcaagcaaggtcaaaaaaatagttgtgctgggtggagctttcttcgcagctggaaatgtcaaccctgctgctgaagcaaatatctatggagatccggatgcagcggatgtagtttttacatcaggagcagctattgatgtggttggcattaacataacaactcaatgctgttttacagacgaggatctcttggaactgaaaaactcaaaaggggtgcacgcacagttcttgtgtgacatgtgcaagttctacagagattggcatgcgaagtctgacagctttcatgggattttcctacatgatcctgtgagctttacagccttagttcatcccgagtacttcacattcaagaagggtgttgtgagagtcgagacccagggcatttgcaccggccatactttgatggatcatggattgaaaaagtggaattcagaaaatccatggtcgggttatgcaccaatttcagttgcatggacagtcaatgtgccaaaggtccttgcatatgtaaagaagctgctgatggcaccctgagaatagaaccagaggtctattctgaatctttgagccgaagtgtaatggttcaggtcaactctcatggccaaagtatatttttctgtttttagaagcaagcataggaggaagggaagcttcctagtgcaaagcaaccaatgggggtaaattctgcacatgacagacagcattgtgacagcattgattccaaacatttatatatacaactacatttcaaatttggaaaaaacttccccatactctgcggtcttgtctttgtttagcaggcatatcttcgcacatgtttagacaaatgagaaaagatctacttctcctgtttggccatgtctagggctaaacctgatctgcccatgtgaggtcgtactgaacatgaattggcgctacttcctacttataactgcctgcacattttaggccc

SEQ ID NO: 30 - DNA, 1746 bp, Hordeum vulgare
acatctctctcctcccaaatcccaatgccccctcgcaattaacacctcctgcggcggcagacagcctgcctccacccccgccctgtcatcgccctccggcctccgcccacgccgccggccggcgcccatgacgtcatccgcgtcgcaccaccacgacgccccctcggccacctccaccccccgcgccggggccggcagcaccggcagcagcaacggcaacggcaacggcaacggcaacggaggccaccacccgcctcctccgcgggcgcaggcgcaggcgcacggggccccgtacgtgcgcctcatgtgcagcttcggcggccgcatcctgccgcgcccgggcgaccaccagctccgctacgtcggcggcgagacccgcatcgtctccgtcccgcgcaccacctcccacgccgtcctcttcgccgcgctcgccaagctcgcccccgcgctcttcgttcccggcgaccccactccggcgctcaggtacaagctcccgcacgacgacctcgacgcgctcatctccgtctcctccgacgacgacgtcgacaacctcatggaggagctcgaccgcgtccacagcctcgccgccaccgccgtcaagccgccccgcctgcgcctcttcctcttcgccgcctcaccagatcactcctccgcgggcgcgttcggctccgtgctctccggtgtcggcgacgcctcctccgaccagtggttcgtggaccagctcaacgccccaccgcccggttcgatcgagcgcggccgatccgaggcctcgtcggtcgtctcggaggtcccggactacctcttcggcttcgacactacctccgaggagcccagccccggcgcgggtgcgcagcccaagtctgacgcggagatggcgcaaggcgacgacgacgacgcgccggctcccgtgctgggcgctcctctggccccatacgtcgcggagagcgccccgtggccggccccgccgccaccgtacatggcgcagccggtgtactacgtgcctgtgcgccccgtccactacctcgacccggctgggcacggcggctacatgcctgggccggtttaccacattgtcggtggggggagaaaccaagccccgggagatctctacgcgtctgggggcgctggtgccgtctacggcgtcccgcggcccatgccgccattccgtcaggtgatgtacgcgccgccacccgccacggaagtctactcggtggaggggaagccgccggaaggtgagtctcactctccctaggcgcaaggggaggaagagtcatggccgtggtagattctgatgatcgcatgggctattcctggagatggttagttcttctgatgatcgcttatatccgagccaagatttttgcattgccgtggtaaatgttcactgtttctgctggttactgttggtagctgtatagatgagggaggtggaggatggatgggtcatggatatcacatttttcgtcgactgaaatagattcttggattgttattatgtgatgagtacatttggtgttattagtaatagcaagttactgtaatgtgggactggattcatatatattctactagaagattttttttatctgcgaaacacaatgtttctgcattttgtattcatatgcttgatgctggatgtatcatggtccatgagtgtcctatatatctactctagctttgatgccaatgtttgcgtatttgttttgctggaagcttaatttactgaatccattctagctttctcct

SEQ ID NO: 31 - DNA, 1655 bp, Hordeum vulgare
attcccatttccccattcattcgtcttcattccttctcagagagacgagtagcgaggcgagacgacggccacgagtagcagcaaggggagggttcggatctctcggcgaggaggaggaggaggatgttgagggccgttgcgaggtgctgcgggcactggccgccgggcgcggcggcggcggacggcatgctctggcagacggagctgcggccgcacgccgcgggggagttctccatggccgccgcgcaggccaacctcgtcatggaggaccaggcgcaggtgctcgcctccccggctgccacgctcgtcggcgtatacgacggacacggcggccccgacgcctcccgcttcctccgctccgccctcttcccccacgtccaacgcttcgccaaggagcaggggggcgtaaccgcggaggcgatccggagggcgttcggcgcggcggaggaggacttcctgcacgaggtccgccaggcctggcccaagcgcccgcggatggccgccgtcggctcctgctgcctgctcggggccatagcgggggacacgctctacgtcgccaacctcggcgactcccgcgccgtcctcggccgccgcgtcgtcggcggcggggtcgccgtcgccgagcgcctctccaccgaccacaacgtcgcctccgaggaggtccggatggaggtctcatcgcagaaccccgacgacgggcagatcgtggtgcacaccaggggcgcctggaggatcaaggggataattcaggtgtcaagatccattggtgatgtatacttgaagaaaccggagtatagcttggacccattatttcggcagatcggccctgttattgcattgaagaggccagctcttagcgctgaaccacaaattcatgtccgcaagctcaaaccaacagatcagttcataatatttgcctcggacggtctttgggagcatcttagtgatgacgctgctgtgcaaattgtcttcaagaacccaagaacgggtatagcaaaccgattagtgcggtccgccttgaaggaggccacgaagaagagagaggtcagcgtgcacgacctgaggacgatagagcggggcgtgcgacgccatttccacgacgacatcagtgtcgtcgtggtgtacctcgaccggcaccggggtcgtcgccagaccaaggtggtggactcgagcagcaactgcaccagcgcccccgtcgacatctactcctcctccagctccgtccagtcggcgcagccacggcaggcttaccgtgactccggttaatagaccagaagggccgcagaagctcaggctatatatatgatcatggtggtaaaaacggtggtagggttgcagatcagcaacgcaagctgcaacccgcaaggctgcagtggcagcgtccgaaagagatgcgcggatgtacataagtagtgcgggcgcgtggaacttttgtctgaagagatgattttttttttcgtatgtaattgcaggatttaactctccttgtttttgtttatctctgcttagccagcagttaacccgtggactactagaacggtagcagcactatatatcatactgaaattttagaaaggacacaccgaatttcagcatgtgagttggtccgtgctggtgcggaatccgaaatcgggttgtctttctactttccgatc

SEQ ID NO: 32 - DNA, 1039 bp, Hordeum vulgare
attaatccgccaacaccaccgattgctcaccttcatatcgcagattgtcgttgcattgccctcgaggaggcgagattagttgatttcggttggggattagttgagcagaaggcagtcggcggcctctggattgatttgcacgccatgaaattcggtaagtggctcaagcggcagatcgagcagagcctcccggcatggaaggacgagttcctgagctacaacgagctcaagcccgtcatcggcgccgtctcgccggccgagttcgtcgcccgcctcgacgttcaaatagagaagatcaacgccttcttcatcgagcaggaggagttcttcatcatcacccacagggagctgcagggggcgatcaggagcgcgctggagaggaaggtggcggtgccggcggctgcgcacgaggccgagatcgcggcgatccggagggagatcgtcaacttccacggcgagatggtgctgctgctcaactacagcagcgtcaactacatcggcctggccaagatcctcaagaagtacgacaagcgcacgggcgcagggatccggctcgccgtgatcgagacggtgctggtgcagcccttcttcacggtggaggcggtgtccctgatggtgagggagtgcgaggccatgatggaggcagtgttccccacggcgcccggcgaggggcaggcggcggcgcggcgggaccgcgaggccctggtcgcagcggagcagaggatcttccgcaacaccgtgtcggcgctcctggccatgcaggacgtgcgcagcagcagctccacgcgcggccgccactcgctgccgccgctcaacctgccggactcggactggctccgctccttctagccgccgccgtcgtcccccattccattccccgtccaatgacccccgccggcctcttcttggtggcctcaccagccacatccacagatatgtaattggctatctgtagtttctaacttctttttttgtttccctttctttttaccacgctggtgtaagatggtaacaagatgtgagcatacaaattcatact

SEQ ID NO: 33 - DNA, 2045 bp, Hordeum vulgare
gccgcacggcgacattcggttgaccttccagcttgacatcgaggctccgctcggcgcctcggctacacgctccgatattatttatagcctcggccgggggggagagggaggaagaagaagccaagcgagcgagcgatagggagggggcgatcgaggaagaggacaagcgcgagtcgccgaggtgatctgctggtggaagcgcaagcaaacaagcgagcaacaacgacccctgctacgtaccgtacctgcctagctaagctagccacggggtacgagggaaatccaagaaggagaagaagaagaagaagcccaccacgtacgggcgggcttccatggcgtctagctgctgcggcaaggggcgcgcgccggtcgtcgtccccttgctagcgctgctcgccgtctcatgcgccttgtcggtgtcggcgagcggcggcgccgggggcaacggcacgcggacggcggagttccgctccggggacgaactgcgagcttaccggaccatcctggcccggatggtcaggatgaacaaggcctccgtcaagaccattcagagctccgacggcgacgtcatccactgcgtgccggcgcacctccagccggcgtttgaccaccccaagttgagaggccaaaagccagaggctgagcccgtggacaggcccaagatcgtcgtcagccacgacgctgccggagaagaagaagaaggggacgccgagttcccgcaggcgtggagcgacggcggcgagtcgtgccccggcgggacggtcccgatacggcggaccacggagagcgacctgcggcggtactccggctccctccggcggtacggcatgaagccccgcgccgccggcgtccggcgcgactccaccagcgacggccacgagcacgcggtggggtacgtgaccggcgaccagttctacggcgccaaggcgagcctcaacgtgtggccggccagggtggcctcggcggcggagttcagcctctcccagatctgggtcatctccggcaccttcggcaacgacctcaacaccatcgaagccggctggcaggtgagccctcagctgtacggcgacaacagccctcgcttcttcacctactggacgagcgacgcgtaccaggcgacggggtgctacaacctgcactgctcggggttcgtgcagacgaaccggcggatcgcgatcggggcggcaatctcgccggcgtcggcgtacaacggccggcagttcgacatcagcctgctcatatggaaggacccgcggcggggccactggtggctgcagctggggtcgggcccgctggtggggtactggccgtcgtccctcttctcccacctcggcggccacgccaacatggtgcagttcggcggcgaggtggtgaacacgcggccggcggggtcgcacacgcccacgcagatggggagcggccacttcccgcgggaagggttcaaccgcgccgcctacttccgcaacgtgcaggtggtcgactgggacaacaacctcctcccggcgagggacctccggctcgtcgccgaccacccggcatgctacggcatccagggcggctacaaccgcgcctggggcgactacttctactacggcgggccgggaaggaacgtgcactgcccctagcgcttacgttacctgccgatcgtcgccggagacggagaaggagaagaaggagatccatccatcgatctacttatgattgatgagaacagtacgtactgctgattgatcgttgattcttactggtgctacgtacgtgatgatcgttaccgaggaacggacggcgacggcatcgatcatactatataggtagctagctggctggtggtttctcgatcgggttgacgcgtacgttcgtggcgcgcgcggtgcttcttttgatgtggttgaggcttgttcttttttttccttttcaccttttgagctacctagcgtgtatacgtgaagaaactgacatatatatagagagagtgtattgtggatttgtgatcctcttgtgtagtacttccttcctaaactaatataaaagcacttaaaacatcc

SEQ ID NO: 34 - DNA, 1293 bp, Hordeum vulgare
gaccacgctccggccaccttccaccttccaaaaccggcagcaccagagctagtcggcgcgactcgtcggcgatggggaggacgctggacgtgctgctggggcggacaacgaagcagacggcgcggctgaggtcgctgctgcaccttgccacgaggcgggtcgccgtggtgcgcgcgcaccgggaggtgcggtgcgcgcaggcgcggggggacgtggagcagctgctccggcagggccacccggaccgggcgctgctgcgggccgagcaggtgatccgggagcgggacacgctcgacgccctcctcctgctcgacgcctactgcgcgctcctcgccgaccgctcggcgctgctcgacgcggcgcacggccgggagtgcccggccgagctgcgggaggcggcggcggggctctgctacgccgccgcgcgctgcggggacctacccgagctgcaggaggcccgcgccctcctcgccgccaagttcggccgcggcttcgcgtccggcgccgccgagctccgcggcggctgcggcgtcagcgccaaactcgtgcagaagctcgcgaccacgctgcccagcctcgagagccgccagatggtgctcctcgagatcggcgccgagaaggagatccccgtgcgccttcacaacgacgctaccgccgccgccgagcacgaggacccggccggccgctcccgccatggccatggccacaggaagatgaggcacgacgacgacgacgaacggcgagccgactccgacgagccggagggagacagggccgtctctgcccactcaaagctgacattcaaagacgtggaagaggcggcgcaggccgcgttcgaatcggctgccacggcggcggccgccgccaaggctgccatagagctctcgcgagccgggtccgggagccccgacggcagctacaggaggaaggcgcacgccgccgacgagacgcaccaccgcggcgatgatctggccgatggcaaggccttggagaggatcggacatgttcggaactacagttctgatgcagaagatctgccggagaaacgcggagaacagcaggatacgcccaggagcaggccggcttcagtcaggacgaacagaggactctagtagtttagctgcagccatacccatatggcagcagcagagactgtttcttgatttagttgtattgctagaagttgaacttctgcagctatatattgcagatcattcattattaaattttgtgtatgcgatgtaaatagagaattggggaagtaaatattaatatgattccgatttttcacca

SEQ ID NO: 35 - DNA, 1855 bp, Hordeum vulgare
ggtggcgcacgggatcggtcctctccctcgctttctcccgtaccctcgcagtcgcagcctcgtttcggattgcatttgcataagctaagcgcgcggcgataagaagcggcagaaccctctcgctctcccgccgtttgacccgcctccctccggcatcgcggggttctctgctcgggttgcttgctgggcgctggacatgaaggacggaggggcgaggcagcactggccgtgcgactactgcggggaggcggcggcggcgctgcactgccgcgcggacgcggcgcggctctgcgtggcgtgcgaccgccacgtgcacgccgccaacgcgctctcccggaagcacgtgcgcgcgccgctctgcgccgggtgcgcggcccgcccggccgcggcgcgcgtggcggctgggggaggcgagccggcgttcctctgcgtggactgcgacggcgggtgcgaaggcgcggcgcgcgtgcccgtggaggggttcgcgggctgccccgcggcggccgagctcgccgcgtcgtggggcgtcgacctcctccctggcggcggtggcgccgccgcgttcggttgcggcctcggcactggcgccggccaggaggatgaggacgccttcttcttctcgtccttggactactccatgctggttgaccccgagatgcgcgacctctacgtgccctgcaacccgccggaggtggctgtctcggcaggcggcggtcggcccctcaagggggaagcgctgtgcgaccagctcgcggagatggcgcggcgagagacggacacgtcgcagccgcaggggtactcggatctgagccccaggactcctcgccggtcctccgccgggtctagcgggcgcttgcctgacaagcagcctcccccgccgctgcctcctgctccagaggtgccgtgtccgtacacgtccctgctgatgatgccgtcagcccactgcgccgagcttgtcggcaacgaccggctccctgatgacgacgaagaacaacttcgatgggagttcgccccaccctcatcagtgccacccacccagatatgggatttcaatttaggaagatcaaggaaccacaatgaaaaatctgcacatgaagttggatttggttcaaacaatggaggctttatgatcaagagttacagtgacatgctcaaggaaatttcttgtgggacaacgaaagatctggaagatatttacgactcaggatacggtgcagctgctgaagatatcatgtcaacaaatatctgccaggtgccatccaaaaatgttagcacagcgagcaacaagcgaatgaaggtcagctcatgcacctccacaatggatggcccaacaacctctgggagcaacgtgcctgcttcagggaccttggcgagctcttcccatgacagaggagcagctcccactagggagatctcctttggtgatcaaacaatcgtcccgactggagctgagaggcctaccacaaggatcgacagtgagactctcgccctaaacagggatagcgcgatgcagcggtacaaagagaagaggaagaatcgcaggtacgagaagcacatccggtatgagtcccggaagctgagggcggatacccggaagcgcgtgaaaggccgttttgtcaagtcgaatgaagcgctcaatgccggcagcaatggcggatgagccttcttccttgctcgcagcacggagatgacatcctgcgccgcacctaagcatgatgccgtgcattgctcagctatttttttgtgttcgttatcgttttcagcatcgtgatccagaggatcatattcacggtgttttttttgtaagagacctctacttttctcctcagaacacatagcttaattttacactggt

SEQ ID NO: 36 - DNA, 4763 bp, Hordeum vulgare
gcggccgcctgcaggaaaagatccccaattccaccccccgcctcgcatttccacccccatcaccaaaaccctagcgcggccacacaacctctgtgtgccgccatggcgcccgccgcgaagaagccgccgctcaagtccagctcctcgcacaactccgccgcgggggatgccgccgggaagaccatcgaggagatgtaccagaagaagacgcagctggagcacatcctgctgcgcccggacacctacgtcggctccatcgagaagcacacggcggcgctctgggtctacgagaaccgcgccatggtgaaccggcaggtcacctacgtccccggcctctacaagatcttcgacgagatcctcgtcaacgccgccgacaacaagcagcgcgacccctccatggactccctcaaggtcgacatcgacgtcgcggggtgctgcatctccgtcttcaacaacggagacggcgtgcccgtcgagatccaccaggaggagggcatctacgtgccggagctcatcttcggccatctcctcaccagcagtaactacgacgacaacgagcggaagaccaccggcgggaggaacggctacggcgccaaactcgccaacatcttctccacggagttcgtcatcgagaccgctgacgggcgccgccagaagaggtacaggcaggttttctctgagaacatggggaagaagtcggagcctgagattaagaagtgcaagcaatcagagaactggaccaaagtgaccttcaagcctgaccttgcaaagttcaacatgaccgagctcgaagctgatgtcgtggcactcatgatgaagcgagtagttgacatggcgggcacccttggcaaaaccgtgaaggttgagttgaatggcgagaaggtggcagtaaaaagcttctcagattacgtgcaactgtatattgactccgcttccaaagaaggaatcgacctaccaagaatttaccaaaaggtaaatgatcgttgggaggtctgtgtgagtctaagtgaaggccagttccagcaggtcagttttgtaaatggaattgcaaccataaaaggtggaacacacgttgactacgttgcaaaccaaattgccagccatgtgatgggcgttgtgaacaagaagaacaagcaggctaacatgaagtcgcatgtagtgaagggctacctatgggtatttgttaatgcgctcattgacaaccctgcatttgattcacagaccaaagagaccttgacgactcgtcaaggaagctttgggtccaagtgcgagctccctgatgattttcttaagaaggtctctagctcgggagttgtcaacagtctcctttcttgggccgagttcaagctaagcaaggaacttaagaagactgatggaaccaagaagacgagtattgttggcatccctaaactggaggatgcaaatgatgctggtgggaagaactctgacaagtgcaccttgatcctcactgaaggagattcggcaaaggctctagctatggctgggataggtgtagtaggaagggaccactatggcgtgtttccactcaggggtaaattattaaatgtgagagaagcaagccataagcagttaatggagaatgcggagatccaaaatataaagaaaatattaggtctgcagcatgaaaaaaattatgatagcacaaaaggcttgagatatggccacctcatgataatgacagatcaggaccatgatggttcccacatcaaagggttgctgatcaatttcattcacaaagagtggccgtctctcctcaaagttccttctttcttggtcgagttcatcactccaattatcaaggcaactaagggcaaaactgttgagccattttactcgatgccagactatgaagcatggaaagagtccttaggaacaagtgcaagttcgtggactataaagtactacaaggggctgggaaccagcacagctgaagaaggtcgggattactttgaacaaattacccgtcacaagaaggattttgtctgggcggatgacaaagaagatggtgacgctattgagttagcgttcagcaagaaaaagattgctgagaggaaggattggctgaccaactatcagcctggtacttgtcttgaccaacgtgagaaacgcatcaagtacagcgattttatcaacaaagagctgatactcttctcgatggcagaccttgaacggtcaataccttcaatggttgatggctttaaaccaggacagaggaagattttgttttgctcgttcaagaagaatttgattaaagaatctaaggtggcacaatttattggctatgtgtcagaacactcagcataccaccatggtgagcagagtctagcaagcacaattgtaggaatggctcaggattttgtcggcagcaataatattaatcttttggagccccgtggccagtttggtaccagaaatgcgggtggcaaagatgctgctagtgctaggtacatcttcaccagattaaatcctatcacccgcttaatttttccgaaagatgatgatgttcttctgaactatttgaatgaagatgggcagtcaattgaacccacctggtatatgccaatcattcccatggttttggtcaatggaagtgaaggcattggcactggatggagcacctatgtcccgaactacaatccaagagatattattgctaatctgaaaaggttgcttaatggggaggctattgtaccaatggttccttggtacagggggttcaaggttgctttgaaggagacaagttcaaaggcaactggtgtgacatataccatcactggtgttatagaggaagttgctgacaccaagcttaaaataactgagcttcctgtccgccgctggactacagattacaaagagtttcttgaatccatgtgtcctattcctatcaaggaaaaggaaaagagcaaggacaagaacaaggaaaagaagaaggacaaggaaaaggacaaggacaaggaaaaggaaaagagcaaggaaccaccattgttagaggaaataaggtcgcagtgtgatcacgcggatgtggaatttgagcttatactgagtgagcaaaacatgaatatagctaagcaagaaggccttgagaagaaattcaagctgactaccacaataggaacaacaaacatgcatttgtttgattcacatggtaaaatcaaaaaatatgacaacccagaggatgtacttcaagagttctttgatttgaggttcaaattctatgtcaaccggaagaaagtaatgatggaaaacatggggaatgagttgctgaagtatcagaacagagttaggtttattcttgctgttatttccgaggacatcatagtcaataacaggaagagggcagacctattcctggagctgaagcagaagaactatacacctttcccaaagaaaaaacccacgtctgggccagttgctgtaggatctacagaagcagaggaagataatgatcagagtcctgctgaagctgcagcaagtgattatgagtatcttcttgcaatgtcgattggtaccttgactttggagaaggtgaacgagctcattgcgcagcaggataagttaaaggctgatcttgaaatgctgcgtaatacagagccacaaactctttggctgagagaccttgacgctcttgagaaggaactggatgtgtgtgatgcaaaacttgaagctgagcagcagaacagatcaagcaagcgcgctaaaaattctgaaaaggcgaaggattctaagccagcacccaagagggcagtggcagctaagaaggcgaaggcgaattcggctgggagtgatgatgatgattatgaagcagcaattccgaaacgtgcagcacaaaagaagaaaccaccacccaaaaaggcaagtgcactggtgaaagatgaagaggaggaagtggctgatctgaaagaccgcctggctgcttacaatattaatgactcctctccagaacccagtgccatggaaacagaagaacagcagaaaggaaagaaaggggggaacggaccaagcaaaagaggtgcagcaaagaaggccatgtcatccttagctgagatttctgatgaagacatagcagagccccagcatgagagcgaggatgaggggtcttccatggaagttgagaagaagactaaaggaaaacagcctgctgctgcgaagccaaagactgctgccatcaggaagagagcgccagctcagagcaaaggcatgaggcagaaagtgatggaagaaatattcaagcctactgatgacagcaacctcagtgctccttctcctgagaagaaggtgcgaaggatcagggactcccccttcaacaagaagagcggctcggttctgcacagaatggcgagcacttcaacaggggtagaagatgatgaggctcctccctccggcagctctgctgagccagttgcacctagaaggacaacaagggagaggaaggcggcggtagtctacgtcgcttccgggagtgaagatgatgagtctgaggatgaagatgtgtcggaaccaagtgacgatgatgacttctctgaagatgactagactccttggctcaaccgctcaaacattgcagtggctagtgtctagagacatttggttggctaatctgatgtattggtgctttgctcaggtgcatctcttgtgcgtcgtatgttatgtttggttgctgagacattctgtgagctaatcggtttgagacttgtgcctatcaccatctctagttctgttttattcatgcctgagacatgttg

SEQ ID NO: 37 - DNA, 1415 bp, Brachypodium distachyon
agaacggtacggcatccgtgacggagacggagagcagagaggcgccctctcccgcggcggtgaatcggccaccgaggcggggctcttgactcttcccgagctccgggtggaaagcacaaacagcttcgccccgccctggggcgaagcaacagcatttcgaatccgtacgcaccgcggaggaaaagatcgagcggggagggaagcgagaggaagagatatgtttatccagaaggcatggaggacggcggcgtttgggctctacggcttcacccagttcaccaaatcaggattcgcggaacatgccaagaaatttagagaggaggatatgcagatccggttggatgggaaaaattgcctggtaactggagcaaattctggcttaggttttgctacagctgagggattggcttcgcatggggccactgtttatatgctttgtcgtaacaaggaaaggggtgagactgctcttaaacagataagatccaaaaccggcaatatgaatgttcatctggagatatgtgacctttcatctattaatgaaataaaatcatttacgacaagattctcttcaatgaacaagccactccatgtcctggttaacaatgctggcttcctggagcacaagcgtgtgactacaccggaagggttggagctcaattttgctgtgaatgtggcagctacgtacacgttaacagagctagtgatgccattgttggaaaaggcagcacctgatgctcgtgtcattacagtttcatccggaggaatgtacactgagccattgaataacaatttggagtacagagaaagtgactttgacgggaccaaacaatatgctcgaaacaagagagttcaggttgcactcactgaatggtggtctgagaaatacagcaacaaggggatcggtttctactctatgcatccaggatgggctgatacgcctggagtctccaagagcttgccgggactttcagagaagttatcgggaaacctgagatcaaatgaggaaggggctgacacagtggtctggttagccttgcaaccgatggacaagttagtggcaggagctttctactttgaccgagctgaagcccaaaaacatttgaagttcgctgggactgcagcctcccatgcgcagataggttccattgttgatagcattcgctccatctgtggcctgcagcctcccatgcgcagataggttccattgttgatagcattcgctccatctgtggcctcccatgcgcagataggttccattgttgatattcaaaaacatttgaagttcgctgggaccttctcattgatgctttaggagaaaaaagaaaagctactcgttgaaaggaaaaatttgcaccagccgggaatcgaacccgggtctgtaccgtggcagggtactattctaccactagaccact

SEQ ID NO: 38 - DNA, 1587 bp, Brachypodium distachyon
cttcctccagccctctctttctctccctgccaaatccccaatccgattgcgatttcgccgccgccgccgccgaggcttcccttccccaacgcgccgtatcttcgcttcggaacccaaagagaggttgccgaaatggagatacagtcgtccgggaggcccatcgaggtgctcatggagaaggtgctgtccatgaacatcgtctcctcggactacttcaaggagctctacaagatcaagacgtaccacgaggtcatcgacgagatctacaaccaggtcgaccacgtcgagccgtggatgaccggcaactgccgcggcccatccaccgccttctgcctcctctacaagctcttcaccatgaagctcaccatgaaccagatgcacggcctgctcaagcaccctgattccccctacatcagagctattggatttctctacctgcgatacgttgcggaaccaaagacgctatggacttggtatgagccctacattcaagatgatgaggagttttcccctgggtccaatggtaaaatgacaactatgggcgtttatgtgcgtgatgtcctccttggtcagtactacttcgacagtcttcttccacgagtgcctctcctaattttgcgtcaggtcactgcccatcttgagaagatgaagctcccaacaaagcagtcagggatgactggggattctagtcgccttggttcagatgatactgcccggcggcctccttcggtgaaggcctctttgtctgtctcttttggtcagcgtgcgccacaccgtgcatccacaagggattcgtccccagttcgaaagacattgccttctatacgggaaagggaaaggagtcatgacggtgatcgtgcaaaatctccacccaggaagcgccgaagtgaaagtcgggagcgtaatcgtggtgaaactgagagggaccgttcggatcgtgatcgtggtagatataacgatagagaacaaggtcggcaaagccgtgatagcagagatcgtgactaccatcgttcgagctatgcagaaagagatgttgaaagacgaggccatgaaaggcgggacaggaactctgatcgaaatggacgttcaagcgcccacagaagcaggagtaggagcaggagtccaagccgtggcagaaccaacggcgaccaccgtcgtgctagcccatttggtaaagcacccgagtcatccaatttggctaagttgaaggatctttatggcgatgcgtcgaatgcaaaggacgatgcaggcgatggcagagctcgcagggattctggagctgaagaggtaatcagattgggaggtgccaggtggaggtgattgtcaaaaccagaaaccgcgagatttaattcttgttgtactaacactgttacatgctgtcagagataaggcaacgtatgatgggattcataccccctgagctgctattctgtctggccattgcgtgtactggatggaacacaatctgttagctggctaggcaatttggtagcactgcaagaaaatgatcaatttggatagccaaagttctgtattttgtatgctgttgtgagttcatcctttttttttaatctctcgtatgcagag

SEQ ID NO: 39 - DNA, 2115 bp, Brachypodium distachyon
ccggccgctttaaaccggagaggccttttcctcttgcacaaacccgcgcttattttttttccgtcacctaatttttgccctcctccttcgattcgcgtttggaactttggatccgagcgcccaagctcggagacttggtggatgctgtagaaatggtggaggcggtcgcgtccgcgggtgggctcgccatggcgtcctcgacctccgtcacgcccggccaggcttctgctctgctgggatttctttgggttcttgcagcctgggtgtatggtgaggtgctctctcacaagaagaatgctgcttctattaaaacacattcggacatcaatttaccagagatggataatagctcaaacaaagcagaggatcaaacaaagttattagaggagggtggccaagcagcaggtgcaaagcctgtttatgcttctttcgcatcacagatgatcagacttttctttatggaccagtcacttcttctggagcatcgattgacactgagggcaatatccgagcttggaggccatctcctttacttttacatatgtgatcgtacaaatctattcggagagtctgaaaagaattacagccgagatctcttccttttcctctactttcttcttattatagtagcagctattacttccttcaaggtccaccaagataagtcaaccttcacaggcaaatctgtactgtatttgaataggcatcagactgaagaatggaagggttggatgcaggtgctgttcttgatgtaccattacttcaatgctaaagagatctacaatgcaattcgtgtgttcattgctgcatatgtttggatgactggatttggtaacttctcctattattatgtgcggaaagatttcagtctcggacgatttgctcagatgatgtggcgcctcaatttctttgtggcattctgttgcattgtcctaaataatgattatacactgtattatatttgccctatgcacactcttttcaccctcatggtgtatggtgctcttggaattctaaacaaatataatgagattagatcagtgattgctataaaatttgttgcatgcttcttggttgttatcttggtatgggaaatcccaggtgtctttgagatggtctggagcccattcacgtttcttctaggctataatgatccttctaaaccagatctccccagattgcacgagtggcatttccgatctggactggatcgctacatatggattgtggggatgatatatgcttattaccatccgactgttgagaagtggatggaaaagcttgaagaagctgaaacaagaacgaaactctacattaaggcctctatagttacagtttctttaacggttgggtatttgtggtatgagtacatttataagctggacaagatttcctacaacaaataccatccttacacatcctggatccccataactgtctacatctgtctacgcaactttactcaagaattccgtgcctgctctatgacgctattcgcctggcttggaaagatcacactagaaacatatatatctcagttccatatctggctcagatcaaaggtacccaatgggcaacccaagtggctattaacaataatcccagagtacccactgcttaacttcatgctcactactgctatatatgttgcggtttcccataggctctttgaactgaccaatactttgaagatagcatttgtacctcgtgacaacaagcgcctctcgtacaattttatggcaggaattgccatttcagtggctctgtactctgtatcgtttgttctggttggcatagcaggatactagctgttatttagtttgttccagttcccgttctagggtataagcaaagctagtttggttgctcgtgagatcaaattcaactggcgaagcagcgattctttcaccttgagcttgaacgaattgggatgagcaaggggtaatcttgaagagtgtaaaatatacaatgggcaccagcaccaagtgggaatatgataaagtagatatctgcctgtatagctgctgaaaccagcaattttgttgttgtggtttaacacttgaaacagagacagaataatgataagaatcttcacaggtattacgcgtgttttca

SEQ ID NO: 40 - DNA, 2061 bp, Brachypodium distachyon
attcttccccttccttccttccgttcctcgccttcttcctccttccccaaggcgagcatcagcggcagattgattcgatttcgatcccgtccccagattttcttcacctcccgatcgctccagacagcctccgcaatcccctccccgaggagcccccccacaacgtgcgtgctcgcacactcgcactcggctccattattaattccccttccccgtccgtacttccaaaacctccccgtcttcctctcctccatctcgttccactcccgcacggccgcattgctcggccgcgtcgcagcggcttcatccctgcattttgttttgggtttgttggatttggtttggtttggtttggttgcgaggagggtttgttcgatcggagcgggcgaggggaggaatcgagaaatgtgggcggtggagcgggtggtgggggagcggcggatgcgggagatccagcggttcgcccggaacgccaagctcaccgtgctctgcctcctcctcaccgtcgtcgtgctccgcggcaccctcggggccggccgcttcggcacgccgcagcaggacctcatcgagctccgccaccgcttcatctcccacccgcagcgcgcgcttgccgagcaccacgacgccaggtccagggcctccaactccgccgcggggaaggtcgccgaccgggatgacgagccggacccgccgccgaggactctcagggacccgccctacaccctgggccccaagatctccgactgggacgagcagcgggccgcctggcaccgccgccacccggagtccccgcccttcctcaacgacgtcaagccgcgggtgatgctagtcacggggtcctcgcccaagccctgcgagaaccccgtcggcgaccactacctgctcaagtccatcaagaacaagatggactactgccgcatccacggcctcgaaatcttctacaacatggcgctgctcgacgccgagatggctgggttctgggccaagctcccgctcctccgggcgctgctcctcgcgcacccggaggtcgaattcctctggtggatggactccgacgccatgttcaccgacatggcattcgagctgccatgggagcggtacggcccctacaacttcgtcatgcacggctgggatgagatggtctacgacgacaagaactggattggtcttaacacgggtagcttcttggtgcgcaactgccaatggtcgcttgatttccttgatacctgggcgccgatggggccgaagggtcctgtccgtattgaggctgggagagtgctcaccaagcacttgaaggaccggccagtctttgaagccgacgatcagtcggccatggtgtatatccttgctacccagcgcgagaaatggggtaataaggtgtatcttgaaaatggatactatctccatggctattgggggatcttggtggacaggtatgaagagatgcttgagaattacaagccagggcttggtgatcatcggtggccactggtcactcactttgtcgggtgcaaaccgtgttcgaaattcggggattaccccgttgagagatgcctcaagcagatggaccgtgctttcaattttggagataaccaggtcttgcaaatgtatgggtttgagcacaagtctcttgcgagcaggagggtcaagagaatcaggaacgagaccagcaacccacttgaggtgaaagatgatcttgggttgctccatccatccttcaaggccatgaagactactacgtgataattatagtaaaatccacttattttgttggttcgttctagatcctcttggatcaaaatcttataagttctttttgtagactcagggtgaaaacaaagtttgggttggtatcacgggatggatatctatgttgtactgtgagattttagagcatgatgttatgtttattgttggcataatcgatgtctcacacttctagaaattgagttagtgaagggaattcttcagttaattggtcactactctctagtctctatataatttatctgtagaattcctacttttggttgttggctgaatggtttggattttcgtgtt

SEQ ID NO: 41 - DNA, 695 bp, Brachypodium distachyon
cacgaacccttgtttccttctccaatccctgattctccccatcgtccttccctttctcctggatccttccttcgctccgccaattccagaaattgttgtcaggaaggcaaatgattgctcatgtggtcaaccgggaggatcagtagcgagaagtggagatgatcacccgagcgaagctggtggaacagctgagggagcaacagatccggtcggcgcagacctactccgcggccctcgccgtcttttcgcccaacccccacatctcctccaggcgggatctaaaggttgctctcctatatgctttcttgttctgttttctcatggtgtcgtgctatatggccctttacctgaaatggttcagactttcatccctctttgtacttttcggtatccttctgcaagtaagtctcaaaatctctaggcatagaaggctgaaaaggaaaagggaaagaaagttgttgttacccttgtccatgtgaatatctttctgatatcgtgtaacatttaagtaaaatggatgaaccacaaagaggaaaaatcttggttggatcggcttacaccctcaaaaatgtatattttgcttttatgcattcacatacatatgcaccaccaccggtctcagttttccccctcttttcaaacttctgtctttgaaaggtaatgctttctttagaaatttatgggcaaatctttgc

SEQ ID NO: 42 - DNA, 2646 bp, Brachypodium distachyon
aaccggctagtcgcatccgctcctcctcctccctccctcccctctcctctcctaccttccgcccgaagtctccacgctttccgtccatttaaaaccttcgcttcgtctcgactccacttggccattttccctcgccaaatctccgcgcgcgtcaaaccctaggggtcctgctgactcccacgcgccccctccagatccaatgggagcggcgccgtcgacgccgaggcttggcgaggtgggcgccgcgccgccgggcgcggcggagcagatgttcgcggcgctggtcggcgacaaggcctacccgatctcctccgagttctggaagcagctgttcgagctgcccctcaccctgcagtggccgcgggagcgcgtgctgcaggcgtgccacgcgttcgcccagaacaactacaatacgaagcatctcacaaagatcttgatccatttggtttggtgtttgcaagagtgcacgtcagcttcttcagtgtcttatggcgtttatagaaaggccatcaatgctgcctatatatcatccatatttctcaagtttattattgagaacgccaaggcagataattggcaagagctatgccttcacattgacaaggatgagaaggggctggagaattttccttctgatcaaacagtggagtattttctgatgaaaggggtgctgaactacattggtagtgtagatgtaagcccagagtcgtgctacctacatcatgagcttctaaacttgatgttagttcttatgtcgactcagttatgttctggaccatctccagaaccaaaagatgtgcatccttttattgatgcagctatgcttcaggagagtaccacagtgggctctgtagttcaaaagttacttctaaatttcgtgagacgaccacagattcctttaaatggttcacaccctgttttctctgataatggtgggcctggtgttctgcaacgagttggctcagcagctgcaaatttggtactgctgccatattatactttcaactatcttgtaaatgcaagtgctgaaggggcaacaagtcaattggcagataacagtttgcttgttctgcttattctgattcactaccgaaagtgcatttcaatgaccgagtccattccaatcgacaatatctacatgagcgattcaaataccaatattaaggatgcgccatcttttcatgagaacccttattgcaaggcattaaataatgccaaggacattcaatttgatcgtgctgatgttgagggaaatgctcaaaatggacctgttgtcaggttgtcttttgcgtcgctgtttgatgctctcggcacatgcttaaaagacgagagctcagttttgttgctctattctttggtccatgggaattgcgactttcaggagtatgttctggttcgaacagacttggatactttgctgatgcctatcttggaaatgctttacaatgcatcaaggaagacttccaatcagatctacatgttgttgataattctcctgatactgagtcaagactcaaccttcaatgctagtgtgcacaaattggtgcttcctagcgttccttggtaccaggagcgcctcatgcaccaaacatctctgggatctttgatggttgtgatactaattcgaaccatcaagtacaacctctccaagctgcgagatgtctaccttcacacaaactgtctcgctattctagcaaacatgggccctcatgtgcataggctgagcgcatatgcatctcaaaggctggttagcctcttcgacatgctttctcgcaagtatgccaaattagctgagttaaaaaatgacaaggcttcaaaaattatatccgatcaaattgaaccagacaacatctcagatgatacgtcaacagagcttcacatatacactgacttcttaagaattgttctggaaatcgtcaacgcaatccttacgtatgcactgcccagaaatcctgaggttgtgtatgctattttgcaccggcaagaggtttttcagccctttaagaaccatccacgtttcaatgaattgcttgagaatatatacacagtattggatttcttcaatagccggatggacatgcaacagttagatggggaatggtctgtggacaaagttcttgagctcattaacaaaaattgccgttcatggcgtggagaaggaatgaagatgtttacgcagttacgatttacatatgagcaagaaagtcatcctgaggaattctttattccatatgcatggcggcttatcctatcacggggattttctttcaatcctggtgccataaatttgttccctgtggagattcatgttgatgatgcacaaccgggtgaacaaaaagtttagggacaatctggaaccgttggggttctgacaagtgacaccaacacagaaatatttgacctgtttcataggttgtggcgaagagctcgttgtatataggcggcatataccagataatcaaagtgtattctcattctttttgtgttaatatttccattgtcccatgatgtaatgcgacaagataggggtgggggaaattgcaagggattgtatctggttaaaaatgggtagagtgtaggatatcatagacaattctttcataagttattgctggacttcaagctgaaggtctctgctgtctattg

SEQ ID NO: 43 - DNA, 2268 bp, Brachypodium distachyon
gccactccccttcctccttccgggccttccccaggccacattcccatctccgcctccgctcccacccccggcccccgtctcgggcgcggccgcatcccacaaccgccaccgccacctaatcctctggagcggcaccgaagagggttcgccaccgcgagtccatccatgggccgacccacgcgccgcgccagcgctccaacatagggtttgcggctccctgcgccctgcatgttaaggtggggaggaggcgacctggggttgtctgggggaagcgggagcggggtctggggtgccacgccggcggatggacgccgatgaggccgcggggagtagcaggaggatggatctgaacctatacctcggcctaccccgcgccccgcgtccgcgccgctccgacctcggctccgacctcgccctcagcaccccgatgccctcttcgccctcctcttctgcggcctccgtcgacgcccctccaccgccggagcccccgcatgccatctactccccacctcgcgccgacctttctcctcgaacaccggaggtatattcctcgcaccatctcgacgacgctctttctgcggacgcgcacctactgtatgcgcctcctccggcgccggtcatccgtgaccgtgagctcccggacgaaatcggatttggcttccaggccccgcccccgcccccaccaccgctggtgcgagccagcgaactgctgggctgggaggaccggccgtcttcctcgacggcctcctcctccttcctccctgacattgccacaaggtacaggcggctgctcgagcaaactggaagccggtggctccgccctcgcccaagaaggtttagatcagaccttccgcctctcagcgcagaggctcaacctatagggcaggacgcagcagtacctgtgccccatcaggagatgacaaatgatgatttcggtgacaataaggtaatcgccaatggagcggaactaggtgcctccgaggagtcggaggagcggggcaagagtgctgccacattcgagtgtaacatatgctttgagatggccggagagccggtggtcacttcttgtggccacctcttctgctggccttgcttataccaatggcttaatgtttactccaaccacaaggaatgcccagtttgcaaaggcgaggtgacagaggcaaatattactcctatctatgggagagggaattcctcttcagatgtagagaaggctgtggaagaaggtaagcagccaggccctacagtaccaccaaggccacatggaaatcggcttgaaagtttcaggcagcagttccagcacttacgaccgatgtcaagaaggctcggtgacgcacatggaatactgtcatcatggaggcgccttcttgatcaacagattatgaatagtgtgagtaggtttgaaggtccacctgaaccagctgttcatgaaacaggtgatactgctcaacccgctagtcgcctaggtacattgcccataaggatgagaccaagacgacggtatcagatggaggcggatgaccttcctgatggtggttccgttgcccctgatagtggtttacctgggaatagtgcaccagatccacacagacatggtccgagcccgcttttaccagaaggaattgatttgttgcaacgacttacccttattggccttgcaaatacagaaagattggcaactgccatgagtgacctgagaaggatagctgcccctaaccaatatggagcatctgcgtcgtcatcgaacccgtcgaatcccgagccagcagttgacggagcacatgttggtgcagcaccttctacagatcaagcatcgaactcgagcaccattgcagtgatacagggggatgctggtatttctgagactgcaggagagcctagtaatgcaggatcttcaagatccctgaggaggagagggaggagcaatgccttggcttctttagatgtggatggtgggcctccccagcgcatcaagaggcggaggatgaactgaaccttctcagtttcggtgtttctttaaacttcataatgtgctttgctaattttcagttttgcatttcgtttctttcggtgctacctgttatattgtagttgtaatgttgtgtcttctcttccatttgtttactagtgtcacccaaatggttctgtttagttcctttgtagcctgtacctctttaatctatcatgaagttattggtcaaagctaattgtggaggaaactaaacagttgtcgacttgtcgtgagatgaagattttcctgttgat

SEQ ID NO: 44 - DNA, 1049 bp, Brachypodium distachyon
tttcctcctcgcccctcttcctctccttcgcacccaccgcccgagatctccccccccgcccgcctccggcaatggcctctcccggaccagcccccgccggcgaactcctccgcatcgaccccatcgagctccgcttcccctttgagttgaagaagcagatctcgtgctccatgcagctgtcgaatctcagcgacgactacgtcgccttcaaggtgaaaactacgagcccaaagaagtactctgtgcggcctaacaccggggttgtcttgccacgatctacttgcgatgttgttgtgacaatgcaaacacagcgagaggctccacctgacatgcagtgcaaagataagttcctagtccagagtgttgttgcaccatctggtataaatgtgaaggatgtcacgggagaaatgtttgccaaggagtccggaaataagattgaagaggtgaaattgcgagtcacctatgttgctcctccacagccaccatctccagttcctgaagaatcagaagaaggttccccatctaggggtgaatcagaaaatggagatggtcctgctgggggattcaccagagcactgcgagaacgcattgagcctcaagaaaaatctttagaggctggagctttgatctccaagttgaccgaagaaaaaaattctgcaattcaacagaaccaaaagattagacaggaacttgatatgatgagacgggaagtcagcaagaggcgcggtggagggttttcctttgtaattgtcttaattgtagctttgatcgggatcttcctgggctatatgatgaagtcataattctttcagtccttatcaccttggctataccgaagagaactggatttgattcatgctagtcgtgtttgggaacttgaaaagaccattcgaaatcaaatgtcttcaagttctcatttctgttttgtcaatataggaagtcatgtatgagaagtgttttgccttttaagcttcttttgttgttaattttattgggtgtgttatgctctttgctgacgccgtaaattggaaaatgcattagttgctttt

SEQ ID NO: 45 - DNA, 1715 bp, Brachypodium distachyon
ttttgctttccgcttccccaaaatggcgggccggccgtccgtctcccctttcccaggtggatttcttcctctcctctcctctctctcttctctctagatcctgccgccgacgcgaccaccgaaagcagtcagcatcatgccgaggtttaatgcgaccgaatcagccccaagtccatggatttctttccccaatcaattctgcccatcttgcccctcccctgccaccagcatcgagcagcccatggtttcgctctcgaggtctcctcccgcccgcgtataactcgcccgctcctccttcctccatcccccccacctcgccaccaccacaactagtctatacctagctgcggccgcgaatctggatatctggttcttgcccttgccctgacggggggacttcttcttcttcttcttcttcttcttcttcttcttgctgctgcggacgtacctcgcccgtcggcgatgggtgcggagtttgaggtggcggtggctggagtcgccgcgccgccggcgaagaggaggcgccggatggtagcggcggcgggaggagcgaggcggcgcgccacgaggcgtgcgccggcgccgccgaccagggccgtgcagcggctcttccaggcgagccgcgccgtcttcaggggccccggcaccgtgccggcgcccgccgaggtcgccctgctccgcgccatgctcgacagaatgagaccggaggacgtcggcctaagcgcggatctcagattcttcaaagccagagaagccgccgaggggaagacccccacgattacacataccaccatatacaaatctgagaatttctcgatggttatcttgttcttgccaccgaatgcagtcatccccctccacaaccatcccgggatgacggtgttcagcaagctgctccttggatcgatgcatataaagtcctatgattgggctggtcctggtcctgatcctgccacgagcggcgctaattcgttgcctgacgatcgattgagactggcagagctggttgtggacgatgttttcacggcgccgtgcgacacatcggtcctgtacccaacagctggaggcaacatgcaccggttcaaggccattgcgtcatgcgcagtccttgacattcttggccctccttactccatagaagaagaccgggattgcacgtactacacagagattccatactcccaccaaccgagcagtgaccttgtcgataacgaacaagaacgccggcgtctcgcatggctgaaagagatcgacatgccgaaggagctgaagatgtgcagcgtagcttacggcggcccgccgatctccgacaggtgaacccccaagtcagccagctgatgtcagaactgccaacctttgtggatatatcagcaacacaatggagctcttagcctggatttcagtttgtacatgatgtcagtgatagcatgtcatgatgtaatgtgcgaatgttttgcttgctttgtttgtgcatgcaccgtcagtgtgggccttgtccagttcctttcttgatcttcggttaatacatactcatccatagatttcacttaattaggcttgcttgcataactgtattctgtttttccttgcaagattagaacaatgagaggccaattctgacacggtcttctcatcgagatttctctatatttcctacaacattttctcttggaacattctaggtataagaattgacatacttcctccctctgact

SEQ ID NO: 46 - DNA, 1169 bp, Brachypodium distachyon
cggccgtgtcggtgtgtgtctctctctgactctcccccacccccgccgcaaaaaccctagcctagccctaaacctcgctgaccgatcgccgccccaccgccgcggcgctcccggcgccgtctggttcgccccgcccccggccacaaggaggcgaggagcccccctcctcccaggacagccgccgccatgaacatggactccttcgagcgcctccaggccgacagcaagctccgcgatgcgctgaggcgaatccagtacgacgaggaggggaccgacgaggaggaggatgaggaggacgagaggggcgcggaggaggagctggcctgcccgttctgcgacgacgagtatgacagcgtcggccttgtcttgcacatcgacgacgaccacccgctggagagcaaggccgggagatgccctatatgctcagagagggttgggcttgacttggttgggcacatgactgtgcagcatcccactttcttcaagggcaggtcgagaaaccgacaagcttcatctggatcacattcttcttcaagatattctgaattgaaaaagaatgcggcgtacatacagtaccgttatggtggatcctctcgtgcttgctcgctcaacacagtgcctgatcctctactctcctccttcgtcagtagcttcattgatgatgatttgccaaaagaggtccaagaagtgttcttggatgatgttattgagaaaagtgattccttggagcctaaagcagcagaaagtgctgaggagcctttgctccctgaggtcaaggaggagagaactaggaggagccaatttgtgcagggactggtgctgtccctgatgtttgatgacatcttatgagcaatgtcttgttctgaaaattggttgaggaaggtagctcttgcttccatcgaagtgtcataccaagtgcaaagttgctgctgctcgtggatctgccatttaaaagggatggcagcattgttgtgggctgatgaggaaaatggatgttgtgaatatagatgctcctttagtacgccggccggtgtcgcatggacaataatataatatgtatagctttgttttatgggtaccagagatgttgtaagaaggggtcctgtgccccttgttgtatgtattattggtagactgccgaaatgaataatctatatcttcggacctca

SEQ ID NO: 47 - DNA, 1105 bp, Brachypodium distachyon
acggcagaggcagaccctctctgcgcttctacttcttcctcaagctcaagcagaacctcccctctctcttctcctctcccagactcccccacaaacccttcttccccgagcccaagcaagccgcgcgcaaccatgttcctcacaaggacggagtacgaccgcggcgtgaacaccttctccccggagggccggcttttccaggtggagtacgccatcgaggccatcaagttgggctctactgcaatagggctgaagacgaaggatggggttgttcttgctgtggagaaacgtgtgacctcgccattgctggagcctagcagtgttgagaaaatcatggaaattgatgagcatgtaggctgtgccatgagtggccttattgccgatgcgagaacattggttgagcatgctcgtgtggagacccaaaatcatagattctcatatggggagccaatgacagttgagtccacgacccaagctatttgtgatctagctcttcgttttggagaaggtgaagaagagtcaatgtcacggccttttggagtttctctcctcattgctggtcatgatgaaaatggtcccagcctgtactacactgacccatctggaaccttttggcagtgcaatgccaaggcaattggctcaggttctgaaggtgccgatagctccttacaggagcagtttaacaaggagttgactcttcaggaggctgaaaccatagctctatctatcttgaagcaggttatggaagaaaaggtgactccaaataatgtcgacatcgccaaggtcgcaccaaactaccacctctacacccctgcagaggtcgaggcagtcatcggacgattgtgaaacacagaaatctttatcttatgtcagcccggatacatatgttctgcttccgtacgttttacaccttgatggaggtccatgcctttcaattagcacaagcacaattgctgtatgatgttgacctctttttcattttgatgtggtgtggacaaggattataagatgatagtgtttgtggacttgtcacctgagatcgacaaccttctgtttgatacgcaggacttgcagcccaacatgcagtatttggccttttctgttt

SEQ ID NO: 48 - DNA, 1913 bp, Brachypodium distachyon
cctcgccgccgcgctcgtgtccccccggcgtttctcaccggcggggatccggatggcgctggagctgagcttagccttggcggcgccgccggggggtggactcttggccccaccccctcccgctccgccggggaaggagcagcaggtggcaggggtggggatcctgctgcagatctccatgctcgtgctctccttcgtgctcggccacgtcctacgccgccaccgcttctactacctccccgaggccagtgcatcgctcctcatcggactagttgttggtgggcttgctaatatttcaaatacagagaccaatactaggacatggttcaacttccatgaagaattcttcttcttgttcttactacctcctataatattccaatcaggattcagcttatccccaaaaccattctttgccaactttggggctattgtaacttttgccattcttgggacattcattgcttccattgtaacagggatgcttgtctatcttggtggtctgacatttctaatgtacaaacttccactggttgaatgccttatgtttggtgctcttatatccgcgactgatcctgtcacagtattatcaatattccaggaactgggcagcgatgttaacttatatgctctggtgtttggtgaatctgttttaaatgatgcgatggcaatttctctttacaggacaatgtcatcagtcagaagtaatgcagcaggcagtgaaagcatttttatgatggttctccagtttcttgagatctttgttggttccatgtcatcaggtgttggagttggatttatttctgctcttctatttaaatatgcgggattggatattgacaatcttcagaacttggagtgctgcctttttgttctcttcccatacttctcgtatatgttagctgaaggacttggcttgtcaggaattgtttctatattattcacgggaatggttatgaagcactatacgtactccaatctgtcagataactcacagcgttttgtttccgcattttttcacttgctgtcatctttggctgaaacatttgtcttcatttatatgggctttgatatagccatggaagagcatagctggtcacatgttggcttcatcttgttctcaattatatttataatcgttgcaagggcagcaaatgtcttctcttgtgcatacttggttaatatatcacggccagaacatcggcgtatacctctgaagcatcagaaagcactttgttttagtgggcttagaggggccatggcttttgcacttgctctccaatctgttcatgaacttcctgaaggacatggaaaggcgatattaacaactaccacagccattgttgttttgacggtacttcttattggagggtcaacaggcaccatgcttgaagctttggatgtagttggtgatgaaaatacatcaatagaaaattatgaggataacagtggttacattcccccaacttatgaggaaggtacatcgtctggaggaggattgagaatgaagctcaaggagttccacaaaagcacaacatcgttcaccgccctggacaagaattatctgactccattctttaccagtcagactgatgatgatactgatgattttggtgatcaaccccaaaacctaagacgaggattctatgatcaatagcagaatttgagctgtcagcttgacaagatatatactttgcgaacttcatggtatcatagcatgtggggtcaagactggaactaatcgtgtaaatatacaatttctcttagttgagtagagcatatggcaaagcatactgtagcatagaaatcataagcctgatcaggacagcatgcctcctgtatatatgtacggggctacaatggtacatggtggagttccacttgagaaggcaaagttttgttgcaaactttgt

SEQ ID NO: 49 - DNA, 995 bp, Brachypodium distachyon
cgcccacaccagatccacaagctaatcaccctaggctagcaagtaagtaagcacactcgaacgagaagatggtgaagcttgtgcaggacgaggagaaccagaggcagctcctggacggccacaaggagaagcacttcacgtccggcgaggtggtccgggacatcatcatcggcgtctccgacgggctcaccgtgcccttcgccctcgccgccggcctgtccggtgccaacgcgtcgtccgcgctcgtgctcaccgcagggctcgccgaggtcgccgccggcgccatctccatggggctcggagggtacctcgccgcgaagagcgacgccgaccactaccagcgggagttgcagcgcgaacaggaggagatcgacaccgtccccgacacagaggccgcggagatcggggacatcctttccgagtacgggctgggccccgaggagtacgggcccgtggtcacctccctccgcaacaacccaaaggcctggctcgagttcatgatgaagttcgagcttgggctggagaagccggacccgcggcgggcgctgacgagcgcggcgacgatcgcgctggcgtacgtcgtcggcgggctggtgccgctgctgccttacatgttcgtcccgtcggcggaccgcgccatggccacctccgtggtcgtcaccctcgccgcgctgctcttcttcggctacgtcaagggccgcttcaccgggaaccgccctttcctcagcgccctgcagaccgccgtcatcggcgcgctcgcctcctccgccgcctacggcatggccaaggcagtgcaggccatctgatctttctgatccagataccttaatttgcgccgtgccgtcaaaccaaacccaccgggcttgctaatgtaccgagaaaaataagtgcagctagggatctctctgtgcctgtctgtgtgtgtggaatagtcgattggtagctgtgcagactctagtgtgtactggtagcccaagtgtccgtgctgatgtacg

SEQ ID NO: 50 - DNA, 1660 bp, Brachypodium distachyon
acaccatctgggaagcgacacgcaggaaccacgccggagtttggcttctccggttgttcctctgcaaccagatcggatttaattagacctggactgttgccagcaatccatacttggagggattattggagcagcaggcacaaaatcttccacgttgtgtgaaaatgcagcatgacctgtaacaaagtataacacgaagcactgatctgctaccggtactctgaagttgttctatacattggagtgaacacttcaaggctggaagtaccaaattccgtcctggaggatttgctgggcatgcagatggcagatgatcctaaccaaaacttcagggcattttcgcagccgttctgcacccaggatgtggtttcatttcagacaagcgcgacaagcagcgggtcaggaggcatgccggtgtacctggactgttccagcggcatggacagcactatggcgatgatgagcagcaccacgccgtctgtggctgtttccaccagctcatcaagcatggctgctgattccgcaccgagcctgaaatacggaggacccttggccgcggattggtcgtaccttgagctcgaagtgctgaaagattgcctggacaagtatgtgaatgaacaaggcatcatgaagtatataaagatagcagctgcaataccaaccaagacagtgagagatgtcgcgatgagatgccaatggatagggaccaaacaaaatacaagacggcggaagcctgcagaacatcatattggcagaaaagtgaaagatagaaaggagaaaatggtagagccttcatcatggggtacaagtcatcctgttcagagggacacaagagtctcttcctttgtgtctagtgacattcaaaatagtctatttccatctgaagcctctgagatagatcgtgcagtgcaccatatactggaagaaaacaatcggcttctgagtcagattgaaacaaatattgtaacattccaggctcaaaacaacatcgacctcttccatcgcatcagaagtaacatcgatggtcttttacaaaccatgagccaaatgcctggaataatgagtaagatgcctcaattgccaatttcagtgaatgaaaatctggctagctacatgctccctggtcttacaatggcacaagttcttggaaacaggcatttcaaggaggagccaagaggatggtgaaccacagccaaacaggtcacagatgaggcagacactgaaacttcattggtagtctgacgaatcaatgaagaaaaagagaaaaaaaaactatttcagtataagcgccagattgggatgaataggatcaccaaggaaccttctttctctatcttgaagcaaaaggggaggtgactgagaaaccactctgctccaatgacaggtgcctgaactcatccattgcaccgcaacaagcctaaatatatattggtggctgaagagttgtggagcagtgatggtttcaggaaactgcagtttttctggtcttgctgcacctgcaaatattgattcttttggatttctcctccagagagtagagtaaatagaagaagatctagcacaggaagctaataataaggagtagctacgtagcaaaagaaaaaagaagccttcggttctccctgtatttgaatgtaatccagacgtctagttttttatc

SEQ ID NO: 51 - DNA, 2293 bp, Setaria italica
atcggcctcggcgtcgtcgcctctcacccacccacccgtccgccacccacctctttgccccctcgccgaatcggagaccacgtacactacccgcccgtccttccccgggcaagacgaagccgagagcagaggaagcacggaggatttttctgcgtcggcgaggaagcgaagcggaccggatcgcggcgccatgtcgctcgacgagctcgccgacaaggagcagtcatcgcccgaggaaattcagctggattccaagttcaggagcttcaacccagggccgattccgatcccagctgctccgaccatcagatcattggccgactcggtttctgatgagagagtggatgtcatggcctcacatcaaagtgaaaatggatccggatccatctctacggctagttctactgttagttcaatagaatcagagaaagcagcctatgaataccttgctcaaactcctatcaagtcgactgatgcacaccttgttgagttttcagaggctatgagaactgttgcaaaggccttacggcgagtagctgaaggcaaggctgctgctcaagcagaggcggcagagtggaaacgcaagtatgaattagagatggcgcacaagcaacagagtaaaatcaaaggctgtggcagttgtatcagtaatgacttagacaaactggccagtcaactaaccctggagacatcagcatctgatcaattaggatgctgtggaaagcatggtatatgttcacatgaggttctccaggacgaagttcctggacctatcccaagatctaatcacaagatggtagggagaaaggcatcatttaaactttcatggggatgtaatggagataaaaatggccagcataagcatgattttgtgtcctttgaaaaaggtgatataacaacagcagaacggagtaataagcagatcttactgaaatgggaatcaacaccacaaacagtgcttttcataaccaaacctaattccaactctgtgcatgttctttgtgcagaaatggtcagatggcttaaggaacataaaaatataaatgtctttgttgagccacgcgttagcaaggagcttctaactgaggattccaactataacttcatccaaacatgggataatgatgaggagatgaagctgctgcacacaaaggttgatctcattgtaactcttggcggtgatggaactgtactgtgggctgcatcattgttcaaaggaccagttcctccagttgttgcattctcccttggatcactcggcttcatgacacctttcccaagcgagcaataccgcgattgcttggacaatgttctgaatggaccatttagcatcacattgagaaaccgtctacagtgtcatgtaatccgagatgcagcaaaggatgaactcgtgaccgaggatccaatattagtgttaaacgaagttacaatcgaccgaggaatatcatcttaccttacctacttggaatgctactgtgacagttcttttgttacttgcgtacaaggagatggactaatcatatcaactacatctggaagcacagcatattcactagcagctggaggatccatggttcatccgcaggtcccagggatccttttcactccaatctgtccgcattccttgtcattcagacctttgatactgcctgaatacgtgactctgcgcgttcaagtgccttacaatagcaggggccatgcctgggcatcttttgacggcaaagatcgaaggcagttatcacccggcgacgctctgatatgcagcatttctccttggcctgtgccaacagcctgcgtgatggattcaacgaccgatttcctgcgcagcatccacgagggtctccactggaacctgaggaaatcccagtcgtccgacggcccgcgtgattgatgcaacgatttttcagttatatcagtccagtgccagaattctaagttggctaaggcactgatgggtttgttctcccagaacagaagcatttcctccatccaagtgctgctaacggcgagaggataattgtacctacgcgagtgtgttctcctttaccattacatacatactatagaaggttgcatacatgtagagggtatagtgcagaatccaaatgtaccacgagtgtgtagaggcacttgaacttgataacagcacatgtggcggatgatgccaataccatacactgatctggataaagtatgggggatggcaacaaaacgtagagtaagcgccaccaatgtatgtgtatatacatgtgatgtgcccccatgatggaaatgaaataatttgtgtgagcca

SEQ ID NO: 52 - DNA, 2062 bp, Setaria italica
cccggccggcaacgtcgagctcctggggtgagttcctggcggaatggaggtcttcggccccgtcacgccaggccaggtgtcattcttgctcggtgtgttccctgttctcattgcatggatttattcagaaatcttggaataccgaaaatcgtcatccattaaagttcatgctgattctaatttggaaaaggaaactgtcagagaagatgataaggcagttttgcttgaaggaggcctatcaaaatccccatctacaatgcttcggaacatgtctacgaaaacaaaaattatacgatttataacgatggaggagtcctttcttcttgaaaaccgtgccgtaatgagagcaatggctgaatttggcattgtgctggtttacttttatgtttgtgaccggacaaacacatttcctgaaagcaagaagagttacaaccgtgatctgtttctatttctgtacatccttctcatcatagcgtcagcattgacttcacttaagaaacacaatgaaaaatcagcattttcagggaaatccatactctaccttaaccgccatcaaactgaggaatggaaaggttggatgcaggtcttgtttttaatgtaccactatttcgctgccacagaaatctacaatgcaatccgcattttcattgctgcttatgtctggatgactgggtttggaaacttctcgtactattacattaaaaaagacttcagcctggcacgatttgctcagatgatgtggaggctcaattttttcgtggccttttgttgcatagtccttgataatgattacatgctgtattacatatgcccaatgcacacactttttacacttatggtatatggttgccttggtctgttcaacaaatacaacgagataccatctgtgatggctatgaagattgtgggttgcttcttagtggtgatcttgatatgggagattcctggtgtatttgagcttttgtggaggccttttacatttctgctgggatacaaagacccagaaccttcaaaagcgaacttaccccttttgcatgagtggcatttccgatccggtcttgatcgttatatttggattatcgggatgatctatgcttacttccatccaaatgttgaaaggtggatggaaaagcttgaagaatctgaaactaaggttaggttgtcaatcaagggaaccattgttaccacttctgtggtggctggttatttgtggtatgaatatatttacaagctagacaaacttacgtacaacaagtaccatccttacacatcgtggattcctataactgtttatattgctttacgtaattgcacccagcagctgaggagtgcctcattgactctttttgcctggctcggcaagattacactagagacctatatctctcagatccacatttggctcaggtctagcatgccaaatgggcaaccaaaatggcttttatctttcattccgggttatccgatgctcaactttatgcttgtcacagcaatataccttcttatatcttacagagtgtttgagctaacaaccatcttgaagtcagcttttattcccagtagagacaacaatcgtctatatcaaaattttgtagctgggatcatcatctccttatgtctatatttctgctcagttatacttctcaagattacagttgtataggaacatgatcttgatacaaggccatttctgtgaaatgttgtcttacctaggatgatcagtcgctgcctcatttccacgttgcagttggagagaaagaaagaggcttattaaggtatgtcgaatgcttatacgcctgagtgcagatgctccagattttttttttctgtttaccagttattgtacacaattaggcagtcggtgcattcctttgggagttgtaacagctggttggacttgcattcctacgtgtttacaaatgcacgagagatttatgttgcatcgaagtttttcttctcaaccatataatggtagattcgtttactgatgtaattttagaatagctatactccatcgtgtactacacaaatcaatacaaatgatacaatgttgttcttcctg

SEQ ID NO: 53 - DNA, 517 bp, Setaria italica
ggattaggaagccctgcgcatcactggcgaaaggggttgattcagagatgcgtttctctaaagaagatctggttgggtcagcgtttatggcttttggcgttactttgtttgtgggtttcttctacgctgctgttctgtccaagctgcttccaccgtatgaaaataggcttctagctgccgtccaaaatgattggtattactgcctacttgtgccgttgacacttcctgtcataatcgtggctgtctatctgcattggcttagcatgaagatgttcaaacatgcatgaagcaatatttctgtggattttatggaacaagtatgcagctttgttccaatttcagaaactctggagcacgatgaggatcaaggtagtttatctgaaagtgtcatgtcaagttgtaaactgtagtgttacacagtcccgagtttgtgtttgtcagctccaatgtgtaacttgattgtgcttcaatcagaaatacccattccttccatatgaacaattgccgccaagtgcta

SEQ ID NO: 54 - DNA, 1880 bp, Setaria italica
tggaaaaaaaaaggcatcagattgccacacgttgtggaatgtggatgctctgaactgatgcaggaggaagaagcacatccagaggccaaggccatcgagtggttcgtggacgagaagagcacggggttctctacttctcttatcattttggtgtgcctttcacctgagacacatggcaggcaaggcatggcggcagttggtcgccgttgcttcgctcctgtcagtcctgtggcttctcccatgggcttcggcgatccaccggagcgacttcccggtgtctttcctcttcggcaccgccacttcctcgtaccagatcgaaggcgcgtaccttgagggcaacaaaagtttaagcaactgggatgtgttcactcatgcaccagtttcaggaagaatcaaagatggaagcgccggggatatcgcggatgatcactaccaccgttacgatgaagatgttgagctcatgaattctctgggcgtaaacgcctacaggttctcgatatcatgggccagagttcttccagaagggaggttcggcagggtcaacccattaggcatcgagttctacaacaagctcatcgattcactcctgctcaaaggaatagagccgttcgtcacgctgaaccactacgacatcccgcaagagctcgaggacaggtacggcgcgtggctcagcgcggagatccagcgcgacttcggccacttcgccgatgtgtgcttcgcggcgttcggcgaccgcgtcaagtactggaccaccttcaacgagcccaacgtcgccgtgctgacggggtacatgctcggcacctacccgccggcgcggtgctcgccgccgttcggctcctgcgccggcggcgactccgacgccgagccctacgtcaccacccacaacgtcgtcctgtcccacgccaccgccgtcgagatttacaagaggaagtaccagagcaagcagaagggcttgatcggcatcgtgatgtacaccacctggtacgagccgctgacggacacgccggaggaccggctggcggctgaacgggcactggccttctcggttccatggtttgttgatccaatagtctacggcgactacccgccggagatgcggcaggtcctgggctcccggctgccgactttctcgccggaggagagaaggaagctgggttacaagctggacttcatcgggataaaccactacacgaccctgtacgccagggactgcatgttctcgtcaggctgtccgttggggcaggggacccagcatgcgctagcggccgtcaccggagaaaggaacggagtccccatcggaccaccgacagggaggccaatgttctacgtcgtgcctgacggcatcgagaagatggtcacctacatcatgaggagatacaacaatctgccaatgttcgtcaccgaaaatggctatccagatggtggagaagctggtcatgaccatgccaaagatttgcttcacgaccagggtaggatacagtaccttgatggctacctcaccaaagttgccaaagctataagggacggagctgatgttcgtggctacttcgtctggtctctcatggacaatttcgaatggctctatggatacaccctccggtacggactgtactacgttgactaccaaacactggaaagaaagcccaagtcatccgcgctgtggtacaaacggttcctccaaagttttcaacatgaagctcaataaagtgtgcgacggctggacatgctggctcttcgatttatgaaaagaagagcatgatctttgtgtagattaattattcctgaataaaatgccaccacagttgccaaataattattgtcacctcccgagaacaaaagtatactccatttccctctaatcttcagatagttgatgtttc

SEQ ID NO: 55 - DNA, 1532 bp, Setaria italica
ccctgtgtttgtgcttgtctcagtgacgtgaactcatcgtcgttcctctgttccagatgatctggccaagatcggcagcggcgagcagggttcatcggttcgtctccgaattcctaggcttggagaagagcatcatgcgagaggggcagggagagaccatcaagtacagggtgtttgctggtacgtggaacgtcggcggcgaggcgccaccggatgatcttgatctggagggttggctggacactaaggccgactcgtacgacatctatgtcctcgggttccaagagatcgtgcagctgaacgcgaggaacgtgcttgggccgaaacagagatcggcagccatgaagtggcagctgctcatcgaggacgcattgaacaacaggaggagcgcacaagacggaggaggagaagaagcaatggatcaagaacgggacgtgttcaggtgcgtcatgagcaagcagatggtcggcatcttcgtctcggtctggacgaggagcggcctccgccggcacgtccgccacgccggcgcctccaccgtcggcgccggcgtcctcggccggctcggcaacaagggcgcggtgtctgtccggttcttgctgcacgacacgagcttctgcttcgtctgctgccacctggcctccggcggcgaggtcggcgacgcgcttcgccggaacgccgacgcggcggacatcctatcgaggacgagcttcctcaacagctccggcggcgtgccggcgccggtggacctgcccaagaagattcttgaccatgaccgcgtggtgttgctcggcgacctcaactaccggatcgccatggacgacggcgaggcgcggcagctggtgcgggccaggaagtggagcatgctgctggagaacgacgagctgctgctcgagctctccgaaggccggcagttctacggctggcgcgagggcgtcgtcaccttcgccccgacctacaagtaccaccgcaactccgacaagttgtactggtgcgccgacaccggccatcgtcgtcagaggcagcaccgcgcgccggcatggtgcgatcggatcctttggcgcgggaaggggattaggcagattcggtatgagcgttgcggcggttaccgcctctccgatcatcggccggtgagggcaatgttccacgccgtgtgcgaggtggtggaaagcaagcatggttgagctgcaggcttctgtggtctgaaattattaacaaatgaggacgctgtaaatgttagagtgttcagtgttcacaacacagaaatttcacttgaaacagctcgattcctgcatccagctttaaagttgggccatcgaagaaactcctaaggcttcagcctgggacaaaggtcacgcaagtaggaaagatccatgtatattttctgttcttttcctgctgaacgagtggaatgctaggatcactgcccaactgattctctttcaaacgggatacagctttgtatggaccacttcaaggaatatttcctgtctttacgccagttttattaatggtttgaagatgtttctccgctc

SEQ ID NO: 56 - DNA, 1841 bp, Setaria italica
tcttcctcctccctccacttcgccacttcccaccaacaaaccacgtcgccgccgcccgccgcccatggcgaccccatcgcccggcgtcctccccctccgcgcgctcctcgtcgcgctccccttcctctccctcctcatcatcttccagctcctccaccgcccggctcccctgcccccgccgctccggacccacgcccacacccagcgccgcgccgaggcggaggaggaggtgtcggttaattccctatcatccacaacgtccccggcgtcgcggcatcgatcggagccggagccgacgtccctgcgccacgtggtgttcggcatcgcctcctcccgccgcacgctgccgctccggctccggctcctccacctctggctccgccccccggcgcgcgccttcctcttcctcgacgccgcgctccccgcgccgccggacctcccgagcggcgtcgcgctccgcgtctccgccgacgcgtcccgcttcccctacacgcacccgcggggcctcccctcggccgtccgcgtcgcgcgcatcgcgggggagctcgtctccgcgctcgaccgcgaagaggagggcctcagccgccgccgcccgccgccgcagtggctcgtgctcgccgacgacgacaccgccttcgtgctcccgaacctgctccgcgccctccgcaggtacgaccaccgcgagccctggtacctcggcgcgcgctccgagtccgcggcgcagaacgcctggcacggcttcgccatggcatacggcggcgccggcatcgccgtcagctggcccctcgcgcgccgcctcgcccgctccctcgactcctgcgtcctcaggtacccgcacctctacggcagcgacgccaggatctacgcctgcctcgccgagctcggcgtcgagctcacccacgagccaggcttccaccagatcgaccttcatggggatatttctggcctgctaagagcacatccactttctcctttagtttcactgcaccatcttgataatgtgtatcctctttaccctggtatggaccggacaagagcaatgaaacatttcttcagggctgctaatgctgatccagcgaggatcctgcaacaaacagtgtgttatgacagcaaaagatcccttacagtatcaatcgcatggggctattcagttcaggtgttcaaaggcaatattctgctccctgacctccttgctgtgcagaaaacatttgtgccatggaaaaggggtcgcaatgttacagatgtctatatgtttaacaccaaacatgttcccagagatgagtgcaaaagaggagctcttttctttctgaaaagcatttcttcgggggaaggcaagacacaaaccacttacaatagacagccaccgagaaaatgcttgcctgacttgataccattgaagaatctaagtctgataaaagtgacggctgaacaactgcaactgattcctgggaaggccttaaaacggcattgttgtgacattgtaccttcttcatctgataccaccatggatgttaacatcagaaaatgcaaagatgatgagttgatcgcgatgcattcatagtcattcttctgtcagatggacgctcatctattgcagaggtcatcatccaccccaatcgtgtcctgaaactgagccatgctctttgaagaatcatcatggatgaacactagatttattatagtatagacagagacagaaacagcaaagaaatacagatacatacagagtctagacagaggtaggaacgtaggataaattagcaatttagcatctctattccttcaaatagcagagttggggcatcagcatttgattgttccatagtctgacttgtaacatc

SEQ ID NO: 57 - DNA, 2134 bp, Setaria italica
aagatcgacgccagcaggactgttgcgtgttcagctgagtcagccactgggccacgcagatttaggatggctagcatcagccaccattgctgagcttcttctccagtaaaacattggatttttcacgccgccccaacctgtacttgatgatcaaaagatgtcatcaaactccagtctaaccgagtctctacatgagaaaacaattgtctttggcctcaaactttgggtcgtgattgggattgctgttggagcgtccctcttgggtattcttctcattcttctcatatgcctcaccattcagagttgtatcaagaggtcacgcaagccactcaatgaccgtccaacgatccagatacctcctgcatacaaagatatcaaggaagtggggacggtggatcagttttcagctaatgattttgttgtacatgatgggcttctactcactattcaaaatgagcctgagcctgttgagtccgtcaatagagatgcagttcagttggctcaggaggaaaagttgaaacaaagagaagagaacaatctttctggttcgttccgcattacagatggctgtgatgtaattcagattgtttcttctgaggaacagtcttcaacacatgctactgtcgactcagcgccattggcgggcttacctgaattttcttatcttggttggggccattggttcaccctcagagatctagagcttgcaaccaaccgttttgcaaaggataatgtgattggtgagggtggatacggtgttgtgtatcgtggcagattatcaaatggcaccccagttgctgtcaagaaaatccttaacaatttagggcaggctgagagagaattcagggtggaagttgaagcaattggccatgtccgtcacaagaatttggtccgccttttgggttactgcgttgagggtactcaaaggatgcttgtgtatgagtatgttaacaatgggaatcttgaaagttggctccatggggaattgtcccagtacagctctctcacatggttggctcgcatgaaaattcttttgggcactgcaaaggcccttgcttacttacatgaggcaatcgaaccaaaagttgtgcaccgtgacatcaaatccagcaatatcttgatcgacgatgagtttaatgctaaaatatcagactttggtttggccaagatgcttggtgctggtaaaagtcatattgctacacgagtcatgggtacctttggctatgttgcacctgagtatgctaacagtggacttctgaatgaaaagagtgatgtctatagctttggggttgttctgttggaagctattacaggtagagatccaattgactatgagcgtcctccaaatgaggtaaacctagttgactggcttaaaatgatggttgccaacagacgttctgaagaagtagtggatccaaacctagagagaagaccttcaacaaaggagctaaagcgtgcccttttgacagctctgagatgtattgatttgaatgctgagaagagacctagcatggaccaggtggtccggatgctggattctaacgaacccatacctcaagaggaaagaagacaccgacagaaccgaacccctgagacttcggaaactgagccattgaggggcaagaacaacagtggcaggagtgatgcccctgagcacgaagcaaggccacctcgacctaagagtcgaacattttcttccaaatgagacaaacaagaaaataaaacagaaggcatactaggagatacgatataggcaactggagtgcggcacacgaaacacacattgtgggaagcaggaaatttcgatacatgaccaattgatgaatttcattcttggctgcaatggttgataatacatttttgtgttccttgacacatgtacagtggtgtgtgatagttgaagggtgtatagtactagtagtttgtaaaaacttaaaatggtgaacacgttcctacaacaaaaaaagaaaaagaaaaaagaagataggcgtgtgtggtggccggtgacagtaactgttgtgtggttgctgatatgaactacaaagtgcgagaggagaccaatgtaaccttggatattgcttgtattgtatcatttactcgaagagtataaagagaagattgctattttgtgggc

SEQ ID NO: 58 - DNA, 1149 bp, Setaria italica
ttgctgcttcgtcgctcggtgaacaaaaagtaaacccacaccaagccgccgacctcgcccagccgagggagggaggaagaggaagaggaaggaggagctgccggagctggtctttgctcgggccagccacggcggcggcggcggcatggcggggcggatggtgcggagctgcgtgcagacgacgctcaagacggtgaactccgtcgtggggctcgccggcatggccgtcatcctctacgcgctctggatgctccgcgcgtggtacagggaggtcgcccaactcgaccaacgcctccccgccccctggttcatctacacatttcttggcatggggatctttctttgccttctgacttgctctgggcatattgctgcggaaactgcaaatggtcactgcctctcttgttacatgatcatcgtattcgtgcttattatactggaaggtgcgatcactgtggatgtatgtctgaataacaactgggaagaggatttcccccctgatccatcaggcaagtttgatgaattcaaggtatttgtgagatcaaattttgagatatgtgaatgggtaggcctctcagtggtggctgctcaggtgttatcaatcattcttgggatggtactcaggacccttgggcctgaccgagagactgactatgacagtgatgatgacaccactgtgcctgcaaggctgcctctcctaagaaaccagtcccaacatggtccagcagactatgctgaacccaacacatctcgtaggagtgattcatggaaactacggattttagacaaggtcaacaactaagattttactgatgtcatatggcgaacccttcaggaaagagttttgctccgagggtttcggaaggatgataagagtataccttttttttcttatggagagatgattctcatggtggagtagcagcagcagtggttagaatagttttgaatggctacttttgaatgcctttcaatatgcacagatatttgagtagcgactgacccttataaccccagccatgatggggaagaatgctgtaccgaatgtttcagaaaaagatgaaggcatgactggtgtcttcactgaccaaacacagaaatatttcatttgtttttcctttttttttatcagctgcatcctccatgtat

SEQ ID NO: 59 - DNA, 1360 bp, Setaria italica
ccggcatcaaacaaccacgcacccagtccaaccaaatcggccgccaggatgaagggcggcgacgtcagcagcattagcccgctggtctccttcgtcctcggcgctgccatggcaaccgtctgcgtcctcttcttcatgtccgcaagccccaccaggcgcctcgccgacatctccgccttctccaccggcaactccaccgcaagcacggacgacctccgcctcgcctcctccgccgacagcggggtggccgacggcgacggcgacgtcgtcagcgccacccccgcgccggcgccggctccggtcgaggcggcgtcgccgtggggcgacctggaggaagtgctgcggcgtgcggcgaccaaggaccggacggtgatcatgacgcagatcaacgcggcgtggacgcgcccgggctccctgctcgacctcttcttcgagagcttccgcaccggggagggcggcgtggcgcgcctgctggaccacctggtcatcgtcaccatggacccggccgcataccagggctgccaggcagtgcaccgccactgctacttcctccgcacctccaacggcgtcgactaccgatcagagaagatgttcatgagcaaggactacctcgagatgatgtggggaaggaaccggttccagcagaccgtgctcgagctcggatacaacttcctcttcacggacgtggacgtgatgtggttccgggaccctttccggcacatctcgatggcggcggacatcgccatctccagcgacgtgtacatgggcgacccctacagcctgcgcaacttccccaacggcggcttcctcttcgtgcggtcgtcggccaagaccctcgacttctaccgggcgtggcagcaggggcggtggcgcttcttcgggaagcacgagcaggacgtgttcaacctgatcaagcacgagcagtccgccaagctcgacctcgccatccagttcctcgacaccacctacatcagcggattctgccagctcagcaaggacctcaacaagatctgcacgctccacgccaactgctgcgtcgggctcggggccaagctccacgacctccggggcgtcctcgacgtctggaggaactacaccgctgggacaccagaggagcgccgcgccggaaagttccagtggaagctcccaggcatctgcatccactgatcatcagacgtcggtggcgaacttctggtggtagctttgtaggtccgatgatgatccattcgttcgatcgagatcggccggtgcacatgtgactggatgtgcacggcgaggccacttccagcgcatcattcaggtggctgcccgatcacacattgcttcttgtccattctttctctgctgcttcttggcgtaa

SEQ ID NO: 60 - DNA, 362 bp, Setaria italica
gggtctccctcatcctgagcattgccccttctgcaaccaggaggatgaaaccattcagcacctcctctgttcttgtgtcttctctcggcaattctggcttcaactacttcgcagttttggactcccggatattgcacctcaaccatcttccactgggttctttgactggtggcaacaagctggtagcacacttgacaaaggaaccaagagaggattcaattcactggtcatgctaggagcttggattctatggaaggaaaggaatgatattgtgtttaatggtgcctcgcccaggatggagcgggtgcttctccttgcacaggaagaagctgttctctggaggctggcaggcgccaaaggca

SEQ ID NO: 61 - DNA, 1778 bp, Zea mays
cattccacgctgcctcggccggcacctacctcccccacttcgccgccggcgggtggagtcgggccggagcagccgctagctcgcctctgttaccccaaaaaagacaaaaaaaaataaagagagagtaccaagcaagccgccggcagctcgggcagccatggggcacggcgtcagctgcgctcgcacgggcgacgagcacaactacttccgcgcggcgcaggtcggggacctcgacgccctggacgcgctcctcgccgccgacccctccctcgcccgccgcgccacgctctacgaccgcctctccgcgctgcacatcaccgccgcgaatggccacctcgaggtgatgtccatgatcttggatcacggggtgccgccggacgccgtgaaccggcacaagcagacgccgctgatgctcgcggcgatgcacggcaagatcgactgcgcgcggaagctcctggaggccggcgccaatatcctgatgttcgactccctgcacgggcggacctgcctgcaccacgcgtcctacttcggccacgtcgactgcctgcgggccatcctcgcggcggcgcggaccacgccggtggccgactcatggggtttcgcccggttcgtcaacgtcagggacgaccgcggcgccacgccgctgcacctcgccgccaggcagggccgctccgcctgcgtgcaggtgctgctggagaacggcgccattgtctccgccctcaccggctcctacgggttccccggcagcacgtcgctgcatctggccgctcgaagcgggaacctggactgcatccggaaactgctcgcctggggcgcggatcgtctccagagggactcagcagggaggattccttacgccgtggcgctgaagcgcaaccacgcggcgtgcgcggcgctgctgaacccgtcggcggcggagcccatggtgtggccttccccgctcaagttcatcagcgagctggacccggaggcgaaggctctcctggaagcggcactgatggacgccaatagggagagggaggagaagatcctcaagggcatcaccaagtattcgcagccatcgcctacttcgccttgcgagcacgatgccattgacgaagcgtccttggaggccagcgacggggagctgtgctgcatctgcttcgagcaggcgtgcagcatcgaggtgcaggactgcgggcaccagatgtgcgcggcgtgcacactggcgctgtgctgccacagcaagccgaacccggcgacgctgacgccgccgtcgccggcctgcccgttctgccgcggcagcatctcgaggctgctggtggcccgggcgagccccgacgccgatgacgacgacaaggccgccgccgcctcgtccccgcagctcgtccggcggcggtcgcacaacctcagatgggcggcggcgacggcgtggacaagcccgagcacgacctgtgatcggcatttgatgctgtgcgtggctgagcagacagcagagcacgaccattttaaaagctgaagcaggcattgccactggctttccaagatgagagacatcacatccaagcgtgattatctactggagtacttgtaatgcatcctcttcttctcccccatgtctggtctatttttgggcgtgctaggatggacctggccggcgcgatatggttgagctgagcttgagccaccgacatgtgtgtaaaactgtcggtcgagagaacacgcagagtggaaccggcgatgtgcactggacttgtgatctggactctgaaggaggcattgcatgttgtaggacagca

SEQ ID NO: 62 - DNA, 1176 bp, Zea mays
ggggcatgtatgacatcggtttttttttctaccgacgtccggagaatttcattagcaatcggtggccacagagagttaactaaaaataattcagcgacagatatcttcgactcctcgttcgtggttccccatcgtcatcgccatggatttctcttaggctcacccgtccgctcggctcgcttccttccccactctctctgatcccgtcgcacttccctcctcgctgcagcccctctactattgcgattaccgtttcctcgctgccctttcctttttcggtcggcagcaatcaccggggcaagcgaaccctcgatttgcgtccccgctctctgctagcgcccctaaaagaggagcgaagcgatgtctatgtcgaagacgggtcaggccgcggagaaggatgagcagcagcagtcccgagggatagcactgatgcagggcatctgcgccgtggtgtaccgcaaggccgataacacgccctgccccatcaagcagggtctctacttgggatctgttggagcagcattcaataaggacgctctcaagagtttgaacatcacccatatcttgatcgttgcaaagtcactggatccagtatttccagctgaatttaattacaagaagatcgaagtacttgatatcccagacactgatctgttaaagcattctgatgaatgctttggtttcatagatgaagctataagctctggaggcaatgttttggtccattgctttgctgggcggtcaaggagtgtgacaatcgttgttgcatatctcatgaagaagcatcaaatgagcctcgaaagtgccttgtcactagttagaagtaaacgacctcaagtggctcctaatggggggtttatttcccagctggagaagtttcagaaatccttgcaagtggagcaggaatggagaatgcaacctgtgcagcactgataattatactagtgttataataggtgcagaaggcctcatatgtagtgaaggcgtatgcgttgtaagagcgtcttgaccgcgtattatgacatctggataacaagcgaggccttggcaaactttatgatgtaaacagcaagcaacgttgttcatccattgggatgcagtttacatgttgaataatattcactgcaatttctcttcaaatgaaccaaagaggggtaatagttggtgctctctctc

SEQ ID NO: 63 - DNA, 669 bp, Zea mays
gccaaccgcgaagcactacactacactacaccacacccacccgacgacgatcacacacgcagaagatcgagttcgttcgatcgtgaccgtgacgcaggaagctataagctagccaagacaggaataataatggcggcgtcgacggtggcgagcctctctgtcccggtgacgacgacgaccttcgcggcggcgggcggcggcgacgtgctgatcgtcgtcccgaggagggcgggcgccaagcgcgtcgtctggttccccgcggcggcgcgccgcggcggcgggcggttggtcgccgtgcggtccagcgggccggccacgccgccggagatctccgacaaggtgtcggagagcatcaagcaggcggaggagacgtgcgcggacgaccagaagggcgacgccgagtgcgcggcggcgtgggacgaggtggaggagctcagcgccacggccagccacgcccgcgacagcctcaaggagaccaacgccaacgacccgctcgagaagtactgcaaggacaacccggactccgaggagtgccgcatctacgacaactagctagtcgtatagctatataggccatcgacatgaaggacgaaggttgtagcacactacgaaagaatgatactctcgatcggcgcgtcatacgtggaatgaacttgtttgtatcaagct

SEQ ID NO: 64 - DNA, 823 bp, Zea mays
gaggaggcggccggttcggtgctgagtgctgagttgttgaccaacgggaagtccagtacccaagcggagccaccaaggaaaggaggaatggaagccaccggcgcagcctcgcagccctcggcgccgcagacaactcacccggcggtggcgccgctggccttcctactggggaagtggcgcggggaaggcgagggcagcttccccaccatatcctccttccggtacggcgaggagctcctcttctcgcatcatccctccaagccagtgatctcgtacacgcagaagacgtggaagacggcgtctggcgagccgatgcacgccgagagcgggtactggcggccccgccctgacggctccgtcgacgtggtcatcgctcagagcactggcctcgccgaggtccagaagggttcatttgatgctgaaaagaaaacagtgacactccaaagcgaactcgtagggaatgcatcaaaggtgaagcagatcacgagaacttttcaggtggcagatggggagctctcgtacgtcgttcagatggcaacgatcacaactagcctacagccacatctcaaggcccttcttaggaggatttgaagttgaccggcaaaatctcctacaacgacgtcgctgcggctaaccacaaccgagggacacctgtaatacagagcatacttctggtgattactacgtagttattagtgaatgaacttacaggttaaataaagctcattttcaaaaacagaggttccgctgataggaactaccgtatatgtaaacggcttaccattcagcccatgctccacaaatcgagattattattttttca

SEQ ID NO: 65 - DNA, 2400 bp, Zea mays
ccaggacgccattgctcaccttttccgtccagcgcaaggaaaccgcgcgccagagaggccgcttcaggcgcgcgtggaatcgccccgtggccggcggggatgtccggattcgtcggggtcgtcgtgtccgacccttcgctgcaggggcagttcacgcaggtcgagctccgatcgctcaaggccaagttcgtgtctctgaagagagattccggccatgtcaccactaagaacctgccggggctgatgaagaagctgagggggctcaatgaggtggtctccgaggaggagatcgcggccttcctgtcggagtcgtaccctgatagcgatcacgagattgaattcgaatccttcctccgggagtatcttaatctgcaggctcaggtgagtgccaaggaaggtggtgccggcggtggcaggggtggcaagccgtcgtttctcaagtccagcatcactacgctgctgcacaatctcaaccaggcagagaaatcttcgtatgtcgcacacatcaatacttacctccgtgaagacccattcctgaagaagtacttgcccatcgaaccgtctggaaatcagctgttcgatctcatccgggatggggttctgctctgcaaactgatcaatgtagctgtacctgggaccattgatgagagagcgataaataagaaaagagttcttaacccatgggagagaaacgaaaaccacacactctgcctcaattctgccaaggccattggatgtactgttgtcaacattggcacacaggatttggtggagggaaggcctcatttagttcttggattgatatcacaaatcataaagattcaacttttagctgatctgaatctcaagaagacaccgcagctggtggagctatttgatgacagcaaggatatagatgaggttttgagcttgtcaccagaaaagatgctacttcggtggatgaaccatcatctgaaaaaagctggctacaagaaaactgttaacaatttctcttcagatgtcaaggatggtgaagcctatgcttaccttttgaaagctcttgctccagagcattcccctgaaactacattggacaccaaggatccgaacgaaagggcaaaactagtacttgaacaagcagagaagttggactgtaagagatacttgaccccaaaggatatcactgagggatctgccaatctaaatcttgcatttgttgcacaaatattccagcacaggaatggtctgaccagtgacaccaaacaagttaccctcacacagacagcaacacatgatgatgttctattatctagagaagaaagagcctttcgaatgtggatcaacagccttggggttgaatcatatgtgaacaatgtcttcgaagatgttcgcaacggatgggtacttcttgaagtgcttgacaaggtgtctcatggatctgtcaattggaagctggcatcaaaacctccaattaaattgccatttagaaaactggagaattgcaaccaagttgtaaaaattgggaagcagttaaagttttctttagtaaatctagctggaaacgatattgttcagggaaacaagaaattgattgttgcacttctgtggcaattgatgagattcaatatcctccagctgttaaacaaactgagattccactcccaagggtccgaaggaaaagaaatttctgatgccgatattctaaactgggccaactgcaaagtgaaggcatccggaagaacatctcgtatagaaagtttcaaggacaagagcttatcgaatggaatgttcttccttgatcttcttagcacagtacagccaagggttgtgaactggaaagttgttactaaaggggaaactgatgaggacaagaagctgaatgctacctacatcattagtgttgcaaggaagattggatgctctgtgtttctgttgccagaggacatcattgaggtgaatcagaagatgatcctaacacttactgctagcattatgtattggagcctacagaaacagccccagtcacagtctgaattgacagaacaatcagaaccatctagcatgacttctgacgcagcctctgaagttgcctcggaggatggtgcttcaacgacagcaccgtccgagtcagaagaggtgaactcgctgtctgatagcatatcgaatttgacaacggatgatgctacttcaaacgccccatctgctgaaaacggaaatggtgtggcagggtcctgatggttatgattatgcaaaccctgttctttttttccccatacagtgctgttacaggaaatagtgctttcatgatgcccaaagttgtcgctaccagaagcgatatttttaatacttctgcttcctgagcatggtagcttgatagatacaacagtcacagatagatatagatgccttttgttcattgga

SEQ ID NO: 66 - DNA, 864 bp, Zea mays
ggcctgttctccagtccccccggcggcggcgtgctctctcgcgtgcacccggcacactccctcgtttctgccgtgctcgtcgcgtgcactcccgtctgtctctgtgggggtcggcgacgattggcagcctccatacgccaggtgcccaaatctctaccttcggtaccttcgccggcgacgagcatcaccaggtttcctgttgatcatggcacagcgtgtgatgtgcttgcttcggcgctccatagggtttacagtgccaccagcacagagagccctgagtacaactgccacaccagcagcggagggtgcagcggtggccgaggcgacggcgaaggaggcaaagaagaggaagaagaaaaatctgttcgacgtggtgcagttcctgccagggtggggcgtcggatacaaggtcgccaagacgacctggcgcgatgtctcctaccagatcaccaagatcaacctgtacaaggatggtcggcatggaaaggcatgggggtttcggtacaaggcaggtgtgcaagctgcagacgccccaactaggatcagcggggttaacaagcgtgggtggaagtacataaaagaatcacagaagaaactacacgatgcccccaaagtagacgtagcgattgctggctagttgcatgttgtaagatgattcttggttccttcattagctaaatctttagatggctgttgccagatgaacagagatgagagatccacttttggatcgagacaatggttccatccattttgcttgtgtggactgaacctccatgcaatatgtccctttcttttatttctggaacctttaccataatgtactaatacaaaagaactgtgttgatggtggcaatctagtta

SEQ ID NO: 67 - DNA, 2810 bp, Zea mays
acgaggagggagcccttgaaggcaaaccaatgcgcaccgccgcttattcattaaccaaagacttgcatccaaccaatcccaccacttgtgtctacctcttcgagtcaggctgatgggaggtgcctgtcagcaactctccgtggacggagatgcgaggacgcctgcgaatgaccgcgatccggccggcctgctccagcatgatgatacggaaaaccagcagcagcagcaggcctgctgggagcgcttcctcctcaaggagactctcaacgtcttgcttgtggagagtgatgattcaaccaggcaggtcgtcagtgccctgcttcgttgctgcatgtaccaagttatctctgccgaaaatggccagcaagcatgggcttatcttgaagataagagaaacaacatagatcttgttttgactgaggtttttatgcccggtgtatctggtatttctctgctgagtagaatcatgagccacaatatttgcaagaacattccagtgattatgatgtcttcgagtgatgctatgagtacagtctttaaatgtttgtcaaaaggtgctgttgactttttagtcaagcctatacgtaagaatgaacttaagaacctttggcagcatgtgtggagacaacggtgtcacagtggtagtggaagtgaaagtggcattcagacgcagaagtgtaccaagtcaaaaggtgccaatgaatccggtaacaacagtggtagcaacgacgatgaagctggcatgggacttaatgcaagggatgacagtgataatggcagtggcactcaagcacagaactcatggactaagcttgctgtggagatcgacagtccacaagctatgtctctggaccagttagccgatccagccaatagcacctgtgcacaagtaatccactcaaagtcagagatatgtagccacagatggctaccaggtagcagcaacagaaactgcaagaagcaaaaatacactaatgatgactttaagggaaaagacttggagatagatggtcctggaaatctatatatggatcaccaatcttccccaaatgagagacccatcaaagcagcagatcatgaaaacaattccaaggagtcaatgatgggaaatttaggggatgcaactgttcgagctgctgacctaattggttcaatggccaaaaacatggatgcccaacaggcagcaagagctgcagatacccctaatttctcttctgaagtgccagaagggaaaggtaagaatgatgactttaagggaaaggacttggagataggtggccctagaaatttatatatggatcaccaatcttccccaaatgagagacccatcaaagcagcagatcatgaaaacaactccaaggagtcaatgatagaaaatttagaggagccaactgttcgagctgctgacctaattggttcaatggccaaaaacatggatacccaacaggcagcaagagctgcagaagatacccctaatttctcttccaaagtgccagaagggaaagatggtgccaacgatacagtcaatgacgatgaacagcggaatagtgcattaaggcgatcgaatctctcggcttttacaaggtaccatacatctgcggcttccaatcaaggtgggacaggattggtaggtagctgttcgccgcatgataacagctcggaggctgtgaaaacggattctacttacaacatgaagtcaaattcagatgctgccgcaataaaacaaggctccaacggcagtagcaataacaatgacatgggttccactacaaaggatgttgtgacaaaacccagcacaaataacgagagggtgatgttgccctctgctattaaggctaatggatacacgtcaacattccatcctgtgcagcagtggatggttccagataatgcgacagcagggaaagcgaaggctgatgaagtggccaacaatgcaggcagaaatagtcatcctggtgacgtgcagagcaacctgacgcaacaacatcgtccaacccttcattacgtccattttgagaatagtggatcaggtgccctgcaatgtggttcctccaatgtatttgatcccccacttgaaggccaggctaccaataactatggtgtgaaagccgggagcaactcaggcagcaacaaggggcagaataatgggagtacagctggtgcgagcacggctgctgcaaatgctggacggacagatacagagatacgggctatcgataaaagtggacctggaggtggcagtgggagtggcaatgacacatatgtcagacggcttgctgcgagcatgacaccacgacaagaacagctaaagaaatatagagagaaaaagaaagatcggaactttgggaaaaaggtgcggtaccagagcagaaagaggctagccgaccagcggccaagggttcgtggacagttcgtgaagcaagctgtgcaaaatcaagagggagatggagagagatgacccccccccccctctggcttcagctcatggttgttagacgtggcggttgatgattcttccttctctggtgtgatctgatatgatcgacaacacaccatccttccttttcttcattggtttcttcacatctagaatttactgcctgaccgggaaaaaataagctaggaacttctatacatgtgtatgcatttctaatcatgtagaagaataagtgtgtcttgactctagataattttaggtagagtcatgctcgctctcctacattatgtgatgtaactgaagtgttgttgtgttgtcatgtatggtcttggatcactttctgtcaatatattactagcccacaactactatt

SEQ ID NO: 68 - DNA, 686 bp, Zea mays
agtcaagtacggctgcaagcaaagcgaagcacaccaaagcgagcatcaagcagcgcctcgcacgctaatcccttcctttcctctgctggccgcccttaacagcactcggtcctcgctctccctgcggcggcctttttcacactctgcacctcctcccctccggccagtcgaaaccgtcgccgccgccgccgggaggagaagagctccatggactacaggcagtcctactgcatgaccctgaggatgaacatcgactgcaacgggtgctaccagaggatcaggagggcgctcctccagatgcgagagctggagaaacacctgatcgacaagaagcacggccgggtcgtagtgtggggcgccttcagcccgcaggacgtggccatcaagatcaggaagcggaccaaccgccgcgtcgagatcctcgacctcagcgaggcctcgccggcagccccagaaggcggccccgacggccacatgtcctgaaggaaccacgtcaccaatacgtactctggagaactgcttgctattctcttcactcttcaccaaggcaggcccgcctcagaggacgtaaccatatgcctgcctggcatcttttaccttcttgtaatttaggaatcctgcatcattttgttctgtaactgtgaaggcttgttgaagtaaccagaaaaaaaatctaggtaccgttc

SEQ ID NO: 69 - DNA, 1750 bp, Zea mays
tcagcgttccactcgcgtagaagtaacagcgctcgcagctcggtccgggtacgtcgccaatgccgttgcgtggcggattcactctctctctccccccggccccctcctccgcccatccaaccaccatataacaacctagtagccgccaacgccacaccaccagtagtcctactggtccttgacgtccgtggccactcaggttgtgttctctgagttctttcgccggggccggggcggaagcggagtgcgcggtcgaggaaggcctaggccttagcggtcggatcgatcggcgccgtgcttgactgcctgtacatgaggagcggctgcggcggcggcggagggagacaacctggggaaggaggcgggggaggcgctggggctgctgggctgcgtcaatgaggtggtggcggcggtggcagccacgtgggggcccatgaccgacggcgcgcgcgtcgagacggcgcccaggctcgcccaatggcgcgtcgacccgctcccctgctacacctaccgcaagtcactccccttcctcatcggcctctggaactggtgcatatctgtggagagaaataacaagcaaacctgtgttaagctctttgcagagaatacaagttctctcaagaacggttcctcagccccaatagcttcctttatcgccaaacttattgtatctcttccacctaatcagcagaccatagtccacccaggaatttttgacaaacagctgaaatacgacggttttgtgtggacaatcgatagcaccgtcactgggaggtttgtgattgagatagagtttcttgacctgaaggtcgctgatccgtctggcggggagccggcctcgatttgggcctcccgccaggtcaagcagtgctcggacagcacggccctgtcgtccctggctcggatgctgcacgaggacgtcctcaccgacatcaccatcaacgcggcggacggcagcgtgggcgcgcaccgcgcggtcctggcgacgcggtcgccggtgttccggagcatgttctcgcacgacctgagggagaaggagctctccaccgtggacatcaccgacatgtccctggacgcgtgccgcgccttcctcagctacatctacggcgacgtgcgcggcggcgaggagttcctggcgaaccggctggcgctcctccgcgccgccgacaagtacgacatcggcgacctcagggaggcctgccacgagagcctgctggaagacatcgacgcgcgcaacgtgctggagcggctgcagacggcgcacctgtaccggctgccgaggctcaagggcggctgcctgaggttccttgtggacttcaggaaggtgtacgagatgcacgacgacgacctcaacgcgttcctgcagacggccgacagggaactcgtggccgaggtgttccatggcgttcttgccgcgtggagcgggcggtaagccgggcgcatgccatggcactgccgctctgctgcaggtgttgcacatctggttggttcagttcgtcacaactcagaagcgttgtttgcaactggaggattcttgctgggaaagcgtgtaaatatttgcaaactgtacatgcgtgccagtggttggtctaaaatttactgtgcatgccttgattggattttgttcctatgatgtggaaatcagctcatatgctgctcatattcacgttttgaggaatttcagacttgatcttcaggtttacacatggcatggcaacagagagaggcaatgctcaataatctcattgta

SEQ ID NO: 70 - DNA, 2059 bp, Zea mays
ggcgagcagcttcccgtctccccgtctcatcccatgtcatgactcagcaccacctcccccatcctcctctgtcctcgtataaagcgccgcagtccacgacggcgacgccgcccatgggagctggagcaccagcacacgccgctgccccggctctgcgccgcgaaccctagccgaccgcctcatggccgccgagtcctgcggcagccgcggcgcctcgcccccgccgcctccctccgctggcggcgcggccgggaggcgccgcaaggcggaggcctacgccgaggtgctccgccgcatccgcgctggcgccggcggctacggtgctgcccgccccgggttggaggacgagctctgggcccacttccaaggcctacccgccagatatgctttggatgtcaatgtagaacgggttgaagatgtcttactgcacaagaaattgctggagcaagcccataaacccatgaatggtctggtctttgatgttcgtcctgcacagggttttactctggaggaaagcactggatttgagtccacaacttcctttaagcaagaagaacaagatccccagtcctcagtattcacatcaagagatcaaaggcctttgcatgaagttatatttgcatgtgacgataagccaaagcttcttagtcagttaacctctctcctcggggagcttggtcttaatatccaagaagcacatgcatattcgacgagtgatggctattccttggacatctttgttgttgatggctgggagtatgaggctgacattctccaaagtgcattgagggaaggcgttgataaaataaagtacagagcatggccgttggtaccgtcgatgtctgctaggatggatcaccaaccattggaggtttctccttcatctgactttgtccagataccagctgatgcagttgatgtttgggaagtcgatctcaggcttctcaaatttgaacaaaaattagcgtctggatcatttggtgatctataccatgggacgtactgtagtcaagatgtagctatcaaagtactcaagcctgagcgggttagcgttgatatgctacgtgagtttgcacaggaagtttatataatgaaaaaggttcgtcacaaaaatgttgtgcaatttattggtgcatgcacgagacctcctgttttgtgtattattacagaattcatgcatggaggcagtatttttgacttcctttacaatagacgaggaaattttcaactcccggatgtgattagaattgcatctgatgtgtccaagggaatgaattacttgcatcagattaatattgttcatagggatttgaagactgcaaatcttcttatggatgatcaggttgtcaaggttgcagactttggggttgcaagggttaaagaccagtcaggagttatgactgcagaaacaggaacctacagatggatggcccctgaggtcattgagcatttgccgtatgatcatagagcagatgttttcagttttgggatagttctttgggagctgctgaccggaaagcttccatatgaagacatgacacctcttcaggcagcagttgctgttgttcaaaaggatctgaggcctactattgctgttgatactcatcctatgctcgctgagctactccagagatgctggcagaaagatcctgctctaagaccaacatttgcagagattgtggatatattgaactctataaaggaggcggttcggagttctgtgcatcacaaaaggcattcatgtcgatctcactccgggagaagacgaggctgttgatgtgccagttttatgtggtgccgcacgcccttttcattttatttttgtagtcgagcgataacttcagaatacggccagaagagcttactgtgttcattccgagaggttttggtaactttattttttttaatttggacttatgcttcaaggattttcatcgttaaaaagcttagaggtgcatatccacgtttacatttggcatgtatctgtatctcgtactcgttttcttaagtttggcaggcaaccaagattttaatgaaaatctttaaccattactcactc

SEQ ID NO: 71 - DNA, 650 bp, Zea mays
caaatcggcggcgaatccccaaccctagcagcagtgggcggccggaccgggacgggcggtagacggctccagcacgcaacgctgacaggtttggccgtgcgaggcgcgagggctagacaggtgtcgcggcgccaggcatccagttccagggctgcgtgggctcgaccagagcgagtctgcaatccgcccgtccttgtccccgtcggcggccgttcaccagtgtcaggtgcggaggtgacaacatttctgaaagaagtaagcaagcactagttatatggtgagtcatgtcaaaggcacgtaatgctgtagttgccactggattgctgctcttcgctggtgctggcttatcatttccgttccttttcgtgaaatcaaagaacaagcctattattgattcgacaaaacctctgccaccacaggctacttttcgaggaccatacgtgaatacgggttcacgtgatatcggacctgatcctaccaactatcccaagaagtgatttgaatcttccatgacatttcggagtcccatttcactcgactccactgctgtgaaattgttcgttttggggccatcttactgtgcacgtgccttgatattgcaaaaaaataaaataaataacaatacctaaataaagggtggttattgaagc

SEQ ID NO: 72 - DNA, 1157 bp, Zea mays
gccacagagagaaacgttgagacagggagagagagagagagagcgagctccacgcctccacgctccactacaccagccaggcagcagcccccaacgactggctcgccgctcgcgagaacccgagtctatttctgcacgcgcttccaggttttagctgcagcggcatcagggcagggagagagcgatagttctgttctactgcaggaagagcagggagcaagatggggtccggatctttcctcaaggtgctggccaataacttcgatgtccttgccgggccactcatatcacttgcttatcctctatatgcttctgttagagctatagagacaaaaaatcctgtagatgatcagcagtggctcacttactgggtgttgtactcatttatcactttgtttgagctaacttttgctccaattatcgagtggcttccattttggtcgtatgcaaagctgttctttaactgctggttggtcttgccttggttcaatggtgctgcctatgtttacgaccattttgtgcggccaatgtttgtgaaccgccaaatagtgaacatatggtatattccaagaaatgagaagctaggtaaatctgatgatgttctgtcagctgcagagagatatattgaacaaaacggaccagaagcatttgagaagctcatcagcaagtctacgaagtcttcgaagtcaaggaacacaaagcggttgaacttggaggatggagaggctgaaaatcgagctaaagccgagagagaatcgtggggcgaaaatcccttctacgacaaaaactacagatactaaaccagttcaaaatccactcagcagtttgaagatgaccttgctcacgagcctcatgcaagctttagttgcgtcggaccgaagacgacattcccatatttctgactctgaatattgtaccttgttacatccactgctactacataatgatgagttctagagcaattgtggactgtgtaaatggaggtagatgctagcgttaatcgtttatgtgctttttggatggtgtccttatcacccgttttactacatctttagcaaggagcgagccttgattttcagtttggctttcgtatttttgtaattgaatgctacttttagataactgaaatatgagggagttcgagcttctatgaagaa

SEQ ID NO: 73 - DNA, 1727 bp, Zea mays
caagccaccaccaagtcaccaacccgagtccgatgtatacgcgcggcaacaataatatcctttcctttcttttgtataaaaaacacccgcctccgtctccatctccggtgagcaggaagagggggagggaggaggccaagagcgcagcggcgaagccatagccaagctcacccgatccagtccctgccgctcccagcgtgccacagccagtcccgcgctagctcagctcagctcagattcacgagctcgtctcccagatccagcttcgtctggttgaattctcttctttggaagtgctggtgggcggcgtggtttggtgctttgggggcctgcgtgttaagtttctgcgttctccgggctatctgcctgtcttgctgcggcctgcggcggcggggtggagatgggggtggccggggagaagttccagctggggacggtgggggcgctcagcctctcggtggtgtcctccgtctccatcgtcatctgcaacaaggctctcatgagctccctccgcttcaactttgccaccactttgacaagctggcatcttctggtcaccttctgctctctccatgtagcattatgtatgaaactctttgagcacaaacctttcgatgcaaggaccgtcatgggattcggagtgctcaatggcatatctattggacttctaaacttgagtttgggtttcaattctgttggtttctatcagatgacaaagctggctattattccctgtactgttatactggagacccttttcttcaggaagaaatttagtcggaacatcaagctttcccttagtgtgctccttcttggtgttggtgttgcaactataactgatctgcaactcaaccttgtgggatctgtattgtccctactggcaatcatcacaacctgcattgctcagatcatgacaaatacaatacagaagaagttcaaggtatcttcgacacagctcctgtaccaatcgtgcccataccaagcattgactttgttcctcgtcggcccattccttgatgggtttttgactaaccaaaacgtctttgctttcgactacacaactcaagtcctgttcttcatcgtgctgtcgtgcctgatctcggtctcggtaaacttcagcactttccttgtgatcgggaagacgtcgcctgtaacctaccaagttctcggccacctgaaaacgtgcttggtcctcgccttcggctacgtcctgctccacgacccgtttagctggagaaacatacttggaatcctgatcgcggtgatcgggatggtcctgtactcgtacttctgcactagagagactcagcagaagccggcagaggcctccccgcaagccatcctgcaggcaaaggagggtgaatcgaaccctctgatcttggattccctgagcgccgccgaaaacgggggcagtgccaccgacgacgagcctctgaaggtgccaatgtggagctcgaagtactccaaggcgtgaaaggctgttctgttactggtgtactacggtgttatacagaattcagcttggtaggcagatactactactagggttggaaggcaatcctgttcctgttcctgttccatttttggccttctattttttttcttgttttcatcctttctggcatatactacaaatatatgtgttgctgttagtaaatggatctcactctttggaggatgatacctcagctcgagacgagtgatctgtctgaaagctatttccttgt

SEQ ID NO: 74 - DNA, 939 bp, Zea mays
catcgctgtcctctcgctacacacacccagccatcctctctcgcacacagacactcgttcgccgtctcagccacagccagagcaccgacactcaggccaggccgatcaatgggcaagaagagcggccgcagcggcgccgacgcgcccaaggcgacggcgttcgtgctgaaggtggcgatgcactgccgctgcgacggctgcgtccccaagatccgcgccgcggtcaacaaactgacgctccggtgcgagggcatccagtcgctggaccagtcggcgctggacaccaagggcgaactggcgctggtggccacggcggacccggagaggctgcgccgccgcctgcgcgaggccacggggaagagcgtcgacatcgtcttccccaagcccgcagcggccaacggcggcagcagcggcagggaggaggcgaacgccgccgtccaggctcaggctcaggcccaggcccaggcgctgctgctcgccgccggtctgcaacagcagcagcagcacggccgtccctggtacgcgctccagcagggtgggtacggcccgccgccagagccgtacgtggcttcctaccccgccaccgcgtggggcgcgtacccacacaacggcctcgatgacgcctacggcggcggatggttcgggtactgagcgaccggcggagagtagagcagcggatggagcttttgaggttcgggtactgagcgaccggcggagagcagagcagcggatggagcttttgcgttgtgtagtgtgtcagtggtgatgtccgcacgtgtagtactgtagtgatctgggattagcaggaactgagcaaatattggttggttgtgtgtttgttggacgacgaagtgtttctgttaaaaaaggtcttgatgccttaactttaattcagcttctatctttaaaataatttattagaattgtcccaagagaaaa

SEQ ID NO: 75 - DNA, 1262 bp, Zea mays
gttcggctgtgggccagtggctgtcgccactcgctacctcacgcgcttccgctacctctcgttgtgtctcgtcctctctctcttctattccattcccaacttggctgcccaacccttgcgtcggtagacggcggccgcggcgaggatagagggttccctgaggaggcagtgatggagaccatggctaagtacaaccgaagcaacccggcagtgaagcggatcctgcaggaggttaaggagatgcagtccaacccctcacccgacttcatggccctccccctcgaggaagacatcttcgagtggcaatttgctatccttggcccgagagacagcgagtttgagggtggaatctatcatggcaggatccagcttccctcggattatccattcaagccgccgtccttcatgctactcacgccaagtggacgctttgagattcagaagaagatttgtttgagcatatccaattatcaccctgagcactggcagccatcatggagtgtgcgcacagcgttggtggccttgattgcattcatgccaaccaaccctggtggggcattgggctcattggattacaaaaaggaagatagacgggcacttggtataaaatcacgtgaagcaccgccaaaatttgggtccccagaacgacaaaaactaattgatgagatccatgagcaaatgctcagtaaggctcctcctgtcccccaaacgctaccaaatgtgccaaacgaggagtctaacgaattacccgcatctgacccttctggcgagcatgcagacaaggtagatgaaggtgacaacacatctggttctgtatcagactcgtctagtggccttcctgtgcctgaatctgaatcgggggttacagaaaacactggtgaaacctcagcagttgaggttgccaaccatcatgtgcctgaagcaagccacagagagaacattccaagagttagttcgtctcaccagaatcctgctgttgcgatccagaagccaaagcatgacaggctgttgaccttggccgcatttgggctgactcttgctattatggcacttgtgatcaagaaattcttaaaaatcaatggcttgggcggtttcattgagggcaagttctgagtagggattgtgcataagttggatgtaagagatgactcattcctcatactaatatgctataagctatataaccccgtaagatttgtaaatgactgtttagttattatagatgaaatcaaaatggtgcggtactattaataccccattgt

SEQ ID NO: 76 - DNA, 1311 bp, Zea mays
gagaactccactcaagaaaaaattgcacgcaagggtccacgcggcgaacagatcgtgccgttccgcggcggcgtcggtgcggcgctggagccgaagtgaaaagtcgatcgggattgggccgttgggggtgcgatacccctcgcctcgaatgcgagctccgtaggtccgcccccccggcggatggccgagctgggccgccgccgccgcccgctgggatgaggcagcgtgaggagtcgcgctcgcggcttccctgcccccaggcctccgctctgaatatccccgacgcgacggtaaccgaacaagcctcagttagaaaggctaagatcagagcatctccgtgtctccacaacacatcctggattcgcaattattgaggtgcctccactataaaaggccaaccatcctcaaggaatgaacacagccagccagcaagcaagcagagaacaaggataacacagcaactgaaaaccttattaccaagaacaaacaactacaagaggctttgcaagttcacagaggcagctgttcactgcgaatgaacaaccagaggaagcctggagactggaactgcaagaactgccagcatctcaacttcagccgccgtgactactgccagcgttgccgtgatccacgccctgacttgcagttcggcgacggctatagcacggttggtgtgctgacctccctggacatccgcccaggtgactggtactgcagctgcggctaccacaacttcgccagccgcagcagctgcttcaagtgcggcacgatcgtcagagacttcccagcggggcaaggcgcagccggtgctgagggtgactttgctggtggacgcgacagcgccgcagtccgtgctgggtggaaagctggcgactggatctgcacgaggcctggttgcaacgtacacaactttgcgagcaggatggagtgctataggtgcaatgcaccaagggaggcagcaggcaccgggaggtaagaggcgactggggtgataccaagagcgtgagatgtgacgagctggccgagcagtggaacctactgccgtcacacactcaccatcaggcatccaggaaggatgagtctactacgtacacgactatattgctgattgccgcgcgtagtgccgctgctgtggtttgcgtgggtggagaagtacccaagcgcaacacctgttacgtgtgttgtttgctcctttttgaggttgtgttgattcagtgacagctgagttgtacggcctgatgatgtactcgcattgtgtatttgtcttaaacagcatatataattatgtaataataagtgcttgcttatcta

SEQ ID NO: 77 - DNA, 3108 bp, Zea mays
aggaacaagtagaggggagtcctgatttgggcccctgccgtggtatgtgccatgaggaagctcttcttctccgagtcggcctgcaaggagaccaagctccactgcgcgccccactcatggctgcccctcgagagggggaagctctccaagttctccggccatgccgccgccggctcctccatagaggcattgatgaagatgccggagccggcagtgcttccgtacttcaagcccgcgaactatgtcgacatactggctcagatacacgaggagctggagtcctgccctcctgacgagaagtcctgcctgtacctgctccagttccaggtcttccgcggccttggggaggccaagctgtcacggaggagcctccagtctgcgtgggagaaggcgagcaccatacacgagaagctcatctttggggcgtggctcaagtacgagaagaaaggggaggaggcaatctccgacctgctcagctcgtgctgcaagtgctcacaggagttcaggctgctggattttgtgtcgcaagtctccactgggtcacacatgatgaactatgatgatgatgatgatgagtctgatgagtttcggggttctgcggtggttcatttccggataagagatgatatgattgcatgcgatcgacggaaacttgcagctctgtcaactccactgtatgcaatgcttaacggtggatttagggaatcctatctggaggtcattgacatgtctagaaatggtatctcccctattggcatgagggcaatcagtaaattcagcctatcaggaagactaccttatttgtcagcagatgctatcttggagatgcttgattttgccaataagttttgctgcaagggcctcaaggatgcctgtgagcgaaagcttgcttctttcatctcttcaaggcaagatgctatagatttcatggagtgtgctcttgagctgggctgttccattcttgctgcttcatgcttacaagtgctcttgaatgagcttccagagtgcttgaatgatgaacaagtggttaggatattctcctctgcaaataaggcacagagattgacaatggttggcaatgcatctttctccctatattgccttctcagtgaagtctccgtgagtaccaacccaacatcggatgtcactgtgagtttcttggaaaaactggtagagtcggcatcagattctaggcagaagcagctggccttacatcagctggcatgcaccagatttttaaggaaagattaccctgaatctgagtgcttgttcaatgctgccttttctgctggccatctttattcgttagtgggtttggctagattggcctctctgaggggtaataagcattttgctctcaagttgctagactctgtgatgtcatctcggtggcctcttggatggatgtatcaagagagagcactctatttggatggtgataacaagttagaaaatcttaacaaggctactgagttggaccctacccttacatatccctatatgtttcgagctgcatctttgatgaaaaggcaaagtgttgaagctgcattgatggagataaaccggatccttggatttaaactggtgctggagtgcttagaactaaggttctgttgctaccttgcccttgaggattatagggctgccttatgtgacgtgcaggcaatcctcactcttgccccagattatcgtatgattggtggccgggttgctgccaagcagctgcgaatgctagtgctagagaatgtagagcagtggacacctgctgactgttggatgcaactttatgatcgctggtcgtctgtggatgatatagggtccctctctgttatatatcaaatgctggagtcagagactgccaaaggagttttgtactttagacaatctttgcttcttctcagattaaactgtcctgaggcggcaatgaggagtttgcagcttgctcgtgagcatgctgcaagtgatcatgaaaggcttgtctatgaaggatggatattgtatgatactggccactgcgaggaaggactgcagaaagcggaagcatcaattgcaatacaacggtcatttgaggcattttttctgaaagcttatgctttggctgattcgagtcttgatccttcgaccacagcaacagttgtatcacttctagaagatgcattgcggtgtccctcagatagacttcggaagggtcaagctctaaacaaccttggaagtgtttatgtggattgtgggaagcttgacctggcagctgaatgctacattaacgccctaaagatcggccacaccagagcgcaccaaggccttgcgagggttcatttccttcggaacaacagagtcggtgcgtatgatgaaatgaccaagctgatagagaaggccaggaacaacgcgtcggcatacgagaagagatctgagtactgcgagcgggagctgacgaaaacggacttgcagatggtcaccaaactcgaccctctgcgagtctacccctacagataccgtgctgctgtgctgatggacaaccacaaggagaaagaggccgtcgcggagctgaccagggcgatcgccttcaaggcggacctgaacctgctccacctgcgcgcggccttccacgagcacatcggcgacatctcgagcgccctccgggactgccgcgcggccctcctggtggaccccaaccaccaggagatgctggagctgcaccaccgggtgaacagccaggaaccatgagcggagcgccgccatggtgtacatacaggacgtgataggaagcccctcatagccaaccccccgccataccagtgtatgttttgtaccatacacagcatgtcaatgtaaggatagtagaaaagccactttaggtccctccctggctccctccccttgcaaaccaaacacctacattccttgtgtgcctagttagatatgttgtttgccatatagcctttcccttagtaaattattgttgtcgactgtgattaagcctcctaattgtacccgccacgtggcccgtgctgccagaatcaagaagttttgactgtaccttctgtatgtaaatgcaatgggggaaaaatgatgaatggaagcttttgtcaagcctgcaggcaacttgct

SEQ ID NO: 78 - DNA, 1330 bp, Zea mays
ccgtgacctccgccacagctgctgcagagctaaccaatggacgtgctgaagcgcgagctgcagcgcaagcgccagctcctcaacgccgatttcggcggccgcaagatcatccgccgcgccgaaatcgaggcacgcgagctccagcgcatccgcgaggtcgagcgccagctcctcctccaaaagcagcacaggcattcccgcccgctgtcctccccctccagttcctcctcaagctcctcgcccacctccgcagccgctgacgccgacgccgacgcgtcgcgggcagagagcggctccaaggagtcgctcccgagggaggaggtcatccggcgcctgcgcgtgctgcggcagccggccacgctcttcggcgaggatgacatcgcgcgcctccgccgcctccaggtcctgatcgaggactccggcgcgctcgccgacatcgacgcggcggagatcggggagggccagaccaacgacttcctccgcgacatccaggcgatgcgtgctaaagctgcgactgtcacgaagcccaaggcggccggcgcggaggccgagcgtggggagggcgacagcgtatcgatagatgtgccgttcgaggagctctgcgacgaggacaagatcactgcgttcttcaggagactgttggacgagtggacccaggaggtggacggtatgcctgaggcggaacggaggacggcaaaagggaaggccgcgatagccacctgcaagcagtgcacgcgatacctcgaccctctgttcaagcagtgcaagaagaaggctctcccttctgatgtccgacaagcattgctggaggtggtcaggtgctgtaggagacgagactacttggctgcagtggacaactatatcaagctagcgataggtaactcgccctggccaattggtgtgaccatggttggtattcatgagcgatcggctcgcgaaaagatctacacgaacagcgtggctcacatcatgaatgatgagacgaccagaaagtacctgcagtctgtgaagaggctcataacattctgccagaggaagtaccccactgatccatcaaggtcggtagagttcaacagcctggcaaatggtagcgatctgcagtctctcctggcgcagcaaaacgcgaagaattcagaagaaacgcttcggttagtggcagcgtcatgaaaggttggattatatctgtcagcggaattctaggcaagttcgattcttgtgtgatttatttgtgatacgaattagtacttgtaagaacctgaattgtatgttcggtcgttactcgttactgccttactgaaccgtggaacaggaacctaatttaactggagca

SEQ ID NO: 79 - DNA, 2295 bp, Zea mays
caggagagctactccgcatactgcacgtcgaggtttggacgcctcatcaaccgtccatcaatttttgatatggagaatgaagagtatgctgaggatctttgtcgagatgtctgggctactcatttcccatccgagccatttgaccttgactcgaatgagattggtggaaacagtgttgataatataacatgtgacaatgtcaatggtgaaattgtcaaaatggtgagacagtacgctggcctagcagaccgttttgcctcactctttgtgcaggaaggtgtctaccatgttgctgctaggcggcgatatgtgcgtttcctggaccttatgaagaaggttgcgtgtgcaacccaagagtgcacacggcttgtgcctagcctagacatattactgatgtggcttgctcaccagagttttcctgtgtgttatgccacggatatggtagcgatgggcatcagtgacaatgttgcaaaagtgggtgtttgttatggcgaagtggtgagcaatgaggcggtaaggaggacaaaggaactgtgggaggatgcatatgatgaaccatatgatatggctggatcagaggttgatgtgggagcagttagcacagcaagggaggcattttactgggtgccagcagcatcagaggaggatgccaaccggctatacaagagtttgcagccaagattccttattgaggtatatgtgttcttgaagggagaatttgataaggagcccaccagcaaggagttcctacgattgcgaacacagaggtgtcacagatcactaaagctcaacatatcgatgtccaatttatcctgcaaaagctggcagaaagtatggcacttgtattgtgaatttgcaactcggggcctcttcattgagttcaggcgcacccttagtgggtgcttcaggaaaagcaagttcctcaagaacatctcattctcatggagcgatgtgttgcatgagaaagcacttgctctcacagaagaacttgatgtcaggatgagagcgatggcatcaattacccctccagttcaagcaccatacttgttgaagtgtgtgcctgatcgagtaactgatgatggtggggccatgatttctgatgtcatattgcgcatgagaaattaccgtccccaagaaggacgttggctgacacgcactgtacttgatcacagtgggagagaatgttttgtcatccggatgagagtaggcagagggatttggcggagaggtgctgaaactcccatggcagtgaaatgggaggataggagcattgaggttcgagaaggatcatggtcatacattgccagtacaagctctgttggttatgctcctgaaaagatagtgggcacaggaacagtgatgaaagatcatcaggagaataaggtagtttggagcttatcaacaggagatacgctgacaatacgtttgggagatgaactcagctttcagttaaaaaatgacagctcagaagaggaggcaaggctgcttgtcgggaggaggttgagctacagagtaaacacagataatgcgtcgagcaacctagtcgaggaggagcaatacctgacacttgttcgtaagtcaccgtatcatcatggtgacagagcaaccgtgcttctaaactggaaattacttgctgtggagttcttacctgaagaggatgcagtttttgttcttctcctatgcatggtgattgcacggaccatgacagagatcaggagagaagatgtggctgggcttttagtgcggcggaggataagtgaagcaagagccgggcagagagactggggttcggtgatgcttcctggctcgctttcaccggatcctcatctgcagccttggtaccggaacgcaacgcaggttttgagctctgcggagacaggaccagtgctcacaaagtactcacctgctgacgggaaggacatgttgtacaggcaagctcttataccctgatgaagccctaatagagattattaccataccatcaggacttgcctgatagataaaaaaaacgaacccaatcttcctgggtatcgcagggaaattatttcatttcctcaatgctatgacatacgacatttgtacaggacaattttttgtggttcgagctgttgtttcactaatgatgattgtcctttcatacgaatccaatgattgctgtcatatattgtttgtactgagaattttacacatttcatttcaagtttgtctggtttctgtagtttgacaatgaactaaaagaagagcttatgtccatttgaacaaactgattatagaggataaaggattcagaatctg

SEQ ID NO: 80 - DNA, 1638 bp, Zea mays
aaaatccaatctcgagctccctttccctctccactgcgactgcagcgtgctcctgttctcgattctcgaagcctgtatccgtctgtcgagccatggcgaagggaagggcacacccgtcgaagcgacccacccaccaacttctcgcggctgtcctatccgttttcgttctcctcccgctgctcgtgccggcggcggcaactgtggctgtggcggtggcggtggcggaggggggcgggaagcagttggcggtcgggaaggacgagggaaaactggtctcggagggggatgctggtggaggcgggttagtggaggagaatgaattcgcgggtggctttggctccctcgacagcatgctgcagtgggcgatcggaaattctgatccggagaagctgaaagagggggctgctgatgtgcagaagttatctgcagatgaactgctcgagcggcgtcaggagatcaaggagttgatggagaagttaaagatgccatcagacgctgacttaatgaaaatcgcaattgatgacttaaataattcttccatttcactggaggatcgccaacgcgcactgcaggaacttttagttcttgttgagcccattgacaatgctaatgatcttgaaaaacttgggggcctccttcctgtgattcaagagcttaataatgcaaatgaagaaatacggaccacctctgcatgggtccttggtacagccagtcagaataatgaacttgtacaaaaccagatccttggttatggagctttggtgaggttggtgaagatgggttattccacatctacagaagaagctgcaaaagcattgtatgctatatcatctttgatcagaaataatgtaaatggtcaagaagcattccattcagaaaacgggagtgcaatgttgcagcacatattggtcagcaacaatattgatgttaggctacagaagaaggcagtgtttttagtaacagatttggcagactttcagctaaattccggaatcgcgcaacttcctttcttgagtgaccgtctttttctgaagtcaatagtcgatatgttatcaaggtttgacctagaccttcacgaaaaagtattattggccatcaagagtctgctgaaactttcctcaactgatgtggaggattttgagttctatgatctcgatagtgtactgctcagactaggggtacagttggaggacttgacaccagaggatcaaaaggagttcgctgtggaggttgatgccctccggagagaagttcaaacactcttccaacagaagctcaagcagggtaaagcgacctcgacatgatgttcggatgaccaccagaagatttgcccgtctagatggaagtagaatggatcagcttttgtgggatgctacagctagatggcggacttgggttttcttcttgcactttggcaaggtacatgagggcatgataggttaggaagtaaggcacgtgcttatgactccattttggcaaaactatatgattctcgcaacgttctgtgatatgggcactgcaacgaaggaattttttttccttgttccgttgcagctgtagcttcattttgagaatgattgaacttgatgttgatcagatcatttgcgagggagctaaattgagaatcgctgtctgact

SEQ ID NO: 81 - DNA, 3017 bp, Zea mays
tcatctcgcgcgcggcggtccatggccaccgccgccaccgcttcccacccggcttccgcctccacctccggccgcgacgctctcgccgccgcctcctcctcccccgccgccgtctgcctcgtcccgttcaggtggtgggcgcgggtgcgggaggaggaggcggcgggcggggtgcagtacgcggccaccgccgccgcgtcgccctcctactacggcctcaggctgcttcacagcttgctgcacccggatctcgtcctgcgcctcgagcgcggggagtgccgcgccggtggcgggaacggaggcgggcgcagctacgcgctcgtcccggccgacgagctctccagggcgctcgccaggcaaaactctggtttgggtttacaaaataagcactcctttgctggagatagtgctggtgcttatcctttggtgcttaggatctctgtccgagaaacaagtatcttgacactgaagatcagcaaaaaggacaatccatttgagaattacaaacgggctaacaagatttttaatgtggattctcaaccagttcatgtttgggatttttcagggcagacaaacctaatattaatgaatgaatggaatagactacatgactgctgccatgcagatcaagagaatcttctggaagtgcaagtctatgcaatgtctgactccttaacatccaaaattggtggtaccaacaaagaaaattatggagatattagtgatatgaattctgattcgtcttacagaagttttggaagagctggttctatggggttaataggattggagaatctcggaaatacttgctttatgaacagttcaattcaatgtttggctcacacaccaaaacttgttgaatacttccttggtgattatgccaaaaatataaaccggactaatccattgggattgaacggtgaacttgccttggcgtttggagaactgttgaggagcttatggaccactgacggaaaaccagttccacctcattatttcaaggaaaaaattgcatgttttgctcctcagtttggtggctttaatcagcatgattcacaggaacttcttgcttttttactggatggtctccatgaagatcttaaccaggttaaatgtaaaccgtatgaagaagcaaaggatgcaagtggccgtcctgacgaagaagtagcagatgagtactggagcaaccatttagctcgaaatgactctgttatagttgatacatgccatggacagtacaaatctacattaacttgtcctacttgcagtaaaacatctgtcacctttgacccatttatgtacttatctttgcctgtaccttccacggcaaagagggtaatgactgtaacagttttcagcactgatggtagcagagaaccatgctcgtatgacgtcagtgtgccaaaatttgggactctgagtgatcttgttcaggctttaagcattgtttgcctacttggagatgatgagatcctgctggttacagaggtctataataactgcatcatccgatacttggaggagccttcagattcagtttcattgctgagggatggagataaactagcagcataccgtctacccaaaagacatgagaaatccccccttgtggtttttacacaccaacattttgtccagcattctagtgatggtaatttaactccacaaatgagggagtttgaggccccacttttggcagcacttccagaggaaattagtggattatctcttcaggatatctacctaaagttgttgagtccatttcaactttccaacggggctagttcgcttaatgattgtatggagtctaatagtgactccgtcgatacgccttctgattcaggcagtatcaattttcagaacagccaattggaagatggccctgaaagcaaccactgtagtgctagtgaatgtgaagtaacaaaaggacctgatgatttatacgatggggtttctggttctaacaaggaagcacatatggacttcgaattttatttaaaaagtgaaaggggcgagggccagcaacagaagatagaaattaatgagctccatttattattggagacagcaccaagccggttgcatgtgaatgtccactggctacagaatgcttcaagaaaatatgccacctcaatgctgaacaatctacctgagatccacaagctcgagcttatcccgaaaggaactgaagattctgttgcactacatggttgtctggaagcctttctaaaagaggaaccgttggggccggaggacatgtggtattgcccgcgctgcaagaagcatcagcaagcgatgaagaaactggatctgtggaggctgcccgaggttctggtgatccacctcaaacggttctcctacacccagttcacaaggaacaagctggagacgttcgtcgacttccccaccgtcgatttggacctgtcgtcctacgtcgcggacaagagcgagcagccgagcagccattatcgcctgtacgctgttagcaaccactacggaaacatgggagggggccattacaccgccagcatctatcatgaggaagggaaggggtggtacaagttcgatgacgactgcgtgacccctatgagcgaggacagcataaagaccccggctgcctatgttctgttctacagacgagagtgactgactggggattgaagcgcatttttctgcaggtgggttttggcgtgtctgagttttctaacgtttcggcatttgaatctctcaagccatactgacgcctaccggtgatacaacaacattatgtacagattcatctgccaacaggagagagagagagagagagagagagagagagagagagagagagagagagagagagagagagagagacctagctcagtgcaatattctttttttcgcatcagctcacagtattcttatatgggtagtacatggaccccacccacccgcacacaccaacattgtaattcctccgacttcaaccggtgatcacatcacattcaccattaaagaaagggtcaatagacaca

SEQ ID NO: 82 - DNA, 1739 bp, Zea mays
agccagacgcagaccccctgcctgttgccctgtcgcagtctagcatcaggcatccatcggcgagagcgagagcgagagcgttcgcagcaagcctacctcaccttgcctgcctgtctgcctgtctgtctgtctccagagctgcgcttgtccggagacggagccgactgaacatggccggagatccgggggacgcgccggaggtgggaggcggcggcatacgctccgtgctcaccacggcctcgctcgtcgctccctccggggacgaggttcagtttcgggagatcgacggcaagatcatcggcctctacttcgcggcaaactggtatccgaaatgcgaggctttcaccccggtgctggccgcggcctacgagcagctcaaggagcgcggcgccggcttcgaggtcgtgctggtgtcgtgcgacgaggaccggccgtcgttcgagcggttccacggaaccatgccgtggccagcggtgcctttcggcgacctcagctgcaagaagcgcctcagcgagaggttccaggtggagggcatcccgcgcctggtggtgctcgctccggacggcggcgcggtggtacacccggacgccgccgacctcgtgcaccgctacggcgagagggcgttcccgttcacggccgcgagggtggcggagctggaggcggatgaccagcgcaagtacgcgtcccagacgctggagaagctcttctccgtcagcgggaaagagtacgtgatgaacagtggtaataatgaaaaggttccggtctcgagcctggtggggaagacggtggggctctacttctcggctaaccattgcgcgccgtgtatcaagttcacgacgaagctggcggccatctacagcagcctcaggggcaaggcggaggacttcgaggtcgtgtacgtccccatggacagggaggaggacgggtacctgcgctcctgcggcgacatgccgtggctggcgctcccctacgacggcgcgccgtcgcgcgcgctggcgaggtacttcgacgtgcgggagatcccgacgctggtggtggtcgggcccgacggcaggacggtgacgcgggacggccggaacctggtgaacctctacttcgacatggccttcccgttcacggacgcgcagatcaggctgctgcaggaggcggaggacgaggcggccaaggagtacccgcggtcgctgcgccaccggggacaccgccacgagctcagcatcgtgtcggagaagtccgggggagggccctacatctgctgcgagtgcgaggagcagggactcggctgggcgtaccagtgcatcgcctgcggctacgagatacacctcaggtgcggccagaatgcggagggcggcagcgcaggaactgcttagctagctaggcgacgtacggcagtcggcagcatgccagcataacagcatcactggagtggtgtctacctattagactgctgcatgcgtattggacttggacatggtctgtgtttgatcccaacaaacgtcagcttgctctacgtcaagcaagtctgatgctaaagtagtcaaatagatagatgagaaatgcatagccttccttgtaaggcttagtaggtggttagctgagtgaacaacaaaatgaagctgcagcaatcaatcaatctactgtggcaggtgttatgcaaatcttgctgcactgcccaaccaaactactgcattttccagtgcgccttcttcgagcctaatttgacaccactgaaattaggcttt

SEQ ID NO: 83 - DNA, 1486 bp, Zea mays
atgtgggcacgtttcctcttcttcgttctctcccccatcccaatcgtgcgtgttcctcactcctcagctccgaccttcacggggcccacggggcccgacgcccggcggctttactcagggcaccatggccttctcttcgtcactggcgccgttcttcccaccttctggaaccttccgagcccatcccgctaggaggctgcgggccgatgcacccgggagattcgtggcgtcctgcttgccccctcccgacgtcgtggtgacgcgcgagcagggaaagaacgccaggctcatctccgcgctggaaaagcataatgtacaccctctggaacttcctcttattaagcatgttgaaggccctgatacagataggctttcagatgtcctacgtaatgacaagttcgactggattattgtaacctctcctgaggcagctgcagtgttccttcagggatggaaggctgctggaagtcctaaggtgcgagtagctgttgttggagaaggaactgcaagggtttttcatgaagtgtcagaatctgatgatcaatctctagagcttgcattttcaccttccaaagctttgggtaaagtcttggcttcagagcttccaagaagcaacgagaactcatgtaaagtattgtaccctgcatctgcaaaggctggccatgaaattgaggatgtgctatcagaacgaggatttgacgtgacccgactgaatacatatacaactgttcctgtagaagatgtcgacccactgacattaaaccttgctatatcagctccagttgttgcggtagcttctccttctgcactgagggcatggctaaatcttatctcaaaatctgataactggaacaactccgtcgcctgcatcggtgagaccactgcgtctgcagcgaagaaactgggcctgaagagcatatattacccaacgacccctggacttgaggggtgggtcgagagcattctcgaggcgctcagagtccacaggacagcatcaaaagaggccccaaaacgttgaaaacgggcggatggcggagcttcttcttggcgttggtagccgtccgcagtgtcgaagaaattctttgcttctttgacgacaattgccccccgttgagggaggtggtggtgtcaagccatggctttccactggcccagtttgtaatggattcttgggccgaaaggcccatctctacatgtcttgactcgcaaggcgattgcatcagtccatccatccatttcatggagggttttagcagtgccgtctctgtttcgctaatcggtgatggcagccagccttgttgtactttgtgggtttgttgacgcagccggtcggattcttcttattgccggattggttgcgtaacgctaggtggttctgaatatcggcgacggcgaggctgtggaatctccgccctccaccgaagattccctgtcgtcgtttctgaatttaattaacaacatggcatgatgaccaatcaaagctcgc

SEQ ID NO: 84 - DNA, 1552 bp, Zea mays
cttccagtagcctgagcgccggggccatcggtagcagagaggttttgctgcagagagctcaagaaagatgtacgtggtgaaggatattggcggcgccatcgggctgatggcggtggcgctggtgctcctgggcacctggccggttgtcctggcggtgctggagcggcggggccggctgccgcagcacacgttccttgacttctccgccaccaacttcatggcggccgtgctgatcgccctcaccttcggccagatcggccccgccagcagcacgcccaacttcctgacgcagctcactcagttcaagaacaactgggcttcggtcttgtttgccatggcgggcggcgtcaccctgagcctgggcacattggccacgcagtacggctgggcgttcgtcgggctctccgtcactgaagtcatggcctctagcctcaaggtcgtcatagggacaacggtcaactatttcctggacggccggatgaacaaggcggagatcctctttcctggcgtcggctgcttcctgattgcggccatccttgggtcacttgtccacgcttccaatgccgccgacaaccaggagaagctggctaataataacgcttccaatgcagctgcagctgcagatgaggagaaggatctcaccaaacacctcctagagctagagataccatcccaagaagcagagccggatgcaggaacggcagggttcctggttggtctggaggagaagaggtcgattaaagtgctgggatcccacacgctgctgggccttggcatcgtggtgttcgcgggcatcttctacgcgctcttcgcgccagcgttcaacctggccactaacgaccagtggcacacgctccccgccggcgtgccgcacctggcggtgtacacggcctacttctacttctccctcgcatgcctcgccgtcagcgccgccctcaacgtgtggctcctctaccggcccatggtcggcgtgccaagctccaccctggcggcctacgtcctcgacggcgacggcaggggcctcgcgatgctggccgggatgctgtgcgggctcgggaacgctctcacgttcatggcagggcaggccgccggttacgccgccgccgactccgtgcaggcgctgccgctggtcagcacgttctgggccgtcgccctcttcggcgagtaccgccggtcgtcgcggcgcacgtacacgctgctggcgagcatgctactcatgttcacagtcgccatggtcctcctcatggcttcctcaggaagccgctccatcattcactgagctggccacgtggatggatatgcgatgcgatgcgatgaggagaatggacaccgggatagctcttgtcttgtgctggaatggaatggaaccaacccactagctgtacagagcgatcatgctacgtccacccactcgtccatgaattgatttgtctctgtatttttttttaaaaaagcgtgcgctgtcacccgcgggccgcggtagcatgcagcccgtctccagcggtctacataaagtttacttaaaaaactgttttatacttgtatgcactat

SEQ ID NO: 85 - DNA, 2312 bp, Zea mays
tgcttgctgtgctgacttcattggagagagagacagtgaagagtagaggagagagagagagagagagagagagagagagagagagagagagagagagagagagagaaaatgggcgtggcgacggtgacagagctgaagcagagcatctccgggaagaggacattccggccgagcctcatcagccgccacgccaatgagtggcctccgaccgacgtctccagcgacctcaccgtcgaggtcggcacctccagcttcgcactccacaagttcccgctggtctcccggagcggcaagatccggcgcctcgtcgcggaggccaaggacgccaagctggcgcggctcagcctgcacggcaccccggggggcgcgccggcgttcgagctcgccgccaagttctgctacggcgtccacgtggacgtcacggtcgccaacgtcgccatgctgcgctgcgccgcgcactacctgcagatcaccgacgacttctccgacaagagcctggagctccgcgccgaggccttcctccgcgacgcggtgctccccagcatcgccagctccgtcgccgtgctccgcagctgcgaggcgctgctcccggccgccgaggacgtcggcctcgtgccccgcctcatcgccgccgtcgccaccaacgtgtgcaaggagcagctcacctcggggctgtccaagctggaccagtgcgcgcagctcaagcccgcggcggcgttcgccgacctcgacccgccggccgactggtggggcaagtccgtggccgcgctcggcctcgacttcttccagcggctgctctccgcggtcaaggccaaggggctcaagcaggagacggtcaccaggatcctcatcaactacgcgcagaacgcgctgcacgggctcatggccagggacgtgcacagatgcggcggcgcggacgccgacgccgtcaagaagcagcgcgccgtcgtggaggccatcgtgggccttctcccggcgcagtccaggaagagccccgtgcccatggccttcctctcggggctcctcaagacgtcgatggcggtgtccgcgtccagcatctgcagggccgacctggagaagcggatcggcatgcagatggaccaggccatcctggaggacatcctcatcgccgcgggcgccgccgtgggcgcgccggccggtcagcagcacgcgctgtacgacacggacgtggtggcgcgcatcttctcggtgttcctcaacctcgacgacgaccataacgaggaggacgacgggttcgactacgacagcccgcgctcgccgaagcagagcctcctggtgaaggccgccaagctgctggacagctacctcgcggaggtggcgctcgactctaacatcctcccgtccaagttcatctccctcgccgagctgctcccggaccacgctcgcgtcgtcaccgatggcctctaccgcgccgtcgacatcttcctcaaggtgcaccccaacatcaaggaggcggagcggtaccggctgtgcaaggcgatcgactgccagcggctgacgccggacgcgtgcagccacgcggcgcagaacgagcggctcccggtgcagatggcggtgcaggtgctctacttcgagcagctgcggctgcggagcgcgatccaggccgggggtggcagcagcatgggcgggcacgacggggcggtcttcttcgggtgcgccgcggccgccgcgtcggtgcagggcagcgtgaacatgcgctccggcagcggcgtgggcagcggcgccatgtcgccgcgggacaactacgcgtcggtgcggcgggagaaccgggagctgaagctggaggtggcgcggatgcggatgcggctcacggacctggagaaggaccacgtgagcatgaagcgggagctggtgcgcgtcggccccgccaaccgcctgctccggggcttggcgcgcagcctcggcaggctcttccgcatgcgccccgccgccgagccggggctgcagcagctcggggccaaggctaccgccgacgccaaggtgctcttccagcgccgccgccgccactccatctcatgatctcggttcctcgactcggagaggtgactggcgggcacgctgccgatcgagcgtgctcgcgaggatgagcggccacgctactgtacgtgcgtacagcaaagtttcgcgtgtgcaattgtgcatagcatacaagaaagaaagacatggtttgagtgagtgcacactgcaggtttatttcaatcccggatttcgtgcggtgcgggcatcgcgtggtcttctgctcatgaaagtcatggcgttcgacacagcttgcgatgcgattcatgtatatg

SEQ ID NO: 86 - DNA, 806 bp, Zea mays
acgcctgcctggggccgggcggcaaagctaagctcagccagagtcgatcatcacacggcgatggagccggccgccgacggcgacgacgtgcacgggcagcgacgggacggaggacaccacgcgccggtggtgtcgctccgggcgctgggcctggcggacgcggacgccttcatggcgtgggcgtcggacgaccgcgtgatgcggcacctgaagcggccgctctgcgccacccgagagcaggccgtggcgcagatcagggacaccgtgctgggccacccgtggttccgcgccgtctgcttcggcgacgtgcccgtggggcaggtgtccgtgtggccgtacgccgacgagggcggtcgcagggccaacctcggctacgccctcgcgcacgaccagtggggccggggcatcgccgccgccgccgtcaggatggtggtgggcacggtgttcgacgacctgccggggctggaacggctggaggcggtgacggacgtggcgaacgtgcggtcgcagagagtgctggagaaggccggcttccacagggagggggtgctgcgccgctacatcgctggacgccgcggcagcggggccagagatgcggtgatctatagcttcttgtcgtccgatgatcgtgcgtgacccggtgaccggtgtcgctatgctacctgcatatggttgtgtgtcctgtaatatgcgttccataaattgtgcaagatagaaatggactactgcgtataatgtatctctaagtgcataacttaagttattgtattaaaaaaaactaatttttttatacttcaaaatagttg

SEQ ID NO: 87 - DNA, 721 bp, Zea mays
gacggtggtgccgcgccgtgtgtgatggcggagagggtgtcgagactatcgacggagaaggcggtggtgatcttcacgacgagccagtgcccgatgtgccacacggtgtcgagcctcttctccgagctgggcgtgtgcgcggcggtgcacgagctggacaaggacccgcgcggccgcgacatggagcgcgacctcgcccgccgcctcggacgcgcgccgcccgtccccgccgtcttcatcggcggcaggctcgtcggctccaccgacaagatcatgtccctgcacctcgccggcaagctcgtgcccatgctcaagggcgccggcgccatatggctctgaattcgcgattattcgctggatcgaacgtaaacccccggaattttgcacctatatctatatattcccatgcatgcaactaattaaatactcctaatggggggtcttaatataaattataagagctatatgtacgtacgtatactctcgtgggtatagcctagctatatatagagcgcgtccataaattaaatcgttaagatatatgaagcggcctatatatgtggaccgtccgatcacaacgggtggttaattaggttgagagagaacttttcttttttgatgagagaacttttttgccgctagcagtgctgaaaagggtgccaataaaggaacttgtaaacatcccttttccagttttcaatgagatatatgaatttttgaa

SEQ ID NO: 88 - DNA, 2617 bp, Zea mays
gagacgcaccaccaccccggcccagagcactgcactgcttctccctctctgttttacggaggacgaggaggaacaggaagcagcagggtgcaacaatggtgaagttctccaagcggttcgagggccagctggtgcccgaatggaaggacgccttcgtggactactggcagctcaagaaggacgtcaagaagctgcaggccgcggcaggagaggctgccgtggcggcgccggcgagggctccggctcactgggcgatgaggctgcccttcttccacccccttgggcagccgcctgccgccattcaggtgcacaggaagctggccacagacaggagcgtcgacggcgcggtggccggggaggtgtacgatacggcggtggcggatggcgccgggttcgcggacgccgaggcggccaaggccttcttccagaggctggaccagcagctcaacaaggtgaaccggttctacgagagggaggagcgggagttcctggagcgcggcgagtcgctccggcggcagctgcagatcctcctcgagctcaaggctgccgtcacccagcagcagcaggcacggcgcggggggagcgctgccgacacggatgacccctccgtttcttggtccattcagctcggaggccaatctctcagggtaattgcagagaaagaagaagagtgtgaagaaaagctcaacggcggcgatgctaccgccaagataagcagtggtgaaggacccgtgtctcaaggtctcagtgaatctgggagactttgcaagccgaatgaagaaatgacgaggacactctccggccagggcaggagtgtgaggatcaacatcccggtcaccacgccttccaggactgtcaccgccatacgcgaactgctgttcggggacatgccgagccagtccaagaagactggcgcgcatggtaccgacggcagtgagaagctgagcatcaacaagaggaaggtgcaccaggcggagaagatgatcagaggtgctctggttgagctgtacaaaggactgggctacctcaagacgtaccggagcttgaacatgatggcctttgtgaagatcctcaagaaatttgacaaggttacaggaaaggaagtgcagcaaatttacctcaaagcagtggagagctcctactacaacagctctgacaaggcagtcaggctaatggacgatgtggaggagctgttcttgagacatttcacagaaggtgacagacggaaagcaatggtgtatctgaagccaaatcagcgggaagagtcacactgtactacgtttttcattggagtatccactggcggcttcatagcattgttcataggttactgtatcatggcacgcgttgctggaatgtacactcagcagtcaaacaaggtgtacatgtcaacttcttatcctgttcttagcatgttcagcctcttcttcctgcatctcttcatctatgggtgtaacatcttcatgtggagaaagacacgcataaaccacacattcatatttgaattcacgcctactaaagagctcaagtaccgagacgtgttcttgatatgcactgcttccatgacaattgttgttggtgcaatgtttgcgcacctggcaataattgttaaaggaaattcatcaggcgttgtccaagcgataccagggtccttacttctggtgttcttgttcatattagtctgccctttcaacatcgtctaccaatcaagccgttaccaattccttagagttatcagaaacatcattctgacacccttttataaggttgtcatggttgatttctttatggctgatcagctctgcagccaggtaccactgctcaggagcctggagtatttggcatgttactacataacaggcagctacatgacacaagactatggatactgcacaagagttaaaaactttagagaccttgcttatgcagtatccttcctgccttattactggagagccatgcagtgcgcacggagatggtttgatgaaggggatataaaccatattgtcaaccttgggaagtatgtgtcagccatgcttgctgcaggaacaaaggtggcatatgagaataacaatagtactgggtggatgtcacttgttatcattgtatcaagtattgcaactatctatcaactgtactgggactttgtcaaggactggggtcttctacagttcaactccaagaatgcctggcttcgtaatgatttgatacttaaacaaaaatacatttatttcgtatccatgggcctgaaccttgtcttgaggcttgcttggcttcagactgtcatccaccctaatattggaagcctggattctagagtaactctgttctttttagcagcacttgaagtgatacgacgaggtcactggaacttctacaggctggagaatgaacacctaaacaatgcaggcaagttcagagcggtgaaggttgttccacttccttttcaagaagtggaagaggaataacaaaacagggccaccactggagcatgttgtaggttttaagaatacaaacagttcgtatgtaacacaccaactaatgctagaaagcatgcactacattaccataataagattcatttttgtatgagcaataaaaaccattccacgctgtt

SEQ ID NO: 89 - DNA, 1118 bp, Zea mays
accaatccccgattccttacacgctaagccacgcaacgcaacgcaactagccatgacgatgaagtccagcagcggcggcggccatgtcatcggggtcccggtcacctccaaggcgcacgggatagaggaggtgtccagggatccgtccttcggcaagggcgccggcgatcacctcgccgtctcgttgacgcaccccagcccttacgcgtctttcggctacaagcacacaggcagcaaaggccaggtgacccactgggtgagcaagctgagcagaagggcgcagggcttcagagagcatgtgaccttggggccgaagctgtcggagacggtgaaggggaagctgagcctgggcgcgcggatcctgcaggccggcggggtggagcgcgtgttccgccaggccttctccgccgccgacaagggcgagcggctgctcaaggcgctgcagtgctacatctacaccacgggcgggcccatcgccggcatgctcttcgtctccaccaggaaggtcgccttccgcagcgaccgccccatcaccgtcacctcccccggcggcggcggcgacacggcgcgggtcacctacaaggtggccatcccgctgcggaggatccgcagggtgcggcccagcgagaacgtccacaggcccgaggagaagtacatccacgtctccaccgtcgacggcttcgagttctggttcatgggcttcgtcagctaccagaggtcgtgcaagtacatgcagcaggccgtctcggagatgcgatgaccggtgtctgtatcgctgccccctgtcggaacgatgtgaagtgactaggatgttatgggtctcgcttcgccatcttttgtcgccaagcagccgtagctaaaaagattgccctgtctttaattttggatcggtgcaattgtgttccttccgcgtacgaatttggaccagcatctctgttgttcccaaagtggttgctctcgatctactagtacacatggaccgaaaaaattaaccatttgtgcatctttgttgaatgcaacagttctatgtgtttctgattagtttatttctctctaccagtagtaggtaagcgtcaaaacataaataatgcaaaatacaatttgacttgtgctgtgtt

SEQ ID NO: 90 - DNA, 869 bp, Zea mays
agactcgagtactagactagagtctcaactcttgagcaggggaaacgagagatccttggagtcagcaatggagtctaccgcgctaatgaccgcgagactaccactgctgacctctggctcccgttccaaacccctcccctttgcttccttcaccagggcggcttgccgtctcgcctccgccccctgctccggcagcggcagcgtcgtcctgctgtcgcgccggagccgcgattatgctggcgttggttccttggtctccgccgcggcggctcctggggatacggcggacgccggatccgagtccatcctgctcagcgtccaggggatgatgtgcgacgggtgcgccgcgagcgtgaagcggatcctggagagccaacccgaggttacttctgctaccgttgattttaaggaagcaagcgcagtcgtgtggacaacagatgaggccaaggggacacaaggttggcagaagcagtatggagagaagcttgctaagcaccttggcacttgcggatttgagtctcgcctacaagagtaaggtgaagccgaaccgatattgaagttcagatcagatgtcaccttaatggtcaatttataccaggatatatgttaaatattttgtctctatggattgcagttgtaggattagtctcggtgcttgtctggtggcataatactacatacctacctttcacatgatctttagctagattgtttcgaataggatgatgtcctaaaattgtaggtgtaggccactgttgcgaggaaggagtttgcggctgggctattgttaaatccggtcttcccgttgcttcgaagatataaagtgatactacctctataactcaaaataaatcgattttttaaactca

SEQ ID NO: 91 - DNA, 855 bp, Zea mays
agcagcaaatagtggttggcctgttggtactctatatcgtcccttccagtgtacccgtcctccagcccattatacatcatacttgctccagataagaccaagagcatcatggccaacgccttgcctctcatcgtcgcgctggtcgccgccgccgggtgcgcggcgctggcttcggccacgtcgtacaccgtcggcgactcgcagggctggacgaccaccggcgtcgactacagcagctgggccagccgcaacactttcgtcgtcggagacacactagtgttcaactacgtgagcaaggcgcacacggtgacggaggtgagcaaggccggctacgacgcctgctccggcgccaacgcgctcagcgacgacgacaccggctccaccaccatcacgctccagaccccgggcacgcactatttcatctgcaacgtccccggccactgcgccagcggcatgaagctagcggtcgccgtctccgcctcgccctcgggcacggccccttccgccggagccctgcaggttccggcgatggcctccgtcgtcgccgcggccgcgggcgctgccatcaagctcgcgctcttctgacggagcacggccgggtcgtctcaggggagagacagtgcatgcagactacgttcttggcggttgatagtttcccgctggcgattgttcgccgcgcagttcatgtacgtatgtatgtgtgtatgctactctgcggtggcgaatgctttttctgatgcctctgtcgttgtgtgttcatcaccgtcgtgtgcgattgttctttgggttgtctttgcctcaataaaactgcttcattctccagtattctatagatgagtgctatgtactctgtac

SEQ ID NO: 92 - DNA, 2492 bp, Medicago truncatula
acactctgctctgcttccttacttgcttcatcccgtgacttagaagtactgctgcttcggttcaacctgggtttgagtttgaagttgtgaagtgaagatgtttgggttctctcgtagacgcaccaaattcggaagatttaaggttcagcagctttctgatggtactagaagtccagtttctgttcggcatcccaaacgaattccaaactccattctcaatggagaaggagaagaagatgggattggggatgcagttaccggctcaagtggccattctcatgaaattgataatgaaattgttagcagcaccgatatcagtagttgtagctcaggcggatcggagaattgggtattattgtcaatttctggagataagcccgctcctagattcaatcatgccgccgctgtaattgggaataagatcatagtggttggcggagagtcttctactgggttgcttgatgatgtgcaggtgctgaattttgaaacattttcgtggacaacggcatcgtcaaagctttacttgtctcccagtagtctgcccctaaagattcctgcatgcaagggccatagtttggtatcttatgggaaaaaggcacttctcattggagggaaaacggatcccggaagtgacagaatttcagtatgggcgtttgatacagaaagtgagtgctggtcactcatggaggcaaagggagacataccggttgctcgcaatggtcacagtgttgtcagggcaagctcttatttgatattgtttgggggtgaagatgcaaaaaggaggaaactgaatgatctacatatgtttgatctcaagtcgttgacttggcttccacttcactacacgggaacagcaccttctccaagattgaaccatgtagcagctctctatgatgataaagttctttatatatttggaggatcctcaaaatccaaaaccttaaatgatttatattcacttgactttgaaacgatggcatggtcaagagtaaaggttcgaggtttccatccatcacctagagctggttgttgtggcgttttgtgtggtactaaatggtatattacagggggtggaagcaagaaaaaacgacatggagagactctgatttttgatattgtaaaaaatgaatggtctgtggcaattacatcacctccatcttctatcactaccaacaagggtttcagcttggtacttgtgcaatacaaggaaaaagactatcttgttgcatttgggggatccaaaaaagagccgtctaatcaggtggaagtattggaattggataagaatgaatcagcacttagaagacgttcaactcccagtaaaggtcctgcgtctatactgcttgaaaaacattcatcatccactagattagcctctcagcttaatcactgttcccaacgcttagttgactctgttgctagacaaaatttagcatctgcagttgaacatggttctggaaggaaatctctttccgaatctgtagatcccaattaccccccaagcaatgtctcccttcgtaagcaatttgatcgcgatgaagaatacaatgcagatgtcaagatggacaagaactcagatggaagttctttacctcaggtggcagatcacagaacaaatgaaaatgaccgtcgtaaactgatgaacattagtggagccaaggttaatattgaaggacaagtgttgttgtctgggatgtcaaatcaacaaaaccaagtatttgaaagtgatgcactagaaagtgaagttgtgtcttttcctgagaatgataaatcaggatcactttcttctacaaatatctatcaatactatgaaagtaaagtagcagccctaataaggaaaaatggaatgctggagggtcaactggcagcttccatggcaagcagagaagctgcagagaaaggcttatcatctgtccataaaagcagacaggaaatggagaaaaaattggctgatgcattgaaggaaatggaattactgcgagagaagctagccggtctagagttggcccaagaagaggccaacaacttatcaaacattgtccactctgataatgttaggctcgagcatgatgtggccttcctcaaggctgttttagatgatacacagaaggagttgcactcgacacgaggagttattgcaggagaaagagctagggcattccaactacagtatgaagtttttcatcttaaacagagattgcaatctatggaaaatcggacatctactacacccaggaaaccgtttcacgtgcagtgaagtagataattggagcagctcaccacttcgttcctagtttttccgcgactttgtcatctctagaagcatctgattgtgtataattttgtcaaacattaggaggaaatatgtatattaagtgtatttgtatattcagctcgacctcttaagctctatctatccttcaattagcaacagtgtatcgagaacaactactaataacataacatattaagaagtcacagttaactagata

SEQ ID NO: 93 - DNA, 855 bp, Oryza sativa
atcgacctcatgtcctcatcatcatcaatggagtgcaccggaaacatgtcggcggcgccattgctcgtcttgacggtggcggtgctcgccgtgctagcctccacctgcgccgccgacccagagccgatacaagacttctgcgtggccgtgccccgtgccggcggcgaggcgtcgccggcatacccgggcttcccgtgcaagccggcgtccgcggtcgtctccgacgacttcttcttcgccgggctcgccgccgccggcagcacggacaacccgttcggggccagcctgaagccgggcaacgtggaggcgttcccggcgctgaacacgctcggcgtcgccatcaaccgcgtcgacctcgcccccggcggcgtcaacccgctgcacagccacccgcgcgccgccgagctggtgcacgtcatcaccggccggatgctcgtcgggttcgtgagcacggcggggaagtactactccaaggtggtcggcgagggggagacgttcgccatcccgcgcgggctgatgcacttccagtacaaccctgggaacgcctccgcccgcgccatgacggtgttcaacagccagctccccggcgtcgtgcccgccgcgacggcgctgttcggcgccgacccggagatccccgacgccgtcctcgccaagagcttccaggtggacgccgagatcatcaaactgctcaagtccaagttcaagaagtgacactgacgtctcatccgccatggctacagcatatctgttttgctttagctgtcctagatacagtaaatagagttgtttcacgtttgatattttggtccgatatttgcccatttggcacatcaataaagtaaatttgaattgtcc

SEQ ID NO: 94 - DNA, 989 bp, Oryza sativa
aacctcgcccgaaaagaagagagaacgcgccgcgccgcgccgagccgcgtgggtataattgaagggaagcggtgcgctcgctcgctgcatccagctcaacgcgcgggggaggcggagcgaatcggcggatcggtgggttgcgggcttgcacgtagtcgaggctcgagaggagggggggatggcggcggcggcggcggcggcggggtacagggcggaggaggagtacgactacctgttcaaggtggtgctgatcggggacagcggcgtggggaagtcgaacctgctgtcgcggttcgcgcgggacgagttcagcctggagaccaggtccaccatcggcgtcgagttcgccaccaagaccgtccgcgtcgacgacaggctcgtcaaggcccagatctgggacaccgccggccaagagaggtaccgcgccatcacgagcgcctactaccgcggcgcggtgggcgcgctggtggtgtacgacgtgacgcgccgcatcacgttcgagaacgcggagcggtggctcaaggagctccgcgaccacacggacgccaacatcgtcgtcatgctcgtgggcaacaaggccgacctgcgccacctccgcgccgtccccgcggaggacgccagggcgttcgccgaggcgcacgggaccttctccatggagacgtcggcgctggaggccaccaacgtggagggcgccttcaccgaggtgctcgcgcagatctaccgcgtcgtcagccggaacgcgctcgacatcggcgacgaccccgccgcgccgccccgggggcggaccatcgacgtcagcgccaaggatgacgccgtcacccccgtgaacagctcagggtgctgctcgtcttgactttgactcgctcaaactcatcgtcgtcgagctatgcaaattgccaccgttcacagctttgtttataccgtgtgttttcgtcactgctgattgatactacaaacttgagaattgggatcaaaaggttgcattttga

SEQ ID NO: 95 - DNA, 655 bp, Oryza sativa
attgccgcaactcacagctcagtgtcaaccaccacaaccacaagcaagcaagccatacacatcaagaaggcgtctgcgtgcgaggaaatcatccggtttttcaagctaaaagcgtgaagatgagctcgtcgtcgttgagcaagaaggcgtcgtcgttcgtggtgacggcgagcatgagcgcggtggaggcgctcaaggaccaggcggggctgtgccggtgggactacgcgctccggtcgctgtaccagcgcgccgccgccgccaagcaggtcaccggccgcgccgtcccggtgtcgctgtcgtcgcagaccggcggcgcggcggcgtcctcctctcccgccgccgcgtgcggcagggccgccaggtcgaagaggtcggaggaggagaagatgcagaaggcgtatcacctcgtctgctggggacctaattaaaatctgttcttcaaattcgtgatttcgtgtagtagttttttcgtttgcaatttgtccacccctcattttctggtgtgtaaatcgagccaatacctgcagggatttttgtattttgatccgttttcatgtactactacttccccatctgattctgatggagaattgctatgtgcaaactacggagtaaaaatcaacaagatgatgcgattgttgcacggaattaa

SEQ ID NO: 96 - DNA, 1345 bp, Oryza sativa
attcaagtgtttgtacttggctttgctggcctgtttctgttttgattactcgagctccagagcacagcagcagagagacgcgagctgttcgtggtcgtcgtcgtcgtcgatggacgcggcgtggcgcggcggcgttggctgctcgccggtctgcctcgacctctgcgtcgggctgtcgccggtgcgggagccgtcggcggcgaggcacgagctgcttgaccggccggccggctgccgcggcggtggggattccaagtcgatgaccaatgacgaggcgaagatcgtcgaggcgaaggtcactcagatgagcgaggagaatcggcggctgaccgaggtgatcgcccgcctgtacggcggccaaatcccgcggctcggcctcgacggctcggcctcgccgccgcggccggtgtcgccgttatcgggcaagaagaggagcagggagagcatggagacggcgaattcctgcgacgccaacagcaacaggcatcagggcggcgacgccgaccacgccgagagcttcgccgccgacgatggcacctgccggaggatcaaggtcagccgggtgtgcaggcggatcgacccgtcggacacctccctggtggtcaaggacgggtaccaatggcggaagtacgggcagaaggtgacgcgcgacaacccgtcgccgagggcctacttccggtgcgccttcgcgccatcgtgcccggtgaagaagaaggtgcagcggagcgcggaggacagctcgctgctggtggcgacgtacgagggcgagcacaaccacccgcacccgtctccgcgcgccggcgagctcccggcggcggcggggggggccggtggctcgctgccgtgctccatctccatcaactcctccggcccgaccatcacgctcgacctcaccaagaacgggggagccgtgcaggtggtcgaggcggcgcatccgccgccgccgccggacctcaaggaggtgtgccgggaggtcgcgtcgccggagttccggaccgcgctggtggagcagatggccagcgcgctcaccagcgaccccaagttcaccggcgcgctcgccgcggcgatcctccagaagctgcccgaattctagcttcctttacaattctccaattcttcttacaggaaaaaacatagaggcgcatttcaatagagattagagcttaatctccccccaaatttgaaaattttatacagggtaagaattccgaatgcttttctgctgcttttaggatgtgaattgtactctctcataataacctgttggtccttgggccgtcggaagaagattgcgggcttctatcgggcctcacgatcctgagcccaattgcgaggctccttgagc

SEQ ID NO: 97 - DNA, 1548 bp, Oryza sativa
acccagtattgcatccatcttctggccaaagaatgacatctcttctcatcatcttattcccttctacttaaataaaaaaagaagaagaaaaaacccatcattgcctccatcttctggtcaaaggatgacatcaatccctatcatctcatcccctcctatataaagaacccagtactaccttcatctctgactcatagcaatatacatacatcgtatcacagggaaataatcaacataatcagcaacaatgggagccaagaagcataccttgcaagtgcttccatggctactgctctttgcgcagcacactgcagccagtgcctgcgactgtgctaacaccacagacggggcagacagacagggtgcaatgaagctaaagctcattgccattgcatccatccttgcagctggggcggctggtgtcttggtgccagtgattggccgctccatggctgcgctgcgccctgatggtgacatcttctttgctgtcaaggcatttgcagccggcgtcatccttgccactggcatggtgcacattcttccagcggcgtttgatgcgctcacatctccatgcctcaaaaggggtggtggggataggaatcccttcccctttgcgggccttgtttcaatgtctgctgcagtgtccacaatggtggtggactcattggctgctggatactatcaccggtctcaattcaggaaggcacgcccagttgacaacatcaacgtacacaagcatgctggagacgagagggctgaacatgcacaacacataaatgcgcacacacatggaggacatacacattcacatggtgatatagtggtctgtggctcaccagaggagggttcagtagctgaatcaattcgacataaggtagtatctcaggttcttgagctgggaatcttggtgcattcagttatcattggagtatccttaggtgcatctgtgaggccatctactatcaggccactagttggtgccctcagcttccaccagttctttgaaggtgtaggtttgggtggttgcattgttcaggctaattttaaggtaagggcaaccgtcattatggcaatatttttctccctgactgcacctgtgggcatcgtgctaggaattgcaatttcatcgagctacaatgtgcatagctcaactgccttcgtcgttgaaggagtcttcaactcagcctcagcaggaattttgatctacatgtccctagttgaccttctagcaacagatttcaataacccgaagctacagattaatacaaagcttcagctcatggcataccttgcacttttcctaggtgctggactgatgtcaatgcttgccatatgggcatagatcttcagaataacagaggatcttatttcccagataggcttgatttgtattaatctatgagttttctatcttcgcaaaataacatactcttggtggagtatttattgtatccatcctagattttctaaaaccaaagcttatctcaggtgatctctttgtactttatgatatgataatacatgatgacttaacttgttcttagctgc

SEQ ID NO: 98 - DNA, 1439 bp, Oryza sativa
cggccgacgagagcgcagcggcaaatatcactaaatatcacacgaaaaccaaaccaaatcgaagaaagagagatactgctgtacttggagccaagcgagagagaagactgagacgcgacacgcgagcaatggaggctgcggtcgacggcaggtggacacgcgtccgcacgctcggccgcggcgcgtccggcgccgtggtgtccctcgccgcagacgaccgctcgggcgcgctcttcgcggtcaagtcggcggcggcggcggcggcggccgagcagctcgtgcgcgaggggcgcatcctttccgggctgcgctcgccgcacgtcctcccctgccttggcttccgcgccgaagccggcggcgagtgccagctattcctcgagttcgcgcccggcggctcgctcgccgacgtggtggcgaggagtggcgggcggctcgacgagtgcgccatccgcgcgtacgcggcggacgtggcgaggggcctggcgtacctccacgggatgtcgctcgtgcacggcgacgtcaaggggaggaacgtggtggtcggcgccgacggccgggccaagatcgcggatttcgggtgcgccaggacggtgggctccgacaggccaatcggcggcacgccggcgttcatggcgccagaggtggcgcgcggggaagagcaggagccggccgccgatgtctgggccctgggctgcaccgtcatcgagatggccaccggccgcgctccgtggagcgacatggaagacatcctctcggcggtgcgccggattggctacacggacgccgtgccggaggtgcccgagtggctgtccgcagaggcgaaggacttcttggcccgctgcttcgcgagaaacccacgcgagcggtggacatcgtcgcagctcctggagcacccgttcctggcatcggcaggctgcagcgtgaaaacaggggaggcggcgccccaatgggtgtcccccaagagcacgctggatgtggcgttctgggagtcggacacggacgacgaggaggacgacatgccagcgagccccgccgagaggatcaaagcattggcttgcccctgctcggccttgccggattgggactccgacgagggctggatccaagtgctcaacgagtccagcgaagcttgcgacacggcagtggccaaggtggaggccgaagggaaggggcgcgttctgatcgaagcgttggaaacgatcaacgaatcttccggtggcgatgcagagtgtgttgatcccgagggcactgtacgattgattactgttgcttccattgggcagcaggaagtgttctgcttgggtctcattaatgacccacttgtattttctgttaataaaagtgaattaacaaagtctttgtttccccaaattgtctcattttaattcttgcttctactcattttcttccactagtatatgcaatttgcaccatctgac

SEQ ID NO: 99 - DNA, 2682 bp, Oryza sativa
gggaaaaaaaatggagacgcgaattggaatataaatagaggcgcgccgcggtcaagtgctaccatccaaatcgaatccccgaaagcgttactaccttcctctccagatactggcaaattattttctttacaaatcattcgcagctagcttagctcgctttgcttgtagtggcgacttgtgaggcggaggaggaaggagatcgaggctagggagatggcgtcgttgaagtcgccggtggcggcggaggagcaggcggcgacggcggcggcggcggcggcgaagggggaaggggagaggtgcccggtggaggaggtggcgctggtggtgccggagaccgacgacccgacgacgccggtgatgacattccgggcgtggacgctggggctcgcgtcctgcgtcgtgctcatcttcctcaacaccttcttcacctaccgcacgcagccgctcaccatctcggggatcctggcccagatcctggtgctccccgcggggcagttcatggccgccgtgctgcccagccgcgaggtgcgcctcctcggcggccgcctcggcagcttcaacctcaacccggggcccttcaacatcaaggagcacgtcatcatcaccatcttcgccaactgcggcgtctcctatggcggcggcgacgcctactccatcggcgccatcaccgtcatgaaggcctactacaagcagtccctcagcttcctctgcgccctcctcatcgtcctcaccacacagatactgggctatggttgggccgggatgctgaggaggtacctggttgacccggctgacatgtggtggccatcgaatttagcccaggtctcactcttcagggcgttgcacgagaaggagggcggcgatggcgggaaggggtcgtcgtcgagggggcctacacggatgcgcttcttcctcatcttcttcttcgcgagcttcgcctactacgcgctgccgggctacctgctccccatcctgaccttcttctcgtgggcgtgctgggcgtggccgcacagcatcacggcgcagcaggtgggctccggctaccacggcctcggcgtcggcgccttcacactggactgggccggcatctcggcgtaccacgggagcccgctggtggcgccgtggtcgtccatcgccaacaccgccgcgggcttcgtcatgttcatctacctcatcgtgccgctctgctactggaagttcgacacgttcgacgcgaggaagttcccaatcttctccaaccagctgttcacggcgtccgggcagaagtacgacaccaccaaggtgctcacgagggagttcgacctcaacgtggcggcgtacgagagctacgggaagctgtacctgagcccgctgttcgccatctccatcgggtccgggttcctgaggttcacggcgacgatcgtgcacgtggcgctgttccacggcggggacatctggaggcagagcaggtcggcgatgagctccgcggcggcgaagatggacgtgcacgcgaagctgatgcggcggtacaagcaggtgccgcagtggtggttcctcgtgctgctcgtcggcagcgtcgccgtgtcgctggtcatgtcgttcgtgtacagggaggaggtgcagctgccgtggtgggggatgctcttcgccttcgccctcgccttcgtcgtcaccctccccatcggcgtcatccaggccaccaccaaccagcaaccggggtacgacatcatcgcgcagttcatgatcgggtacgcgctgccggggaagccgatcgcgaacctgctgttcaagatctacgggaggatcagcacggtgcacgcgctgtcgttcctcgcggacctcaagctggggcactacatgaagatcccgccgcggtgcatgtacacggcgcagctggtgggcacggtggtcgccggcgtggtgaacctggcggtggcgtggtggatgctgggcagcatcgacaacatctgcgacgtggaggcgctgcacccggacagcccgtggacgtgccccaagtaccgggtcacgttcgacgcgtcggtgatctgggggctcatcggccccgcccggctgttcggccgccacggcctgtaccgcaacctggtgtggctgttcctcgccggcgccgtgctgcccgtgccggtgtggctgctcagcagggcgttcccggagaagaagtggatcgcgctcatcaacgtccccgtcatctcctacgggttcgccgggatgccgccggcgacgccgaccaacatcgcgagctggctcgtcacgggcaccatcttcaactacttcgtgttcaagtaccgcaaggggtggtggcagaagtacaactacgtgctgtcggcggcgctcgacgccggcacggccttcatgggggtgctcatcttcttcgccctgcagaacgcccaccatgagctcaagtggtggggcacggcggtcgaccactgcccgctcgcctcctgccccaccgcgccggggatcgccgtcaagggatgcccggtgttctgagctcgccggccggagctgcacacggtggtgtatgtaggtagcaagaatttgggtttggattggggaaaaaccatgaattcagcctggtgtcagttaactgatacagtcctaatagttgtcagctgttacctcccgtgtgatgagtgtaacaaattggcttcctgcaaggaaatgatatagtagctagtagttcat

SEQ ID NO: 100 - DNA, 1957 bp, Sorghum bicolor
tccctgtcgaatgtctcctagagccgacctccaccgcgctctcgtcgagtcgatgaggtgattgcctcacaagggatatccgattcggtggtggcgtgctgtggtgcggttttgttgcggaagataggtgtgattttccttctggcgggcggcagctccggaggtgaagatgatccgtcttcagacgtacgcggcgttcagcctgctggcgacggcgtcggcggtgtactacgccttcagcagccgggagcagttctacccggccatggtctacctctccacctccaagatctgcttcgttctgctcctcaacacgggcctcgtcgccatgtgcgtcgcctggcagctcgtcaagcgcctcttcctgggctcgctccgggaggccgaggtcgagcgcctcaacgagcaggcctggcgggaggtcgttgagatcctcttcgcagtcaccatcttccggcaggatttctcggtctctttcctcgccatggtcgccgcgctgctccttattaaggcactgcactggctggcccagaagagggtcgagtacatcgagacaacaccttcagtgcccttgctctcacacatcagaatcgtctccttcatggcgtttctcctcattgtcgactgcctcttcctgtcaaactcgctcaggtcactcatacagaagtgggaggcatcggttgccatcttcttctccttcgagtatatgatactagcaacatcgacagtatcaacatttgtgaagtatgtattctatgtcagtgacatgctaatggaaggtcaatgggagaggaaggcagtgtatacattttacttggagctgatcagtgaccttgtgcacttgtcactatacatgctcttcttcatagctatcttcctgaactatggtgtcccacttcacttgattcgtgagctatatgagaccttccgcaacttcagaattcgcattgcagattatgtacgctacagaaagatcacttccaacatgaatgaacgctttccagatgctacagcagaagaactcaatgcgagtgatgctacatgtattatttgccgtgaggagatgactacagcaaagaagctgctttgtgggcatctgttccatgtgcattgcttaaggtcttggctagagcgccaacacacttgccctacgtgcagagctccaattattcccccagacagtggacgttctgcatcagcacgacaacatggaggtcaacctggtgttcagcctggtactgacactccagcctcagaagctgcgcaaggtgacaatatgagcaggcgccaagcaaaactcgaagctgctgctgcagctgcttctttatatggaagatctcttgtttatcctccagcaaacaccctaaataggtcaggtcctcagtctacatcaagtacaccacaatccgaagctagtaactccaatcaatcacagaaagaccaagaactccagatccaaaactcaagtgatggtttagcaccttcgccttttagcgcacatggtgccattggttcaggaccaagcaccagcaatcttgaaaattcactgcagaaggcacaggaaaactttataaagagccagatagagatgttacaaatccaacttcaaatgattcggcgcggtgctgctgtgtcggtgactaacagtgggaatgacgagcacaaaaggaatgactgaagctgtaaataggcaggcggaaatgaggacagaattaaacgacaagaattggtaaatacctagggggcaactgttacatgatgcctcgttgcccagattttgtactttcatgtttctgcactcttactgataatgtttcttttctctttgtaataccgctgatagatagaggctgtcgtgttgtaacaatggttagtttcacagtaattatgagattaaacaaaatccatctgccgataaatagaatggagctttttgatccgtgatataagatgtttg

SEQ ID NO: 101 - DNA, 944 bp, Sorghum bicolor
tcgcagcgcaccgctacagtccaaaaccaaaaccccaatcgcagagaagaggcagagagagagaggggtccatccatggcttccgccgtcgcttcccaggtggccttgccgaagcccgtcttcctcatggacatcctcgcctcaccgcccgcctccgcccgccccctcttcagcaccggagacgcgccgccacgctcctcctccgacggcgtcaaggacaccgacggcgtcaaggactccacaggcgaggacgccgccgccgccgaccgccgcccggagcgcgtccccaagctcttcaccggagacgtgctggacctgttccccgaggctgcgatccgggacctgctactggcgctggcggaggatggcggcggcgcggcgtccatgaccggcttctccccgcgcgggtcgtcgtgggtctccaaggatgatgccgacgcggtgcagctgaaggtggcgatgccggggctggggaaggagcacgtgaagatgcgagtggagaaggacaccctggtgatcaagggggagggcgacaaggactccgagggcgacgacaagaaggacccggcagggtacatctgccgcatcgacctcccctcccacgctttcaaggtggaccagatcaaggcggagatgaagaacggcgtgctcatggtgaccgtgcccaagatcaaggacggggagcgcaaggacgtgttcgagatcaaggtcgagtaggtctcctggttgcagtccatatcgtagttgcagtccatatcgtagttgcagtatactagagtagtagtcgtttctgatgcagagcagcagaacgggagggctttggctttttagcgtctcgttcctgatgtgaggcagccgtgtttacctttctgttcgtcttgcaaagtttagtttcatgtatggcgatgatcactgatgatctcgcgtgatgaacttcaaatggt

SEQ ID NO: 102 - DNA, 2850 bp, Sorghum bicolor
cccacgaggtaaaagttttttttttccctctcctcctcctctgttaaacacgcgcagcgaagcaacgcagcagcaacaaaagagacgagccttttcgctcgccgctgccaccaccctcgtcgtctcgcctccgcctcggcctccgcacgcgcgcgcgcgcgggatctcgcgcgggctcgctagactccccgcgggaccagcccgcgcgcgcacgcgcaccgaggagggcgcacccaccacccgcagggtttgggggcgggggcgatccggcggcgatggcgagccgggtcaaggaggacgagcggcacgagaagatcatccgcggcctgctcaagctgcccgccaacaagcgctgcatcaactgcaacaatttgggaccacaatatgtctgcacaaatttctggacctttgtttgtaccaattgcagtggagcacatcgagagttcacgcatcgagtaaaatcagtttccatggccaaatttaccgcacaagaagttactgcccttcaagaagggggaaatgagcgtgctagagaagtatttttcaaggaatgggatcctcaacgaaatggataccctgacagcagtaatgctgacaaattgagaaatttcatcaagcatgtgtatgtggaacggagatacacaggagaaagaagtactgataggccaccaagggcaaaggatgacaaggatgagtatagtgaaaataggagatctgatgggaattggggtggttcaagaagtccgccaaatggaagttactctgatcgtcggagttatagtggacggagtgatgacagaaattccagatattcctatggggaccgtagtcctggctatgaccaaaatgactataagaaaagtcctcgctactttgaggttgtcgatgatagatctggaaaaataactccagttcaaaggtttgaagaccggaggttttcggagcccagaaagccagatagtgggtctccagacttccagaaagaagctgatggttctagtcctgttgtacggccagtgagggatatattgggtgacaacgctcctcagcttcgggttggtgagccttcaaagccagctgctgaacctccaaagccaagtgtagtcagaccacttgatcctccaaagtcaagtgtagtcagaccaattgatcctccaaagccaaacggaaccagggcaattgatcctccgccactgacaaagacaatatctagtgccagcagcattggttcttcagaagggacatcggaacagacaaaggtggcaactgcagtgagtttaattgattttagtgcagatcctgaacctgcatccacagcaccaccacagccgacccctatgccacaacagcctccagttaatgcagcagcaccacagcctgttcttgaacaagggaagagtgctccttctgtcagcggtggtgactgggcatcttttgatgcttttggccaacaacaaacaccacaaacaagcaccagtgtaaatcctcttgagtctgcacttgcacagctgtcattctccgaagcaccctctgcaccgaatgcgtcagcttatcctgcttctcttgatcccactgtgaaagcaaatgatggaggacattcatctgtgctagaccattcacattccttgtttgatgcgccctttggaatctcaggcaaccaggcctcaacagtaatgtctggccaaggatcatcggttcaacaatctcctctagctgcccctacggctggatttccatctcaagctactgcaaatccgcaaggaatcagtggtattcaaggagcagcctcttctactgacagtaaattcagtggcaggaaagaacttccagcggatatcttcactgcactatatccaccatcaactccaatgatgcctggttggcagagagctccccaatttggaatgggatacgccatgcaatatccagctggagtgttccagggaatgcaagcatatcctcatggagcatttcctcagcctacatatcagcaacctatgtattcgcaacatgcatattcccacccccagcctgtgaaagcttcgaacccttttgatcttgggaatgagtcagctccaattcaagctcacatgcccccatctgggccaccaggagcatcagcaggcctagcttctgcaaccttaattggcaactctagttttggtgttcctccacagcagcctcaccagctctatcagtcagctgcacagccaagccatttcatgatgcagcaagttccgaacagcatgcccatgccggagcaacaacctaatagcatgcttgcaacgcaacaaggtttgggttccttcaacatgggttttgatcagcaagctcctcccagatacccgcagccaaacaccccaccttcctacggctccgttgggggtagtaatccgtttggctaaagcaagtgtggaaatacctgctctttcatctctagactaagggtctgcagcactcagcgggacagacatgcatcgaagcccacgagagaatgtgtttcatacaaccaggtggtgtattttgtcggccgtaatctgttgtacaacttgtttccaaaggcttaatgatcgaatgtaactctgtttaagagggcctaagctgctttcagcctcattccttgtatattgtgcctggcgttctgcttgaattgcatagtatgtatatttttgtgtcttggacagtatcagctactgttttagtacaagtcgtttctagtgcagttggctattcaatttaacgtggatgataagtactgtatactagatcagaagtgtaatcgtgatcaatcaattttgtggtttcttttacttgctacttcctctatctcaaattgtaagtcatctcagg

SEQ ID NO: 103 - DNA, 3182 bp, Sorghum bicolor
attcgcctcctccgccgacctccccgccgccgccgacgaggacgactccgtgtactcctccatcggccgccgcagcaccgcctaccgctcgctccggagcatccgggagatcgacctgctgcccgacgacgccgtcgccgacctccgcgccatcgcgtcccgcatggccgccgccgggtacggccgcgagtgcgcgcaggtgtacgcctccgtccgcaagcccgccgtcgacgcctccctgcgccggctcggcgtcgagcgcctcagcatcggcgacgtccagcgcctcgagtgggacgcgctcgaggccaagatccgccggtggatccgcgccgcccgcgccgccgtccgcggcgtcttcgccagcgagcgccgcctctgcttccacatcttccacgaccttcccatctccagcgccaccatctccgccgcctcagcgcccgccacgcacgacacccccttcgctgaggccgtcaagggcgccgcgctgcagctcttcggcttcgccgaggccatcagcatcggccgccgctcccctgagaagctcttcaagatcatagacctccacgacgcgctctcggacctcctccccgacgtctccgacatcttcgccgcctccaaggtcgccgagtccatatacgtgcaggccgttgagatccggtcgcgcctcgccgatgccgtcagagggatactctccgagttcgagaacgccgtgctccgcgacccgcccaagaccgcggtgcctggcggtaccatccacccgctcactcggtatgtgatgaactatagcagcctcatttgcgactacaaggtcaccctctccgagctcatcatatcgcgtccatcagctagtgcccgtctttctgctgagggcaatgagctcgcgccgtccttggccgacctcgagctccctgagcttgagaaccggttaccgcttgcctctcacattgtctggatcattgttgttcttgaacacaacctggagggcaaggcggcactctacaaggatccagctctctcgcatctgttcatgatgaacaatgtacactacattgtacacaaggtgaaagattcgccagatctctggggcatgatcggtgatgattacttgaaacggcttactggcaagttcacagtggcggccacaaactaccagcgcacctcatggctgaagatcttgaattgtctgcgtgatgaggggctccatgtaagtggtggcttttcgtcagggatatccaagtcggcgctgcgggagcggttcaaatccttcaatgctgcatttgaggatgcacatagggtgcagtcagggtggtgtgtgccagataaccagctgagggaggagctcaggatctcaattgctgagaagctgctgccagcataccggtcattccttggcaggtttcgacatcatatagagaatgggaagcatccagagctgtacattaagtactctgttgaggaccttgagatagctgtgggtgatttctttgagggtgttcctccttccccacataacaggaggagatcacatggatgaaggacttgtacctcctcatgtattcaactagctgatgttgctatttattcttttattcttcacaaggaaagctggtgctggcatctgggctcgatttctgctgtcctgatagatgtgagtataaatttggtgatcttcaatcaaagatggcaaatatgaatacattttgggatctttctgaagctgtcaatcggcccagtggttcctactctgtaagagaagttgttcatttggtacactattattatataaattttgcatgtagcatgtccatataggaaattctttcagtaacattggatagttggaactcatggcattcctgttttgcaccagcttttgttacccttttcatcgttaacaattatccgaagggtctatgcttttgtggattaggtgtaaaaagatttatatgactcttatgtaccacatgattttgtaatatgataatatcatgctgttacaaattcaaaagaaaacttcaagtcttctccatggcgcacttcttttcagctgttaaaaccaatataaagatgaactgctaaagtggcattgttgattcctccataagatacactttgttactattttagtatatgatcagtgagttaggaaatggatgctatttggaaggaatgttttcaaagtttcgattgtgtgattattttccagtacacaccactttaggttgttgtccttctgaaaggcatgtttttactagttgtgttcgtggtccctgaccctgagaagttgattgtagaaaaaaacatactgagaaaaagctataaaagagaggtcttctatgtcccaatcattttgttttgccccttcttttcttttgggatgggtcatggatgtcaaagctgtgcttatttgagactgaaaaacagatggaactaataaggaaataaataagaagaataataattagtccaaaatgtcatgcttgccatggttcttgtttgaaaaacatatgtacctgttctcaaaaatagaaaccgcataccatgaatccatattagcttgttttgtgttgttatcaggtacaagaaattactctattgcactctccatttccttctgcaggtatgggactagtgaaatgtgtttacacacctatctttatgattttgttcacttataaatgcacaatattgatatattgatgtaccaatgtgtgcaactgaaaatagcctgtccatatatattgttgctgtatatgttctggaatcacatgatccatcattgcctatgatgtaataaataaactattgaatcggaggtcaagtgttcggtgctatatgtgtaacctgccaggaacaaaaatttgatgcagtaccagctgattgcccttttgagcttataatgttcgtgatcttttgaagagtataacaatgcaagctgaaagatttgttgtcatattttttgattcgaactggccatcatatttggcagcatgtatcctggcatttttttgtatgcatatcgaattttgtatagctataatctgagtgtctagttgtctacctggccaacccttccagttgcattcttgttcgcttgagctaaaaagtgctgctgctgctgcttcagctgtagcctcctcacatgttactgtagcaccaacagagcaagtagcagcagc

SEQ ID NO: 104 - DNA, 2171 bp, Sorghum bicolor
ggcagcgtcgcgccgccgtctcccgccggctcgtccagcctcctcccgtctccgagctccgagccgttccgtgcctccgtgtccttcaacctcgcggggtttcctacggcccgggcggcccgtccttcctccgcctgtgcgctccccgccgccgcctggcctcgcctgtgaagcgccgttgtctgcctcgttcccatcgtcaactgccgtcgcggtactctgagcgggtaccgtaggagcaagtcgccgagggtacagaaaagagagagaagatgtcgtccaagaagaattactacaaggagaagatgatgcggcggaaagaggagaaaaaggtagaaccggagacacccaggtatcgcgaccgtgctaaggagcgccgtgaagatcaaaacccagactatgaacccacagagcttggttcatttcatgctgtggcaccccctggaacagatttgaggctggcagatgcacacaagatttcaattgagaaaagcaaatatcttggaggtgatttggagcatacacatctggtcaagggcttggactatgctctacttcacaaagtgcggagtgaaattgaaaagaaacctgatgcagaggatgggaaggattctaaatcaagggcaacaaaagaggatcaggcagtctctttccgcactgcaactgcaaagtctgtctaccaatggatcataaagcctcaaagcataattaaggagaatgaattgtttcttcctggtcggatgtcatttatttacaacatggaggagggaataactaatgatattccaacaactcttcataggagcaaagctgattgccctgtaccagaggagatggtaactgtcagcgtggatggttctgtacttgacaggattgctaaaattatgacataccttcgacttggatcttcagggaaggtcttaaagaaaaagaaaaaagagagagatataaaagggaagaacaatttggcaagcggtgactatgacgaagcagtaaaaccttcacaaactaatggttctgctctgaaacatcaatcagatatgccaccaccatcagctccaccccctcggaacaataatttcaatggaaaggagaaacaatcggcccctattgctagagcagacgatgatgacatttttgtcggagatggagttgattattcagttcctaacaaggaaatgagccaaagccctggttctgaggatatggaggaatcaccacataaccatcagaagcagtcctatttcactgaacccatgtatggcccagtaccaccatctgaatctgctcaggcttggcaacagccgaatgagtatgatgctgctcaagcccagatgatagctgctggatatcaaggcgattggtcaggctatgtgtatgcagaacagccattgggttatcaagaacagtatgcgcaacaaagcactcaggaatatgatgtactggctgaccctagtatatcccaggatccaaggttcatgactcaagcagacaaggatcggggtctaggttctgtttttaaacgtgatgatcaaaggcttaatcagctgagggaaaaagatgcacgggagagagatccaaattttatttcggatagttactcagagtgttatcctggttaccaggagtataataatgagatcgcagggagtgatgatgaagatgatttatccaagatggatatgggtggacgggctaagggccgtcttcacaggtgggattttgagacggaagaggagtgggcgaagtacaacgaccagaaggaagctatgccaaaggccgccttccagtttggggtgaagatgcaggacggcaggaagacgaggaagcagaacaaggaccagaagctcacaaatgacctccacaagataaacaagatcctggctcgaaagaagggtgagaaagatgggggcgatgatggcggtcattacgatgatgatttgcctagcgcaaagaaacaacgtggctgaagttagtcgatcatttttttgtttctcctagcaatggtgtaacttataatgtactagttacagcaccatgtttagctggcagctgtgttcaaggtgccactgccagcgtgaaatgtgttgacctcttgagctgaaaatatggaagaaatatgtctgtatatgtaaccttttcttgattagaaaaaggcaaagccctttttg

SEQ ID NO: 105 - DNA, 1996 bp, Sorghum bicolor
tagagatgagagagggtatttagacaagtacaacaacaaacatatatggttcaaatacaatcttgtcctgtgcttatcttccttcccctccctgttgtgttgtgatgtttctctgctccgacttctaattctgttctcttatcccctctaattctcttctcttatccccacagaggggcgtgccttcaaggaaagtcacagccacagaggagcatgtcgttgagaggtgttacggccatggagggcatgccggcgagggcagccgtgcccatagaggagcttgtcgtcgaggacctaccggaggagtagtggggagaagtttcgcacgcgagagaaaattagactaaaaccttttttgggggctttgcctggagccataggaatgagggtcggagggtggttttgagtttctatctaaatttgagagctctagtagactgtccgttgaaactctgtttttagtctaggcattcatattttgctacgccgcttatttgctgaagttgcttttattgatgttgatcttttcgctcccaggagatgaagattcaatgtgacggccggaggcaaacaaatcactcgagcaaagggtaacttttctcttttaagaaaagggtgtgtatatatatagcagtagcagagttctcccgattgcctatataagctaaaccatgccactccagtgctctggcgcatgtgccctttaccggcccagataatttcagcctcgcgaatcccactttgctgtcgaataaatctcaagaaaatcccgagatatctcatcttcctcgtctagatgccgccggaaagagaccggcccctctgcctctgggccgccaccaccttccctgctttgctgctgcatcagcgtcgcaaagggcgctgtggtccggcctcgttgccaagaccccacccgtagcgaggaggcgattccagcattttacacgtcgcggcgcccgcacgctcgcaggcaccggagcgcgaggcccgctgcggccactgggatggggtcccggcgcccccagccgcccactcgtcagcggggcgtggccggggaagtgggagccgcgcggctgccgaacgctgactgtgctcgcccggagcccgtgccgcggggcgccatgcacgcaacggcatagccggtgcacgctccccgctgcgcctcgccgcgtgccgccacacactgcccgcgccggcggtgcgctataaagcccaccacacgcggccactgcctctccgtgcaaatcggaacaaacaccagcgacaccacaggtagctagcagcctagcactagcataccgcatccacagctcccatcagccacagtagcagcttcttcgttctacctagctagactcctctagagcaagcagctatcttgccttagaccaagcaagagcttagcttgcttccctctcactttggtagcttgcaatttgctcgatcgcacacactgcgatggcaccagtgtcggaggcggctagctacctcgagctcgtccaaggcggcagcattgcctcctcgtcgggcgccgtttacgccgcgccatgggatgggcgctgcagcgcgcggggaaggatggcagagaccgacagcgacgacgatgacgacgactacgactgcgctcctgctgcctgatcgagaatcaatcgatcgttcgggtgaaactgatctgtgttcagtgttctgagataatgagatgtgctgcgcgtacgaggcgcgcggtaggcgaaccgacgaagagcatgcgtactactattactccagagtagagtacgtgtgctgcttcaagctaataaaattttttgtttaatttctactcctagtaggtacgtaggtatatatgtatttcgggtagcttaattatgagccagtgtggttttcgtccggggattaagctggagatcatgccggctaagcaataaacactgggttaattagatctatatatatatatgtacttcggatccgatgaagaaaataaactgaatctagt

SEQ ID NO: 106 - DNA, 3252 bp, Sorghum bicolor
actcgtccagtcatcagtcagatctgggtcgcaaccatccctcccctgctcccgggcgtcgcaacaacaagcgccgattcattcagttactgctgctgatacagcttccagtaggcaacaattccatccgtttctgattgctgcagagggacgcacggcaaacagagttctcaacttttccagtgcgggagaggtccccaagccgtcgtctttttcttggccggcccggaggagctcctctgccggatcgctttccttccccttcgacgctgccgcaatgccgccagcgtcattataaatcggcagcgctgaccacatggtacgctcccccaaatgctagactactgtatgcgaaagttgcaatctttttctcgtttctcctcggcaacttgccaatttggtcgtccttgtttacatcagcagcggcggcggcgcagctgaactggacccaccggacgatgctttgcccgagatccggatgctcatccagacattcatcccccatcgccatgcggatgcgctggctcctcctctgggcgctcgccgctttcgcccccgcccccgcccccgccctcgccgccggcgagatggggtacacgcattgcggctgcgacggcggaggaggcgccggcgggttctggagcctggacaacatcttcaagtggcagaaggtgagcgacctgctcatcgcggcggcctacttctccatcccgctcgagatcctctacttcgtcgcggggctccgccacctgctcccgttccggtgggtgctggtccagttcggcgccttcatcgtgctctgcggcctcacccacctgctggcggccttcacctacgagccccacccgttcatggtcgtgctgctcctcaccgccgccaagttcctcaccgcgctcgtctccttcctcaccgccatcacgctgctcacgctcatcccgcagctgctgcgcgtcaaggtccgcgagagcctgctctggatcaaggcccgcgagctcgaccgcgaggtggtgctcatgaagcgccaggaggaggccagctggcacgtccgcatgctcacccaggagatccgccgctcgctcgatcgccacaccgtgctctacaccacgctcatcgagctctccagggtgctcgcgctcaacaactgcgccgtctggatgccctccgaggacaagtccggaatgtgcctcacccacgagctccgccgggacagcgacgatgatggcgaggccgtcgtcgccgcagacgacgcggacgtcctcgaggtcaaggccaccgacggggtcaagctgctgccgccggactcggtccttgggtccgccagcgggggtggcaaggaggggaccggcaccgtggccgcgattcggatgccgatgctcaaggtcgccgacttcaagggtggaacgcccgaggtgatcaagacgagctacgccgttctggttctggtgccgcccagtgacaggaactgggcgccgcacgagctggagattgtcgaggtggttgccgatcaggtggctgtcgcgctctcgcacgcctcgctgctcgaggagtcacaggcgatgcgcgacaggctggccgagcagaaccgcgagctgctgcaggcgaggcgggacgcgctcatggcgaacgaggccagggacgcattccagcgcgtcatgagccagggaatgcggaggcccatccactccatccagggactggtgtccgtggtgcaggaggagggcctgacgtctgagcagaagctcgtcgtcgatactatggcacggaccgcaaccgtcgtctcaacgctcatcaacgatgtcatggagatgtccgccgccaaccaggagcgctttccgttggagacgaggccattccacctgcactccatgatcagggatgccgcctgcgttgcacggtgtctctgtgacttcagggggtttggattcgcggtgcatgtcgagaatgtgctgccggaccttgtcattggcgacgagcggaggattttccatgtcttgttgcacatggttggcaatctgattggtcgaatcgatgtgggaaatgtcacgttccgggttcgtgctgatgatgaggcgatggaggaccagaggtggaatccgtggaggccaagctactccggtgggcactcatcggtcaagtttgtgattggggtgaagaggcagcagaatgctgactcgccaagctcgcttgcacagttcttgcggaggccaaggaccgaggggtttgatctcaggctcagcttcagcatgtgcaggaagcttgtgcagatgatgcaagggaacatctgggcaattctcgacggccaaggactccctgagagcatgaccctggtcctgagattccagcttcaaccatcattggcgagctccagcctcggagggtcatttgatctgcaatacccatcaccaactaaccaaatagccgggctgaaggttctgctcatcgacgacgatgaaatcaacctagtcgtggctcggaagctcctggagaggctaggctgtaccgtttcctcgctcccctcaggctcaggattcatgaactccgtcggcccttcctctacctcgtcccagctcgtcatggttaacctggagatgtcaacgattaatcccctggatgctgcctcgaggatcaggcagtacaggagctcgcactggcccctggtgatggccatgacatcggagcagaacgtgtgggagaagtgcgcacagtcggggatcaacggcgtcctgaagaagccgcttgttctgcaggaagtgaaagaagagctcacgcggattcttcagaacacatgatacttacaaattattggtgggttcctttgctgcctgccaagagctctgaactctgaagtagccaaacatggcgccaccctgactgacgatgaatacgaccccactgtctagcatagcagaagaaaaaatttacaggctctcggaatacataggctgtcgagggtttctggtgtcttgcagcacaattgctggaatatggcaaatggtagtgaaatggcaaatgccgatgtgccttggtgagtctattcagatgggaattgcggtggcctgagaatgaaggagagtctgatacttagtccttcatagaaacctgggtggtggtatatgtaatggccagtagtggcaataaggctgaagttttgtaagttagctaacctggttgtaaggatctaatgtagggagttccacaattgtatttatcaccaccttttaggaatggaagaatgacccattcactgccctt

SEQ ID NO: 107 - DNA, 2350 bp, Sorghum bicolor
cttttcttcccatttgtagttctgtctaggcggaattcttctgttcttgaggggaaaaaaaaggtagcgtagaggtgagatttgtgaagtgagttgtggcactaaagagcgaaaatcagaaaaatcttgtggatacaatctccaaggaatgataatggacccccgtcctcgtgataatctcaactttggtgctcgattgcccaccccaaatccacccacacctcacatgattagcttctccctccaacagccacagcctcagttcttcccgtcatatggattccacagccacaaccacaacaaccctgctatcagctcacatccatctccaccctcagtcatgcctggctgcaccacgccaagcccagcatcaacaaccacaaccgaggcagacaatgccgaggatctctccgaggctgttgctgatgatgcagtccttgcttacatcaaccagttccttcttgaagatgaggatgaggagtcctatcctgttaccagtgtgcctgtggaggattcagtactcctcgccgctgtcgagaaaccattcgtcgacatcctcaagtctgctaaccatatcacagcaaaggcctatgaagtaaaatcctggatcactgatgattgccattccacgggaagtggaagatttcatgatgtggtcacaagtactctggactccacccaattggcccctgaaatggttcaaggggatgtagttgatgctgttcataagggtcagaagaacccacgtgacaatgacttggaggtggagaggaggaagagcaaacagtccgcattgtgtgatgaggagactgtccgagagatgtttgacaaagtgctgttgtgtaccgataagaattgtgcgttccactcaccaatgccagccgatgcacaaaacagcgggggatatgtgaaaggatctggaaatagaagagggcgaaggaagggaagatccggtgctggtgcagagcaggagccagtcgatctcacaaccctacttattcattgtgctcaggccgcggctattgatgaccacagaaactcaagtgagcatctgaaacagattaggaagcattcttctgctactggagatgctggccagagattggcacactactttgctgacgggctcgaggctcgcctagctggcactggtagcagcatctaccgttcacttgctgcaaagagaacttctactggtgatatgctgaaagcgttcaatttatatgttaaagcatgtccatttaggataatatcacactatgttgcaaatacgaccatcttaaatgctacgaagagcgtgacaaggttgcacattatagactacgggataatgtatggtttccagtggccaatcctcatgcagcggctctcaaagagatctggtgggcccccaacccttcgaatcactggtatagactttcccctgtcaggattccgccctgcagagcgtgttgaggcgacagggcgacggttacatgagtatgcccgtatgttcaatgttccgtttgaatatcaggccattgctgccaagtgggatactatccaagttaaagatctcaatataaagagcgatgagttcattgtcgttaactgcctttaccgaatgaggaacatgatggacgagacggcaacagatgacagcccgagaacaagagttttgaacacaatcagaaagttgaatccccatttgttcgttcatgggattgtcaacggtacttacaatgcacccttctttgtgacacggtttaaagaggctatgttttttttctcttcaatctttgatatgcttgaagcaaatgcctcacggatggatgaacataggctgctgatagaaagagaattctttggacgggaagctattaatgtgattgcttgcgagggtacagagaggattgaaaggccagagacctacaaacaatggcagatgagaaacctcagggcaggcttcaggcagctacctctggacagagagataatggcgagagcaaggtacaaggttagcaagacctatccgagggatttcctcgtggacgaagataacctacaaggttggaagggtcgtgtcatatatgctctttcagcatggagtacctagacttgtaaatcctagttagcttagctgacatcttcccttaatatcttgatttttcactatttcattttgttgtattatgattacgttaatgaatctgtccctcgtctaggaaccaaaattttgtaagtttgaattgactgccataaagatttttgtctgtgtgcctgacatatttgccgaatagtgtaagaggtttctctttgtccctatatatcatataggacagaagacagtagcatttttttttgggtatca

SEQ ID NO: 108 - DNA, 2600 bp, Sorghum bicolor
aagaaccccacctggccaccttccccgagcccgcgactgacggctcagcttccgcgcggcacggtcaaacggacaccgcaggcggcaggccggccgaagagcacaagcgagcaagtccaaaccggaagaggcgatcgctagccgcgagtgcggggcggccatcatcatggcggcgagcgcgagggggagcgtgtgggagatccagccgcgcgacgtggaggcggcggggctcgccgcagccgacgcggccgcgttcgtcgccgcgctccgctccgccgcggccgccgcgggctcgggagccacgcgggacgccgtgtgggcggcggttgcggcggcgggggtgctgcggccggagcacccgcacgcgctccaccagctcgtctactactccacctacgctgggtgggaccgcgacgcccggggcccgccgccgtactggttcccgtctccaattgactgtaagcaaacaaacctggggagattgatggaagcaaatggaccaaagctgttaggatcatcatacaaggaccctatatcaagtcttagccacttttacaggttttccgtagagaaccaagaggtctactggtcaatggtgctaaagcaactagcagtcaattttaaacaagaaccaaggtcaattctgagtacatcagatagatcaaagaaaggggggacatggcttcaaggtgcagtgctcaatatagctgaatgttgtctgctgccttgtccttccctgaagaggacagatgacagtacagctatcatttggagggatgaaggccttgatgattatccagtgaaccgtatgtcactgaaggagcttcgcggtcaagtgataactgttgcacatgccttagatgccatgtttgagaagggggaccggattgcaatagacatgcctatgacatgcaatgcagtcataatatatttggcgatcatccttggtggctttgttgttgtatctatagcggatagttttgcacctcaggagattggtagtcgtatgggtgtctcaaaagcaaaagcaatttttacccaggatttcattgttagaggagggaagaaagttccactttacagtcgtgtcgtacaagggacttcgtctaaagctgttgtgattcctgcaattggagactctattggaattacgctaaggaatggtgatatgtcatggaaagattttctttctcgtgctgctggaaggtcatcttcttattctccagtttatcaatctgtggatgcactaactaatatactattttcttcaggaacaactggggagccaaaagcaataccgtggacacaactttctcccataagatgtgcatctgatacctgggcgcatttggatgttcgtccatgtgaaataggttgctggccaactaatctgggctgggttatgggaccaataatcatatactcatgctttctaaatggggcggctttggctttatatcatggatctccacttggacgcgatttctgcaagtttgtacaggatgctggtgtgactgtattaggaagtgtgcctagcttggtgaagtcatggaaagctgggaactgtgctgaagggcttgactggaccaaaatcagagtactaggcacaacaggggaggcttctgatattgatgacaatctgtggctaacttcgcgtgcctcatacaagcccattgttgagtgctgtgggggcacagagttggcatcctcatacattcaagggagtcttttgcgaccacaggtctttggagcttttagtggtgcatcaatgtccactgggtttgtcatacttgatgaacagggaactccgtatcctgatgatgtaccttgcactggagaagtgggtctcttccctttgtattttggtgctagtgatcgacttctcaatgctaatcatgacaaggtttactttgatggaatgcccatttataaaggaaggcaactcagacgacatggagatataatccagaggacagtaggtgggtactatattgtacagggaagggcggatgacaccatgaaccttggaggaattaagaccagttcagttgagatagagcgggtatgcaacagagctgacgagtgtctgctagaaacagcagcagttagcatcaagccttctggcgggggaccagaacatctagctatcttagcagtgctaaaagatagatcggcccagtatgacgtgaatcttctcaagaggaagtttcagacagccattcagaagaaccttaaccctctcttcaaggtgagctatgtcaaagtcgttcctgagttcccaagaacagcttcgaacaagctgctgagaagggttctgagggatcaactagcgcaggaactctcaaatcggagcaagctatgacctttgggattgttcggccttctttcaaataaaggaggcatcgtttaccgcgtgtccattgttgatgtgttgtgttgtattatactattgtcaatgcatgtcaagatgatactacaaaattttcccctcttttgtaaaacttcaagccttatacgtttgttgcccttttgaaaagggaaccatattccagagaacgtttgtaaagggcaatacattttatctgatcatttgaaagact

SEQ ID NO: 109 - DNA, 1098 bp, Sorghum bicolor
tccccatcgaaacgcttgtggcgatcggcaagctcgcggcgcgtggcagcgggagcgtatacgaggtagaggagagcgagggcgacgcgcggatcgcatcgcagctttgggcggggggaccttgccgcggagatgctggcggtgttcgatcggtcggtggcgccgagcccggaggggctgcggcagccgggcgccgcgggtggcgacagcgcggcgtgcctcgctgatcggttcagagaggcgcgccccgacgcggtcaccgtcaaccttggcgggtccggcgccatggcctactcctccagcaaacagagccccctcctccccaggttatttggggcggtggataacatattctgcatgttccaaggcacaattgcgaactttgcggtcctcaagcagcaatatggattaagtaaaggtactaatgaggtcaacatcatcattgaagcttacaggaccttgagggacaggggtccttatcctgcagatcaagttgtgagagacattagtggaaaatttgcatttgttctgtacgattgcacgactaagtcggtcttcatggctactgatcccgatggaaacgttccattctactggggcgctgataccgatggccgtcttgtggtctctgacgacatcgatctcgtgaagaaggcctgtggaaaatcctctgccccgtttcccaaaggcttcttcttcacgacgtccggggggctgaagagctacgagcacccgatgaacgaggttaagccggtgccgtgggtggacagcaagggcgaggtgtgcggcacgacgtacacggtcgatgcaagcgccaagaaggagaccaagaccagcattccaagggtcggcagcgccgccgattggtcttcacaatactaacaatctgtttatgttggatcggagcaaaggtagcaggcgtggctatgttcatacggaagccagtcctagtgtttatctgaatagactgttctctataaatcaacacacggagtactggtttggcctttctagagttgtgtatatttaacagagtttattaaaaagatgtatatattttatgacatcaaatatatgtattatgagaatatattttac

SEQ ID NO: 110 - DNA, 613 bp, Sorghum bicolor
gtgttggtggtggggatgagccgggggagcaagctccggtggctatggcgtgcgccggcgcgggcgctggggcgggcgcgggacatgtacgtgcgggggctgacggggtgcgcgcgctacgtccccgccgacgccgggttcggctaccccgtgttcgtgccggcgccgctgtcgcggagccacagcgccgactggcggggtggcgccgggtccggcgccgacgaggacctgcgggagctggtccgcgccgcgtcgcagcgccgcgtggagcagcggcgcgccgagctgcaggccgtggccaggagccagagcatggccgcctcgctgtccatggcgcggatcgacgaggacgcgccgtgcgagttcggggccgacgccggcgacggccccggcgcgctgtacccgaggagccagagctgcgttggtgacgccgcggggaggagggcacatgcccaccgccggcacgggaaggtggtggccttggtctgacggagctgctgctgcttctggtctggctgctgcccggccgccgtcagtgacacagtgtgtgcgatcgtgtcatgcgctgtctttgatcatgtcaatactcgaaaagttggatatttttgctgtc

SEQ ID NO: 111 - DNA, 2688 bp, Sorghum bicolor
gtgcagcggttaacctattctccatcacagcaaggaaccccaggagagggaaaaagttgcgtgtggcgttttcacgaggagatgtcacagtcaacggcctttttgcaggctcgccactagcgtgtcattggtgctgcttgtgtgtatatatacacatacacacgcagtgggagtggatacagagcagttggatcgaagagaaagggctttgctttccgttttcctctccaaatggctcattagctcttgaccggaagagtgaagggtggtggtgtggtgcgggtaggggtagatggttgccactcgttggtgtggacagtgctgggttccttggagcttagcgtgaacttcagaagacgccatttccttggtcttggatcgtccggactccggagctctcactcgtgctcggcttcttcctccctgctactgagttccgggcgctggccactaggcaacagcaactgatctctttcttgattggttcttaagctctgccacggcatggaggtggaggctctggagaagaaggggcacacagcttttgccaaggcgatgaaatctttcagttcttcagaaaggtacaagcgatccaagagctattttgaggatatgtatgctacagatgctttgcgttcttcagacaaaacaattgttctacctatgccgcaagttgtaaaagctaaggtgaaaagtgatatcagtaaggaagctcaacctgggaggggagcacaaagcaccttgagaaaggagattcttcagcttgagaagcacctaaaggatcaacaggttgtgcgtggtgcactggaaaaagctttagggcctaacgctgctcaagtcaacttgtcaccagagaatccaatgccaaaggcagctaatgaattgatacgggagattgccacattggagctagaggtgaagaatatggagcagtatctcctgacactgtaccggaaagcatttgagcagcaagcgcctgcattttctccccctgatgctgctcctgcattttctccacctgatcgacgggaagcttcgaagatgtcagtgagctcacgttccgggcagctccgggaaacgcccgtggcaatgaagtcttgcaagagcagaggggatgcagcgctccggtcaagttacccgccggtgcataagaaattgaatgatccattggcagattgctgcacatccgctcgctctgatagagcgattgattcagatgtcctccgctgccagtctgcgttgtcataccgtggagttttttcgtctaggatattgccttcagaggatgatagtcttgcaagggctcttcgctcgtgccattcacagcctttctcattcgtagaggaaggagagactggtgcatcaggaatgataagcttagcagagtatctaggaactaatgtagctgaccacatccctgaaactcccaacaacctgtcagaggagatggtgagatgcatggcggggatatactgcagacttgcagatcctcccttggttcaccatggctcgtcgtcttcgccatcgtcgtcgttctcctcaactagtgcaatctctccacagtatgtgggggacatgtggagtccccattacaggagagaaacaactctggactcccgtttgataaacccattccatgtggagggtttgaaggagttcagtggaccttacaacacaatggttgaagttcctatgattagccatgacagtcggaggctgaaagaagctgaggacctgctccagacttacaagttgattttgtatcggttggaagccgttgatctgaggagaatgacaaatgaagaaaagatagcattctgggtcaacatacacaatgctttgctgatgcatgcttatctgaagaatggcgtcccacagaacaatctaaagaaaacatccctacttgttaaggctgcctgcaaaatagctggacgtaacatcaacgctgccgttatccagagcattgttcttggatgtaacacacattgccccggacagtggctacggacgctgctttacccaaggatcaaaagcaaagtgagcaaagcagggcatgagtggcgagcctttgccgttgcacaatcagagcctcttttacgctttgcgctttgttccggcagccattctgatcctgcggtgagggtgtacactccgaagcggctgttccaccagctggaggcggccaaggaggagttcatccgggcgacggccggcgtgtggaaggagcagaagctgctgctccccaagctcgtggaggcatacgccaaggacgtgaagctctcgccgcagggcctcgtggacatggtccagcgctacctcccggagagcatgaggatggccgtgcagcggtgccagcagggcggcaggtcgtcgggcaaggtcgtggagtgggtgccctacaacccggccttccgctacctgctcgctagggacctcgcgttccctcacctcagctgaccctgactgtaggtcgcgctaagcatccctgggctgctgggcatggagtagtagctagtaggtgttagtagtatatgcgtgtcatagggctagaagtagagaagggatcatgtgcagtttttgtgtggtgattatcaactgcgtagcttgtaaagatgcttttgtagatgatgaacagaagaaacaggggagaagaaatgagaagcacgtttgaccattgactctttgtga

SEQ ID NO: 112 - DNA, 1753 bp, Sorghum bicolor
ccaggagctttcacaaagctgtctccgtccacgagtgctctagctgacacctatcgccggcgtcaatggcgagctccggcgatgaagggcgcgtggtggtggacctccgctccgcggcggagtcggcggctgccgacgaggaggcgcacgccacgcctctccacgagatcgagtccctatgcatgcgctgcggcgagaacggcatcacgaggcttctgctgacgctgatcccgcacttccgagaggtggttctgatggccttcgaatgcccacattgtggtgagaggaacaatgagattcagtttgctggacagctccaacctaagggatgttgctatagcttgaaggttccgttggggcagagtgacatactgaatcgtcaggttgtgaagtctgattcagcgactatcaagattccagagctggactttgagattcctcccgaagctcaacgtggaacactttctactgtggaagggattattatgcgggctgtggatgagctgcaggcacttcaagatgaacgaaagaaagtggatcctcagaaggctgaagctatcgatcaatttttactgaagttgagatctcttgggtcaggagaggctgcattcacctttattcttgatgaccctgcaggaaatagctttatcgagaacccgcatgctccatcatcagatcctttactatctgtgagattctacgaaaggactcgtgaacaacaagcagcacttggttttctggctgaaccaccaacagaacaacctggagaggctgttttgcctgcttcagctgtggaatccaattctgatgggttgcaaagcgtgccccatggctcagttggagctgttgcaggtcgtcgcgctatagctcagggaaaccctgacgaagttgctgcagcattgtgtagatactcagcaccagaagaggttgatactttaccatcaacatgtggggcctgtggaacagaatgtgtcacgcgattctttgctacaaaaatcccatatttccgggaggttattgttatggcaacaacatgtgacatgtgtggttatcgcaattcagagctgaagcctgggggtgaaattccagctaagggaaagaaaattacactgcgtgttcaaaacgcacgagaccttactcgcgatgtcataaagtcagattcagctagcgtgaaagtacctgaacttgagttggagctttcaagtggaacgttgggtggtatggtcacaactgttgaaggtttaattgtgaaaatatgtgaggctctggagagaatacatggattccaattgggcgatagcacactggaatggaaaaagaagaaatgggaggattttaaggagagattatccaagcttctgagtttacaagagccctggactctaataattgatgatggattggcggcttcgtttgtagccccggctactgattctttagaagatgacagccagctaaccatggaggagtatcagaggagttgggagcagaatgaggaacttggcctgaatgacatggatacgtcctctgcagacgcggcttacaacacgaccagcacatgattttttttttaagttttgttgtgctgaatgtatttgttatgctagcttgtatcattatctatttactttggtaaactcccagtgtgtatactaatatcaaccacttatatttcttctgacgataaacatcgagcggcaatgcgttgaacgatgtttagaacattttataagttctgcggagcaccagcttt

SEQ ID NO: 113 - DNA, 908 bp, Sorghum bicolor
ctctccctgcctatatacgcccgtttctctctcctcgcgcaacatcggacaaccacacaagcgaggaatctagtccagtcccggcggcaatggagtgcgttttgggcgtggttggccgcgacttcgcggtggtggcggccgacacctccgccgtgcagagcatcctcgtccacaagaccgacgaggacaaggtgatggtcctcgactcgcacaagctgatgggcgcttcaggggagcctggtgaccgggtgcaatttacggagttcatacagaagaacctccacctgtaccagttccgcaacaccatcccgctctcaaccgccgccgccgccaacttcactcgcggcgagctcgccacagcccttcgcaagaatccatatatggtcaatattattcttggtggttatgataaggatgttggtgcttccctgtactacattgactacattgcaaccttgcacaagattgacaagggcgcttttgggtacggatcatatttctgcttgtctctgatggacaagttgtaccgcccggacatgactgttgaggaagcagtagatcttgttgacaagtgcattaaggagattcggctgcgactggttgtcgcgccccagaacttcgtgatcaaaattgtcgacaaggacggggcgagggagtacgcaaggcgtgaactcgtcggcgacaatgcacctgttgatgctgcaatcacagttgctgcctgaggcatgaacttgttggaagttagactgtgttaattgtgttttctcagcgaggctacttatgtaatcacaggatactggtgggggtcccacaactgttttatcaatttgagcccagacgtgtgtatttctgtttctgcactattcatgtctttgctgagtacaagtttacaactagtgtttaacgct

SEQ ID NO: 114 - DNA, 2149 bp, Sorghum bicolor
tgtcagtacactcactacatatagcgacgtagccagcacaactactggggctcacacgagtgcagttagctcatcaagagccctcgtgtgtgtggtcgtcccggccgagaaccaaccaaccggtggacatggtgttcgtcggcggcgaccgtgccatggggggcgcccctggcgccgacgccgcgagcacgatgcggttcgcgctgcacgtcatgcgcggtcggtggttcatgttcttcgcgtccatcctgatcatggcggcggccggcggcacgtacatcttcggcatctactccaaggcgatcaagacgtcgctcgggtacgaccagcagacgctcaacacgctgagcttcttcaaggacgtgggcgccaacgtgggcatcctcccggggctcatcaacgaggtcaccccgccgtgggtggtgctcctctgcggcgccggcatgaacctggtgggctacctcatgatctacctggccatcaccggccgcacggcgcagccgcccgtgtggctcatgtgcgtctacatcgccgtcggcgccaactcgcagtcgttcgccaacaccggctcgctcgtcaccgccgtcaagaacttccccgaggaccgcggcgtggtgctcggcctgctcaagggcttcgtcggcctcagcggcgccatcttcacccagctgtaccgcgccatctacggcaccgacaacgacggcgccgacctcgtgctgctcatggcgtggctccccgccgccatctcgctcgtcttcatccccaccatccgcatcatgccgcggcagcgggacgccgccgccgccgccgcgcgcggggagcgccgccagcgcgagcgcaaggccttcttcctcttcctctacgcctccatcgtgctggcagcctacctgctcgtcatgaacgtcgtcgagctggaggtgatccacttccccaagacggcctactacgtcacggccgtcgtgctcctcctgctcatcttcttcccgatcgtcatcgtcgtcaagcaagagctcaagacctaccttgcggcggcgccggcgacggcgacaacctcgtccgccaccatcgtgacgatcaccgtcgacgacgagaagacgcgggcgtcgaacaataacgtggcaccggagtcgtcgtcgcccgatcaccgtcgtggccatcatcaggcggccgtcgccgccgaggccgaggacatcagccgccgctcgccgtcgtgcttccaggacgtgttccggccgccggcgcggggccaggactacaccatcctgcaggcactgttcagcgtggacatgctggtgcttttcgtggccaccatctgcggcgtcggcggcacgctgacggcggtggacaacctggggcagatcgggcagtcgctgggctacccgcagcggaccatcagcacgttcgtgtccctggtgagcatctggaactacgcggggcgcgtcgtgtccgggttcgcctccgagtacgtgctggccaggtacaaggtgccccggccgctggcgctcacggtggtgctcctcctggcgtgcgtggggcacgcgctcatcgccttcggcgtcggcaacgggctgtacgcggcgtccgtgatcctgggcttctgcttcggcgcgcagtggccgctgctgttcgccatcatctccgaggtgttcgggctcaagtactactccacgctctacaacttcggctccgtggccagcccagtgggatcctacatcctcaacgtccgcgtcgccggacgaatgtacgaccaggaggcgctccggcaggcgggcgggcggcggggcagcaaggacctcacctgcatcggcgtgcgctgcttcagggagtcgttcctcatcatcaccggcgtcacgctgctgggcgcgctcgtgtcgctggtgctggcctggaggaccaggaacttctaccgcggagacctgtacggccagttcagggaggtcggcatggccgccggagcagcagcagcagaggacggaaaggtgcacgaggccgaggcgagtagcagcagtggtggtggtgccagtgactctgacaccaaggacactgaggccgttaatggcagcaaggtctgaattgttgacgtgtagtcgtgtactgtagtgtctctgtcagggttaattgacttgacctgaatatatgcatatttgaa

SEQ ID NO: 115 - DNA, 4163 bp, Sorghum bicolor
gccgcctcgacctcggcctcggcctcgcgctcgctcctcctcctgctgctcctcgccaccgcctcgccgtcgcgactccgcgcctgggccgccgtcgcacgcgctcggccctgccaccgcgccgcggccagaggcaggccgcgcacccgcgcggaattgttcaggggacggagcaggccgctgctgtggtggtgggtgtcgcctgccgccgccgccgcgaggatggacgccggggagatggaggacgtgcgggccgccgcggccgccgaggaggtcatcagcagcaggggcggctccgtgctcgggaagaagaccatcctcaagagcgaccacttcccgggctgccagaacaagcgcctcaccccgcaaatcgacggcgcgcccaattaccgccaggctgggtcgctgcgtgttcatggtgttgcaatgcccacaatggaagggattgctaatgtgctaaatcatatcggagcacacaagaaaggaaagcaaacccggattctatggcatagtcttcgggaggaaccagttatctacatcaatggtcgaccctttgttttgcgagatgttgaaaggcccttctcaaatcttgaatacacgggaattaaccgggagagagtggaacaaatggagtttcgccttaaggaagatattcttcaggaagcttcaaggtatgggaataagatactagtcactgatgagctgccaagtggtcagatggtggatcagtgggaatcagttgagtatgatacagttaagactccacttgaggtctatgaggagttgcaacaacaagggtacctagttgactacgaacgtgttccaattactgatgaaaaagcaccaaaggaaggagattttgacaacctggtacgtcgaatctctcaagttgatatagaaacagaaattgtgtttaactgccaaatggggagggggcggacaactactggtatggttatagctacattggtttacctaaatcgaataggagcttcaggtatcccaaggacaggctccatagggaaggtcttctatgctggaaatgatgtagatgattatatgcctagctcagaagaagcaatactcagaggagaatatgctgtcattaggagcttagtccgagttcttgaaggtggtgttgaaggcaaaaggcaagttgacaaagttattgacaaatgcgactccatgcagaacctaagagaagctattgctacttaccgcaataacattcttcggcaacctgatgagatgaaacgggaggcatcactttccttctttgtggagtacttggaacgttattacttccttatatgctttgctgtctatgtgcattcggtgagctctgctcaccaaacaacattatcagtagaagttagtttttctgattggatgagagcgaggcctgaactgtacagcattcttcgaaggctattgagaagagatccaatgggtgctcttggttattcaagttcaaaaccccctcttaccaaaattgttgagtctgctaatgggcgtccacaagatatggatgttgttgctgccatgaggaatggcgaagttcttgggcgtttaactgttttaaaaagcgatcactgcccaggcaaccacagccttaatttacctgagagggtggagggtgcaccaaattttcgggaaatacctgggtttccagtctacggtgttgcaaatcctactgttgatggtattcgagctgttatccagtgcatcagtacaagcaagggagggcgacctgtactgtggcataatatgagagaagaaccagttatctacataaatggaaaaccatttgtgctacgtgaagtggaaagaccttgcaagaatatgctcgagtacacggggattgatcgtgctagggtggaacgcatggaggctcggctgaaggaggacattttacgcgaggcagaacgatatggtggagcaataatggttattcatgaaactgacgatggagagatcttcgacacatgggaaaatgtagataatgaagctgttctgactccgttggaggtatacaaaaatttggagagtgaaggccttccaatcaaatatgcacgagtgcccattactgatggtaaagctcccaaaagttcagactttgacacaatagccttcaatgttacttctgctagcaagagcactgcttttgtattcaattgccagatgggcaggggcagaacaactacaggaactgtgattgcttgcttgctgaaactccgaatcgatcatggcaggcctattagaatcccagtttgtcaatatggccatgaagatactatttactcaactggaggagatacagcagatcacaacggtcacttgaattcagaatcatggaaacctcgcactttgacaaagctaaattctggatttggaattaatgacatcctattgctgcgaaaaattacaagattatttgataacggaattgagtgtaggcaaactttggatactgttattgacagatgttcagctttgcagaatattcgacaagctgttttgaagtacacaagagtaattaatcaacaacatgttgagcctagagttaggagggttgcattaaatcgtggcgctgaatatttggagagatacctcaaattaattgcattttcagcataccttggtagtgaagcatttgatggtttctgtggacaaggagaaacaaagatctcatttaaaggatggctgcaacagcggccggagatccaaaccatgaaatggagcataagactgcgacctggccgttttttcactgtgccgcacgagcagaaaacaacatatccacctccacaaggtgatgtaacaatggaaaccattgtcaaagctcgtagtggttctgttctgggaaagggatcaatactcaaaatgtacttctttcctggacagaagaggtcaagcagtgtgaatttccggggtgcaccacatgtttttaaggtggatggataccctgtgtatagcatggcaacacccactattgatggagcaagtgatgttctgtcatatctgggctctaaagacacaaccggaagaagcattgcacagaaggtggttgtcacagatcttagagaggaagtggttgtttacatcaagggatcgccatttgttttgagagaactagatcaacctgttgatactttgaagcatgttggcattagtggtccaatggtagagaacatagagacaaggctaaaggaggatatactctctgaaattaaacaactaggtggccggttactgcttcataaagaagaatttaatgcagccacaaatcaatgtagtgtggtaggttactgggaacacatagatctggaggacgtgatgacaccagctgaagtctacagcacattgagagacaagggctattgtatcgactacaaaagaatacctttaaccagggaaagagaagcattggctgctgatgtagatgctatacaatcattaatcgaagaatctgctaggtactatctctttatttcacacaccggatatggtggtgttgcttatgcaatggccattacctgcctgggactgggtgcagatgcaaagtttgtaatggaagaaacagcagaaacacactttgtatcaacatctcttgcaaaaaatgtgtccatcaaaactaaaacagacatagcacttaggcagggtgattaccgtgacatattaaaccttactagagtgttggtacatgggcccaagagcaaagaagaggttgacaccgttattgacaggtgttctggtgctggtcatttgcgggaagatattatgcattacaggaaagtactgcaagattgttcacatgacgacgacgacgacgatgatgaggaacactcttatctcactgatatgggtacaaaagctttgaggcgttacttctttctgatcacctttaggtcctacctatacagcaaaagatcatgtgaagcaacatttacatcatggatgaaggcaaggcctgagcttggccacctttgtgacaatctaaagctggacaaataggttatcttcatgtggtgtgattatgtagttttgtctcttccttggacaaattcacccagagcttcaaaaaggaaggagactaaaagagcgagtagagaggaagcagtggttatgggagttgtggacaatgaaagagcggcttagactgt

SEQ ID NO: 116 - DNA, 3315 bp, Sorghum bicolor
atccgactcgcgctcagcggcgctcagggcagatcttctgctccttccccactcgcgctcagcgctcaggctcggctcggcggctcccccttccgcttctcgccagtcgcctcgcgccctcgtctccgtcctccgcgcaccggccggcgacccttcgtacgcacctccctctcccctcccgcctctgctgtaccgtgggagcccggccagctgcctagggttgccgggccttggctccgccggtgccgtaggaaggcaagaaacgttgtgctcatgccacgctacgaggttcagtcatgagtgggcttctcatgagcttccctaagtgatgcttcatatgttttctaacaagtaacatctccccgatgttatccatgcactggatatatccttagaagtcagagatgcagaagtctgatcatcatgagcagaagctaacttcgccaagagggttaatccataagatacttcgtcgtacaaatagcaggcgttctcccactgcagctgatcaacaaccttctcctgtatctccagaaacaagcaactcatcaatattctcaaagcaaaaggatgctgatgatgccatcaaagattcagaaaagccgagcacacatactatcagaattgaagatgagaaatctgatttgctagggtatgaagtttattctgggaagcttacattagataacaaagcaaaaaattcatccagtgaacagtctggatctgggtctagtagcaattgctttgatgctaggctcagcactgaagcccttatatggggttctaacatccttaagcttgaggatattgtatctgtatcatataattctggtctccggtatttcaccgtgcatgcgtgtcctcttgaaaaaagatccagtggactctcctgctttatgaatcctagaagaacccaaaaggacttgaagttcgtatccacttctccgcacgaggcctttcggtgggttaatagttttgcggaccagcaatgctacataaacctgttgcctcaccccatggcatctagcaagaagcattcttctgaactcattcagtttgataccatgtttgatccttatcttaaaaaatgtcggtctccaccaaagatacttgtcatcttgaatcctcgatctggacatggtagatctagcaaagtttttcatggaaaagtggaacccatatttaagcttgcaggtttcaagatggaagtggtaaaaactacacatgctggtcatgcaaaatctcttgtatcaactattgattttagtacctgtcctgatggtattgtatgtgtgggtggtgatggaattgtaaacgaggttctcaatggtcttctatgcagagatgatcaaaatatggccgcctctgttccaataggtataatacctgctgggtctgataactcacttatttggacagtcttgggtgtcaaggatccaatttctgcagcattgtcaattgtcaggggaggtcttacaccaattgatgttttttctgttgaatggattcaaagtgggactatgcattatggcacaactgtatcatattttggtttcgttagtgatgttcttgagctctcagagaaatttcagaagcattttggtcctttacgatactttgtagctggttttctcaaattcctgtgtttgccaaagtacagttttgaattggaatatcttccagtgtcagatgtcaatgacgctgagcatacaattttggtaggacaagaaaaggtcgatgcatctgatctatatgatgatgttgttcggagatcaagagcagaatgtttaccacgcgcctcaagtttatctagcattgattcaataatgtctacaggcatgtctggggcagagctggaggtttgtagtcctcgtgcaaataatgaaccttctgaggttgttcgtgcacttgacccgaaatcaaagcgcttatcattagggagagcgagtacatttaaagaaccagaagaagtgcttcatccccactcccatggtacatctactcccaactggcgtagatctaagtcaaaatcaaggactgaaaaggcaaggccaggcttgtctgctacaaatgatgcaaaatcctctaaggttaacacagacaaagaggacacgtcgtccacaatttctgatcctggacctgtggctgtatgggattcaggaccaaagtgggacgatgaacctaaatgggacaatcaacctaactgggaacctgagacttcaattgagctccatagtcctcgtgaggacattgagcttggtctgactaaggagctggtacctagcttagatgaaagatggacagttaggaaagggcgctatcttggtgtactggtgtgcaaccattcatgcaagactgtgcagagtctgagctctcaggttgttgctcccaaggctgaatatgatgacaattgtttggacctgctgttagttggtggaagtggaagactgagattactgagatttttggtgcttttgcagtttggaaagcacatatctcttccaaatttagaatatgtaaaggtgaagtctgtgaggctcaaggcaggcccaaatacacatgatggatgtggtattgatggcgaactactccatgtcaaggggcaagttcgctgtagtttgttgcctcaacaatgccaattgatgggcaggccagtgaaaaaccttgtacaatagctgtaaatacactactctgcggactgtctgcagctctgaggtcagcccataatcttgcacctgtacaagcggcgaaccatggaattttgtccgcatccacatataagtaaatatattcagaagtcagaacagcttagctgacactcaaactccagagatgtacatttgtggttaatgagcagaaggtgctgggtgggtgctatttatccagatgtaaagccaaagcctatcacagactgcagcttgttgcgcacctcttgcttttgcctttttctcgtctgatagtatacgtctactatacaaccatccagagtgtacttgctccagaacatagtgtccacctccacccccgggtgtgtttggaggtccctgatgccggccacttgataatactcattacccctattatagggacaacataccagtgccgtgtccttgatctgtttgttgtgtttgcaaagtgtgaataagactatagaactgttgcattcccggtacagcgtagggtttcagcagaaagggttggacgatattttgtggcgatgctgcctcttttttcacgagtgtaattcttgttctttgtgatttgtgaattgtgatgatgtatgagctgtgtactaatttgtaaaccttgcctgcc

SEQ ID NO: 117 - DNA, 2372 bp, Sorghum bicolor
tattgctcgacgtttggcacgcaacctgaactcgtctcgcccgcggccgatctcctccatccgctcgccgcgccgcaatccggagaggagactacgctaggtcgagcaccacctggggctcagcgttctcgcaaccagttccggcgcagcgtccgccctctgcagccactcgccacctttggccggcgacgagcaccaccaggacagcaggttgcttcagagactaagctgatgaagcatcctaattgggtccacgttggcaaagaatcggtaactgacttaagagagcaaattctccgactcattgagcatgattctcacgatcaagaggaaaaatcacgggcagagctactggagaagctcaagagctgtaaaagagatacgctaattgaactgtgtcattcatttgatgtcattggctcaagcgctaataggaaggaggatctggtatgttttctgatggaatttattaaggatcagtgttctggtgatggcataaactctgataagaaattcaagaaaagaaggcgtgtaaaagaagacgaaaatttgtctactggtaaaccttcgaagaaaaagaaacgagaaggtgaagaggaagcagatgagaggaagggtgtggaggatataggaaaacattctgactgtgatttgatggacaacaaatatacatgtgctgatagtaagaagggattcccaaatgaacagaccaactttgatccttctgagaggataaatgactctatgtcacagaaagatggagcatcactcagcgaagcgccaattcttacagatgaacagttaataataaccacaccacctacaaagtttgttacagctgctacgggtgacagtattgacgtgaaggctttaaaagggaaaatgtcttctattaccaagaaaaaagcaactcctaaggaagattgcaaagtcaaattctgtggtaaacaggagtctaaaggagacgcaaaacctcgaaaacaggcaatcaaaccaagtaaggatgagctgagggaagctgtctttcttatcttggataccgcggactttgccacgatgacctttggagatgttgtaaaagaagtcgacaaatactttggcaaggatctgtttgagagaaagccactaataaggtgtcttatagaagaggagctctttaagctagcagacgaggctgagaagaaggaattggaagagttggaagcagcagaggcgaaggctagagctgagcaagctgccaaggagatggcacaagttcaaacagttgaatcgggtatcaacaagcaacatgtacttcaagctggtcgagatagcaacactaaagacagtctaaagaatgcaaatgacagtactaacaaaataagtatcgatggtggggcatctgtggagtctgctttcaagagaaacagctgttatgctgccgaaggttcaggcggccacaaagctgacactgatgcaaagaataaagtcataactaaggatggcaatggtgaaaaggttgccctcgcacccattgcaaacagtgattgtaccatacaactacaaggttcaagcaatgtcgtagctgagctgatgaataacaacaatgttgaaatcctagaagggtcaaaagatggcaaagtgaaaggcgctagcagtggagaaaacaatgacactgaagatggtagcaatgaaaaaaacaggagtgagaatgtcggtagcaatgcagaagctgccaatggttgtgaagctgaagagtctaacaatcatggaaataatgaacgtgtagaacacacagaaggtgacaaagctcaggaagctaaccataatgagaacagtgcaaatgtagaaatccatgctgatggagacggcgaagcaaaagaaggcgatatagatgcagaacagagtcaagcagacggtggcagcaataatacggctgaagatgctgagcacaatgagaacaccaaagttgatgatgccaattcaagcaagaatggtactgccgagaatggaaagactgatgttgatgtgaaaggcaacagcgatggcacagctgaaggaagcccgctagcgtgatgagatgggcgtagattgtaagagagttcgaataagatcccgcttatgtagattgtaagagagttgatgtagggtcccacgtgagagactatcactgatgccctaactcttgtatgatagcttatcatgcagagccatggcaagtgtaaggtctagaagcctagaacctagagatggccagattgtttgtattgtaaaatatgcacgggtctagcttgctcttgatgtgtatagcactggactactggaaacctagaccagggaatccatccagttgcgctgttgtatgttggaaccaagcaattcagagcaggatg

SEQ ID NO: 118 - DNA, 1116 bp, Sorghum bicolor
accttcttctcgcccagatccggaagttttgtgggtagaggactagggactgtgcaccagatcggtggtctggccgtggcagttgggcgattacgacggagagggatgggcctcctcgacaagctgtgggacgacaccgtcgcgggcccgcgcccggacaccggcctcggccgcctccgcaagcagcccgcgcgccccgccgccgtcaagatcaatgatccagccggggacgcttcggcgttcgtgccgccctcgccggcttcgggcagcagcgaggagacgccggtgaaggtgacgcgcagcatcatgatcaagcgccccgcggggtacccgtcgtcgccgaggagcgcggcaagcacgccgccggcctcgccactagggactaccccgcccatctcgccgtttgccgccgccggtggtcgcttcagaaggaaatcatcatccgatgcatatgagagggcaaccccaccagggactaccagccaacctcctcccttcgaagtgtgaactgactgcaccctcgcacttgttttgctccttgatgacaattaatcatctacttcacctaaggtagacagggaggagagaagatatcaagacgggaaaagggatgagttgcgggtttacctctactgtgatatattgtagatgccgctatgtgtattgttttctatctactatgtggcatatgttgtataataataatgttgaaagctcatggtgccgtgctgtgtcaataaggtgctatgtgcgtagagtggctcatggtcagggctgtgtgtgggctttgccgcagctttctgtgctgctcgctgtgtcgtgtgtgtttcctctgctgctatgtcataacggatggtgtgtggaggatggggtcatgcatgtaatgttagctgggtttgaggtggactacatgtagttttgttcaatgtctggtatgtagtagctgaagatgtttgcttgaactctctgaactgtgcgggataatgctaagatgcgggttgtcttgtcgattgtgaattgtacgcactcttatgggtgcaatggtggctacttcacaatggctcgctcattcgtgtgctagttaacagcaaataatattttcaactatggtttttc

SEQ ID NO: 119 - DNA, 930 bp, Sorghum bicolor
ccgccgctgggcggcggccatctattatccggaaagaaaaataggccgcaccttgtccgctttgcctcttcttcaaccttccgctgctggttccagaggaaggagtgcgagcagacggcagccggatggcggcagcggcgcggccatcgaatgccactctcctcgcgcgcctccgggacggcacggccatgttcgagctcctcgacgactcttcgcttgcgcatgcgcccccgtcctggccccgacttcactgcttcgccagggttgcctcctcgctgaggggtgggtggtcggcggcgctgaccaaggtggagcattacggggttcagagggtcaccggcgatggccgttgcatgtttcgagcgttggctaaaggaatggcgaaaaataaggggattcctttggccccaagggaggaggtacaggatgcagatgatttacggatggcagtgaaagaaattatatgcgacagcgagaccgagcggcaggagtatgaagaagcagttatagcaattactgtggagcaatcattgaaacgctactgccaaaggataaggcggcctgatttctggggtggagagtcagaattcctggttttgtctagactgtgtcggcagccaataattatttatattccagagcgtgagtaccatggtcggggtaatggcttcattcctatagctgaatatggtttggaattcaccaaaaatacaaagcagtggaagaaaaagacaccagtaagattattatacagcgggaggaaccattatgatttgctagtgtgacataactgcagaactatctactttttattgtccgtcatcataccatggttgtattatcattctttttatacctgtgtttgtgccctgcttttagctaccagtggaattggttcagttatcaaaatatcaatttggaaatatatat

SEQ ID NO: 120 - DNA, 2002 bp, Sorghum bicolor
accactccatctcccttccacttgcaggcattgcctgttctgttctccactccagttcttgtctccgcagctcgagaacggagtggaggagcagccgtggagggagatagggaccggaaccggacggacaggggaagaaggggacggagagtcccctctccaattcacaactctgccacggccggagccggagccggagccggcggaggaggaggaaggcgccatccactacaggcaagcgaagcgaatgccgccgttctagactcgcagatctgctccgccgcgctctgttcaccgggaattttggaggctgagagcaaagattgtagcagaagctgccgagcatggccgaggcggagaagcgccgtgccgggtagggctatctgatctcgtaggccttgcacgcggaccggcctgagcgcttcccgttcgttccgccccggctagccgaccgaccgagtggttttggtttcttgggttgggactccgacatcgcaatggcgtcgtgggacaacctcggggagctctccaacatcgcgcagctcacgggtctggacgccgtgaagctcatctccctcatcgtcagggcggcgtccacggcgcgcctgcacaagcgcaactgccgccgcttcgcgcagcacctcaagctcatcggcggcctgctggagcagctccgggtgtcggagctcaggaagtacccggagacgcgggagccgctggagcagctcgaggacgcgctccgccggggatacctcctcgtcaactcctgccaggaccgatcctacctctacctcctcgccatgggctggaacatcgtctaccagttccgcaaggcgcagagcgagatcgacaattacctacgcctcgtcccgctcatcacgctcgtcgacaatgcccgcattcgggatcggcttgagtatattgagagggaccaatgtgaatattcttttgacgaggaagacaagaaagtgcaagatgctctgttaaatcctgacccttgcacgaatcctacaatagtgctcaagaagactctgtcatgttcctatccaaacttgcctttcaatgaggccctccgaaaggaaagtgagaagcttcaggttgagcttcaaagatcacaaagcaacatggatctgggttcgtgtgaggttattcagcacctgattggagtaaccaaaactgtggaatctacaattccagaggaagaaacaaatgctaaagcttcagaaaagaagggttcaaactacagtgaatccaaaggagataatgcaaaatcgtttgatgatgacgacgactatcctaagaagcaaaaggatacctgcagcacgcaacgattttcttcacaagttccatatggccatgatcttgtctcaagtagaggatcgtacagcgatgagtggcatgcagatttacttggctgctgttcagaaccagctttgtgtttcaagaccttgttcttcccctgtggaaccttctcgagaattgcttcagtcgccaaggacaggccaatgtcttctggagaagcttgcaatgatattatggcatactccctaatattgtcctgctgctgttatacatgctgtgtaaggagaaagcttcgccaaaagttggacattgcgggaggctgctgtgacgactttctttcacatctgctgtgttgttgctgtgcacttgttcaagaatggcgggaagttgagattcgtggggcatataccgaaaagacgaaggttaccccaccgccatgtcaatatatggagcattgaacagctatatgcccgtatgggtagacctgaacttctgtaaagatattaacagaatatctgatgtcgtactgccagagtagtcatactacactatttctgtgtagtatttatgcttactgtctattgttcgtcctggtacttccatgtatatgttgggacatagcagcatagtatgtactttgtaaacacatcagttacaggccggtagagcctaacatcggttaacaccgtcagttcttggc

SEQ ID NO: 121 - DNA, 2948 bp, Sorghum bicolor
gccttagccatggtttagcggaggcgattctcatagcagctgtttccgggtggtggattttgaaggaataaagaatgatcaacctctttgaattgagcgttggagccagcgccaaggtctcctcaagagatggctctccagtgagaggaactcaatctgaacggaaggaatacgttggatcaaaggcattgactggcagcacaaggaggagctcgtccgatagatcgggtggtacgcccatgaagatgctgatagctcaggaaatggcgaaggagggggacgcaaatcagaagaccactaatgttgtagcaaggctgatggggcttgacgataacgtggatcttcctaagcatgtagtgccttcaaacaggaggagtttcccggatggccatttatctgctacaatggcaagagttaacaaccaaatttcatttgagaagcacacaagttccgccgaagatgtggagtacaaggatgtctacgaagttgggtaccaaccaccaagaggtgatgaatatccaagaaggaggccgaatgaagatcatgacaagagaaggatggatcttgtccgccagaagtttgttgaagcaaagaggcttgcatcacatgataatatcctccagtcgaaggaattccacgatgctcttgaggttctgaattcaaacaaagacttgtttctcaaatttcttgaagaacctaactctctctttacaaagcaatctggaggacacaattctgcaccaacgtcacctcagagaaagcgcattactgtgttgaagccctcaaaatcagtggagttgaagggtgacaaagcaattaaaaggatgaaaaaccatgcagtcgatggaaacagaatagaaaggagcaacgtacacaagtctgatgctgctcatgtgaaagaagataggcttcccaaacacaccaggatagtggtcttgaaacctacctcagtaattacttccacggagcaatctgagcaaaattatcatgctgatctggatgattctgaagcacctggtctatcaaggcatttgagtgatgagatagattggtcagtgcatggaatttgtcgacaccacacagaatctttgcagggttgcatacagtcaaatttgttcagcgcagatagaccataccatcggtatgctgaagaagagagtgactcggatattggaaccccaacatcacatcattcttgggagtacatctaccagtttagcaatccttactttggctctttgagccatgcttcttgctcccctgagtcacatgtaactagggaggctaagaaacatgcttctgacagatgggcaattgttccatccagtgagatatcccagcaaaaggtaccagtgcgaagaagtttgagcacacttggtgaaatgcttgccatgcctgatatgaagaaagaagaggttgctgatcaagcatctcctgacgctaatacccaccagttgtgtgaaccaacaggcggtgtatcatctaattctgctgttgatgaaggtgagggagaacgctccctcaggaaaatctcgaggtcaagatctgttccggtctcttcaacagcttttgatagcctgcggttagatggtggacgtttggatgctcaacataaagaacctacagtgccaaaggaggtcaaacctaagaacgggaaatcatctttgaagggaaaaatcacgagtttcttctcaaaacgaaagaaagcagaaaaagagaaggctaacccatctcccttgggaaccctgaacagtcgagcttcgtcagcaagtactgtagcagttggtaaatcagatgttccacaacatgtttgtactagtttacaagatgatgttgcttctgaaaatttagaagaacagtttaatcatggaccaattggagttccggttgatgaacccgaagcaccctctgtgtctaagtctccagcttcccatgagaaggcactatcgtttgagattcgaacttcccacttcgatcagcccagccctacatcagttcttgatttacagtttgaggacatcagtgagaaatcccccatttcatcagaaagtgcaattactgctaagcaagaacctctatctaggtctcttccaattggatcaattgcaaggaccttatcgtgggatgatgcttcccaagaggctccattgtgttctaccaaaggagataaccttgagcaagagcagtatgagttcgttgagaagactctaacatctgcaggcttctgtaatgagaaggtccaggacatctttgtccgttggcattcacttgactgccctttgaacccagccgtgcttgaccagctgctggaacgcaaagtggaggatgccaagtgcagagagagacggtcaaaccaaaggcttctcattgattctgtaaatgctgccctactagacattggccaaagtaaactttggggtgcatacccttgcactgcacgccattctaatgcaccgggagttgctacatgtgatgtgctagtaaccgacgaagcatggaggttagtaaagagttggctcttcgatgatgagaatgatattgctggtttgggagactatccaggccttgcagcagattgggttgtcggtaaggagattaatggcaaagggtggcctgaaatgctgcgcttggaggtggatgaaatcagcaaggagatatgcgaggaagtcctgggcgagttggtcggggaggcattttcacagcttgcggatcattgaagctgctttattttccctgcttgtggcgtccacctgttgcttttatttccaatccggtggagtccggccatggggctgatcttcaccctccagagctgttcttgtgtgtatattaccctcataactgttctgcacgctgctcaaaatgttccccactggctctatctgttcatctcttccgcattgatacattcacagtaataacatttatgaatacagctgctgcatttc

SEQ ID NO: 122 - DNA, 2209 bp, Sorghum bicolor
gccacccgtacactagtcagcccactagtcagagcaggagagcaccaccagctgacaaccaccgccgcgtctccgcagcgcgcacgcacacaggccggagaggcggcgcacccggcgaggcaagccaagcgatccttcccactctcaggctccgacccaggagatcccggcgatcgcgatggcggaccggccggaggtggcggtggactcgcgcagcggctactgcgccgcgacgcgcaccttccgcagcaagcgcgcggacgtcccgctccccgccgacgcggacctggacgtggtccggttcctcgcgtcccgccgccacgcgggcgtcgtcgcgctcatcgacgccgccacgggccgccgggtcacgttccgggacctctggcgcgccgtggagggggcggccaccgcgctcgccgcgccgccgctgtcgctccgcaagggccaggtcgcgctcatcctctccccgaactccatccacttccccgtcgccgcgctcgccgccatgtcccttggcgccgtcctcaccaccgccaacccgctcaacacgcccgccgagatcgctaagcaggtcgccgacgcgcgccccgtcgtcgccttcaccacccgcgacctactccccaagctccctctcggcgccggcctccgcgtcgtgctcctcgagcccgaccgcctcgcctccgaccctagctccgtcgtcgccactatcggggagatctccgccacgccgcccgaccctgcgcgccgcggggaccgccgcgtcacgcaggacgatccggccacgctgctctactcctcgggcaccacgggccccagcaagggcgtcgtcgccacgcaccggagcctcatctccatggtgcagatcatcatgacgcgcttccgcctcgagggctctgacaagaccgagaccttcctctgcacggtgcccatgttccacgtctacggccttgtcgccttcgccacggggctgctcggctgcggcgccaccatcgtcgtgctctccaagtacgagctccccgagatgctgcgctccatcaatgaatacggggtcacctacctcccgctcgtgccgcccatcctcgtcgccatgctggcgcaccccaagccgctgccgctcgggaacctgcgcaaggtgctctccggcggagcgccgctgagcaaggagctcatcgaggggttcaaggagaagtacccgcaggtggagatcctgcaggggtacgggcttacggagagcacggctatcggcgcgtccacggactctgccgaggagagccgtcggtacggcacggctgggctgctgtcacccaacaccgaggctaagatcgtcgacccggagaccggcgaggcactgccggtgaaccgcaccggcgagctctggatccgggggccatacgtcatgaaagggtatttcaagaacacggaggcaacacagtcaacattgacacctgatggatggctcaagactggggatctctgctacatagacgaagatgggtatctctttgtggtggatcgtctgaaggagttgatcaaatacaaagggtatcaggtgcctccggcagagttggaagctcttttgctaacacactcagaaatccaagatgtcgccgttataccgtttcctgatcgggaggtcggccagttcccaatggcctacgtagtgaggaagaaggggagcaatttgtcagagcgcgaggtgatggagtttgtggccaaacaggtagcgccttataagaaggttagaaaggtggcgtttgtgacagaaattcccaagaacgcgtccggcaagatactgaggaaggatctcatcaagctcgccacatccaaatccaaactatgaaaatgtccgagtttactgttgtcatccacgagcagggagccattctctacgctgccccaatattgtagaatgctcgtaatttgaggatcctatcggctgtgtggacctgtatagactgttctcatacgagatttggaaggaataatagtgcgtctgtaccttctttttaagagaaaggagtttcctctgcttttaagaaagctgtaaagtttactagtgcatctgtactaggcttgaataattagcataggaaataatttttttccgataattttcagtgttatatcacaagaatttttattttcatgcacggatcatcacaggtcattgccctagctcctgctctgatccttttacctcacccagaca

SEQ ID NO: 123 - DNA, 2080 bp, Sorghum bicolor
atcggacggcgactccaccgcgccaaccgatctcctctctccgactctcccccgcgcccgcggcgagaaataaaagagatccccgaccccgacgcgccacccgcaaatctcgctctcccggccgcccgcccgccgccaccccgcccgcctcggccgcacccgcacgcaatccgatggcccccgccgtcgccgcagcggggtcctcgcctcgcaggtggctcgcggcggccgtcatcgcgctcgcctgtgccctcgcgccggcggccgctaggcctgacaaggagatgcgggagaagttctacgggacgctcgtcaccaacggcacgcacaacgctaccggggacggcagcatcgccgagatgttcggccgcgtgctcgacaaggagttctccgacagcgacacgcccgacgctcctgacaagagtagcttcaacaacagcgtgtcagatcatcaagctgttctggagacagtagctgtcattacacatgacaagaagaagaatgattcgcagcatactaattccccaaaatctttccaaattggtgacatgtttggaggccaggatgagaactctgatgacttggaaactgtgatagataaagaggataatgtttttgtgatgtcaaatcgtaaaacgaagtatccaactcttcaactagatttacgattgattaaagatctagtaattataatcgtttcagctactggtggtggtatcatattctcttgtatggggcagccggttattgttggctacctacttgctggttctctagttggacctgggggtttgaactttatcaatgaaatggtgcaggtggagacttttgctcaatttggtgtagtgtttcttctttttgctcttggtcttgagttttcactgactaagttgaaagctgtaggtcctgttgctgtactcggaggtctgcttcagattgctctgttcatgttcttgtgtggcctcactgcagcgttgtgtggtgctaaatcatctgaaggagtgtttgttggtgccttcttgtctatgtcatctactgcagtggtttcaaagtttttagtggaaaaaggtagtacaaacacacttcatggtcaagttacaatcggaacccttatacttcaggattgtgcagtgggcttgctgtttgctctccttcctgttcttggaggtgctagtggcattttcggaggagtgatgtcaatggcgaaactgttgcttgtgttatccatatttgtagctgttacgtatatgatgacatggtcaattgttcctcgattcttaaaactgatgattcagttatcttcacagacaaatgaactctaccaactggcctccgttgcattttgcttgcttctagcctggtgcagtgactattgtggattgagtcttgaattggggtcattccttgctggcgttatgatatcaaccacagattttgctcatcatactatggagcaggtcgaacccattcgcaatctatttgcagcgctcttccttgcaagcattggaatgctcatacatgttaagttcttgtggaatcatgttgacatattacttgcagctgttatactggttataatagtaaagagcattgttgtaactattgttgtaaaggcatttggatacagcatcagaacagcttttgttgttgggctgtccttagctcagataggagagtttgcttttgtgcttttgagccgtgcctcccatctccatcttgttggggggaaaatgtatctactattactgggaacaactgcccttagcttggtaacaactcctctcattttcaaactaattcctgtggtaatgcaccttggcatccttatgcgttggttcccctcggaaaacagtatgcagagtgagcttccattacaggataaagcggttatgcttgaagctcacaacagatcactctaattgcctagctacaacattcttttgactgacagtgatttatttgtgcatcgactctttgcacatgccatgaaaacattggagaaacaattacacaccaaatccccttttgcggcgatatgggaacacgaagggatgggcaaagttaacagcttggccagccg

SEQ ID NO: 124 - DNA, 2025 bp, Sorghum bicolor
gtcccagattgaccaagccaaatcaaaccaccgcaccggcacggccacgacgcgtaggccccgccacgccacccgagcgatggcgagtgagtcgtctcccccagctcgacgcgctgaaaattgattcctccactccggccttgcccgccgatctccaggctgtcccccaattacctccaacgccatttcggcgctctcccccctcccacagctcaacaaatcgcaacccaaatccacctccgacctccccgtccccaccgtcatggctcccccaccaacctcgcgccgtctcaccctcggcctcatcctcatcggcgccctctgctccgcctccgtcgcagcgcggttcgccccggcggacaaccacctcctcgcgtgcggcgcggcggcgcccgccgtcctccccgacggccgccgcttcgtgccggactccggctgcgcgtccacccgcctccggtcctcctccccgtccctctcctccgcggcgccgcccggctccccgccgccgccgtccccgctccacgcctccgcgcgggtcttctcctgccgcgcgtcctacgacctctccgtccgccgccgcgggcaccacatcctccgcctccacttctaccccttcgcccccgccctcgccgcgtcccgcttccacgtcggcgccgcggggctgctcctcctccacaacttcacggcctcgtcccccgtcgtcaaggagttcatcctccccgtggactccgacgttctcgtcctcaccttcgtccccgactccggctccaccgccttcgtcaacgccatcgagctcgtctctgcgcctgaggagctagtcggcgacatcggcaccttcgtcacgtccggcggcgccgcgcagatccacgggctgtcgtctcaggtgtttgagacgctttacaggatcaacgtcgccgggcgcaaggtcacgccatttaatggcacactgtggcggacatgggttaacgatgagaaattcctcgtcgacaccgactcggccaactacagggtgtggtcattcagcggccggattgcttatcccaagggtagcaggcagatgaccagggaggtggctcccgacaatgtctacaacactgcgagatcggtgaagccaggggccaatgtgacttggggtttccctgtgcctgctggcagccggtaccttgtgcgtatgcacttctgtgacattgccagtaaggcgctgtatgagctctacttcaatatctacgtcaatggtgatcttgcagtcaaggattttgatctctccagtgtcaccggattcttggcctatccttattacattgactttgttgtcgatgtgaaggatgaagggatactgaaattggcgattggtggcttgaagaagagtctatctgatgaagtaagtggcatccttaatgcactggagataatgaggatgaacaagaccagtggaggtatggatggagacttcccaattgatctagacatggagtatgtggtgggtaaggggattggagaatttgcccgctccttgctctgtggtttcatctttgctgggttgtttgtggctttggtcatgcgggtgctgagattgaggactgagctgaggaataacggtgcagcttggtcctggagaccgatggactccagtgaagggaaactggccagagcatatcaacttgtgcctagtaagacagactattgaatagtgcaagctgaacatctttgaggagtgacaaactgcggctgttgtatgtacctaatcacataatacttttatgaagttgtaagtattgtagttttatcacctctctaaaagtattgtagttttgcatcatcactcctttcatgcttgaactttgtgatctccgtgctttgctcattatgctgtaaaagtactctaccctagatgtggctgtattgctgttacctcacttattcagtttgatttctgacatacacttgaatggatgcttgtgatatctatagtgttgattatgatgttgtggattcacatctgaattacattataattagtttcca

SEQ ID NO: 125 - DNA, 2057 bp, Sorghum bicolor
gaccctagaactagaacaaccaccacaccacaccccgcctccctccccgcccgcactccaccacccgcgccgcgccgccgcctctgactccgcctcggccgcctcggatccggaccgagcgccggcgatggcgctcgccttcgacgagttcgggcgccccttcatcatcctgcgggagcaggagaagaagacgcgactgcgggggctcgacgcgcagaaggccaacatcgccgcgggcaaggccgtcgcgcggatcctccgcacctcgctcggccccaagggcatggacaagatgctccagtcccccgacggcgacgtcatcatcacaaatgatggggcaaccatcttggagcagatggatgttgacaaccagattgcgaagctgatggtggagctgtcccgtagtcaagactatgaaatcggggatggtactaccggcgtggtagtcatggcaggggcgctcctcgagcaggctgagaagcttctggaacgtggtattcaccccattagggtggctgaaggctatgagatggcatcaagggttgcttttgatcacctagaacgtatatcccaaaagtttgagttcactgctgacaacattgagcccctggttcagacatgcatgacaactctatcctcaaagattgtcaaccgttgcaagcgggcattggcagagattgctgtcaaagcagttcttgcggttgcagatttggagaggaaggatgttaacttggatttaattaaagtagaaggcaaggttggtgggaagctggaggacactgagcttgtatatggaattattgttgacaaagatatgagccatccacaaatgccaaagagaattgaggatgctaagattgccatcctgacttgcccatttgagcctccgaagcctaagacaaagcataaggttgacattgatactgtcgagaaattccagacactgcgtgagcaagagcagaaatacttcgatgaaatggttcagaagtgcaaggatgctggtgcaaccctggttatttgtcagtggggttttgatgatgaagccaatcatttgttgatgcacagaaatctgccagctgtcagatgggttggtggtgttgaattggaattgattgccattgctacaggaggaaggattgttcctagattccaagagttgagccctgaaaagcttgggaaggctggattagtcagagaaaaagcatttggaacaacaaaggaccggatgctttacattgagcagtgtgccaattccagagctgtaactattttcattcgtggtggaaacaaaatgatgattgaggagaccaagcgtagtcttcatgatgctctttgtgtggcaaggaatcttatccggaataactcaattgtgtacggcggtggctcagcagagatatcttgttcaattgctgttgaaactgctgcagatcgtcaccctggagttgagcagtatgctatcaggtcatttgctgatgcattagatgctgttccactagccttggctgaaaacagtggtttgtcaccaattgataccttaaccgcagtaaaagcccaacaagttaaggagagcaacccccactgcggtatagactgcaatgatgttggcaccaacgacatgaaagaacagaacgtcttcgagacccttattggcaagcagcaacagatcttgcttgccactcaggtggtgaagatgatcttgaagatcgacgatgtcatctcaccgtccgagtactgacgaagtctgaaggaaaaaggaagggatggctatgctggatgacagttcagtaggcagcattgctgatgtgacattggtgtactccgtatccaggcttgctccatgtatctcgtgagctgcctgcctgcctaccactttttgtgtgaccgtttgtggaaattgtttgtatttcacgatgagtatgcgtatggatgtagtctagactctagacaacaagttttttgtgatggttgcagtattgatacttttgtagtgttttcgccacttggctgaagctatcttttttgtttgatgcatggatgcaatagttcgacgccctcat

SEQ ID NO: 126 - DNA, 2567 bp, Sorghum bicolor
caccactctgctgctcaaaacgtagactagagtagctctgatgatgaagcacccaattgcaattgcaaggcttctctccatccgtcgtcttcttcttcttgtcctgcagcagctctgcctcctcgtcccgctcgtctccgttctatccgccgccgcagccgtcccgccgccgccgccggcgcaccggcgtccagaaggctgcccatcgaggtgcggcgacgtcgacatcccgtacccgttcggcatcggcgatcagtgcgccatcgacggcggcttcgacctcagctgcagtcttgtgaacggcacccactacaggcctttcagcgggccgttcgaggtgaccaacatctccatacccgacgccaaagcttggacgaagatgaacatctcatggcggtgctacgattctcgcaccaacccgacgacgtggtccacgaggagagagaacttcacacacacgcccttcaggttctcgcaccaggataacaaaatctttgtcgtcggatgcaacacgctcggctatatcaccagtgaatattatagcataggttgcttgtccgaatgctacaataaaccgaggaacatgagttcgtgctctgttggcagtggctgctgtgaggcggatgtcccaatcgacatggggtatagtcgatctttcttcaatccagagtataactacactggctgcggctatattgcagtgatggaagagaagatgttcagctatagcacgacgtatagggactcatcaacatcgttttttgatgcatacaacggcacagttccagttgtaatggactggaggattagacggtacacatgcgaggaggctaaattgaacatcagcagctcatatgcatgcattagttacaatagccaatgtgtcaacaccaccaacgggccaggctaccgctgcaaatgccaggacgggtatcaaggcaatccatacgtcagggatggatgcacagatatcgatgaatgcgttcaggataatatgaatgactactgcacggctagaggagcgacctgtcaaaatacacaggggaactttacatgtttatgtccacctggaaaaagtatgacgaatggcatctgtatggcacatcacaagtcctcttcttggctgatacctgtcgtaggcgcaagtgttggcctagttgtccttgtcgttaccttaacctgtgcatacttgatacaacaaagaaagctacatcacaccaaacagagatacatccaacagtacggagatatgtggatttttgagaagatgaaatcacaacaaggtttcaaaatattcacagaagcacaactccaagaagccaccaacaagttcaatgaaaaacgagtgctgggtcatggaggacaaggaactgtgtacaagggacttgtcgaaggcaacgtcgaagtagctgtaaagaggtgtatgtccgttgatgagcagcacaagagagaattcggcaaggaaatgctaatcctttctcaaatcaaccacaagaacatcgttaagctactcggttgctgcctcgaagtgcaggtcccgatgctggtgtacgagttcatccccaacggcacattgttccagctcatccatggaaaccatggcaggcagatttccttggcaattcgcatacagatcgcccatcagtctgccgaggcgcttgcctacctgcactcatgggcatccccaccaatcttccatggagacgtcaagtcatcgaacatcctcatagatcgtgactacactgcgaaagtctcagacttcggtgcttctatcctggcaccaacagatgagtcgcaattcgtcacatttgttcaaggaacttgtgggtacctagacccagagtacatgcagacatgccaattgacggacaagagtgatgtgtacagcttcggggttgttcttctagagctgctcacacgcaaaaagccattcaagtttgatgggcctgaagatgagaagagcctagcggtaaggttcatttcagttgcaaagcagggaaagcttgaggagatcttggacgatcacatcaagaaagacgagagcatggaggttctccaagaggttgcagagctagcaatgcaatgcttggagatgtccggtgcaaataggccgaccacgaaggaagtctccgagaggcttgatagtttgagaaaggtgatgcaacatgcacagcagcagcacaacaaccctgaggagatggagcccttgcttggagagtcatccttggcaagctctgatgaggtggttgtcagcactggaaatctaagcattgagatggaagctgccaggagtctagaacggggacgttgaccacaaattcaccgtctagtaaagtagtaatctcaaagtgtgtatgatatattaatatcatatttacctacgtacgtatatatacatggttagcaataataattttcactgttgtattaatgatttcgcacacgagctttgtgtgtgtttgtactgctgttttggcaatttacttgatgtacctgttgtcttcttgttgttactggttgtatatatattgtccatattgagtataacttaataatcatctatgtcc

SEQ ID NO: 127 - DNA, 1173 bp, Sorghum bicolor
gacgaagcagcaacaaagatcacacgagctccgcttactcgacgacccactgcactcgcctccgatcgatcgatccggcgatcacactagtcgagtcgactcgactcgagcgagcgcgcgcccccgatcaatcaatggcggccaaggtggcgtcgccgctcgcgttccgccgcgacgtgcgtggcccgctcggccggcctcatccgagcggcggctgccggagcgggaccgggatgccgggggtgctgtactggagcagcggcgccggcggcagcagggtgctcgcggcgcgggcgcgcgggcggaacaggttcggcggcggatcagggcggacggccaaggacgaggcggcggacgaggacgaggaggaggtcgcggacgtggtgatcgtcgacgccggggacgaggaggagttcgcctccgacgagctgtccgggttcaggggcctggttcttgatctctcctacaggcctgtcaatgtcgtgtgctggaagcgcgccatctgcctggagttcattgggaaggccgatgtgttggagtactatgatcagaccgtctcttcgcctagcggatccttctatatccctgcagttttaagggttccacagttgctgcaagtagtaaagagaagaagagtcaagcagagcctaagccgtaaaaacattctttacagggatgatttcacctgtcaatattgctcttcaggggacaacttgacaattgaccatgttattccgatttcgcgtggtggtaaatgggaatgggagaatttggtgactgcctgtgccagatgcaactccaggaagggtcagaagacaccggagcaggcaaacatgaagctgcttaagatccccagggcgcccaaggagtacgatattatggctgtgcccttgacaaaatctgcattcagaacgctcaagaggaaccatgggcttcctgaagtgtggctgcagtacctttccagaccatctccatgaccaaaactccaagagcctcctgatcttacgggccagcatctcagtgtatattaacattatactatgctgcgcacagccaaagactgcagatcctattctgttcaaagctctgtacatgaaaatagtataagaaataagaattgctgtaagctggtgcagaaccagcctaacaactcaaatctaatttaatttatct

SEQ ID NO: 128 - DNA, 522 bp, Sorghum bicolor
gctacaagccaacaaaccaaggtccgcccctaacaagcagttcccaaagctacaacttgagcacacacataagcaaagccatggcaaaggcacaggcaatggccgcgctgatgctgaccgtcttggtggtcctggcggcgtctgccgagatggcgcacggcgtctgcaacctgtcgagcgccggcatccgggcgtgccagccggcggcagccatccgcaacccgacggagcagccgtcggccgagtgctgcgccgcgctggcgggggccgacctggcgtgcctgtgccggtacaagaacgccgccggcgtgtgggtgaggttctaccggatcgacatcaaccgcgccatggggctgccgggcaagtgcggcctcgccatgccagccaactgctgaggcatggtcaccgtgcgtcactggctcatccacaataatgcaatgcaactgctgatgccgcgcgcgcgtgctgcgtgcgtattctactgctatatatagctacgacatctatcgaataaatgaaggc

SEQ ID NO: 129 - DNA, 619 bp, Sorghum bicolor
ctctcggtcgcctggtccaatgcaactccaatccagcatggcgtctctggccctccaccccatcatcccggccaccgccgcttcatccacgaccctcgcggtcgtcgtcggctcccgccacgccgccacactccaccgctgctttcgcccgcggcggcgcctcatcaccacctgcaaggcggagccgagcgggggcaacagcaccgtggagctagccgcaggggccgccgggctggcatcgagcgcggtcgtggcgtggtccctctacacgctgaagacgacggggtgcggcctccctccaggccccggtggcgccctcggcgcggcggagggcgtcagctacctcgtcgtggcgggcctagtcgggtggtcggccaccaccaaggtgcgcactgggtcgggcctcccggctggcccctacgggctcctcggcgccgctgagggcgttgcctacctcaccgtcgcggccattgccgttgtcttcggcctgcagttcttccagcagggatccatcccgggtccgttgccatcagagcagtgttttggctgactctgtaactcattcggttgatgtttgttaccgagtgtacgctgctatatgctactccgtatctgttta

SEQ ID NO: 130 - DNA, 674 bp, Sorghum bicolor
tagtgcttatcctgttggtattcttctatacctcccttgctctcgtccctcccattgtacctgcagtgcagcccatcatactttagatcatcatggccaacgccttgctgctcctcgtggcgctgctcgtcgccgggtgcgcggctctggcttcggccacgtcgtacaccgtcggcgacgggcagggctggacgaccaacgtcgactacagcacctgggccagcggcaagagcttcgccgtcggagacaaactagtgttcaactacatgagcaaggcgcactcggtgacggaggtgagcaagagcggctacgacacctgctccggcgccaacccgctgagcgacgacgagagcggctccaccgtcgtcccgctccagaccccgggaacgcactacttcatctgcaacgtccccggccactgcgcggaaggcatgaagctggccgtcgccgtctccgccacgccgtcttccgcggggggcgccctgctgcaggtcccggcgatggcctccgtcgtcgccgcggcggccgcaggcgctgcgatcaagctcgcgctcttctgacggagcacggcggcgcggctatggatcgtcagagtcgtctcagggtagagacagtgcatgcagttggctatgttcttggacgttgatggttcgtgtaatcggtgattactgtcc

SEQ ID NO: 131 - DNA, 1979 bp, Sorghum bicolor
tatcgccataacctttggcatctttctctcgggccactgcaaccttgaagtggtccgacactacttgtggtctgccactcatgaagcatgtgaaaatgaagcgcaaagtgaataggaacaaattagagccaacggtcaggcaacaagacatgagcatctgaagtactcaatccatcccaaatttgtgcacaccacacacgggcactgcgctaaagttagcactagcagatcggccggacgacagtcctagccagtagctagctagcaatggttgaccttcgtctccaggtcgtcgccaccgtcctgggcatggtggccctggcggccgctgccggcggcagcagctccagcggcaagcagtccgagttccaggaggtcaccgtggacgccatccatcagggcttcaagaacggcagtctcacctcgacggcgctcgtccggttctacctggaccagatcgcccgcctcaacccgctactccacgccgtcatcgaggtgaacccggacgcgctggcgcaggcggcgcgcgccgacgcggagcgctcggcctcccgcggccgctgcgccgtcggcctgcacggaatccccgtcctgctcaaggacaacatcgccacgcgcgacaggctcaacaccacggccggctccctcgctctgctcggctccgtcgtcaggcgcgacgccggcgtggtggcacgcctccgccgcgccggcgccgtcatcctcggcaaggctaacccttccgagtggtccaacttccgccccgtcgagtccggctggagcgcccgcggcggccagacgctgaatccatacgttctgtccgcgacgccatgcgggtcgagcgccgggcctggcgttgccgcggcagccaacatggcagcggtgacactgggatccgagaccgacggctccatcctctgcccatcgtcgttcaactctgtggttggcatcaaaccaactgttgggttgacaagccggtccggtgtcatccccatcactcctcttcaagacactattggaccaatgtgtcgcacagtatccgatgccgtccatgtgttggacgtcattgtcggctatgacgagcttgatgctgaagccaccggagcagcatccaaatacatcccgcacgggggatacacgcagttcctgaggatccatggattgaagggcaagaggatcggtgtcctcgacgtgttctttcaaggatacgatgacatgcaattggcggtttacgagaagcatctcgatacaatgaggcaacaaggcgctgtcgtgatcaagaatcttgacattacaacaaatttcactgatctgggtgagcaagagattctgctcatggctgcagagttcaagttaagcatcaatgcgtatttgtcggacctactgtactccccagtccgctcccttgcacagatcatagccttcaacaaagcacatcctgtagaggagagactcaaagattttgggcagccagacctgattgccgcggagaaaaccaacggcattggcaccagggagagagctgccatccagcggctcaaggagatatccaccaacgggttggagaagctgatgaaggaacaccagctggatgcgatcgtggcggccaacagcgacgcctcctctgttctcgccgtcgggggctatccgggcatcgccgtgccggcagggtacgacaagcagggagtcccatttgcaatatgctttggtgggctcaggggctacgaaccaaggttgattgagatcggttatgcgttcgagcaggctaccaaagtcagaaggccaccaacttacaagagctagcaaacaagattgtaactagcatgatggcacgccataaggaatttaattgaaataattcagtggaaacaagcaccttgaaaaagctttttggattgtttttatttgaacaatcacttgatatacaatagaattattcattgtgagaccatttcataattttttggttggatgaacccatc

SEQ ID NO: 132 - DNA, 488 bp, Sorghum bicolor
ccgctctatatatacatacaagcgcgcgccgcgcacacgcaagaagaacagtggttgttggattggagagtgcgcgatccagctagcgggccgagggagccagcagccaggaggagcgagcgggcgagcgatggtgttcttctgcttcctggtggaccagcggcggaaggtgcggagcagcaagccggcggcggggatctgctcgcgctgcggcgggtgcgctagcgtggcggacatggagaccgccaccagggtctgctacctgctcaccgtgcaccgccgcacctggcgcgccatcatctgcaccttctgcggcgccatgctcaagtcctaccgccactacaggctctactgatcagtcccgatcgatcgtgcatcgagatcgagcgctggtaattgtgctattaccggtagatcgagtcggtcagtgtgtaacatcccagattttcacgaaaaccaaaaatacgagttttttttaaaattttttt

SEQ ID NO: 133 - DNA, 684 bp, Sorghum bicolor
aggactgccatagcttcctagctagcactgagtagctagtactagctagagcacagtagctcaaaagccagcagccatggccacggcagccctgacggctccgaaggcggcgctgccgccgaggggcccggggaaggagcaccggacggcgatcacggtgccggagttcaagcgctgggtgaagcagttcgacaccgaccacgacggccgcatcagccggaaggagctccgggaggccatccgccgccggggcccgtggttcgccggcctgcgcgcactgttcgctgtccggcgcgccgacaggaaccgcaacgggttcgtggacgactccgagatcgagggcctcatcgacttcgccgagagggagctgggcttcaggatcacaacggaatgaacggcggcgcgatgagctagtctgtcgtctcgtctgctccgatcctctctacagctacaggtcgccgacgacgtacatgccggcgtatattgtactgtgtactgtattgacgtaattacgtgacacgtacttgattaattatgtacggtctgtgtagttttttctctctcgctgtgtagtgctagcgcactgtactagctagctagtagttttgtttttgtttttcttttttcagtgtgtcatcgtacctagtagctgctagctccactttctcctctgaataatttgtg

SEQ ID NO: 134 - DNA, 617 bp, Sorghum bicolor
tcgaagactcctccgaatccgagggctcaagcgaccgacggcgagcatggcggcagacggcggccccgcgacggcggcgctggacgaggccctcaagcccttccaggaaagagcctccgaggctgagatacgcatagcaaagctggaagccttgctgtacaacaaagatgatctgagccgtggatctgaggcaacttcctctgccgtgaaggatcttcggtcaaagctggatgcggctactgcagaatgcttgactgaaaaagagaagaacaagaagctaatcatggagaacgagaagctccagtaccgcatgacccatcttatccgtgcaataaaagaggcagaatcaagataggagcagcctgacgaggcctatgttgaagtgtccccatcttgttgatccttcacgttattcctgaatttacaatttagcttaagctattgttgtgatcctgatatagatcttggttgaaactgtgtcaaactgtcgattggaacgatgatatgcacactattgtctgttttgacctgaccccaacttgaagggcaggtgactccagcattgaacattggcatgcatatactgttatctgaaatggcaattcatatgttaaaca

SEQ ID NO: 135 - DNA, 2939 bp, Sorghum bicolor
ccgcctccgcgtataaatatttgccgagcacgcgccatgacctcaccctccgctctccccgccattcttttttctattgctcccccacaggccacaggccacggccccggcctctccacacgcgtatccacggaggcggcggaggagctgccgctcagcgatcgaactcggcgcgcccatcccgcctccccttggcgaattgttcggccgggtaggcggccccgcaactaccgcgagttggaaggcgtataaagcgacgcactccggccggggaattggagttggaggagcagttggcgacggcacgacgacggacaggagcaacgaagggaaaggagacctcagaggcagccgtagcgttctccgatcgttgacagctcccgttctcttctccggatgtcctgggggcctaccggcccatggaaaattcagacgccagagcggttcgccgcgtgagatgccccaggtgcccctgcgttcttgaggagccccgcgctccggtgtaccaatgcggtggatgcggcgctacccttcgagcaaagaaccgcaccggcaccggcagcgcgggagacgcggccacggcgtcgccgtcgcggagcggtctgcctcctcggagcaggcacctggacgccagcgacgtcgcgagcaccagcaggtccagcaccccgactcctcctcatgtcgcgagcaccagcaggtccggcaccccgccccctcctcatgtcgggaccagctggcaccgagccaccaccgacgcgacaagcagccggcacggttccggtgatctcgctctcgtgtcggccgggacgcgtgcgtccggtgacgtcgcgagcaccagcagtactcctgacgccaccgcgagcagcaggcgccaaggcaccgacgcgacgagccggcgcgggtcgggtggtcctgtgtccgccgcgaggagccgtgcctccggcgatgtttccagcaccagcagcacccctgacgctagtgccgccatgagtatcgggcgtccgggcgcggacaccacgagccggggcgagtccggtggcccggcgaggaatcgtgtccctgagcaagtggcactgatcgagaagagaagccgcgaacagatcgcggtcggtcaggaagtccgtgacgactctgaaggctgcggaccaagtgatgccggtggtgcagagtcgggcgtcggtggtgccggcttctccggaggaaacagagaggccactcctgaatcgcaggatgacacagagaaggggatgaaacgccaggccgaatcgaccgatgctgcgagaaagaaacattctggtgaagctgctgtgcagccgcagaacccccatgaccgtcgccaagaacttgcgccgaagtcatcagctcaacccgcagctgctcaacctgcacgggatgatgccggcgagaaggcgcggagtccatctcgccatgagattcaagaagaacatctggggcccttgcggaagaagattctgaagacggtggatgagctgaaaggcgacctctctgaacttttcaccaagtccccagagctcaaccagccacgcgcgcgccctgctcgtcttccaaagcaagaaggctacgtgtctcgtgcggcggcggcggcggcctcgggcttccctgccagagctcgtcacgccgctgctgctaccgacggtcaccgtggtcaccatgtcagcgcagctcgtgcggtgaagccccgtcaagccgctgctcctccccgtggccttccgtcacggcgctaccgtcagtgcagagcacacccgtgctgccatgacgtggagccgaggccgtgccatcacgggcacggctgctgccgccaccacggcaaaccggagtgcagcagctgccgaggatactgctgcaggcccagagcgcaggagccgtccgcgccgcggaagccaccggcaggcaaggagcccaagcggcgcctgccgccccgcaaccactgccggccggtgctgaagggcgcgccgttcatcgtctgctccagctgcttcaagctggtgcaggtgcccgccgacttcgccgtctcgaccaggacagtgcgcaagctgcggtgcggctcctgctccaccgtcctctcctactcctacagggacccggccaggaagaaggcctaccaggactccgtcgaccagtgcagcatagacggctccgagctgcacgtcggcaaaggcgacgaacgatccgacccgttcgcgccgttcatcgatgccttcgggctcagcagttactcgacggaggacgaacagcggctgcccgtctcgaggaacacgtcgttcgacaccctcgacgggacgaaaggcgtggggcggctgcatcgactgatggggtacgggtcagctagcgagctgctgcggcactcccctgacctgtacgagagcttcagcgagcggacgacgcctgacgtgagacagcacgacaggaaagggaaaggcgtttgcatcgacgacggagacggcgacgacgactacgacgtcgatgactcggatgaggaagacattggtgcgctgaagagatcagcgaggaaagggtccggttgggcgctcccatggatgcccggcaaggggactccagcagcgggagccatcaggatcaagtaaatagcagcaaaggcttgtgtatattgcaggaataggttcaggttttggaattcgaatgggaattcttcttattataggtatatatagtttgactattcattttaggtgcggtattggatttataggctgtttgtttgccattttttgaagcgtgacaatgctgtataatgaaatgtgtaaatatccagcattgagagtctgagaaagaataagcatcatggccttgtttgggaacaagaaatttcaaggtgcctgatgaagaaacacaagtgtataagaaagtaaaatttccagtatcttttttcaaagataatattgccgtaatttgaaaaa

SEQ ID NO: 136 - DNA, 1654 bp, Sorghum bicolor
tcagctcgccgccacgcctccgtcctgtcccgtgccttctggcaccacctaccatggcgacgctcccgagcgccagccggtggtcgtcgtccaccgcgtggccacggagggccgctggagcggcgtcgacggcgctggccgccgccgtcttcgcggtcctggacgtcgccgacgcgctcctgtgcttcgtgtacgccctcctggatggcatcctcgaggacagccccgtgcgctgctactgccacaggagctacgacgaccaagtggatggcggcgaccacgagcacgaggaggtctccggtacgctgtacgcgcgcggccggaggagcgccgtcagggacgcgatcctgtacctcctgcgacacgtcgtcgggaggaggggacgggcgccgccagatgagacggtggcgccgtgcaagtggcgcagccccaggtggtcagactgcgcgtgcaagtcgtgcgtcgcatggcggggcggcgaaggcgaaggcggcggcggcggcggcgaaggcggccggcttcacgtcgtcgtcaaagagccgcagccgtatcgaaaagatgcaggaagaaaacagagtgagacgacgaccactcgtgaccccgagaacgccatcttcgtgcacggcttcacgtcgtcgtcgtccttctgggcggagacggtgttccgggagtcctcctccgtcctccacgactacaggttgttcgcggtggatctcctcggctttggccgcagccccaagcctgcgaattgcaagtacagagtgagagaccacgtcgaggcgatcgagaggagcctcggcgagccgccgcagagcctgatgagcggcagcggctccttccacctggtcgcgcactccatgggctgcatcatcgccctcgccttggctgccaagcacccgacccgagtcaaatccatcacgctcgttgcaccgccgtacttcctggcgtgcgagcagaagcaggcgagccaggtggcgctcaacaggctggccgagaagaagctgtggccgccgctgctgttcggctccgcggtgatgtcgtggtacgagcacgtcggcaggaccgtctgcttggtcgtctgcaagaaccacctgctctgggagtggctcttcagcctcttcacgggaaacaacacgggcgtggatttcagggtgagggatctgacgaagcacacccaccactcggcgtggcacaccatgcacaacgtcatctgcggcggggcggcgctgcaggacacgaacctggaggccgtcgcggcggccggcatcccggtgcaggcggtccacggcgccgacgaccaggtggttccggtcgagtgcagccgccatctcaaggcgaagctcccgcgcgccaagctccgtgtcaatgtcatggacaggcgcgaccacgcgacggtggttctgggcagggagagggacttcgccgaggagctcaaggcgttctgggtctgggggtcagcaactccttcaacgaagcggaggttcagaggatgctgattgttagcagggccacgggccaagtagtagcaggccagagtgcgttcttgggccaagcccaaaggcttctccgatccttttcttaaagggccttgtttacttcgaaaagttttgtaaaatagaaatagtatcgctttcgtttatatatttgataaata

SEQ ID NO: 137 - DNA, 1518 bp, Sorghum bicolor
acctactctcctctttctactactggtgcggcagcggcggttgcagcgttgcgatggggaagcacgagttcctcacgccgaaggcgatcgcgaaccggatcaaggcgaaggggctgcagaagctgcggtggtattgccagatgtgccagaagcagtgccgcgacgagaacgggttcaagtgccactgcatgtcggagtcgcaccagcggcagatgcaggtgtttggcatggcgcccgaccgcgtcgtcgagggcttctccgaggagttcttcgagtccttcctctccctgatccgccgcgcgcaccgccactcccgcgtcgccgccaccgtcgtctacaacgagtacatcgccgaccggcaccacgtgcacatgaactccacgcggtgggccacgctcaccgagttcgtcaagttcctggggcgtgagggatactgcaaggtcgaggacacgcccaagggatggttcatgacctacatcgaccgtgactcggagcaggccgtcaaggaccgcctcaagcgcaagaggatcaagtcagacatggctgaggacgagcgccaggagcgcatgatcgcccgccagattgagcgtgcgcagaagtctttatccaaacccaatgatggtgatgttgccgagggtgagtctgagtccggcagtgaagaagagtattcaggctcggatgatgatggggaggagcgggaggatgacgcgaaagaggcaaacaaggcaacagggaagattgcaattgcactgcagaaggctatgccagggcccaaggttaatccttttgaggataagccgaagatgaaattcggttttgacgaagaggatgactcgggtacccaagagaaggtgaaggatgaggtgcccaagaagaagggaaaggatgtgaaggcagcagaggctaggaggtcagcattggacgagctgatgaaggaagaggagaaggccaaggagaggagcaatagaaaggactactggctgtgccctgggattgtggtcaaggtaatgagcaagtcattggcagagaaggggtactacaagcagaaaggggtggtgaagaaagttattgataaatatgttggggagattgagatgttggagagcaagcatgttctcagggtcgaccaagatgaacttgagactgtgatccctcagattggtgggctggtttggattgtaaatggggcttatcgggggtcaaatgccaggttgctctctgtggacacagagaaattctgtgcaaaagtgcaggttgagaaaggcctctatgatgggaaggttcttagggctgtcgaatatgaggacatttgcaagatatcctcttgattatattatacaacatgatttattccattttcctggatcatcactgttgcaaagaataggaatacgatccagtgcactagctctgtctcatagatgcctaacagtgtctttgcttgctattgcttgtgctagaatatcttctgttaaagcaatgttcaatatgagcaaatgtttctagttcactgtatct

SEQ ID NO: 138 - DNA, 2731 bp, Sorghum bicolor
cgcagcttcttcttcttctgttgctgttgggcctgtgcctggcccgttggctggtcggcatgtcgcgttagcttctcacttcgcccccctcgtcgctgtcagaaatcaatttctactactactagtcctcgccgtccgcgcccggctgcccggacgtcgtggtgcggtggtggtggtctggaagggcggctcccctctttccagagcagagcagacagagcaccacgacccgccagaccgccacttgccaaccaatacccttttacttctccttctccttcgcctccgggagggacagcgggtatggacgccgccgagctgcccctcgtctaccacatcggcctggtgctggccgcgctctgggccgccgccgccatcggcttccgcggctccctcctctacctcctcgccttcctctacctctacatggtaaatgctcgctgtgcagtgagactgcggaagaggatacaacatgaggagatgaaatctgcctatcaacgaaggctcctctctgatgcagaatcagtacgctggttaaactatgcaatcaacaagatgtggcctgtctgtatggagaagatcgtttcacagcttctacggcccatcataccatggttcttggataagttcaaaccttggacagtcagcaaagcaggtattcaggagctttacatgggcaggaatccaccaatctttacctccatgagagttctacctgagacatcagatgatgaccatttggttcttgagctgggaatgaatttcctttctggtgaagatatgagtgctgtacttgctatgcagctgcacaagagtgtgggacttggaatgactgcaaagatgcatttaactagcatgcatgtcgagggaaagattttagttggtgtgaagtttgttcggagttggccatttcttggccgtgtaagactatgttttgtggagccgccttattttcagatgactgtgaaaccacttattaatcatgggcttgatgtcactgagtttccaggaatttcaggatggctggataagttgatggatactgcatttgggcagacattagttgagcccaatatgatagtcataaatgtggaaaaatttgcatctactccttcagaaagtaactggttcagcattgaggagaggcctcctattgcatatgtgaaacttgagattttagaaggaattgacatgaagccatctgatataaacggactagcggacccttatgtgaaaggtcgtctgggtcctttcaaattccaaacacagatacagaggaaaacattgtcccctaagtggtttgaagaatttaaaataccaatcacatcgtgggaggcaacaaatgaacttgtcatggaagttcgtgataaggaccccatgtttgatgactcgcttggacaatgtaccattaatgtacatgagctgagaggtggacaaaggcacgacaaatggatgtcactgaataatgtcaagaaaggaaggattcacttggcagtaacagttgaagatatatctgaggaccaaaatagatcaagtatggacgaatcattgaaacaagcggatactgaagtaccagtatcaacatctgtttatagcaaagtggattctggtgaacttcctgaagaaaataaagtcttaatggatgaagtggagcacataaacattgatggacaagaacaacctggaggtttatatgtacatcgccctggcacgggggttccaaggacatgggaatcccggaaaggacgagcacgaaacccagacacacagattcaccaagaggttgacaagtcaaaggaaatcccgacaccaaaaggcagtggacaagggggtctatttaatgtaggctcctttttccggagaaactcaaggaaggggagctccaaaaatcttgatcccagccttcctgcaactccgggtcctcagagtgtgacagagcctgatccaaagctccctcaaactccacgtcccaacctgaaggagctgggcgagaagcggacatcgataaagattgtagtgaatgaagaagcaaacccagcagacaaggtgggatatgcagaaaactcaggagaagatgtggcaaaggtgatagagaaaaatgcaggtgaaccaggcagatcactgacaagcacattgagcaggaagttttccagaaagagagcagatgacagactatcagatatcccagagcagattgaagctcatggatctgagtcggtgagtgaagggcctattcttgttagaggcgagccaatgatagcagaaggccatccaacagcggaacatggcaatggagatggcaccgagcaagatgtggcgggagcaaaggttgctacccaggcctcataaaggattgggacttaagatcagcagtttttgttcttgtaatcttgatgatagatttggtttgtgcatgcatccctgtttgctgtttatagactcatggtggtgaagaatgtcagatactagacttgtttcgttgtccatagttgctaaggataaccatttagaattgggtgtaaaatatagtatcaaagagcagcgtgctgtgcagtgatatgcgctcatgttgataagataagttggctctttgagattttgttcacttctgtaaagaaacataaattccatatattccttgacacaatttatgtaaaatgtattctcactagatcgtttttgcggctgatgctgatttattgtgagagaaaaatattgttatgtggtagga

SEQ ID NO: 139 - DNA, 1399 bp, Sorghum bicolor
gcagccttctgtgggaaatttccattgttcctcaaagcagagaccctactgatagccatgtcggagactgaatcggcggcagtggccgcggcgctggacccggcggctacagcggagccgaagcctcggcggctgcgggggcacaagaagggcgccgtcacctgctgcgtcgcctcctccgcccgcccgggcgtcgtcgcgtcctccggcgaggatggatgtctttgctggtttgatctgcgcaccaaagatgtacttttgaccatggaagcagcaaataaaccaatttcttcaatttgctttaaaccaggaaatgaagattgtgtgtatatctctgctggaaatgaaatattgtcctttgatgttcgtatgggagctcaatcaaagccattagagacgtataactacaatagagatgaaatcaatcagattgctgtcagctctaaaggttttctcgctgctgcagatgatagtggggatgttaagattgtcaataccattcagaagtgcctgtataaaagattaagggaagcccacacaagtatttgcagcagcgtgcaattcattccttggagaccttggacagcaattactggtggccttgactcaaagctcgttgcatgggatttctccaaaggacgaacactgttttctattgattatggatcacctgaattgcaaaatggcaattcttccggtagtgcagggcaatgtttcaaccctgcttttgttcattcagtagcagtttctgaagagggtattttgggagggctctacaaggtttgtgctgttgcaaggggggatggtgctgttgatgtgattgatcttgagtatgaactggctcctgcgaaatcgaagggacctcctcgggcagctatttcaaaaaagagttcaaaaggagctgaacttggagatgggagctgtaatcaaagtcaagcgaaaagaatccatcttgactacacgatgggtggccataccgcagctgtatcttgtgtagcattttcagtatttggtgagaaggggaagttcctcgtttctggcggcaatgatgcatcagtgaagctgtgggattggtcgaaaggattttcgtctgaaacaaacagcaaagttgaattggttttgaatattgatgtaaagaaaaaggtaaattggctgtgtactgctccaactgattcagataacttgattgtgtgtgacacatccaaggtggtcaaagtatataatttccggtagatggatcaaggtgtagcctcagtttgtcagacagctatccgagggagtgaagattgtctgaccgctggaaccaatttggtcctaactctggtatccagatattacaagcctggtgctgatagctcctgagtcgagaagtcattggttagcaattcacaatatcagt

SEQ ID NO: 140 - DNA, 1729 bp, Sorghum bicolor
gtcgctcgtcttccttcgccgcttccccgcgaatctcgccgcccggcttccggtctccgcttccccagtggtcatggacccgtctctctcctcgtcgcctctccgcctctccgcaacccccgccggcccgggcgcgacccttaccaccccgaagcccaccctcgtggcggccgccggccccggccgccagcccaccaccaccaccacctgcctccgcgccatctcgccgtccccgtccccgcccacccccgtggagtcgttcggcttcgacgcgctcaaggagaccttctccgtggacgtggcggccgccgacgcgcgcccgctcgacgtcccgctcgccgcgcccttcaccatcgcgtcctcccgcctcgtcgcggtgagcaacgtcgccgtgcgcgtcgagctccgcagcggcgccgtcgggtggggggaggcgcccgtgctgccttccgtcaccgccgaggaccagcccgcggcgctcgacgccgccggacgggcgtgcgccgcgctcgaggacgcctccgcggcgccactcggcgcgctgctccaggacgtcgccagtgtgctccccggacacgccttcgcctcggccagagcaggagtggagatggcgctgattgacgcggttgctaatagcattcgcataccgctatggagattattcggaggagcatcagatagtgtgacaactgacatcacaattccaattgtgaccccaaatgaagctgctcagttggctgcaaaatatcgtggacaagggtttcaaactctgaagctcaaggttgggaagaacttgaattcagatatagaagttctgaaagctattcgacttgtccatccagattgctcatttattttggatgcaaatgagggatacacagcaaatcaagcaattgaagttcttgatagactaaatgaaatgggagtgacccctgtgctctttgagcaaccagttcacagggatgattgggacggtctccgagatgttagctctgtggccatggagaaatacaaagttgctgttgctgctgatgaaagctgtcggagtttacttgatgctcagaaaataatacaagggaatcttgcccatgttattaacatcaagctggcaaagttggggattcttggagccctagaaataattgatgctgcaagaaaagccaatatttctctgatgatcggtggcatggtcgagactaggattgctatgggctttgctggtcatttagctgctgggcttggatgctttagtttcgttgacctggacacacctcttttactctctgaagatcctgtgtatggtggctatgaagcttttggacctctgtacaagtttacaaacgcccgtggccatggcggtttccttcacttggataatgatgcctcgaaatgaagatggttaacaattttttctgtccttctggagcttcatcgaagcattgcagtgcataggtatagcctgctgttgcaagtccagtacaccagtcaggcctggaaccctggagtatttggtcagcctgtagatagatattcagaaggctgtcccccgctgattctgttgttctatccagagtaacttctgtgcaataaaatacatctggttgtaaatgtcaatgcatgcagccgtcgcaagctttcttctatagctgttcagtataaataaggctttccttgattagctgttcagtatgtaatcaagtactttgcattgtgattgcatagtttattt

SEQ ID NO: 141 - DNA, 1446 bp, Sorghum bicolor
ccgttccaccctaacagaggcaggcgtcgcagcgcgctcccgactcccgagcgagtagcgacgacggcgcctgcgtcttccgtggcggcgcccctacccctcgaacccgtccggccgacctcgcctcctcggctagctacctagccgccgtgcccaccagcgtccactggtcagcaggcgcccagccctcagccggccaggcggtaggctcctagcccccaagcgaccgcagtgccccctgcaggctgcggcctagcccttgcccggttgccccctgctgctgcacagtgagccagacagcaagctttgtttctttccattcagtagcgtggagatcaaactagccaagggcagcccaaatttggggatttttcaagtgaatccccctgtatagagatagttcgaagatgatgaaccagcacagagaggaggatgccttgagaggtcaagcagtcaaaaaccagaaggcgatatgggacaagaccctggaaatgagattcttgctgcagaagggattttccacttccaacaagttgccccaggaacccatcagaacaaggttttgcaatcatgataagcagatagagcaagcctatgatgatctgttgaattcatcaaagcagactttgagcagcatgatggagctgcaggaggctttgctcgagagtaatcaggctacaaagggtgccaatgaaattccttctgccgcaaatggagacaatgacgagtggtcagaagtacagagattgcagacaaggataacaacattcagaaatactgagatagataaatggcagaggaaaatacaggtgacaacaggtgctgctgcacttaaaggaaagctacatgcatttaatcagaacattagtgaccaagttgctggttacatgagagatccaagccggatgattaacaggatgtacttgtccaactctgctgttagtgtatttggaaaggatgtgggagaacccagaacagctgaggaggggcacattatggaaggtgatcctgaacttattgacgattctgagttttatcaacaacttctcaaggagtttcttgagtcatgtgatagaggggcctcagagtcggcactttatgccctaaaaaagcagcaggttaaaaagagaaagcttgttgatcgtcgtgcttcaaagagcagaaagatacggtatcatgtccatgagaagattactaatttcatggccccagagcccatggttgttcctccaatggccccgaagttgtttgagaatttatttggcaatggcaactagaatcaacttaagcttggattcaaatgtcacattacttggtgcagcttttttgtacttttataaattgcagtaggtatgatgtcactagacttgggactgagttgaaagttttgatggcctcgtcagttttgtgcgtagagtaaaacagaaattatacttcgatttgggc

SEQ ID NO: 142 - DNA, 1973 bp, Sorghum bicolor
cccttcaccgcttccgaagtctacttccattcctccccttcctaaccccgcgtcgcccacgagctcgccgtgccggcagaggagaggacctcgccggagcagaggccatggggccaccgcagccagccagggtcggcgccatcaacatcgaggcgtgcgcgcggccgatcgccgtcgaccaccgcatcaggctcccctactacttccgcatcgcgggcagcctcctccgacaggctaatatatatcggaacgagagtaacttcctcgacctgtatgtcatccttctgagatactcgagcttgctgtgtgagacgattccgaagcatcgtgattaccatgccttcaagttaaaagaaaaggcattttttgataaacttaatgatgttatgaaagagcttgagacattgaagccagttgtgcagcggcaggttgccgagcataacagaggaggtactgtggaatcgaatactaatagtctaaatggaaactatggtataactcgtaggatagagcagcgcactccaacctcttatactccacagccatttgtaggcagcactaatggagcattgcaaaaaaccttccatgctgggagacaagtggcattattaccaagcgtccagaaacaatttatgaatctaccatatccaaaagaagaaacactagctagacactccatattaggacctaatggtcttaatggccgatggaatgggcctgttactgaaattaaggttcagtatccaagcaattttgaattaacacaaaatgatataacaagtttagtgccatccatcttgaaccaagatgattcgcatggtcccagtactgcacctgcacctccacctccagatagctcctcaaatgacaatgacgatatgaaatctgttctctctcttgatgatggtcgatggtctgtgccagcagaacgcactccacttccttctgctagcttggaagaagagttgtttcaattggatatcaaacaaccttctcctccaccagttctggcagaggtgcaaagaccaatttctccatctagagttgctgatccaacacccggacttccgacctcaggaactgcccgttttcagaacttgcatgttccgatcaagttgatggagtgttttctaagggttgctgagtcaaacaccaaaagaagcttagaaacctgtggggttcttgctggtaccttgaaaaagagaactttttgcgtgacaaccttaattattccaaagcagaaatcgacatctaatacgtgtgaagctataaatgaagaagagctatttgaagttcaggacacaggctcactgttcactcttggttggattcatacacatccaacacagtcctgcttcctttcttccattgacctccacaatcattattcttatcaggtcatgctacctgaagcaattgcgatagttatggcacctactgacacaacaagaaaacatggtatatttcatctcacggatccaggtggtatgggcgtgatccatgattgtcaagagagaggtttccatcctcataaggcacctcttgatggttcgccaatctatgagcagtgctcccatgtgtacatggacaacgatataaagtttgatatgattgatctccgagaacgatgacaaagctcaacttctttgggtttattttggagcctatacttctcacagttaaatcatattgctgccttattttttcttagttgtgctgaagatttgtgaattcttatgtaagctgttgtacatagctattgcattgtatagagaaaacaattgagttaatgctggtaatctgcaaagccattgatgctttgttgtaattcatcccttcaacctcgcaaagcatgtttgtgtggcaagatgaggaagtggtgtctagattttatgccatgccaattgtacatccttgaatatttgacttaaagagcatcaatatcactgattgttaaagctgtattatttttc

SEQ ID NO: 143 - DNA, 2278 bp, Sorghum bicolor
ggaaagaagacgataacaactagcacgggagcaggggaggaagtagagaggacggcgcgaggcttggccgtgccggcgagttggggcgtttttcctgcggtcggagatgcgaccgttgggacccgggagacagcgcagttcggcttcgggttcgggggcggctcccgcgacggcggccgccacctgagcaggatgtttagctggaacgacgagcagcagcaggtaggggatgcaatatggactgagttcaatgagagtgaggaccatattatgccttatcctaaaggtgcagaagatagtacgactcgcaagaacaatgaaaaagaggtggctagtattgatggcatcactgaacattctgaaggtgttcaaactggacttcaacggatggaaaagcaaactgcaaatcagacaagtgcacatttttcagccacacgaattgacatggaatcctggcctgaccttccttccctgaatcctacacttgatagaaactatagtgatgacaacataacatccacatatctggatttcagtgctgaacccagtttacagaaagtgacaggaaaagctacagggcaactagatggtgaatcagaagtgttcagtaatgatcaagaagaaaagagtaacagtttccttgattgcgactggggcaatattggagattttgatgattttgaccgtctatttagcaatagtgactccatatttggtaatgagatagttgccaacgacagcgattttctttctgcatcttcgaatttgatggataatgctgtgcaatcaatcccaattctggtcgaagtgcagaagaggccagtgaggtcacgcagaaaaccagaggagagaggtaaaagtaaaatatccagcagtacaagtggcttctcccagagcaaagtagagaatgcatcaaccaatttgcaagctcctatgcaacctgtacagactcctcaatatgcactgttccaggatagcaagaagataggacaagttcagcatgttaatcagtttatgtttcctggatatgggtatcctgcatatccatttcctacaattccgttagtgtcaaacattcaagctgaaggctatctgacaaaaccaactggcacaagctaccgaactttggaagattccccaaaacagtcaagttccatagaaatgtcacaagacattccatcaagagcactgataatgacaccacaagaaaagatagaaaagcttaggcgccggcagcaaatgcaagcactgctagctattcagcaacagcagcaacagtttggtcaagagggttctggcagtgacacaatggtgtctcaggcatactcccctaggaacaaaaatccggattccttggggagttcaattgtcatagatgaaaacgcaaataaggttttttcgcctgaggtgattccaactaaccatgacctggttcacaagagttctgcaatttctgttgatccttttatagaggaaaaaatatattatcagctacaagatgctcttggcaagttggataccaaaactcgactatgcattcgagatagtttgcttcgtttggcctatagtgcagcagagagacaaattgatggtgataggagcagcactaacaagactaataaagatgatgatgaagcttccgaaaatgatgcatctactaggagaacaaggtctccaactagggaagcagaaacgatcacaaatccaattgatcgtatagtggcccatttgctgtttcatagacattgctccaaggttgcaacagcaacaaaggaggaaatcatatcctcaacccccttgatactagaacctgaaccgaaggtacccttgggaactcctaggttgccatcacaagatcaacgagatgagcaagaaattgtattgcctctgtcacaataacgtgagatttgctagaagatgaggttttaccaaatttgagtaagattatttgcatttagttagcctgtgaatctaatgtcgttcttctaatgagcatacagatgctgattttatcaactgttcagaatcaaaatgatagcaaatccaatgattatggcaatctgctgatcacctggggttctggagatctcttgtgtaatatgtaaccatttcaacattgtagcatcctttttttttcatcctgtaagaacatctcagactgtattggaacctacgattgtgtcgagccctaaaaggagcaaaccttggctctggacatcattatgattaaccttttttctcatgcgtaaccgcccaatgtttaaaggtggctgcttac

SEQ ID NO: 144 - DNA, 1295 bp, Sorghum bicolor
ggcagtcgccacagcctcgcctttgattggctcccctccctttcgtcctcaccagagacgaacccctcctcctgctgctgctgttgtcggctccggagccatcctctgctccgaccacgcaaatccccgaccccgaggcagacaccggccaggccccgcgatggcaaagaccaacgacaacgacgccttcagtccccctgtttcccaagaaagggttgtggtaacaaacaaacatggtgagaggcttgtggggctgctgcatcacaccggatcaaacaagattgtggtcttgtgccatggttttatatcttccaagaatgacagcctcattcttgacctagcggcagcattgacaaaggaagggatcagtgtcttccgcttcgatttcagtggaaatggagaaagcgaaggtcagtttgagtatggcaactacaggaaggaggctgacgatttgcattctgtcgtattgtatctctatcaaaaaagttacgatatagcagctgttgttggtcatagcaaaggaggagatgtagtgattctatatgcttctatttacaatgatgtcagcaaaattgttaatttatcaggccgatttgatttaaaacaaggcattgaagaacgaataggggaagggtctatcgatagaataaataaagaaggctaccttgatgtcaaggacaaatctgaacatgtcaactacagggtaaccaaagaaagtttgacggaacggcttaatactgatatgcatgctgcaagtgtttccataagtaaggaatgcaggttcttaactgtccatggttcagctgacaagaccatacctgtagaagatgcccatgagtttgcgaagcatatacccaaccataaactgcatatcatagaaggagcaaaccataactacaccgcacatcgcaaagaagttgctgatgcagtagtagatttcatcacgtccgatggggtttaaggctgaggagcccacgtctccaaggtgaatgttcattccagactgtttaacacttggtcatacacctattcccattggtggacatgagcggtacagctccaaattggacccttcaatactagggcaataatcgacacagacttgcatggtactaggtgtgcattatcttctgaaccgaaaaaactcatgccttgcaggtttgagtgtttttttttgttttttttttgaaacgaggtttgatatgatgttactggtatgtgctttaagaattcctataaatatctaactcctggtaggacttgtatgtcgctgttgtataactgatgaagtttca

SEQ ID NO: 145 - DNA, 2874 bp, Sorghum bicolor
ggcggactcctcgacccgcgggacgaaaccctaatggagaactggcggcgccgccacgtccccgcgccgtagcctagcagcagcgagctccgtctcaaggataacgccagtgcttgccgatccggtggggaaaagtgggagcacggagcagcctcgcctcggcggggacgcggcgcccaccatggggagcgatctcaaggagatgaagtacaggcggaggattggggtggaggagcggccgcaatgcagcgacccgaggggcggcggcgcggactggcccgcgctgcagcaggaccccgtcgagctgctgcgcaagctggacgagctcagggaccagatcacgcgctcctgcaacgtcgtcggccagccgcgggagcaccgcagggtcagccgacgtgcggtctccatgctccccgagcaacttgagccaccgcctctgccggcgtaccaccgctcccgctatggcgggcggtatgggcacggcttgccaccaccgagcccatacgcaccgccacgccctgaacatggggaaaggtatgtgcggcagtctagtgggcactaccgccagtaccctgcgactgggaggcagtcggagaacggtgggatggggcctgggggctaccatcactatgggtgtgcctgtccacactgtcttcatgggcagaggcctttgcagcaagaggagaacatcccaatggcgagatactttgccgggcagcatgaatcataccggttccagaggtcgccatcagtgtcatccgattatgataggaggtctgtggcgtcatcactttactctcatcggtctgtatcaaagaggagggcagagtacttcaggaaaaaggcagaacatatctgccgtccagtggatggtgctgcacctttctctgtatgcagttcatgttataaactactgcagatgcctatgggaaaatgcatagggaggaagcagaatcggtttcaatgtggatcttgttgtcagataattagtttgaagcatgaagaagaaaatggtattccctttgtgccatcatcatccttatatgctcctgaaatggagcaatgctcaagtgaccagatgaggagagattctgcccatcaacgccatgaggatttcaattctatgttctacaattcaattgatcatagcaacatgcaaaacaacatggatttcaccgatgataattcactttcttcgaccatgagtaatgacaggattgaaaaagagtgtggttcaactagaagcattcagtcaaaagctgagggtctctctttctctccaagtaggtctgtagacattggtagcccaaaggatatattgtgtgagagggaggcagactgcaaggtggagccttctgtagatggtccacttggcccacgatctccagctttagaggacaaacttgttgacccattgtgtgcccaagaaaatggtaacgatgaggatgatcaaggcatgccttacagatcagacctaacttgcaaaggagagtatgatgttagtgatgagtatgatgtgggcattagtacaagaagcaaacaggagagcaatgaagatgacaaagatgccactgaagatgaaaggtcatacagaagttatgaacagaagagcaagagcaaggaagatgactgttgcaatgttgaggatagtagcaaaacatacaggcagaatagtggagaagatgacgctagtagtctagtagatggaagtgaaaagtatgagtgtatgaatattaaagatgacgatagcagccccggaggtgaggacacatggaataaatatgagccaaaggtcaaaggagatgaaaattgtgttcttggagctgagagtattcacaacaattgtgatgaaaataataaagatttcataggaactggaagcataagtttgagacatgaagagctgaaaatcgaagaagataacgggaaattgcagcagccatttattgaggatgccaattcccaagcagggagtggttcatcaattaatgagcggacaaattctgggttttctcgtggttcctcagagactgggttagatgaagaccagtcctcaaccggtaagagtggggattcatcattttttgctggtttcttgaagaagggtttcaaggacctttctttattaaataagtccatggacagtgttaaggtttcaattaatggtcatccaatctctgaaagagcccttaagaaggcagagaagaaagctggtcctgttgatccaggttcatattggtacgactaccgtgctggtttttggggtgtcatgggacgagagtgtatcggcattgtccctccatttattagagaatttaattatccgatggccagagattgtgccggtggggatactggtgtttttgtcaatggcagagaactgcaccagagagatttagatttacttgtaggaagaggattaccgcggatatctggaaagtcatattctattgagatgtcaggaaatgtaattgatgaagcaactgggaaaaaactacgcagtcttggaaaacttgctcccacgattgagaagttgaagcgtggttttggcatgcacgtccctgaagagtttagataactggttctagtacaggtcttggctttgctaatagtacactcttcaaagattaccatggggtgcaaacctatgatttctgcggattgtggtattaaatctcagatttctctgaattggactggagctctacaagcaatacttaagatccttggtgtgaagcgaagggtggcactcaagaagccaagataatgtggtctaatgccttaactaccaatagtatccctcctgctaattccattactttaatggaaagcacgtttgctagtgactctagtctatcaggcagttcttaactt

SEQ ID NO: 146 - DNA, 1391 bp, Sorghum bicolor
tttccggcctctccatccccacgccgaccgcaccacccgacccgatcgcacgcacacaaacacaaaccgagcagcagaaacatgcgagacatggaggacagatcggtcgtcagccgccgccatgaacccaccaccgtcgccaggacggcggacgacgacgacgacgacgtggcttccggcgacgaggactccgactcggacgccgagttcgagttccccttcgtgagccgggagtccgaggcggcggccgacgagctcttcgcgggcggccgcatccgggccttctacccggtgttcggccgagtcctggacgacgaggcgccagccccagcgccgaggtcgccgctagggcggctgttccagctggagcaggcgcggacctcgtccgtcgcgtccacgtcctcctcctcctcctcctcgacggcgggcgcaggcgcggcgggcctcgacggcgcgtccccggacagctactgcctctggacgcccgggtcggcgtcggcggcgtcctcgccctcgcggtcgccgcggaagagcgggtccacgggctccatcccgcggtggcgccgcatcggggagctcgtcgtcgggcgcagccacagcgacgggaaagagaagttcctcttcctctccgcgccgccgtccccggccagggacagggagagggagcactcctcccccgcctccaagtccaagtccaagccaaagcagcctcagccgaaaggaagtaaaaccgccgccgccgccgccgccaccgagctcgacacggtcgccgcggggcgccgggtgtcctacggtggcgccaacgccaaggcctccaccggaggtgcgcggcgcacgttcctgccgtaccggcaggacctcgtggggctgttcgccaacgtgcgcgggctcagccggagccaccacccgttctgaagcggatccggtgagccacgacgcgccgtggaagcggacccgttccaagcagtgccgacttcaagtttgaaatcgggatttgaaatttcagacgttttgacttggagatcccctgcaaagatgctctgtgaagattactactgttattagtattaccaatacgtgtgggatcaaagcaattacgcaagtgaaaaagacaaggtgtgaagtcagagaaaaacaggggaaatgtgaggcctccatttcaggattcggctcggaatcgtggtctcgagtcggtggctaaccacctgcctgccctgcgatttgtcaaggtggtctaggcgggtacacatatacgcacatgttggtgttggacaagaagtttacattctgtatatgctggtatatatagtagctttgtacatatacatacaatctataatgtatagagtagttagaagtaggtgggtttgtttgcgaggaatttgggtttc

SEQ ID NO: 147 - DNA, 2684 bp, Sorghum bicolor
cgctctcggtttttgccttctgcgctcagtattcaactagtcaagtcaccaaaccatcaaagatagttaactgcaaggagctaaaccagaattagagctaccaacctctccctcttcttcctccgttgccaagctctctgaggagaagaatggctgcgctgctctatctcgcccttcttctactgctgacctttccggtttgctctggcgcttcgccatggcaaaccatgaccaccggctcgcacatacgaggagaggaccatgacaaggtcatcctcctctcgcctgatgctaccttctcctgcggcttccatgaggttggcacgaatgctctcaccttttccatctggtacaccacccatgccgccgagagaaccgtcgtctggacggcgaatccctattccgcagagagaggaggatactctccagtgaacaaatatggctccagggtatcgctaaaccgcgacggcaacctgatcctcacagataccaacggttccatggtgtgggagagcaagacatcgtcaggcaagcacacgacagtcaccctcctcaacagcggcaaccttgtgatcagtgactccagtaacaagatcatgtggcagagcttcgattcgccaactgacaccttgcttccggggcagaacctgacaaaggacacaaggttagtctctggttaccatcacttatacttcgacaacgataatgtcctgcggatgttgtatgacggcccagagatcacaagcatctactggccaagtccggattacgacgctcaaaaaaatggccgcaataggtttaacagcaccaggatagcagttctagatgacatgggtaatttcacatcaagtgacgggtttaagatagaggcttcagattcaggtccaggaatcaagagaaggatcacaattgattatgatggcaatttcagaatgtacagcttgaatgcatcaacagggaaatgggacatcacagggcaagctgtaatacagatgtgctatgtgcatggactatgtggaaagaatgggctctgtgactacttgggtggcctcagatgtagatgtcccccagattatgagatggttgatccaacaaattggaacaaaggatgcaaaccaatgttcttgactgatggaaaccaagcacgtgaggaatttacatttattgagcaacctcatgctgattactatggctttgatctatcctccaataagtccatcccatttgaagcatgccggaacatctgctggaacagcagcacctgcttatcattcacatacaagggtggggatggttggtgttacactaaagatttactctacaatggtcaggtgttcccatatttccctggggacaattatatgaaagtaccaatgagttttaacacttcgacgtactcaatctccaagcaaaaaaccctcacctgtggacccgcaggttctgagaatatgctaggaccagcaagtatgtacggaacaaagaaggacaacataaattggacatacttctatgtctttgctgcaatactgggagctctagagttgcttgttattgttacaggctggtaccttttcttcaagaagcataacatacccaaatcaatggaggatgggtacaagctagttacaaaccagttcaggcggtttacataccgagaattgagggaagcaactgggaagttcaaagaagagcttgggagaggaggtgctggaatcgtctacaggggagtgcttgaagataagaaaatagtggcagtaaagaagcttacagatgttcgacaaggagaagaagaattctgggcagaagtgacccttattggaagaatcaatcacataaacttagtcagaatgtggggattttgctcagaagggacaaagaggttattagtatatgagtatgtggagaatgagtcactggataagtacctctttggtgagagaagtactgaaagcttgcttggttggagccaaagatacaagattgcactgggcacagcaagaggtcttgcttacctacatcatgaatgccttgagtgggttgttcactgtgatgtgaaaccagaaaacatacttctaactcgagatttcgaagccaagatagcagactttggattggccaagctcgcaaagcaaggtagcactagtttcaatttcacccatatgagaggtacgatgggctacatggcaccagaatgggcattgaatatgccaatcaatgcaaaggttgatgtgtacagctatggggtagtgcttctggagattgtgactggaatcagggcttcaagtggcataatgttagatgaaagacaaatagattttctggagtttgtccaggaggctaaacagattctatctaccgggaatgtcagtgatattgttgatgatagattgcacggacactttcatacagagcaagcaattgcaatggtgaaaatagccttttcatgcctcgaagaaagacgcaagaggccgacgatggatgaaattgtcaaggtgctcatgtcatgtgatgatgaagacgactaccatcctgcttattcatattgacttgcaacagatgcaaagtggcaggcataacaagtttcatgccaattgtacctttggtcatgttactacaggaacaatgatttaagatgaactgaactgactgatgaaacatattgtaaagtgtggcaaattgtgata

SEQ ID NO: 148 - DNA, 2436 bp, Sorghum bicolor
atgaagggaaagcagaagcttctttccccctccctcccaaaaaggcatcaaaattctccgcttggaaaaatcttgaaaattctccgcttagaaaattcaactagattcggagcaatccaccatttgtttactcgtcgatcgagagcccccccattcgttaggggttagggtcgtagcgaggagggctctggaattggatcccaacagaggaatcacactcgggttggggggggcttgcagagaagggaatgtcggcaaccatcgaccggctcgcgacgccgagtcatgagggtcatgcacacagtgacggaaagagagagtgcaattctgatgaagagaactcggaaggagaaagaaagcccaaaaagggctctctcaagaagagagcagctactgcagggtataagtttaggcattccttaaggagaaagagtaaaaccaaggatgataaccatgtagcctcaatagaagacatcagagatgttcaagagctggagactgttgaaaggttccgccagtgtttacttgacgagggcctgttgccagaacatcacgatgattatcacacgatgttgaggttcctgaaagcaaggaaatttaatattgacaaagcaaagcatatgtggtcagagatgcttagatggaggaaggaatttggtgctgacaatatagaggaatttgactacaccgaattagatgaagttgtgaagtactatccgcagttttatcatggtgtggacaaagagggaaggcctgtttacatagaactaattgggaaagttgataccaacaaactagtgcaaatcacaactattgaccgctatgtaaaatatcatgtcaaggagtttgagagatgtctccagatgaggtttccagcttgttctattgctgcgaaaaggcacatagactcatctactacgatattggatgtgaaaggcgtgggcctaaagaacttctcgaaagatgcaagagagctaattatgcggttgcagaagatcaacaatgacaactatccagaaaccttataccgactttacatcataaatgctggccaaggcttcaagatgttatggggtacaataaaatcatttcttgatccagaaactgcttcaaaaattcatgtcctcggaaacaagtaccaaactaaattacttgaaataattgatggcagtgaactcccagaatttcttggtggcaagtgcaggtgtgaagaatatggaggttgtccgaaatcagataaaggcccttggaaggaccctgaaattgtcaagagagttatcaatggtgaggcaaactatggtcggcatgttcttgctgtatcaagcataaatcagaaggaagttggttgtactgaacactcaactgagcaggaaaaaggcaatgatgcctctgccgaatctatttctgaggtggaagatgtttcttctccaacagctttagtggatcctataagccctaatttgacccatgtggatgagtcaaaatttccaggacgtgcttcctcatctgatgcccctcccattacaggggatagcatccctgctgttgacaaggtcgtggatgcatgctccaatccaagaaacagctcgacgccttccagctcaggttctttctccttgagaaatataccggcaacattgggaggacttaaaactcgaattgtcgcatggtcaacaatcttagtcctgagcttgttggcattcctccgttctgtcctgagcatagtgaccaaaaggctctcaaaccaggccatcacatgtgaccactatagtgctgacttccgtcaaggatatacgggaaatggcacccttacatctgtattgacacggcttggtgaattggaggagaagatacagacacttgaagcaaagccaccccaagtgccatttgaaaaggaggaattgttacgtacttctgtttaccgcgtggatgtgttggaagctgaactaatttctatgaagaaggtcttgtatgagacattgattcggcaggatgagctgcttgcatatattgaccaacaacagacagcaaaattttgtcggcggaagttctgcttctaagggcctgtttggaagagctccggcagctagcactgtattgtggcggagccgtcggagcctcaaaacgctgggtcctccggctcctgcactttgcagttgtattttgccaaagccagagccggccagctccgcgttacagtgcagcacagtactgtaaagtgcacctgcgcagggagccagagccggcgagagcgggtgccaaacagcctcgaagtactggagtacctgccacctattttcttctctttggagatggcatgctgctgttgtggatgcagtatacttgtaaatacctttgtatttttttcttgaattatcttcgtattttgttgcagtgtaaagcatcacaattttttagaaatagataggattgacg

SEQ ID NO: 149 - DNA, 747 bp, Sorghum bicolor
cggccgccatacccggcccagcacagccgtagggtttattggcatctctctccgtccctgcactcctccactgggggagtcgcgccggccaccacagcgcagaagaacacagcacccgcctgcctcgccgccgcaatggccgccgccgcctcagctgcgagatccttcctccggtccagcggctcatcatcactccgcagcgcggcagccagagccgcctcgcgtgccggaccggctccgctgccgaggcggatgcccacctctgccccccgcgcactcctaaggtcgccggtggagatgagcagcgtgtgcctggagtccctgatgcccatgcacagcgccacggcttcggcgctcatgacgtcgctactcgctgccccggcttgcaagggattcggttggctatcagaagctggtaatgatgacgtgtgacagtctctagatggaacgtagcagactattatcccgtcacctcagatctacagatggatgatttgtcgttattggagacctgcagtgatggtatctggtctggattatggaatacctcgtgaatttaaagtacttggcatctcagttaaaacatgttttatgctctgggattccagtttgtatgaaatttgcagaattgttactgagatttattttggctgactagctgtcaaaaagactttggtcttgacctgcctgatcatgtagatctggaatgaataaacttggttaaaggctgttcacactttttgcatt

SEQ ID NO: 150 - DNA, 3906 bp, Sorghum bicolor
gtctttgtctctccccttctccccttcgccttcctccttcctaaaccctagccagactgtcctaaatacgctcctctccgctgcgatcgctgcagcgatccgatctttcgccggtcaccggcgccggagacgccgggctccataatcatggctgtgtcgggcgcccccgagcagccacagcgggagcagccacagcaggaccacgatgaggagatgctggtcccgtatcaggatgccattgaggggccgcagcaggatgttgttgagggtccgcagccgatggaagaatctgcatccgctgttgagaaccaacttgtgccagatacctccacatccagatttacatggtgtattgaaaatttttctaggcgcaatgttagaaagcactactctgacgattttattgttgggggatacaaatggcgagtgcttgtcttccccaggggaaataatggtgaccacctttcaatgtatctggatgttgctgattcaaacttgctgcctcctggttggagtaggaatgcacaattcagccttgctgtggtaaaccaattagacagcaaagcatcattaagaaaagaagcgatacaccaattcaattcccgtgaaagtgattggggttttacatcttttatgcctttgttggatctgtatgattcaagtaaaggatatgttgtgaatgataaatgtatcatagaagctgaggttgctgtgcgtaaaacttttgatttctggaactatgactccaaaaggatgactggttatgttggcctgaagaatcaaggggctacctgttacatgaactctcttcttcagactttataccacattccctactttcgaaaggctgtatatcatatgcctactacagagaatgatacaccttcagggaacattccattggctttgcaaagtcttttttataaacttcagcattgtgataacagcgttgctacaaaagagctcaccaaatcttttggatgggatagctatgattcgttcatgcagcatgatgtccaagagttgaatagggtcctatgcgaaaagctggaaaacaagatgaagggaacccccgtggaaggagcaatacaaaaattgttcgagggtcaccatatgaattatatcgagtgcattaatgttgactcaaaatcgaccaggaaagagtcattctatgatctcgcacttgatgtcaaaggatgttctgatgtctatgcatcatttgataagtatgttgcacaggagaggttagaaggcgataataagtatcaatctgaggaacatggtctacaggatgccaagaaaggaatgctttttattgacttccctccagttttgcaacttcagttgaaacggtttgaatatgattttgtgcgggatacaatgctcaagataaatgaccgttatgagttcccacttcaattggatcttgatagagatgatggaaaatatctttctccagatgcggatagaagtgtgcgtaacctatatactcttcacagcgtgctggttcatagcggcggagttcatggaggacattactatgccttcattcgcccgaagctgtctgatcaatggtacaagtttgaggatgaacgagtgacgaaagaagacatgaagcgggcattggaggaacaatatggtggtgaagaagagcttcctcataccaatgggcttaaaaatgctcctatcagatttacgaagcattcaaatgcttacatgcttgtttacatccgagaaagtgacaaagagaaaatcatctgcgatttagatgatgaagatataccagaccaccttaaggttaggttaagaaaggaacaggaagagaaggaatgcaagaaaaaagagaaggctgaggctcatatgttcactgcattgaaggtggcccgagactctgatttcaaagagcaaattggaagacacatgcattttgatctcgtggactttgacaaagttaatagcttccgtgcacctaagaacatgtcaatcaacgatgtcaaggaggagctttcgaaagaatttggcatcccagtagaatcccaacgattttgggtgtgggcaaaacgacagaactttacctacagacccagtcggccattgaccttcctggaggaaacatctgctattgggtatctcaaagacgcaatagtggcaaagttaccaaattctgaagtacggttgttcttggaggttcatttgggacaggagaatcaaggaattgcttctgggaagaccaaagaagatatattaattttcttcaagctctatgatcctgaaaaggaagacctaagatatgtaggaaatttttttgtgaaagcatcaggaaaaccatctgatatagtagaaaggctgaatgagatcgccggatttccgtctgatgaagatattgagctctatgaggaagtaaaatttgaaccagcggtgatgtgtgtaccaattgagagcaatatttcgttccgttcaagtcagattgacaatggtgatataatatgctaccaaaaacgctgtttgccagattcaatggatcgataccgatatccaagtgtcccttctttctttgaatatattcataatagacaggttgtctacttcagattgcttgataaaccaaaagaagaaggcttctctctggagctttcaaaacgctccacatatgatgatgttgttgagaaggttgctcggcaactacgtctggacgatccttctaaaatccggcttactcaacacaacctatcgtctcagcaacccaaacctcaccacatcaaatacaggagtcttaattatctttcagacatgctacataatcataatcagatgtgtaacattttatattatgacgtcctggatattccgttgcctgaactagaatctacgagatcactgaagatcacttttgaaaacgccacaaaccatgagatgtcgtttcacactatgcggttaccaaaaagtaacactcttcttgatttgattgaagacttaaagtcaaaggttgaactttcttgtaatgatgctgaatttcggttttttggagtccaccttcacaagatatgcaaggtgtatcaacctggagataagatagattcagttaacgaacccttgtatattgaagaggttcctgaggaagaaaaaaatgctgggcctcatgaccgtttggttcatgtctatcacttcgaagataatcgtcatgttcagtattttggagaacctttcttctttctaattcgtgatggtgaagctttgtcggatatcaaagtacggattcagaagagacttcaagttcctgatgagcagtttataaagtggaaatttgctcatgttacattcagtaggccagaatacctccaagattcagatattgtattgaaccgattccataaacagaaacctgtttatggagcttgggaacaacaccttggattggagcatacagccactaccccaagaaggtcgtactttggcagtcagaaccgccattcttttgagaggcctgtgaagatttacaactaaaactggcaatattttttgcatgtgatgaatgatgaacaggatatgatggcagtcttgttccaaaaggagtctcttatgtttttggtgatgtacatggtggaggttttgcatagagtagtttatgtggcaatttatcagaagaattttcatttggtggatgtacagggttcgtatagcaacatttccttgtagcaagttgaagctgtatatcgagggtcgataacctgtgtttttgtcgtttcgtccccaagcctctggggagctgtgaaccatagcctcatacaatttgcgttgcagttgattcagtgtttttatcgttggtcattatgacctagcctgattcgcaagtgcgtcgtgttgggctctggcaaaagattttgacttgtcatttgtctctgggtc

SEQ ID NO: 151 - DNA, 1508 bp, Sorghum bicolor
ccttgtcttgtctgcttgccccttgagttctctagcaccttacctgctactgatctgcagctgatcgatcgccaaagcttgcaatcaagcctgctatattaccctagctagtgactataccaccatcatcgccatgggctgctacggtgatttcttcgagaaggccaagccttacatcgccatgacctccctgcagtttggctacgccggcatgaacgttatcaccaaggtgtccctcaaccacggcatgagccactacgtgctcgtcgtctaccgccacgccttcgccaccatctctattgcaccatttgctctcatccttgagaggaaggtgaggcccaagatgacgtggtcggtcttcctccagatcttcgtactcgcactgctcgggcctgtgatagaccagaacttctactacgccggtctcaagttcaccgggccgactttcgcgtgcgccatgagcaacatccttccagccatgaccttcgtgatggccgtgatttttaggatggagaaggtggacctgaagaaggtgaggtgccaggcgaaggtggccgggacgctggtgaccgtggccggcgcgatgatgatgacgctgtacaagggcccgctgatgaagatggcgtggaccagcggccacggccacgcgcaaggccacggcgccgaggcgcccgctgccgtcgccgccgccatcgaccccagcggccgggagtggttcctgggctcgctcttcgtcatcatcgccaccctcgcctgggcctccctcttcatcctccaggcgcacaccctgaagcagtacgcggcgccgctctccctcaccaccctcatctgcttcgtcggcaccctgcaggccatcgtcgtcaccttcgccatggagcaccgcccctccgtctggaccatcggcttcgacatgaacctcctcgccgccgcgtacgccggcattgtgacgtcgagcatagcgtactacgtgcaaggcctggtgatccagaagacggggccggtgttcgcgtcggcgttcagcccgctgatgatgatcatcgtggcagtcatgggctccttcatcctcgccgagaagatattcctcggcggcgtcctcggcgccgtcctgatcgtcatcgggctctactcggtgctctggggcaagcacaaggagacacaggagaaggaagaggaagaggccatggagctgcccgtggcgtccaaagccaacggatcgggaataatctacgacgacgccgtcttcatcaaggagatcgccgccgtccccgccgctggtgttggagatgagtgcaggaaggccaatggggtggtgtacaagtcatcctcctcccatggacacggagctgctggtgcagtttgatgcagcatgcatggctagctagtgctaagctgagcgcatagctactactacctggatggaacatggaagaggcggtgtccatatgctgactgtctttgtcatgtgtgtcccattgaaaccgttttgtgtctactgacgttgcatccat

SEQ ID NO: 152 - DNA, 2344 bp, Sorghum bicolor
ccccctcatgtcgtcgccttcctccccgcgctcttgcccccgcatctgctcgctcccccaccagcaccacgcgctcgcattaacggcgaaggctcatctctgattatggaggtaacagtcgtctagcacaccgcaccgccgggcgtccctctctgttgtcgttcccagtttagaggagagtttttgtttcggttccttcgttccacccagcgccgcggcattctgtgggtcgtgtggatttgatttggccgggggaaggaggctggtcaaagatttgtggtggaattgatggtggggttcatggaatgggtgcatgactggttgctgtgggacgccttcttggagtgcggagggatcatgaggccaccgattagatagcggctggggagcgagggaccaccggaggcggaggccgccgttagcacccacaccaccccgcggcgcgtgtccgcagccatgggggaagacctcgtcaccaccctgtccatggagaacggcggcggcggcggcggccaccacggcccctgcacgctcctctccatggacccgtcgggccacctctccgcgccggacgaccgcgccgtcggcgtcatggtgcaggccctcatcggaggggccgtcggcgtcggcgcccgcgcccacgccgtgtcgccctccggcgcgcctccgcccgacatcaaccagccctggcagacggacctctgcgacatgctggacgtcggcctcggcccgcaggtctacagcgccgaggcagtactcagctgcgctcccaaggccgggaaccggaaggccgccaagcgcggggacaccatctggggcgcctggttcttcttcaccttctatttcaagcccctgctgtccgacaagtgcaaggacaaggtcgtccgggacaacagcggcgtctccgggttcgacaagtcggacctccgccttgacatgttcctggtgcagcacgacatggagaacatgtacatgtgggtgttcaaggagcgcccggagaatgctctggggaagatgcagctcaggagctacatgaacgggcactccaggcctggggagccgcagtttccattcagtgtcgacaggggatttgtgcggtcgcacaggatgcagcgtaagcactaccgggggctgtcaaacccgcaatgtattcatgggatcgaggtggtcaggtcaccaaatcttgcggggctcactgaggcagaccttaggaggtgggcagagcttacagggagggagctcaatttcatcatcccgcaggaagccagtgattttgggacatggaggaccattacaaactcagagcttgagcttgagaagccacaccctgtcatgaagagcaatggtacccagaacccaaagaaagcaggcttgaatttgtcatcaccgtccaatcattcaggcgaagatggtatggatctctccccagttagcagcaagcgtaggaaggaattatccccacaagccatggatgaggaagtattcttcccactgaattcttgccctcagaagacacaacaagatgtggagatgcattcaccagcgcaacctgcatggctccatgagtttgctggggtgatgaaaaatgcttgtgggccagtgactgctgccaagtctatctatgaggatgaccagggctacttaataatggtcagcttgccgtttgttgatcagcagagggtgaaggtttcgtggaggaacactctgactcatggcattgtgaagatcgtttgtgttagtactgctaggatgcaacatataaggagacatggtaggatgttcatgcttgccgatccttcccccgagcactgccctcctggggatttcattcgtgaaatacctctagctactcgtatccctgaagatgctaagctggaggcatgttttgatgaggctgcctccgtgcttgagatcatggtcccaaaacgaggaaatgaacctgaagagcatgaagttagggtctctctgcgaccccctcactttggagctaatgatctacttttgacctaagctgagtaaggtctctgcaccatgttccgtcttgtttgtaaccccagattaatgccaaatgtagctgagaatcaaggtttcagtatgcttgttctctgccaaatgttttcagtacctgtgccatactaagtctcttcagcaacaaagactttggctgaagactagtttgttctagcttttgtgttatgggtgtctttttaaccctcatgtttagattttgtactaagttcaattaaagaaaataatattctgagttgtcacttgtttgattgttggattgtgattatctgtttgtaccagtttcttgtctctaccatccaaaatttacactgta

SEQ ID NO: 153 - DNA, 5171 bp, Sorghum bicolor
cattgactactgacactggcaaaaatatttgccgtacatgcgacgtcggctgtcgtgctcgtgaccgccctcccgcctcctccacctcctgcgactccgatccgctgccctgtctggccggccggccggccggcgggcaagccccccgcctccgccgccgcctccgcgcctgcctgctccctcccccatttcatttcaattgagagctgggagcaaccaaccaaccctagatccaccacaggagaggagaggagatctccccgtccccgatccaattccgcagagatggactcctcctcccccttctcccctgacgaccagaccgacgccgacttcttcgacaagctcgtcgacgacgacgacgaccccgccccgccgcccgccaccgacttgcctcggcccgtctccgccaccagcctcaacgctgcagacgacccacccgccccggagccgcagcctccggtgccggcgcctcccgaggggtcaggcaagggcggagccggcgtccacaccgcggtcaagcaggtgcagtgggcctccttcggaggtggcgcggacgacggtcctgatccgttcgctgatctctcgggaggcgccggcgacgacgacggcttcctcgggagcacggccgggacccagacggcctcgggtcaggacttcttcgctgggaccaactcctcctccgatcagcagaatgtcaatggtcagcacgatcagggaggtggcaccagcactgcagtggacccagcagatcccaagtcttgggaggccatgtaccctgggtggaagtacgacgaggcatcgcagcagtggtaccagcttgatggcagtgtaaattcaaccgggaatgcagctcaggtgctggagaatagcaatcagaatgcgcagcagcagctcaacacgtcttacctgcacaattcgtcgcatgcggggctcgagacaattgctgaggagggcactgccgcagccggtgctgtctcaagttggggccaaggggccgcctcagagtacccacccaacatgctcttctacgcagaataccctggttggtactttgacaccaacactcagcagtggcactcgcttgagtcgtaccagcaggctgctatgcaggctggaacagctagcacgggtcagactgttgttgcaaacgatgttgttgctgcgaattcctcctcgctgacaggctataatgctgcacaaactgaggatgttgctgcccacaatcaggtgacccatcacaattcattctcaaatagtttcactctgcagaaccaatggcagactacggatgcatttggtaacaatgtacgatctgaaagtgctacagataacagcctggctagtagtttctatggttttgaacaaaacaggaatgctgagactaccacttcctctacgagccaacaggctggttttaacacagttgaaactgttacagatcactatggtgcacgcaagggctttgaatcatcaagtcttcagagtggttatagctcatctgacagtcaacaatccagttacaaggcattcgaaccttccacgcgttataaggctggttacaaagcgtttgaacctgccatggataaccagagtggctacaaggcattcaaaccttctacgggtcaccatagtgcttcccagggattcatgccctccacgggtcaccggactgatttcaagggttccagagcttccacagttcaccaggctggttacaaagagtttgaaacttctacaggttacagtacaagtttcaaggcatttgaaccctcttcatctcaacatgctggttacaagggttcccaacctaactacacgggatttgacagttctgcaaaccaccatggttatggtgatgccaatggtgttgtgagtactcaaggctttgtcccaatgcaaaccacgtaccaaggccagaaacaagtaaatgcaacctcgcaagggcacctgtcaaatagttattttggtactgaaaactccatgaactttaatcagcaacaatttctgggtgcaaatgcgtcaaacttgcaattcgatcactccccacatgaaggcaggtcatcggctggtcgaccaccgcatgcccttgttacttttgggtttggagggaagctcatagttttgaaagaaactagctccatgcccgcaagctttaacactggaaatcagttcaagggtaactctagtagcacagtttcagttcttaatctgtcggaggtggtcattgatagagttgatccttcaagcatcactaatggtagtgcacttagttatttccatgctctgtgccatcaacctgttcctggccctctggttggtggaagtgctgcatcaaaggatgtaaataagtggcttgatgaaatgattgcatggtacgagtcttcctctagtgaattccagaaaggtgatactcgcaagttgcttatttcattgttgaagatactatctcagcactatggaaaactccgttcaccttttgcgtctgacccattgcaagaggagacaaatggtccagaaatggcagtaactaagctattttcatcgtgtaagagaagcactgctcatatgggagattatggatccattgttccgtgcatgaaaaatattgcttcagaaagtcagatgcaggctgttgcacaagaggtgcaaagtcttctagtttctgggagaagaaaagaggcccttcagtgtgcccagagaggtcaactttggggacctgcaatcatactggcattgcagcttggtgatcagttttatgtggatacagtgaagaaaatggctcacttccattttgtatctgggtcccctctgcgaacgctatgccttctcattgctggacaacctgcagatgtttttaatgtagagaacaatgtcaacagtgactatggtacatcccgtcaacctatggagcctggtcctaatggtatgttggatgattgggaggagaatttggctataattactgcaaacagaacgaaaggtgacgatctagtaatcacccatcttggtgattgcctctggaaagaaaaatatgaggttgcagctgcccattcatgctatttagttgctgaactaaatattgattcatactcggaaagtgcaaggttatgcctcattggtgcagaccacttgaagtgtcctcgaacatttgccagccctgaagccattcagaggacagaggtttatgaatacgcgaaggtgcttggtaattctcagtatattctactaccctttcagccatataagctgatatatgcatacatgcttgtggatgtggggaaggtttctgattctttgaggtattgccaagcatctatgaaggtgctgaaagcctctggtggtgcccctgaattggaggtgtggaaacaattattttcttcactggaggagaggatacgcactcaccagcagggtggatatggaacaaatcttgccccagcaaaactagttgggaagatttttacctcgcttgataaatctatatcccacatgatgggtacaccatctgcaccacttccaccattaccacatggatctgttagtgatagagagagccactctatgcctgcagcagcaaaatttggaaatagccaatcggcaatggccatgtcatcgttaatggcatctgcttcaatgcagtcaatgactgagatagcagagaatagtggtggcactggcaggacaattgcacagaacagaagtgtttctgagccggagttcggtagaacatcaaaacagggtgctggatcagatggcacacagagtagtgcatcaggatctggtagttctcgatttggttggctagtgcagaagactatggatttagtgtcgaaatcccaccgccaggcaaaattaggggatcagaacaaattttactatgatgaaaagttgaagcggtgggtggaagaaggtgctgctgttcctgccgaggagcctcctcttcctccacctccaacaaaaccatctttccagaatggtatgccagaccataagttgaatggccccgtgagtgtaaaccatgctcccaatggagtcacagaatggaaatcctcaaattcttcggatcaaggaggtctgggtatgcctccaattccacctagccaaaaccagttttctgctcgtggacggatgggtgtccggtccagatatgttgacacattcaataaatcgggtgcgtctggagcagtgccatcatataacaaaccagctgctccatctgtgacaccaccagctggtgccaagttcttcatgccgactgcagcacctgctgctgcagatcagatggtgccacaccaagcggcagagatacacagtgaaaccatccatcaggatgagcggtcagcctcaccaccagcagaaacatcaatttcttcaaccccaccacccacacaattttcatcacccccaccgcacttgcaattttcatcaccaatgcaatcaacaattcatcggcaatctagtatggagaatatctccaccccttacctgggttctggggtatcatcattaagcagcagcagctcattctcaaaatcacgagccgcatcctggagtgggacatactctgagcagtatagtgcttttgcgggcactcaatcacctgacagacagacgatgccttcaccactcatgcctggcaaaccatcacacagtcgttccaacagcaactcatcactgcagctcaatggattggcagaggatcttcatgaggttgagctctaactgatcactgctcagcatgacctcatgtcttgtatccacaaagacagccatggcaaccgctgacggttccagaaaccccaaagcgggtgtcagaaaagaagctgccctcacaatgctgatcacagggatgacacagttggaatgggttggtgccactttgcacgggattctgggggcgcgctctaaaccaccgaggtgcgtcagacctgtactaacagaaatgcagggtttttgaacattttgtagttatatctcctatacaactaaaaagaagaaaagtaagatcaccaaatggtgcgataattttttgggttgcccccacctctccttgcgattctaaggtggaagggtgcaaaaacaaataaagaataagaatggattcctgatgtaaatatacaatagagaaacaatatataaatgtggaggtggaagggaaaggattcctg

SEQ ID NO: 154 - DNA, 2606 bp, Sorghum bicolor
cccctttccctccacgacgctcctccaacaagacaaggcaaacgcaacgcaaggggggcgttgcacagagaaagggcagtgcagtgcaggggcgtgaggtagacgacgacggagggagggatcgatggaatggaagaggaagacgaccgagtgcttgcccacagctctgactgacgagatcttgcactagatgggacttatttgatgttttcgccattctctacttcggtgcgagctaatggatctctacatgaaacttctcctggcctccctcagctgtattctcctgatgcaagcagcatcatgtgatggcaccacaggcgaaactgaaacggcaaactggacatgtgtatgcgcagctcatccactagatgaaccaaactctaacagcagcctgttgtccaattgctcttcatcctgccattgccaacaagatgataatggtggcacagggtcatggaactgcacatgtgccgctgataagggccttcagaaagaagaacatgctgtgctacgtgccaggagttgcttcacttcctgtaactgcacatctggtattggaagttcagaggaagggaaaaggcatgtctccagcaaaacagtcataattacgctcctagtttgtgtgattctcaccactactgctttccttgtcaccaccgtatactacttccgccgcaaggatgctctctctccacgatcgcagatatactccttcgataaatacactagctggagcagcagatcgaaccttgtcagcaatcgatcgtctccacttccccaattgaaatcaaaaccaaggcttggtgttttaaaagagtttctgtgtagctgcaacctcatctgcgggggcgaaagcggcacgttccctggtgtcattatccggttttcatacgcggagttggagcaagcaaccgggaaattctcagacgagcatcttatcggagttggtgggtcgagcaaggtgtaccgaggccagctcggcgatggcaaagttgttgccgtgaagaagcttaggcccctaggaggtgcagatgaagacttcgaattcctatcagagatcgagctgctgtcgaggctgaaccactgccacgtagtgccattgctggggtactgctcggagagccagggccggcagctggagaggctgctggtgttcgagtgcatgtccaacggcaacctgagggactgcctggacctgaagcaagggaggaggcccatggactggcagacccgggtgagcatcgctctcggcgccgctaggggggtggagtacctccatgaggcagccgccccgcgtatcctccaccgtgacatcaagtccaccaacatcctgctggatgacaagttcagagccaagatcactgaccttggcatggccaagtgcctgatgaacgacggcgtgacgagctgctcgagctccccggcgcggatgctgggcacgttcgggtacttcgcgccggagtacgccatcgtgggcaaggcgtcgctcaagtcggacgtgttcagcttcggcgtcgtcgtgctggagctcatcaccgggcggccgcccatccacaagtcgtcgtcgacgagggccgacgagagcctcgtcatctgggcgacgtcgcggctgcgggacagcaggctggtggtgacggagctgccggacccgacgctgcagggcaagttcccggcggaggagatgcagatcatggcgcacctggcgcgggagtgcctgcaatgggaccccgaggcgaggcccaccatgacggaggtcgtccagatcctcgccaccatcgcgccactccagcagggcgccaagcgccggaacctccccatcgccgccgccttcaacctcacggcgtcgccgcacgttgggaggtgcgacccggagcctaaggacgacgacgacgacatcgagaggcaacagctgcagcagcaggagtgctcgccgacgacgcccgtccagtggaaacagcaagcgcggcgcgcgccgtcgccgccaccgggccgcgcgtcgtggcccggcgacagggggaacgttgtgagcagaggcgcggtggtgtcgggcgagctggtgaacgggacgctgctgatgagcccccacgggcggggaagctggcggcggccgccaccgccgcctggcgacgacgaggaggcggtggacgtggacctgacggagcctcggatggaggcgttcacgcagccggcggcattcagatgacgaaaggattagcaggatcgggaggagatggtgatggttttgattgctgcatcagcggcgggtgctgtacatcttcttgttcatggctccacgatccacagcagcatctgcttctgcttctgcatctgcgtccatgaatgtacagtacaggcgaacgcatctagatcgacaaggggaaaagaaatggtattgagatcgttgtgggatagggatagataggttgaagttgaacacgagatcaatgccgataggatggccaatcctccatggctgaagtgaatccacagcgcacgagagagagatccgacagcaacactgggtatccagcgattgtaacaaaagcagatgtgcatgtgtgtatcatcttatactctgtcaaaagaaaaaaaaaatgcaacta

SEQ ID NO: 155 - DNA, 1383 bp, Sorghum bicolor
tagagatgatactgggacaactaattcgacaatgctactgaagcaagatagggcgtgcatataatcccaagctcctcatagaaatgaatacagattttcatatgactgaaggggaaggagaatggagctactccaaaaattctaggcgtcaagaaattttttttcttgagacgaggccaatgattgagaatgccataaaagaagtgtacacaactcttctccccaaaactatgatcattgctgacctaggatgctcttcagggccaaacacaatgctcttcatatctagtgtcataaacatcattgttgaaaaatgtaaatctactggagatgattgcatggaacttcaattcttcttgaatgaccttcccggtaatgactttaatgaactatttcggtcaattgagaagttcaaaaggccaaatacaacaggtgaaagggaacatctaccacctttatattatattatggggttaccagaatcctattacaaaaggctttttcctcgtgaaagtgtccatctattccactcttcatactgccttcactggcgctcccaggaacctgagggactagaggcatggagaaaaacttatctaaataaaaacaacatttacattacgaagaccacaacaccttttgtggtcaaacaattccaaaagttgttctacaaggacttctccctcttcctacagctgcgtcatgaagaacttgtgcatggagggcaaatggtccttatatttcttgggaggaagaatgaggatgtatataatggtgatctcaatcaactttttgcattggttgcaagatcgttacagtctcttgttttgaagggcattgtggagaaggaaaagctagaatctttcaatctaccaatctatgggccgtcggttggagaagtgaaggaactagtcatgcaaagtcatttattcaacatggatctaattaaacaatttgagatgaactgggacccttttgatgatttagaaggtgatgatgttgaggataatacccgcagtagcatgaatattgctaagttcatcatgtccgtactaaaatatttaattgttcaccattttggagaaaccatactcgatgcatggtttgccgagttcaagtgcctcgttggtgagcaccttgaaaaggagaagaccaagttcaccgtcatcgccatgtccttgaagaaagaataatatagatctatatgtgtgttgtttctcaattcttttactcaaatgccaaagaatattatgtatgtttgtatttgtgcatgtgtctctctgtgtctgtacatgcatgcatacatgtctactcctactttgtgtagtcactccaatgtgtatatcttatgataggtcgtatatggccaatgaagtatatttg

SEQ ID NO: 156 - DNA, 1608 bp, Sorghum bicolor
agtcagccgacagacacacagcgcaaagcccccccacgagaagatccgccctctcctccggtcctccgcgttgctgtcacgccggcgtcgaggctcgagagaaggcggcggcggcgggtgagcgcgtggctgtggggtgtgtccgtccggtgagatagctgggggacgcgccggctcgtgctgtgacctggaagctctggaggcgctgaaagcggcctggcaggcgggcgatggggtgggggtggtcttcctgctgcaagcggtcggacggggctgagcctggtaggaggaagaagaagaaggacacgacgtggcggatcttctcgctgaaggagcttcagtcagcaacaaacaatttcaattatgataacaagctcggcgagggtggttttggcagtgtctattggggccagctctgggatgggtcacagattgccgtgaagaggctcaagagttggagcaacaaagctgaaagagaatttgctgtcgaagtggagattttggcacgagtgaggcacaagagccttttaagcttgcgcggatattgtgctgaaggccaggaacgcttgatagtctatgattatatgccaaacctgagcatacactctcaacttcatggacagcacgcagcagagtgcaatctcagttgggaaagaagaatgaagattgctgttgattctgcagaagggatcgcttatctgcatcactatgcgacaccgcatatcattcatagagacgtcaaggcgagcaatgttctcctggattcaaatttccaagctcgggttgccgactttgggtttgccaagctaattccagatggtgcaacgcatgtcaccacaaaggtgaaaggcacacttggttatctcgcaccagagtatgcaatgcttgggaaggcctctgaaagttgcgatgtcttcagttttggaattatgctcctagagcttgccagcgggaagaagccagttgagaagcttaaccccaccacgaagaaaaccataactgagtgggctcttcctctagtccgtgacaaaaagttcaaggaaattgctgatccaaagctcaaggatagcttcgtcgaggatgagctgaagcgaatggtgcttgttgggatcgcctgttctcaagacaagcctgaacagagacccataatgtctgaagtcgttgagctgctcaaaggagaatctactgagaagctttccaacctggagaacgatgatctgttcaagcctgatagctcattccagagctcatccggacctgatagctcagactgcgtcaccgaggagaggagtcccaaagctgatgcgatagaggaggcagttgattcaagtgagacagttccctcagcaaggtagcgtgatgcatagtggtgttgtctgtaggtgccctgagctccttgcctgggagaaatgtgtttatcagtgtgcttaatttgggagcttccttgcccagttctcctatgtgctgtcatctcttcgtgttggcatggtactattagcttgtaaaattctgtaaatctgggcctgattccatctgtagcactgctgttagcgtttagctacttaaatccatcaatgatttgtgtgcaagtcccataatgttattttt

SEQ ID NO: 157 - DNA, 1936 bp, Sorghum bicolor
gtgcactggtggctttgtattctccacgctgctaaagacccagcaggcatatagatcggtcctcgtcaagccgccccgaaggtgattcacgggtgcaccgctgcactttgccggccagctcgatcagggggaggcccgacgaagacgtggcagcagaggtccgagtccgatccatgggcgaggaagcagcggccgcgcccaccgtggcagcagcggcagcgacaggaaccggcggcgccccgccgcacctgctcctgatctgcttccctggccaaggccacgtgaacccgatgctccgcctggcgaagcgcatcgcggcgaaaggtctcctggtgaccttctcctcggtctccaccgtcggcgcgaagctggccgcgtcggcgggcgtgtcggccggcggcgacggcgtggccgtgggccgtggccgcgtccggttcgagttcctcgacgacgaggaccccggccctgacctggacgacctcatgcggcacctcgccagggaaggaccgccggcgttcgcgaagctgctggcgcggcaggcggcggagcgcaggcccgtggcgtgcgtggtggtgaacccgttcatgccgtgggcggccgacgtggccgccgacgccgggatcccgtcggcggtgctgtgggtgcagtcgtgcgcggtgttctccctctactaccaccacgtgcacggccttgtcgagttcccgcgcgaggacgaccccgacgcgcggttcacgctgccgggtctccccgagatgtccgtcgccgacgtgccgtcgttcctgctgccgtccaacccgtacaagctgctggtggacgcgatcatcgcgcagttccgcgccatcggacgcgcgtcgtgggtgctcgtcaactccttcacggagctcgagcgcgacgtcgccgcggcgctcccgggggtgactccccgcccgccggagctcatccccgtcggcccgctcatcgagctcgccggcgacggcgacggcgcggtgcgcggcgacctgataaaggccgcggacgactgcgtggagtggctggacgcgcagcccccgcggtccgtggtgtacgcgtcggtgggcagcgtggtgctgctcaacgcggaggaggtcggggagatggcgcacgggctcgccgccacggggcgaccgttcctgtgggtggtccggccggacacccgggagcacctcccggaagggttcctggacgccgtggccgggcggggcacggtggtgccgtggagcccgcaggacagggtgctggcgcacccgtccacggcctgcttcctcacgcactgcggctggaactcgacgctggagaccatcgcggcgggcgtgcccgtcgtggcgttcccgcagtggggcgaccagtgcacggacgccaagttcctggtggaggagctcaggatgggggtccgcctccgcgggtcgccgctgcggcgggacgccgtgcgggaggcggtggaagcggccgtggccggggccgaggcagacgccatgctcgccagcgccaggaggtggagcgccgcggcgagggaggccgtggcgcccggagggtcctcggacaagcacgtccaggcgttcgtggacgaggtggcacggcgagcgtgtggcgtgcaagcggctaaggtcgtgccgccgccgccgccgtcgtcagagactccagactcgtagagcaatcagcagtcaccagttaagagagtccgaagctgaaagcgagtaataatcctgcatgttgttacagtttcaccgtgtgatagtacgaaccgaattttgcttcttctttttaccgtgtgttgacgacgacgcctttttgtttttgtgttggtcgagtgtgcatggaacattccaaggtgacacgtctgtctgctggtttgggctttggggtgtggccgcgcaaaaggcattttattgaacttgatcgatctttatcgatcttcgaa

SEQ ID NO: 158 - DNA, 2448 bp, Sorghum bicolor
ccccaatccccatccgaccacgacgctgccgcggtccgcaggtcttctcctacaaaaccaccagagaaagagaaacacacacggacaaggccgccgggcaggcaccacgcgcaaaagcgagagactacctggagctatgccactccgcttgcccgcctgccgcgtcttcctgctcctcgccacggccgccgccgtctcagcgtcggccgagtccaacagctccgccaactgcaccttccgtgacggagacatcatccgcgcggcgttcagccaggtcgccaacttccccttgccgctgcctgctcctgctggccgccgccgccgcgcgtcgtgccgccccgtcaggcggctccacttcccgtcgcggaacctcacgggcgccgtgaactgggccgagctcgccaacctcaccagcctcctcaccgtcgacctctccgacaactccctccacggccgcatcgacgacgacgcctcgttctggcgcgcgccgctgctccgcgccgtggatgtctcccgtaaccacctccaaggcgtcctccgcttcgacgacgacccgggcacgcgcctcgcgtcgctcaacgtgtccggcaaccggttcacctccgtccacggcgtggccgggctctcccgcgtggtccacctcgacgtgtcgaggaacgccatcggaacggtgccggagggactgcggagcctgacgctggtccgcgtgcttaacctgtccgggaacaacatgaccggggtgttccccgacgacctgccgcctctcgccggcatccaggtcttggacatctcgcacaacaacttctccggcgcggttgacgccgccaccgtccttaagttcggcaactcctccttcttccaagccggcaacgcgttgcgagtgatcgacgacgtcgcaccggcttcttcgccggcgctggcgccgtcgtctaatggcggagacatgaacaggcgtgcggtcaccatagcgctaatctcagtcggcgcaacggtgaccctggcgtgcttggccgcgtgcgccttgacgcgtcgtcgccggaacaagaagaagaagaagaaggacaaggacgggaaaacagcggtgtgggaggacgaggaggtggtggtgggggcggtgaaggtggccgcggcggcgccggtggtggtgctggagcggccgctgatggagctgacgctggcggacctggccgcggccacgtccgggttcgggcgcgagtcgcagctcgcggacacgggcggccgcagcggggccgcgtaccgcgccgtgctccccggggacctgcacgtcgttgtccgcgtcgtcgagggcgccgtggctggagttgcggaggacgccgacgccgccgccatcgaggccgggttccgggagcttgcacggctcaggcatcccaacattctcccgctccttggttactgtattgcagggaaccaaaaacttgtgctttacgagtacatggagaaaggcgacctccaccggtggctccacgagctgccagtggggagcatggacaccgaggacatctgcatggacaccatggaagccatcgaggacagaaaacccgccggcgactggccgactcggtaccgcatcatcctcggcgtcgctcgaggtctcgcgttcctgcaccaggggtggacgggggcggccgccgggtccggccggcggcggcggcccatcgtgcacggccgtctggtgccgaccaacatcctgctcggcgacgacatggagccccggatctccgacttcctgcaccgccccggcggcggcggcggcggcgacgagacggcgacgccggcgagcgacgtgtaccgcttcgggacggtggtgttcgaggtggtgacggggcaggcgaggtggggcgacgcggcgaccacgagctgggcgcgcggcgtgatccggaaccgcaagggcctcaacctcgtggacgaccggctccgggacgagacggcgggcacggacgccgagaaggagatggccgagtgcctgcaggtcgggttcctctgtaccgccggcgcgccggagaagaggcccaccatgcagcaggtggtcgggctgctcaaggacgtcaggccgccggcgacgaccgccggagccggaggagtgccgccgctcggggtctcatgagatgcagcgtagcgatgagcgcacgcacgcgactacggtcgggaatgtggtggtagctgcaggctgctttttttcgcacggtagctcacaaatccaagaagattcgtggtgatttttggggcagggagataccgcttctctgtgcgctgctttttgggggtcccctttgttgggttgtgtgttgtttccatcttgtgttcgttgaaggtaggatgacactttttttggttggtacgaacagcagctttgcttgtgacagcatgcaggactacacgtttggagcgactgtcattgaacacgaggtgcctggagtgagagttcgt

SEQ ID NO: 159 - DNA, 804 bp, Sorghum bicolor
attgacctccatcaactggtgctaggggagaggaattactagtagaagaaaaacaaaattaaatcgcgagttagggcggcggagatgaacgttgcggaggaggaggaggtgagcatggcgggggaggagaagggcggcgctagcggcggtgttcgcgatggcgaggtgaggacggcggcggcgggtgcgggggcggtgagcctggagacgctgcggaagcggatggcggacttcgcgacggagcgggactgggagcagttccactccccgaggaacctccttctcgcgctggtaggggaggtgggggagctgtctgagatattccaatggaaaggggaggtgcccaaggggctgccaggctgggacgataacgagaaggagcacttgggcgaggaactcgccgatgtgctcctctatctggtgcggctgtcagacatgtgcggcgtcgacctcggcaaggctgccctgcgcaagatggagatcaatgcccgcaaatacccagttgggcagtgcaagggttcatccaagaagcacactcactacggctccactaacaatgttagcgacaatgctaacaccgtgaacaaggagaacagcaatggcgtctaaaacgactcggagctccttgaatgatagtttggctggtcggacatgatctaggttatgtgctgatgaaatagggatgctctattttggtggtaaaggaacaagtctgtgggttcaagtttcactatatattagatgcctaatgaaccaagtgttaaccacaaatcttcgtaggctgtagttccccttatattctaa

SEQ ID NO: 160 - DNA, 1769 bp, Sorghum bicolor
acttgcatgctctcgcagtctcgctctcctctcgctttctcctctcttgttcttgacacttcttgtgatcgccaccggcctcgacctcacttactagtatatttccagctcgagagaagcgcacggcaggcgagaagaaaaggcgctgacgcctcgtttccgtcgcacacactactcgccagattggatcactccccttccctgctcttccgtcttccgcgggccgggcaaagctctctggcgcggcgacacttcctccaagacctcgccgccggcgtgaggggcagtcgccgccggcagtccgcggcgcggagcatcaaggccgcagcaaaagggagagcaagtgggcgaagtggtactgttgcggtattctccggaacactctctccatccccatccccatccaccaaagcagcagccagcagcaggtgttctcaaaatgcagtcatctgtgatggcgttcttccctagtgttgccacagcaaaactggagctgaattctctgtacaggaaatatgtggacatgtttggtatatcgttaaacaactctaccgttggctgccatctcacccgcaaaatggcgcaccttcctgttctgttgatcgatcgtacatttttcagtactggttctgctattcagagtattgccaccagctacggagctcttattcgtaggtggttactgaacagaacttctgttgtacagcacacgctgatttccagtgctatgaactcactgtcttggtgtggctccttgccattctttgtcagcattggtgttctaatcaccaagctctgtgactgcactatgaccccgaaccgtttttgtggtcggcaatgcatccttagtcatagtgctaacctccgtggagaatcagttttggtcatggacaataatgaactgggcaatgatcagagcttcttatcaagtttccttgggcgcaagcgagattatgtcgtcctagcgcttcagtgcatctgttaccctgcttgtctgaaggttgttgatgtcccccacaagaagctcagcttcagcaggcagtggatacggactggccatgacacaagtgcaatttggaggatcatggcaaggaatgaacaatacttggcatgcatgatagtcctggcagccttgcaagttttcctgcggctaaccagagtgaatgttaccattctgttcttgccaatgctgtcccgagccataagttccaggagcagcccagcagtgatcggtaacatcgtgctggttttggtgaactcctgtggagttcttggatctgcactttcagtgaaacagcttggcagggaggtgacgttcgccatcagtgccatcgtgatggtaatttgccaggtcgcaattccattgatcctagaagttcagatcggagttggtggtggaactcgcatgccgatgggttacacaacagcgatgttcgtcctgacttgtgttgtctcctgcggcctcagctggtcatggggttcattcttctggaccttccctggtaggaaggttcactcggctggacaggttctggccatggctgtgaacctgggcgtctgcttcgcccagatgcagtacttcctgctggtgctatgcaggctgaagaacgccactcttgcctactatgcactgtggatctggtcatgattgggattcagctgaggaaaatgcgtagctagatgagtgtgtgttaactctggttacttgagtgggttagtttggtggatgtaaatatttctcttcccacttctttatcttggcctggttt

SEQ ID NO: 161 - DNA, 1717 bp, Sorghum bicolor
agagaccgcaactgcaaggcaccgaaggagaactcaccaggaagcaacgacgccgacgacgcggaaagaggaatccacgggtcagagaagccgctcttgttggatattctgttcgtcagttccgtcgcggagggcttctccttccaccggcgtcgacctctactggtgctggactgccgtggggtggagatcggcttggatcaactcttattttaggttctgttgttggtgcgaaaatgagtgataacctgatggacaaggttagcgcctttggcgagcgcctgaagatcaccgggacggaggtcagcaaaaagatgacggctggaatgagctccatgagtttcaagatgaaggagttgttccaggggcagaccccggctgacaagattgttgaggacgccacctcggagaatctggacgggcctgactggaactcaaacctggagatttgcgacttgatcaacacggagaaggttaacagtgtggagcttatacgtgggatcaagaagaggatcatgctgaaggatgcgagggtccagtacctctccttggtcctgcttgagactattgtgaagaactgtgagaaagccttctcagaggttgcggccgagcgtgttcttgatgagatggtcaggttgattgatgaccctcagactgtggtgaataacaggaacaagacccttatgctgattgaagcatggggggagtctggcgatgaactccgctatctaccagtctatgaggaaacatacaagagcttgaaatcaagaggagtgcggtttcctggacgtgacaatgagagcttggctcccatatttactccaccacggtcagttgctgaagctgatgttgactcaagcttgccccagcaagcattcgaagacatccatgttcatacatatactgctgaagaaacaaaagaagcatttgatgtagctcgtaacagcatagaacttctttcaactgttctttcgtcttcccctgaacaggatgctttgcaggatgacttgacagccactcttgtgcaacaatgctaccaatctcagcacactatccagaggattattgagaccgttggagacaacgaagctgtgctctttgaggccttgagcgtgaacgatgagatccagaaagtgttatcgaagtacgaggagatgaagcagcccagggcctcagagcatgcagaacagagaccagttgtcataccgattgccacagaacatgaagattcgactgctatcggcaatgaagacgcccttgtcagaaaaccagctgccgcgagagcaaggtcaggtggagatgatgatatccttgatgatctcgacgagatgatatttggcaagaagggaggtagcagctcccaggatgggccgaaaaagccagatccgaagaaggatgacctgatcagcttttaagtacctttccataattgcagccagtgcttgctattttctggtgctgtacccactcggtagattgaagattcgataggatttgaatcgattgtttattcgcacatacgattcatacctgcccctttcggtttgttcagttaagtcgctgcactttctcaatcttgtttcatgaatgagtcccagtgaccatgaatgtattggatggtggattatgccttgacggggggaaaatgtccagtgttactgaatctctgttcttcactacagtaaaccattgtttaagctcatcgtatgctttggct

SEQ ID NO: 162 - DNA, 959 bp, Sorghum bicolor
cacagcgctgctcttttttccccctctgctctcgttctcgactcgtctcgtctgatcggggtttggacttcattcgggaagaagatcaaatcatggaggcatacttcttgttccacagcggtcgggcctccgcgtgcgcggagcaggaggaggacatcggcgcgccgtcggactccgagtccccgtccacgtccatgtccagggagtccgcgggctcctcctcctcgtcggagctcgacgacgacgccaccagcacctcctcgggctcggacccggaccgcttcgagatgtccgcgctcatgacgcagctccccttgaagcggggcctgtccaggttcttcgacggcaagtcgcagtccttcgcctcgctcgccgccgtgggctccctggaggacttgcccaagccggcggcccggaagcgcatcaagccgtcgcggagctgcggcggcgccctcgacgcgcacaaccgcggccgcttcctctcgccgcgcaggcattgcaccaagcccaagcccgccgccgccaggaagcaggcggccgcgaggagcggcgcgctgtcggttttcgcggtcgccgccgtcgcgcccaggatgccgccgtcggtgacgaggcctgagggcgtggccgccaaggttctcatcgttaattgagacacggatcggcggacgctgcctgagctcaacgttgacgcacacgacacgcgcgccttgatggggttcgctgtcgcaggcacagctacgcaccgccgcatcacacccctgcctgaactaacagccaaatcagtggcattctgttccgttttttgttcttgtttcccgatgcgtttgtggtctttgtagactgaccactttgtaatgaaaatccacagttcaattagaatggacttttagttggaaactcacttgtcttttactcctgtgcatgcatttcagcatcaatcgcattccctagatcactgg

SEQ ID NO: 163 - DNA, 1243 bp, Sorghum bicolor
ctcctcctccacgcacgcacgcacgcgagcgcgcgccacggcagaccaccacgaccgcccgcccgcccgccactgagctccgccgctctggtactggtaccacccctgtccagcccagcggctccaagattgacgccacgatgggcttccccgtggggtactcggagatgctgctcccgcgcgtgctgctgcaggtgctcctcctcctcggccacctccaccgcttcctcctctgggccttccacgccgtggggctcggcgacctcatcgacctcggctgcaactactaccccccgccgccccccacgcccacggcgcaggagcaccaggacgcggccgcggccgcgccgctgcagcaccggcggccggagttcaggcccgtcccgtcggtgctcatcgaggaggcgctccccgtggtgcggttcgacgagctgggcgggaccgcgtgcggtgacggcgactgcgactgcgcggtgtgcctcagcggcatcggcgcgcgcgacgaggtgcggcggctcagcaactgccgccacgccttccaccgcgcctgcctcgaccgctggatgttggcgcacgaccagcgcacctgcccgctctgccgcgcgccgctcatccccggggccggggccgcggccgcggacccctgggccgccgcgggcggcgtcgcgccgtggcccgacgcgggcgactacgacatgtcctacccgtcttcgctgccgtccacgccgctgctgacggcgttgcccaccccgacgctgctgcggcctcacgagctgctgctcaccggcctgggcggcttccagtgagctgctgcgtctgcgtcgtgtgcgtggctggcgctggcagttgggcgaatccgatccgtggcaaggcaaaccgcgtcctcgatgtcatgtgcatgtgcggcccaccccgcccggtcggtcagacgggtgaccgccgccaaacctgctcgatcttcggtcgtgtctccgttggtgaaaggcgaaaccaacggcagaggagagcgctctggtttttacagctagcggctcccaagtgaaaaaaaaaacagacaggcactaggaaactagccaatttggttgatgtgtaggccgattccatcttccaaacctgtggagttgtgaatccttttgcagattactatattttatataagctaaaatctgttaacaagagctctagatcctgtgcagtctggctccatttgtgttgcgacattccgcatcgatcgatcactcga

SEQ ID NO: 164 - DNA, 2187 bp, Sorghum bicolor
gcacttgcagcaaccctctcgccaacctcgcataaattattcgcctctctttgtcactaccgtcgcctccgcgccggagacagcgcgctagcctgcacgtctcgggactcgcgcagcggcagtctctctgctggctccccgggacgtccggtccctctctcgctccgagacgcacgtaggagtagagcggagcgttcctctgtttcggctatgtcgtcttgcgccggcgccacggtggcgctccgggatgccgccgaggaggccctcaacgcctctctgctctccaaagcggacgtccggctaccggtggaggacgtgccgccggtgctcacgagcaagccgccaggccggttcgccagggcggtgaaggaagcctggtccgtctcgctgtccgtcacattccccatgatgccgtccatgtcggccggcgccgcgggcgcggaggcgcggtccatcctgggcctcgcgctgccgatgatcctcacgggcctgctcctctacctccgctccatgatctcgatgctcttcctcggtcgcctcggcgggctggcgctcgccggcggctccctcgccatcggcttcgccaacatcacgggatactctgtgctgtccgggctcgccatgggcatggaaccaatctgcgggcaggccttcggcgcgggccattacgagctcctcggcgtcaccacgcagcgcgccgtgctgatgctgctcgcggccgccgtgcccatcggcggcctgtgggtgcacatccggcctctgctcctgctctgcggccaggacgccggcatcgccgcggtcgccgagacatacattcttgcctccctaccggacctactcctccaggcgttcctccaccccgtccgcatctacctccggacgcagtccatcaacctgccgctcacgctgtgcgccgcgctcgccattgcgctccacctccccatcaactacgtgctcgtctccgtcctcggcctcggcatcagcggggtggcattggcctccgtgctcgccaacctcaacctcctcctctttctcttggcttacatcctcttcaagggcgtccacaagcgcaccggcggcctcgcgctctcggccgagagcttccgcggctggggcgagctcgtcagcctcgcgctgccgagctgcgtcagcgtctgcctcgagtggtggtggtacgagatcatgatcctcctgtgcggcctgctcgcgaacccgcaggcaacggtggccagcatgggcatcctcatccagacaacgtcactcatctacatcttcccgtcctcgctcggcttcggcgtctcgacgcgcgtcagcaacgagctcggcgcgaaccggcccgaccacgccggccgcgcggccacggtcggcctcatgctcgggttcgcgttcggtggcgtggcgtccgcgttcgcgtacctcgtgcgcggcgcgtgggcgaccatgttcacggccgacccggcgatcgtcgcgctcaccgcgtccgtgctgccgatcctgggcgcttgcgagctcggcaactgcccgcagacgaccggctgcggcgtgctgcggggcagcgcgcggcccaaggacgccgccagcatcaacctccggtccttctacctggtgggcacgcccgtggcgctcgtcctcgccttctggtaccactacgacttccagggcctgtggctgggcctcctcgcggcgcaggcgacctgcgtggtgcgcatgctgctggtgatcgggaggacggattgggccgccgaggccaagcgcgcgcagcagctcaccggagcaggcacggtggaggagaccaaagacaaagagagcagcggcaagggcagtcatgccagtaaagtcacagcagccggcggagacgaggagctgggcttgcctatcgacgttgtgatcgagagaccaaaggatcagtgctgacatccaacggcaaccatctgcgtgccgttcgacaattcgagcgattttttgtcatataatttttggcgggagggagaggaaccagaggctgacagagtgactagtttatttcgaattggttatttgtaaatgatttatttctgatggttattataggaaatgagaatattgacaagaaatacgagaaacctatacctgttaagggctcgttctgttggacttgttcctcgtagagaattattcctagtgagaacttgctatacaaattacaca

SEQ ID NO: 165 - DNA, 1393 bp, Sorghum bicolor
cagggccgcgccgcgccggtgaccgtcccgtggcccttctacagaaccgaccccccgccggaaccccgccgtcggatgcgacggagaaggcgtcaatggcgtcctcctctgccgccgagcccagctcccgcctctctgatcgagcgaagaggtcgtcgctgggactcagattcatggtgctcctgatgcacttgctgttcgttggcgctgtcttcatcctcgatccgaccctcgactggcgaatccacgaggagccgtggtatatagggttgtatggagtgcttgtcctgctcacgttagtgcaatacttctacacagctggctcatctccagggtatgttgttgatgtaatgagagctggttccatgatgcatgcaaccttcgtcaacactactgctctttcaaagcagtcaaattcaagaaatggaaacacaagttccccgacgagtcgtgctcaactacagaaacttagcacgatgactcctacatcttcgtgggcacagatggttatggatctttatcctccagggtcaagcagcagggattggacctgcacttactgcagggttgttcagccacctcgtacccggcactgccatgactgtgataaatgtgtccttcaatttgatcatcactgcatatggcttggaacatgcattggcaaaaagaaccattgtcgtttttggtggtacatatttgaagaaacaatcttgtgtatctggactgctgctctctacatcgagtcattgcgtttagatatggacaaggcctggtggaaggactttgttggtgtaatcctgttggcagtgcttatttttatcctaatattcctactactattgtggttgtttcattcgtacattgctctaacaaatcaaacaacctacgaagttgccagaagaaagcgaatattctacctaaggggagtacctgaaagagttcatccattcagtagaggcatatgcagaaatctctacgacttctgctgttctagccagaagggatatattctggaagctgtgcccccaagtgaggagctggaagctagagctgctcgttacacgtgccgagatgtcatttgctgccgttgctgctgataggctgtacaatagcattctgcccatatagccagttccgctgttctttgtccaacctttcgctaatggaagcaaattttagtgacctgcgaccgttagatactctagagttcattatttgtgcatagtcatttgtacatttcactcagaaaatgtgtgccctgagatcaagttgttgacagtttgtctgtaaaattctgtatggccctgcattcaaataggttttaaggacagataggattgatctgtacttttcagttctggtgtcgaatgtacattcgaggtttggttggtaa

SEQ ID NO: 166 - DNA, 3215 bp, Sorghum bicolor
gtccgcacccgcaccaatcctgtccggggactttccgctcccacgccccacgcgcgccagccccgctccttcctcgaactcctcgccgccggctctcctcaactccgccgactcgcttcgctgtccacctcgcccctgtctcctcctgatcccggattcgcctcgccggtccccggtacgtcgccggcggcccggtactcgtccccgcctcccggcgcccgccacgagcgccgtcaagcgaagccttcttcgcctggccgcgcgccgctggcgtacccgccacgctccttccgccggagcacgtcgcggccagttgctctctcgcgctccgtcccctcgctcgtcctcctacaccatcgccgcggggcggccttcgtcctcctcccggaagtgcagatccgcacggggctcgcatatatttttcctctttgctggtaaggaagctcgctccgatggattgctccgagggttagttccgccctggtcttccgttcctacgcttgccagcaatcgagtttcaagtcgtcgatggactgcgatttgctcgctgcgtggtggagcagcagcaccagattaatctccaggatttttcgggggtcagcagctgatgcgccggggccgtcgccaatgaggccagccataccgcttcaccagaagcaggcggggctcgctgctagcaagctaggggtggggacctcgaagaagcacagggcctttgtcgcgagcgatgagcagtggtacaacaagatatttgacccatcgagcgacttcatcttgacatggaaccgcatcttcctcttctcctgcttcgtcgcgctatttatagaccccctctacttctatgtgcccaagatcagctacggcagccccaaattctgcgttggaacagacacccgtttcgccgtcggtgttacattcttcagatcgattgctgatttattgtatgtcctgcacatcataataaagttcagaacagcatatatcaacccgagctcgactctgagggtgtttggaagaggggatcttgtcacaaatcccaagcaaattgcgtgcaaatatatcagatctgacttagctgttgatgtggccgctgcattgcctttgccacagattattgtttggtttgtgataccagccataaagtatacctctgctgagcacaacaataacattctggtgctcatagttcttgctcagtatcttccaagattgtatctcatattccccttaacttatgaaattgtcaaagctactggagttgtcgcaaagactgcttgggaaggggctgcatataacatgctgctctatctgatagctagtcatgtgctaggtgcactatggtatcttctatctgtcgatcgccagacattctgctggaagacgaggtgcttgaatgaaactggttgtgatcttaagtacctagattgtgattcgacactgaatgctacttgggcgagtacaacttctgtcttcagtaaatgtaatgctagtgatgacactattagttttgattttggtatgttcgggcctgcattgtctaatcaagcccctgctcaaagttttgcaatgaagtatttctattccctctggtgggggttgcagaatttaagctgctacggtcagactcttgttgtgagtacctatcttggtgagacactgtactgtatattcttggcggtacttggtcttgtcttgtttgcgcatttgattggaaatgtgcagacctacctgcaatctattactgtgagggttgaggaatggagattaaagcaaagagatactgaggaatggatgagacatcgtcaacttccttgtgaactgcgggaaagggtgagacggtttatccagtacaagtggcttgcaactaggggtgtgaacgaagagtcaatattgcaagctctgcctgcggaccttcgacgtgacattaagcgtcacctttgcttgggtcttgttcgacgggttccatttttctcccagatggatgatcaacttctcgatgccatctgtgagcgtcttgtatcatcactgtgcacaaaaggcacatacattgtccgtgaaggcgatccagtgactgagatgctcttcatcatccgtggaaaactggaaagctccacaacaaatggtggtcgcactggtttcttcaattcaatcaccctgaaacctggtgatttctgtggtgaggaacttcttggatgggctcttgtccccaggcctactacgaacttgccatcatccactcggacagtgaaggcactgatagaagtggaggcctttgcactccaggccgaggatctcaagtttgttgccagccagttcaggcggctgcacagcaagaagttgcaacacactttccggtactactcacaccactggagaacgtgggcctcatgcttcatccaagctgcttggagacggtacaagcggaggaagatggcaaaggacctgagtatgagggagtcattcaattccgttagattagatgaagtggataacgaagatgatgattctccgcccaagaatagtcttgctctaaaattcatagctaggactagaaaagtgcctcagaacatgaaagagttgcctaagctaacgaagccagatgagccagatttctcagctgaacctgaagactagagatgtttgcttatgctaagtacagtggtcatagctgactattgtgaattagtcctatttggttcgtgaaggaggttacaggccaactagttacggtgaattgaacttgggttgacggtgccatctgtggatgtgaggcaggtaactcgaaactcaatcaaagctcatctgtggatgtgaggaagttaactcaaatctcaatcaaagcgtgatgaagcttctgactggtatagatcgaatggttgtaactactagctatgttcatgttgtatattcagatatctccgtgcctatagatttcttgaaaaaagaagagaaaaagaagaatgcatcgttacatagactgataacttaaacatctaacaagggtgtggctacattgtttgtgaccgtggaggactctgtaaattatgaggctgtggcttctggcaaaatgttagcacagactgctgtcatgtacaaatgcacctgtgcctgcttttgagcatggtcgaggtgctgtaatgtttttttttggttaactgtacaaatgtgctgttcctgcgatatgttatgacttatgctacagtacacgaagttgt

SEQ ID NO: 167 - DNA, 1970 bp, Sorghum bicolor
ccctagccttatcgtttcgtttctaatcccagccatcactcccaaattcccagcggctggcatgcctcaactgttgctcgatgaagccgagagatgaccagatgtcggagagtggatagggccggatagcttcttcacgcagtcgcggttcatcctctcctgcctccccgagagctgactgtaagtggatcgcgaggtgcccgctatacctctctggtggtgacggatctcgcacactccacgctcgtgtggtagtggcggagctcgggcggtccatggccctggcagaggttggcgagggcatgttcccggctactcgcgacgacgttcagcggcggtggctgaggttgcgtgggcctcgcttgggtggatctctcggcgacttgcgaggggcctaggcatggcagtgggttccatgacaaggaggtcgtctagatctggtgagcagcggtcctagaacgtagcaaccatgctgtgtggagaccggcaacgtcgcaggactgctgttccctcggtgattgcggtaggcgacgtcgggatgcgaagaacgcacatgtgcaatatgttttcgtctaccctccccaaccatgacctctcaggctctcacagtcccagccggccagcccagcgccccgtggtataaatacgggcacccaccgtacatgccaaggtcacagtccactagctgcagctgaagctgaagcaggagcatcgggacacagcacatgggacgcgtcaccatgtcgtcgtcctccgcctgcggtgatgaggaggaggaggagcagcagcagctggtctgcgtgaccggcgccggcggcttcatcggttcgtgggtggtcaaggagctgctccagcgcggctaccttgtcaggggaactgcaaggaaccctgagcacggcaagaacgcgcacctgctggctctggacggcgccaaggagcgtctcaccctgtgccgcgccgacgtcctcgacagcgcctccctccgcgccgccttcgtcggctgccacggcgtcttccacgtcgcctccccggtctccaacgacccggagctggttccggtggcggtggagggcacccggaacgtcatcaccgccgcggcggacgagggcgtgcgccgcgtcgtcttcacctcctcctacggcgccgtccacatggaccccaaccgcagccccgacgccgtcctcgacgagacctgctggagcgactacgacttctgcaagcgatcagacaacctgtactgctgcgccaagatgatggcggagatcacggcgacggaggtggcggcggcccgggggctgcagctggcagtggtggtgccgtgcataaccttggggccaatgctgcagcagacgctcaacgtcagcacccaccacatcttgcgctacgtcatgggcaccaagaggtccatccccaacgccgtcgccgcctacgtcgacatccgcgacgtcgcgcgcgcgcacgtcctcgcctacgagcgccccgccgcgcgcggccggtacctctgcatcggcaccgtgctgcaccgcgcacagctcgtcgccatgctcagggacctcttccccaagtaccccgtcacggccaagtgcgaagacgacggtaagccaatggtgaagccgtacaggttctccaaccagaggctcagagacctgggcttggaattcactccgctgagggagagcctgtacgagactgtggtgtgcttgcagcagaagggccacctgcctgtcatcaaacaaaaacaacgtgcgtgcttgtaaatcagtggacatatgccgggatttcccagataatatagtcagtaatcagtctcaacccgggcaaacatcttttccattgcttgattgctagtagtctatcgtcttcctaaggcacccgtaggataggaaatgatgatcatataaacagggaaaacaccacagaaaaaggggaatgaagtacaagaatacatcaatgcaagttctacgcgtgat

SEQ ID NO: 168 - DNA, 2423 bp, Sorghum bicolor
catcgtgttcgccgcctccccactcccaaaccctagcaaccctcacccccgatcgaacccaaatccgcccgaggaattatgcgaaattccccgagatcctagcccagcccaaccttaccctaccctaccagatcgatcgatagagactacgatgagcctatcaccgctcgactcctcctccccgccggcggcggccgaggtgcccctcgccccgggcttccgcttccaccccaccgacgaggagctcgtctcctactacctccgccgccgcgtcctcggccgccgcctccgcgtcgacgccatcgccgaggtcgatctctaccgcctcgagccctgggacctgccctccctctcccgcatccgcagccgcgacgcccagtggtacttcttcgcccgcctcgaccgcaaggtcgccggcgccggcgccgggggccggggcggccccggcaacaggaccaaccgcgccacgccgagggggtactggaagaccacgggcaaggaccgcgaggtgcaccaccgcggcaagcccgttgggatgaagaagacgctcgtcttccacgccgggagggcgcctaagggcgagaggaccaactgggtcatgcacgagtaccgcctcctcgacgcagacgggcctcaggatctgcatgtggtgtgtagaatcttccagaagcatggatctggaccacagaacggtgcgcagtatggtgcaccatacatggaagaggaatgggaagaggatgatgatgctattgagaatggtcctaccagtggcgcatctgctcaaatggctgcaatcacatgtgctgtagatgaggagtcaaatgaggacgatgagaatgcgtattgtgaaacaaacagacctgctcgagtagaaccatctcatctgcctttggtccatgaaatgctcaatccaccagagatggctcctcaacaaggtcaggattctaaagagacaagtgatggaagctgtgctgatggtgctatttctctggaagaggttttgcaggaacctttgtcgaatattagtgtggagaatataggtagacttgaagggcagaatgcaactgatgatagcatcaatgttgatgacttgttatcagcataccccaggaaagataatggctatgtaggccaggataacactatgaatgggagtggtccagcagatggtgatcacacaagctggcctttgagagcatatagtaatcagaactatgtcaatggccctcttgctgatgagttctttgacacagggaatgataccaatggggttgcatattctgggcagcagcaagctgatggctttccagcacctcgccaagtggatgacagtatggtattttatgatgctccatctgattataacttggtggatggaaatgatgacttcgtatatctgaatgacctcctcaatgagccacttggaaatgaatcactctttgatggagatgatgtgatggcttactttgacgccacagagaatgatttcaagtatgacattttgggctctgctcagggttcgaattatcaacttgcagacatgccgttgaactttgcccaaaagagtgataacaaagacaagtttacattcgatgggatctcagaggttccggaagcaaatgctcagtacggtgcatcctcatctggttcccatgaggatctgtatgcagatactgaatttccaggtgtgccaacagatgacactgctgataaaacttatggaaagcgccttgccagcatgttgggctctatcccagctccacctgcaatggcctcagaattcccgccatcgacagggaaatctgttgggatgctctcggctgtcagctcaagctcaattcgtgttactgctggcatcatccaacttgatggcctcactttcagcagtggctccgatcggtggcccttgcagaagaatggagacttgagtttgcttgtgtctttcgccgtggagagcgacgtgtcatccaagcttcctgttggtcttgaggatgctactcggattagcactgttcccatggtgatgcgaagtggcttttaccttttctttatgtcggccatgattctcctgttgagctacaaagtagggtcgtgtatctacagcaggtgagttgaaggtgatggcgcctctggtccggtctgactctgagggctgtttattttgattttatacgtgggtcatcccctcagtgatgaggggatagtagtcgttcgacactatttgtttatttaccattctgacctgtcaaaacatatagcaataaacttttgaactggtgatggtggccatgccgggaccatgtcctcatcaggcaaagtagtgcactgtgaacttggggctctgcccttattattgtaaccaaaacttaactgcagtatgtttatgttctgtcgtgtggaagaaaagctattttttctggtgt

SEQ ID NO: 169 - DNA, 1611 bp, Sorghum bicolor
gctaagcactcggctcctgaagaaagaatgaagacagaggccactcacaaggcgatagcagcaggtggcaagatgacggtgctccactctccggttggagtgaggagcatcgtcacctccatggtggctttcttcatcttagccagctccatcgtcttcctccttgacagaggccaggaagagcaagtgcaaatggcaatcgagcatggacgccaagaagtgcaggtgaagctggaagctgggctccaagaaccagcgatcagagggacaactgacgagggggacgccagcaatgaggagtgcaactggtcgagggggcggtgggtgtacgacaacgtctcccggccattgtacaacgggctcaagtgcaccttcatcttccccgaggtggcctgtgacaagtatggaaggaaggatgtcatgtatcagcactggagatggcagcctcacggatgcgacctcccaagatttgatgccatcaagctgcttgaaaagctgaggaataagagattggtgtttgtgggtgactcagtcaacaggaatcaatgggtctctcttgtgtgcatggtggaggcctcaatacccgatgacaggctcaagacacgcatcttcaatggctcactcatctcctttaaggcattggaatacaatgcaacaatagatttctactggtcaccactactggtggagtctaacagcgacaaccccattatccaccgggtggagtaccggatcataagggcagatagaattgagaagcatgccagtgtctggagggacgctgacatcattgtcttcaattcttacctgtggtggaggaagcagaaggatgacatgaggatgaaggtcatgtatggttcatttgaagatggtgatgcaaagttagacgaaatggaaatggttgatggtttcgagatagctctcaagaaactaaccgaatggcttggggaaaatattgacaagaacaagactaggatcttttttgcaggatcatcaccagcacattcctgggctagcgactggggcggagaagacaagaacaaatgcctgaatgaaacagagccgatctacaaaaccggatacaaagctgcaactacggactacagcttgatggccacggccaagtcctatttccgaacactggagccgaaaggcatacatgttcagatactgaacatcacagagctgtccgactaccggaaggacgggcatccgaccgtgttcaggaaacagtttgctcctctaacgaaagagcaaatcgcggacccagccagctatgcggattgcacgcattggtgcctccctggagttcctgatgtctggaacgagtttttatatggctacctcgtgcaccaaatgatgagtaaattgtaaaatgtcaggtttgttttaccccttatatataataataataataataatgtacagatggcatactccatttagattaggatgctcttgcgcagagaatggttggacctattacatttacatgtacatgtacagacagagaaaagcaaggatctgtctgcgcatcacctaatgggatcactggtgtactatttctttatacacatataaccgagcaacatggttttgtaagaaatttgt

SEQ ID NO: 170 - DNA, 2335 bp, Sorghum bicolor
gtgccctgcgagctcagctccatcggagagctttgcagtttgcactgcacagctctgactctaaggactgtgatccttgtgtgcactgcctagccgccatggctgcttcctccatggacaggatcacccagtgggtgtcctcccaggtccagcaggtctccgccgacctcaccgtcaggatcgccgactccgtcttccctctccacaaggcggtgatggtgcccaagtgcggctacatccgccgggccgtggcagcggcggcggcggtggcgacgagccagacgcagggcccggggcccgcctccgtcgagctggacctctcggcgctgccgggcggcgccgacgccttcgagaaggcggcgcgctactgctacgggggcagcctggagatcacggcgcgcgacgcggcggcggtccgctgcgccgcggcgttcctcgacgccccggacctggcgcgccgcgccgaggactacctcgcgcagaccgcgctccggtcgctgccatgcgccgccgccgtgctgcggtcctgcgagtgcgaggcgctgctccgggccgccgaggagaccggcgtcgcgcgccgcgccgcggacgccgtcgcgctcggggtctgcaacgaggcgctgttcccgacggcgcgggcggcacctgggtggtgggtggccgagctcgccgcgctgtcgcccgcgtcgttccggaaggtggtcaccgcgctgcggtgccgccgcgcgggtccggaggtggtggccgccgcggccgtcgcgtacgcggagcgcgtcctggccggggtcctcgcacccgctgcgcccggccgccgggacgccgtcgtcgtcgtcgcgaggaacgcggacgcggacgcggaccggcgggcgctgcttgaggccgtcgtggacgcgctgcctcccgcggccgacgcgccgctcccggccgcgttcctctgccgcctcctgcacgccgtggtcaccgccgaggcgtccgccaagacgtgccgcgacatggagctccgcgtggcgggcgtgctgcaccaggccaccgcgggggacctgctgggcgtcgcgctcgacggcgccggggagcgcgtccggaacgcggacaccgtgcgccgcgtcgtggccgcgttcgtcgagcggccgcagacgcaggagggccggcgggcgtcgctggccggaggaccagcagcaggcgagctcggcgcgctggagaaggtggcgaagacggtggacgaggtggcggcggagatggcgacggaggagtcgctgggcatctccaagttcgtgggcgtggcgggcgcggtgcccaaggacgcgcgggcgtcgcacgactgcctgtaccgcgccgtggacatgtacctgaagacgcacccggggctggacgagatcgagagggagaaggtgtgcagcgtcatggacccgctcaggctctcgtaccaggcgcgcctgcacgcgtcgcagaacaagcgcctgccgctgcaggccgtgctcagcgcgctctactacgaccagctcaagctccgcagcgccgacggcggcggcggcgatggtgcggagggaggagcagggtgggagccgcagtcggccgccgggaaggctcgagcgcaggcgcgggcggacgcgtcgctggcgagggagaacgaggcgctgaggtcggagctggcgaggatgcgggcgtacgtgtcggggatgcagcagcacagcaaggggagcgggtcgaggtcgtcgtcggcgtcgctggtgccggcgtcggcggcggggaagaaggcgagcttcttggggtcggtgtcacggacgttgagccggctgaacccgttcaagggcgggtgggccaaggacacggccagcatcgccgacggacgtgacaggagcgccatgcatgtggtcaagcccaagaggagaaggttctccataggctaatttagtttgtgatatatgaatatggaatgtgatattgtttgtgattatgtttttttattactgtaattagaaaaaggttgtgggtgctttgtagtttcaatgttacctttgtttttttaatttcttactattatagtggtccagtgtgcttaaaatttttgtatttgtttatgtcaatatgtgatgtgtgcttgcttaaggaaaacgcaaagtccacatgtgttttgtcaaaaaaaaaaaaagaggacatgttatttcaaaaatgaagaaaatgctaaaagaataaaaattggggcttctggtttgagggttgtattatatgtacaaccttgtgaaatggaagtagttttatcaagatggatgtgttcttgtaatttcatatacgaagcaagtgtaagttcttgtttcctagtgatatgtttcacacc

SEQ ID NO: 171 - DNA, 1356 bp, Sorghum bicolor
cacgaaacaaggctcgcgccggctgcttggctgcagacacaccacgccaccagtccatcgccggcactccggaagcacgcccttctttgttcctccgactcccactcggcggcggcgacgacgacgacgggaggagcggcggatcgagcgaatcgatctgtgcgtgcgtggctgtcgcgcgcgtcgatctctgccgggcagggcaggtcagggcgggcggcatggggaggtccccgtgctgcgagcaggcgcacaccaacaagggcgcgtggaccaaggaggaggaccagcgcctcatcgcctacatcaaggcccacggcgagggctgctggagatcgctcccaaaagccgcagggctgctgcggtgcgggaagagctgccggctgcggtggatcaactacctccgcccggacctcaagcgcggcaacttcaccgaggaggaagacgagctcatcatcaagttccacgagctcttcggcaacaagtggtcgctcatcgccgggagactgccgggcaggacggacaacgagatcaagaactactggaacacgcacatcaagcggaagctcctggctcggggcacggacccgcagacccaccgccctctcgccgccgcctctggcgcgcccgcggggcagcagcattaccagctggagcaacagatgcaggcagccgcggccggcgttggcacggtgggccatccgcaccaccaccgccaccaccagcagcagcaccaggctccgcagcagcaggacgtcatctccaactcgccggaggccgcctgcacgagccgtagcagcgacgacgagccgcggtcctccacgccgacaccgccgccgccgccaaggcgccacctggacatcgacctcaacctgtccatcagtctgtctgcttaccagccgccggaggaggaaagcggcagcatcaagtcgccactgatgatgatgatgatgaagcaggaggaggagacagcggcggcatcggcggcgggcggcaccaatgcggcggcggcggtgtgcctgtgcctcaacagcctcgggtaccggccgggcgtcgagtgcgcctgcggcggcaacggcggcgtcgggtcctcctcccagtcccagcaatgggctcggagttttttacaggcagcggcggcggcgacgccatgctacagaggccaatagtgttaagacaggaagagtgatcagtgagtgagacagtgacataagtgggagggttatttacgcagggcagatacttttagttaactactggagtactagtagtaaaaagccacacatgcttaggctttagcagctctctttgtaaaacatgcatcatgggttatgaggaggagatgtgctcttgtct

SEQ ID NO: 172 - DNA, 1335 bp, Sorghum bicolor
tcccctcttctcatcccattcccatatcccatagagagaaaagcagagcaagctgagctcacacgcaagccgaaagatgatgcggagcccaaggggcgtcggcggcggctgctaccgcggcgccggcggccaagaccagcacgtcgacctgatcccgggtatccccgacgacgtggccgtggactgcctggcgcgcgtcccgcacgcctcccaccgcgccatgcgcggggtctgccgtggctggcggagcgccgcttccaccccggccttcgcctccgcccgcgcgcaggcggacgccaacgaggacctcgtctacctcatgcagttcggcaacccgtccgccgccgctgacgacgccgaacccaagggcgacgacggtcccgccaacaccccggcctacggcgtcgcggtctacaacgtgacgaccggcgagtggcgccgtgaccgcggcgccccgcctgtggtgcccgtcttcgcgcagtgcgccgcggtggggacgcgcctggccgtgctcggcggctgggacccgcgcaccttcgagcccgtggccgacgtccacgtcctggacgccgcgacggggcggtggcgtcgaggcgcgccgatgcggtcggcgcggtccttcttcgcgtgcgccgaggccggcggcaagatctacgtggccggcgggcacgacaagcacaagaacgcgctcaagacggcggaggcctacgacccccgcgccgacgcgtgggacccgctcccggacatgtcggaggagcgcgacgagtgcgacggcatggccacggtcgcgggggaccggttcctggccgtcagcgggtaccgcacggcgcggcagggcgggttcgagcgcgacgccgagtggttcgacccggccgcgcgcgcctggcggaggctggagcgcgtccgggcgccgccctccgccgcgcacgtggtcgtcaaaggacgcgtctggtgcatcgagggcaacgccgtcatggagtggatggggacccgccgcgggtggcgcgaggtcgggccgtacccgccggggctcaaggctggcacggcgcgcgcggtgtgcgtcggcggcggggagaaggtggttgtgacgggcgcgcttgatggcgagggcggtggtgggcggcacgcactgtgggtgttcgacgtcaagaccaagagctggactgttgtgcgcccgccgtccgagttcgccggcttcgtcttctccgtcgcctccgtccggatctgactgagcatctgcatcttgcttcgcaccgttcgtccgcccacggctatcagacgtgaaggaaaggaaaagtctactagtacaagtagtatactagtacatggctacat

SEQ ID NO: 173 - DNA, 1132 bp, Sorghum bicolor
acctccacctccctctccctccccccaccccctctcttccgccagcgcgctcagctccgaccgaccgaccgaccaccgccgcgatgaggcagtggaagtccctggtcccggccgcgctgcacctgcacggctcggccgcgtcctgcttcccgcacccgccgtcgtcgcccagggccgccgcggaggagacgacgacggacgacctgcagctaccgtctctaggcgctgcggcggcgaaaggcacggcggtgcggctggtggggtgcgacggccgggtgcgcgcgtacgcgccgcccgtgacggcgcgggagctgatgcaggagcacccgcggcacctggtgtcccgcgccgacgcgctgctgatcggggagaagatccccgccgtggcgcccggcgaggagctgcagcccggggaggcctacttcctgctgcccgcgcacctgttccgctccgtcctctccttcgtctccctcgcctcctcgctgctgctcctgctgtcgtcgtcgtcgtcgtccaccaccaccgccgccggcgcgggtgccggtgccggtgccgggaagaaggccggcgccggcaggccgttcgagctccaccgcacggcgtccggcacgctgcagatcaagttctccgacgacttcctcctcgcggacaacggcaatggggaggacgaggaggaggaggacgaggcgcccgcgcagaaggagcagcagcagcgcgccgtgctgctgcgcggcgacgaccgcctcgccaaggactacgaggagctggtcgggtacagcaagtcccgccgctgggcgcccaagctggagacgatcgaggaggcggttccgcccgccgccgccgcggcccccgagtccgccggcgccgcgtcaccgaaggcccagcgcggcggcaggaagagccgcgcgcttccgttcctcggccgcctgggcagccgccgccgcagccgcgaccgcgacgcctgcagcgccgtcgtggcctgctccggctagggacggagggagggtgagagtctctctcgatctgtcccgtccggtagggtagtttttcaggtcgccggcggtcgacggcgtcggcgtcctggtttagtgggtggctggattttgtatgtaattaggggaaacaaattttg

SEQ ID NO: 174 - DNA, 863 bp, Sorghum bicolor
gccgccaaggccaagcgagccccgtagcctctcctccgcctaacaacgcctcgacgcggggtgccagctgccacgaatccgacgacccagtccatgtccagcccagcgatggcaatggccgtgatccgcctcgcgcgccccgccgccatccgcccgccgtcggccccgtcgctacggccgaccgcgcggctgctgcgccgcctccgcgtcgtgaggtgccgcgccggcggcggcggcaacggggagggagggaaggggaaggaggagggggaggccgcggaggcgcccgagtcgctcttcgccagggagctccggcggcgcgggatggcgccgggggccgccgccgcgggcgctaataaggaggcggaggagggggcgccgccggaggccggggccaagcgccgggtggcggccgccgagttcgagcgcgccgccgccgccgacggccagcgccagcggtccatggcgctcaacagcgagggcctcgagggtcttgttcctcgggcaaagttactactatcacttggcggtaccttctttctggcatttgggcccctgattcttgtgaccgtttctctttttgctggtttatatgtgtactttggaccgagttttgtacatgatgcaagcaagacaccggtgtcggtgccaccatacattgatccatacgagctgcttgaggacgagaggctcagccgaccctccccagatgtgttctgaacctgaatagtgcaagaaccagtgcagaaatgtttacaagaaatagtcatacatagcccaacattctctttttttactagacgtgtagttgtaaatgcaactatagctgtagactgatataatcaaaaaaagcttcaatacgc

SEQ ID NO: 175 - DNA, 550 bp, Sorghum bicolor
catctatcaccatcgaaatcatctcacagaacctaaggagagagggggggggggactagaagcctctagaaccttccggtccggacaagcaaaaacaaggagcagagcgaggatggcaatggagcacgtggcgaggctggcgtcggagcgcgcggtggtggtgttcacggcgagcaactgcagcatgggcgacgtcgtgacgtcgctgctgagcagcctgggcgtgaacgcggcggtgcacgacctggacagggacccccggggcatggagatgcagcgggagctggccaggaggctcggcgccggcgccaccgtgccggcggtgttcgtgggcggcgacctcgtcggcgggaccagcagggtcatggcgctgcacctctccggcgagctcgtgcccatgctcaggaacgccggcgcgctctggttgtaggaattcagagcccgcgtccatgcaatgcaagcatggctggtgacctttttccatcaggtgtgtgtgtacgtacgtgtgaataaaaacgacggtaagaacagggggaaaaaatgggaaacg

SEQ ID NO: 176 - DNA, 1308 bp, Sorghum bicolor
ccgtcgcgcctgcaaccattggtacaagtaccctatattcattatcatcacttgcccgcacttcaaagctcaatcccttccttgcgtggcccttgcgtttgccatggccatgcaagcgcggcaccactcccacgactacttcctatcgagggccggctccctgttcttggacgagtacgccgggtgcgtgcccctgccaacgtcgccggcggtggggatccgggacatgccgctgctcagcgactttgcaggcagcgagcttagctttggctacagtttcctgccgaggaagcgggcgcgcatggaggatcaccgcgttgttctgcccccggcggtgatgcaggggctggtgcaagtgcaagtgcaactgccgatgacatccagtaacgtgatgggttccggcgccgtgacgtccacaagtgggagggagatcgacgcgctgctaagagtggagagcgagaggatgcgcgcggcgctggaggcggcgtggcggaggcacgcgcgggcgctggcgtccgccgtgggtcgaacagcggcgggacggatgcgcgcggcggagtcggagctggacggcgcgctgcggcgcaacggggagctggaggagacggcgcggcagatggtcgcggagtgccaggcgtggatgggcgtcgcgaggagccacgaggccgtcgccgccggcctccgcgcctcactcgaccagctcctcctccagtcgcccccctgcgcggtggcgactggcggcgcttgcgagggtcatggggagaccgaggacgcgcggtcgtgctgcttcgagccaggctgctccggcggccgcggaccacagggggcggtggaggagtgcaggtcgtgcggcggcggcgaggcgtgcgtgctgctgctcccgtgccgccacctgtgcctgtgccgcgcgtgcgaggccgccgtcgacgcctgcctcgtctgcgccgcagccaagaacgcatcgctccttgtcctggtctcttgatccgaaaaaatttcggatttcgctactgtagcactttcgtttgcttgtggtaaatattgtccaatcataaactaactaaagtcaaaagattcgtctcatgatttatagacaaactgtgtaatatatttagtgtttcatgcatgtgccacaagattcgatgttacggggaatcttgaaaactttttggatttcgctggaaactaaggtcttgtttagttccaaaatttttgcaaaacaggtactgtagcactttcgtttgtatttgacaaatattatccaatcatgtactaactaggctcaagattcgtctcgtcaatttcgac

SEQ ID NO: 177 - DNA, 875 bp, Sorghum bicolor
cagcagcttccgagctttgagtctctgacggacgccgggacgcggaatcgctccgcgccgccgccacccgccaggccgcccgcccgcgccgccacaccttcagccgcgccacgcggtgccgcccgccgcccgctgcccccggtccgccccgcgcccgcggcccgcgcgttcggccgtcgcccactgggcgagatcccgcaggagccggcctgctccagctgtctgctgtctgctgtctgctgcgaggtccgactgtccgagtctccgaggaaagcacctcaccccaaaatgaagcacatattcaagattgctgcaatactgatagcaatctcagctatctggattgctctacttgaaacctcaactgttcctcgaagttatacttggctgcttcccatctacttggtagtggctcttggatgctacggcctttttatggttggatttggacttatgctcttcccaagttgtcctcaagaagctgtactactgcaacaggatattgtggaggcaaaggaattcttagcaaagaagggtgttgatgtgggctcaattttaagtggttgacagtcatgaccgtcttgaaggatcaccattctgttcctaggaatatattgcttttttggatacttactgtagataggaaacatatcatttcactatgttcagctattattaacacagtttcctaactcagtgagttggcatgtttacaattgtgcttttgtcaatgatggggctcactaagttcgaaaagtgaacttttctaggaatatttggtttctatctcgattccccgtcagtggaccctttaccaattctgctgttcagtacatccatcaccttatgccttaatgacgattgcttgtaccctc

SEQ ID NO: 178 - DNA, 561 bp, Sorghum bicolor
accaccataagcaccaacggaaaagcagagccttctgtccccggccggtacggtccgccatggctctggatgcgaggtccctgcttccggtagtgtccgtcgtcgtcgtccccgccctcgaactcgaagtctgctccgggatgatgccgagaaccaggaacggcggcggcgtcccgtccgcgacgacgacgggcgcggcggaggtgtccgtcgtggacgtgccggcgctgtggagtgacgaggggaggatgaagcgggagctggtcgcgtgggccaaggccgtggcgtccatggccatcagggaaaccatgaagtgctgaaacttcgttccttaattcgtgcatatatagagccctgatgatgcacatctctttgtttgttttttcctctcgtgctgctgagtcctttctttgttgtacatgttcggttgatcatttcggcttgtacatgttcttttttggaaaggatgcaagagagaacttcagatgttttgtcgcacagaatattttggatgtgcgttcctgcgttttgttttcgctcaaattgtcacactgggggctt

SEQ ID NO: 179 - DNA, 1353 bp, Sorghum bicolor
aagcgcgtggtgtgtcggtcgcttgtctcaccaaaccggcgacatggaagccagctcgtcgcttgtctcggtgccgtccgcccgacaagcggcgcccgcacgcgctgcgcgtgcacgcctctaaatacacagccccgagcgaggccgccaatcccgccgccgccccacccacccactcatccacgcaaagcgaacccggccgccggcgacgcagtccgggacatcacagctacagctagcgggagccgcagcggcgatggcggagatcccggtgatcgacctgcgcctcgccggctcgtcgcgcgaggagtccgcgcggctgcgtgccgcgtgcgagcgcctgggctgcttccgggtgaccggccacggcgtgcccgcggggctgctggccgagatgaaggccgccgtgcgcgcgctcttcgacctccccgacgacgccaagcgccgcaacgccgacgtcatccccggcagcggctacgtgccgcccagcgccgccaacccgctctacgaggccttcgggctcctcgacgccgccgcgcccgccgacgtcgacgccttctgcgcgcgcctcgacgcgccgccccacgtcagggagaccgtcaaggcctacgcggagaagatgcacgacgtgatcgttggcgtcgccggcgagctggcctccagcctggggctggagaagcactcgttccaggactggccgtgccagttccgcatcaaccggtacaactacacgcaggagacggtgggctcctccggcgtgcagacccacacggactcgggcttcctcaccgtgctccaggaggacgagtgcgtgggcggcctcgaggtgctggaccccgccaccggcgagttcgtgcccgtggaccccgtcgcgggctccttcgtcgtcaacatcggcgacgtcggcacggcgtggagcaacgggaggctgcacaacgtgaagcaccgggtgcggtgcgtcgcgcccgtgccccgcatctccgtcgccatgttcctgctcgcgcccaaggacgacggcgtgagcgcgccggaggcgttcgtcgacgaggaccacccgcgccggtacaaggcgttcaactacgacgactaccgcaggctccggctgtccaccggcgagcgcgcaggcgaggcgctcgcgcggatggcggcgtgacgtggtgcagctgcaaattggaagccggcagcgacaagccgttaattataggcttaccgtgggaccgccatacgcctacacgagcagagtattccatatcggttttctcgttgatccgttgtattaatcgtgtggggagaaggattatatgtacctaatttgctctactgcttaatgaaagacatgcccagcacgatcta

SEQ ID NO: 180 - DNA, 1785 bp, Sorghum bicolor
ccccgcgccgcctcccccctccttcaaatttgcgtagtagcgttggttccacgccctatcgcccctgtacccaaatctactaccgacgcacctctcacaacgctcaatccaatcgcgagccgcccgcaaccctaaccctagcaaccgcgagtgatggcgcgcccgaggggtaagaagcgcacggcgtcccaggcggccgccactgattcggtcgagctggaggccgccgccggtgcttcgagcaagccggaggcggcggcggcggagccggcaacacgggggcgggggaagcgcgtcaaggcgccgcccaagcccaagcccgagacggactacttccctgagaagagaaatctggaggatctctggttatctgctttcccagttggtactgagtgggaaaacattgataagataaaggagttcaattggagcttcgaaaatttagagaaagccttagaagaagggggagagcttcatgggaagacagtttatatgtttggaagcaccgagccccagctactggatgttaatggagaatcaaagatagtgcttattccaattgtagttgttgtagactgccctttccctccatcagacaaaattggtataaactcagtccaaagggaaaatgaggaaatcgtgccaatgaaggcgatgaaaatggcatgggtgccttatgttccacttgaggaccggcttagcaggattgacagtttaaaaacaaaaatattcactctcggatgcacacagcgaaggtctgcgctgaagcatctcaaaattgagagagtcaagaagtttgattactgcatgccttactatatgcctctacaacctcttgaagatgaggatgacacagttatcaatttcttatatcctctagaacccccgatagtagatgagttcgactgggaaatggatgattatgaggatttttcagatcagaaagtgcaagaaggtagcctgccagagggcgagaaagaaaaattcaaggagttcctcaaggagaaggttagagaaaggaagagagagctgaaacaggctaaagaagccaggaagaaagctatcgacgacatggatcctaaaatgaaagaagcattcgagaatatcaaattttacaaattttatcctgtaaaaaccccagacacacctgatgtaaacaatgtaaaggctaggtacatcaacagatactacaggaatgcccattatctgatgtaatggctttcctgatgacctgatctcatgtgcttggccagcatgtcatttgaggagttgatagaagaagatttttgaaacccgggaggagaacaatttggtgacatcttcgaatgtggtcttactgttgtattgtactagagttgccctcaggtctcaggttttcattcccttgggcatcttctttcactgtacggtgtatacaatcctgcaggatagattattgtgtagcattcagagggtcaaggtagttttgagactaaacaaatcattaaggaacaatttgttccatttttatcatctaaatagtgaagcttcagcacaagattcatgagtttaacatcgttatagcacagcctgatggttatgttgtgactgttttaacatctgctatgtgcaagctatgcaacacgatgtgattgtgatgtacagagaatcatgctgtaatcatagacgcacccgactgtttttttagatgccctagctgggaactccaaaggtagatgtgtatataggagaaacacggcctatcttagaccatttcggttgccaggtctattaatgttatatttg

SEQ ID NO: 181 - DNA, 2424 bp, Sorghum bicolor
cgaggactgagggggaggccggaggaggaagaggaatggtattggggggaggccctctaggcgccattattggccgctatccctccgccgccgccggtgatgatgaacaaggggaccccgggcccggaggaagcgtcattcgccatgaccgcaagtgccgggactggcccttcctcttcctcttcgccgccttctgggtcgccatgattgtcaactccagcttcggattcaaccagggcaacccactcaggctgacatacggactggactacaaagggaacatatgtggcagcaggcacggtgatcctgatttgcgtgagttggatgttcgctattggttgaaccccaaccaggtctaccaaagtgggctcaaaaccagtcacatcgagctacctgacgctaaagccatctgcctgatggaatgcccacttcctgccgaagatggcttgaattttgtttgcgattatccagaaggtgacatacgcctctctgtcgatgattggattgacagggactacgattacttcgagtacctcacaccagacatgaggaatagttctcttcagctgcagggtccttgttaccctgtcatatttccaagtgtaaatgtctactggagttgccagtttattgcacgggcatccaatgcctctttgaagcattggaaggacatgggtggtgtcagcatcgatgaaaacatgctaatagatgaaacaattcatgatgcaatcaacagcaaatctgccgtcatgaagagatatgttgcagatattgggaagtcctggcctgtgttaatcctttgtgggggattactccctctgttcctgtctgtgatctggttactcatgattcgtttttttgttgctgggatgtcttggataacagtggtggtcttcaatgctcttgtgatatctgttacaatgttcttctatataaaagctggttggataggccatgatcctttgactgttgtaattggtgaaagtgatccttatgttagcataggtggacgggagataaatcaccttcatgctgcttctgtcttgatgacagtgataatgatacttgctttcctgacttcaatagctattgctcggcgcattatgatagcaacatctgtcttgaaggttgctgcaaaggtcattggcgaagtccaggcacttatcatttttccagttgtgccatacttcatcctcgctatcttttacatgttctggttttcagcgacacttcatcttttcagcgccggtcaagttatacgaaatgattgtaataatgattgttgttcatatgatctcaaacttggcaaagtaaattgtgacagctgttgtggctacagtatccattacaccccacatattggcatcgccattcttttccatttctttggctgttactgggcaacacaatttttcatcgggtgttcttcgactataattgctggatcagttgcttcatattactgggcacgtggtgaaatatcgcgtgatatccctttccatactgtggtatcttccctgaagcgcttattgcgctatagcctgggatctgtggctctgggctcgctgattgtgtccatcatagagtgggtgcgattcatactcgagtcactacgccgcaggctgaaatttgttgattctgcccgtgaaagcaggttggggaaggcagtatcatcctcatctcagtgctgcttaggctgcattgattggaccctgaaatcagtgaatcgaaatgcttatgtcatgattgccattacagggaaaggattcttcaaggcttccgtgctagcaactgaattaatcatgaacaacatattgcgcattgggaaagtgaatgtcattggggatgtgattcttttgttgggcaagctttgtgttagcctgttgtgtgcactgtttgccttccttatgttggatgagcacaagtacagatctggccataacaagatatcatcgccactagtccccgtgctgttgtcgtgggtgctgggttatatagttgcaaagcttttctttgcagtggtggagatgtcaatcgacactatggtcctgtcattctgccaggactcggaagaacatcaggggagcgctcagtatgcgcccccgctactgatggagacactggatgaagagagcgagttgcgaagactgacacagggacaggggccatgaagcatgatcttctaaatacgtgtagggatagagctagaggtgaaactgaatggtgtgttatctgtactttatttatatatgaatcactggggtggatggaggtgcaagtaattaaggtggttatggttatggttatggactggttatcagctaaatacgaggaatagggctagagctagaattgaaactgaatggtgggatggcagatactgttggctgttggctgatttgttgtgagagaaaaatactttct

SEQ ID NO: 182 - DNA, 1485 bp, Sorghum bicolor
ggacgccacgtagtcacccactcccaacgcagttccatcttctcctccgaccgcccaagaaaagaacccgacgagtgagttcccccaatccgccgaaacctcccaacatcccaacggagcccagtgcccagcctgcctcggcgcgatcccgccgcgctgctcgaggtctccttccctgacctgaaccagtccagaacgccgacttcggcggacgggatcgtccagagccgccgaatccgccgccgtcgttgatgcaccggggccgggtcatcgagattccggcgtgaggcggcgaggctaccgactgtcccttgcgcgcgtagggcatcggaggagcgccccgccgcggcccatggcgtgccggggcttcttcgagtgcgtcctcaagctgctcaacctcgtcgtcatggcggtcgggctcgctatggtgggctacggcgcctacctgctcgtgatgtggctgcaggtcgcgccgccgctcccgccgcccgcgccgtcgccggcgcccagcggcggcgacctcgtgcggctcgggaggccgctgctgctccttgtcgatgcgtccctgtcggactcggatgggaccgcggagaggctctccagtgcctggtttatttttgctttcattggtgtcggtgctatactcttcatcacatcgatctttggttgtgctggagctagaaatggatgctgcctgtctatttactcattcctcattattttgttcatactggtcgagcttggtgcaggaggcttcattttcttcaaccatagttggaaagaggtcatcccagttgacaaaactggaaactttgacatgatgtacagctttttgaaagagaattggagaattgcaaaatgggttgcacttggagctgttgtatttgaggcattgttgttcactgtggctatcatagtacagtcggggaatcaagctgattatgacagtgacgatgagtacatcggcgcaaggtctggaatacggcagccgttggtgaatcagcaagctgctgccactgatcctagggtgcccaatctcgactaccgcccaatccggaatgacgcatggagccaaagaatgagagaaaagtacggggtggacagctttgatccgaacaggtttcaacaggccacgatatctccaggagaacaaagaaaccgatgcaccattctctgaagcttgattgacagcaaccagtagtggttccaagttttatatacatccaaccgtacaattacatcgagttgcagagaatatgtgcctgattgtgtagcatatgcctgtatctgttttttggtttatatagtccaaactcagcacaccaatgcacaggtgcaggtgccacaatccttttaagtttttctaataagtactgaacctagtttgtgttttagtctaatgttccaatgtgcataaaacttttcctgtttaagtgatggtcactacattcacgaatttgcgaatcagacatgtttgttacgcaa

SEQ ID NO: 183 - DNA, 2633 bp, Sorghum bicolor
aactacacttgcaggacacaagcctaaaccaagcagcactcatcaaccaagtagctagaagacagagagtgtgtagtagcacccacagacgaagcaaaccaaccaaaattgtcatgctcccacacctacaccagtgattgtgtgaagtgataacacaggggagaagagcgagagagagacagagacagacagaagaaaagatacacagatagatcgccatgccgcctcagctggagcaccatgagcagcagcagcagacagccggaggtggtggccaccgagcagctgcacctcctcctcctcctcctcccaacagcatgcccacctttagcagcagcagtagtagcagcagcagcagcggcactccctctcctacttctgtttctgccaccaccaccaccaccaacgtcccctccggcgccgtcgtccatcccaccacctccagcccgccgtcgtccgccgcctccgcccgccctgccgccaactccttccctctcgtcctaaagttcgaggaagtggtgtacaaggtgaagctcgggaagccgacggccggatggtgcgacaagctgtcggcggccgcgtcgaacatggcgtccttcggcggcggggacgggagcaagaacaagaaggccactgcgtcggcggcagggtcgtcgtcgtcgtcgtcgcgggcgcgggcgcgggagaagaccatcatcagcggcatgtccggggtggtgcgcccaggcgagatgctagcgatgctgggcccgtccgggagcggcaagacgacgctgctgacggcgctaggcggtcgccacggcgggcgagcggcggtgctgtccggcaagatcacctacaacgggcagcccttctccggcgccgtgaagcgccggaccgggttcgtgacgcagcacgacgtgctgtaccctcacctgactgtctccgagacgctgtggtacacggcggcgctgcggctgccgcggtcgctgagcgccggcgagaagcgcgcgcaggcggaggccgtggcgcgggagctcgggctggcgaaggtggccgggagcatggtgggcggcgtccgcggcgtgcgcgggctgtccggcggcgagcggaagcgcgtcagcatcgggctggagatgctggtggacccgagcctgctgctcctggacgagcccacgtccgggctcgactcgacgacggcggcgcggatcgtcgggacgctccgccggatggcggcgcagggcggccgcaccgtggtggtcaccatccaccagccgtcgtcgcggctgtaccacatgttcgacaaggtgctgctgctgtccgccgacggccgccccatctactacggccgcgccgccgacgcgctcgactacttcgcctccgtcggcttcgcgtcgccgctctcactcaaccccgccgacctcatgctcgacctcgccaacggtatcgcgccgcagacgacgagcggcgacggcgccgcggacgggatggcggcggtgaccagcggcagcgagagcgagcacaaggaggtgcgcgccaagctggcggcggcgtacgagcgccacattgcgccggcggtgaagctggacatctgcgcgcgggagacgacgtcgacggcggcgttgccgccgggcagcagcggcgccgggcacgcgacgacgacgtggacgacggggtggtggacgcagttcctggtgctgttccagcgcgggctcaaggagcgtcgtcacgagtcgttcaacaagctgcgcgtcttccaggtgctgagcgtcgcgacgctggcgggcctcctctggtggcgcacgccggcgtcgcacctgcaggaccggacggcgctcgtcttcttcttctccgtcttctggggcttcttcccgctctacaacgccgtcttcaccttccctctcgagcggcccatgctggtgaaggagcggtgctcggggatgtaccgcctctcctcctacctcgcgtcgcgcgcggcgacggacctccccatggagctcggcctgcccacggcgttcgtgctcatcctctactggatgggcggcctcgacccgcgcccggcgccgttcctcctctccctcgccgtcgtgctctacagcgtgctcgtggcgcagagcctcgggctcgccatcggcgccgtgctcatggacgtcaagcaggggaccacgctggcgtccgtcatcaccatggtcttcctcatcgccggcggctactacgtgcagcacatcccgccgttcgtcgcgtggcttaggtggctcaactacagcttctactgctaccgactcctgctcgggatccagttccccaacggcggcggctactacgactgcggcgacggacacggcaagctctgcgccgtcgccgagttcccggccatcaaggccgtcgggctcaacaaccactgggtcgacgtctgcgtcatggcgctgctcctcgtcggataccgcgtcgtcgcgtacattgccctcgatcgcctcaagcccaggtgatgatgatcagcggccattgtctgcagctgcagtggccgagagctgcctgcccaaacatgaaaatggcatgcatccggccatggatggagcagtagaagagtctgattaatcagtcagctccaagaccaagaggcattacttaactggaagaagagttagttaatt

SEQ ID NO: 184 - DNA, 1118 bp, Sorghum bicolor
gtccccttccccgcacgggcacggcaacactgcaccagctccacccaccagcgcgcagtccatggcgatccggatgagcaacaacgtgatccgcgcgctgaccctggtgacgctgctgctctcggtgcccatcatcgtcacgggcgtctggctgcggtcgcgcgccgacggcaccgagtgcgaccacttcctcctgtccacgccggccatcgcgctggggacggtgctcatggccgtctccctcttgggcctcgccggcgcctgctgccgcgccacctggctgctctggctctacctcctcgccatgctggccctcatcgtcgcgctgctctgcttcaccgtcttcgccttcgtcgtcaccagcacgggcggcgctggggaggccgtgtccggcgccgggttcagggagtaccgcctcggcgactactccacctggctgcggcgccacgtcgagggccgcaagaactgggccaggatccggagctgcctcgccgacgcgcacgtctgcaggcgcttcctggaggcggaggaggaggaggaggagagcaaggacgcgaacgcggcgggtggtctggcgcggctcggcggcctctccccggtcgagtccgggtgctgcaagccgcccgcgagctgcaacttcacgtacgccggcggcggcacggagtggacgaccaagacgaaggcggcggcaggggcaggatccgcgcccgccgccggcgccgacccggactgcggcaagtggagcaacgacgaggacgacctctgctacgggtgccagtcgtgcaaggccggcgtggtggacgcgctcaggcgggactggaagcgggccgccattgttaacgtcgtcatcctcgccttcgtcgtcgtcgttttttccgtcggttgttgtgccttcaggaacagtcgccgggacaactacgcctaccacagcggccgcggatggaaacgaagcggtgacgcttaatctaacttctaatagtctgtagagatgattgatttgctagctgctggctgctgatgtaggttccctaggatctgcgttcagtttaccattagcttaatagcttgtacattagtctagttgtctgtatgaaacagatattcagttgtacactctg

SEQ ID NO: 185 - DNA, 2420 bp, Sorghum bicolor
ataaaaaccagccgcagcggagccggcgagacgcgaacccggccgcgaaattctcctcgcggattccgccccctgccgccgccgcgtccgtccccctcgacaagcaggttgctgcgatcgattcctcattcgaatagttgatgagcgagaatacaaagcaactgagcgctggaagtttgatggtgtgatgcaacttggttaaggaagctgactgcttgaagtgatcatgacggaccatcttgctattatcgcgtccgagctaggggacgcaacggattttgaggttgatggcattgacaacctcagcgagaatgatgtcagtgatgaggagattgatgctgatgagcttgcccggcgaatgtggaaagacaaggtcaagctcaagaggatcagggagaggcagcagaagctcgctttgcagcggttggagctggagaagtccaagacaaagaagatttcagatcaagctctccggaagaagatgacgagggctcaggatgggatcttgaagtacatgctcaagctgatggaagtgtgcaatgcgcgggggttcgtgtacggcatcattcctgagaaagggaagcctgtcagtggtgcatcggataacatcagggaatggtggaaggagaaggtgaagtttgataagaatgggccagcggcgattgtaaaatatgaggttgagcactcgatgctgagtaatcctaagagcagtggagccatgaaccagcatagcttgatggatctccaagacggcactctgggttcattgctttcagcgttgatgcaacactgcagcccacagcagcgaagctatccattggataagggtgtcccgcccccttggtggccatcagggaatgagccatggtggcctgcgttgggccttccaaagggagaagcgcctccgtacaggaaaccacatgatctgaagaaggtttggaaagttggtgttctgacgggtgtgatcaagcacatggccccaaactttgataagatcagaaatcgtgtaaggaaatcaaagtgtctgcaggacaaaatgactgcaaaagagagcctcatttggcttggtgttttgcaacgcgaggagaagtctattcacagttttggcagtgctttactaccgattacccagcatagtacttcagaggacagaactgagggcatatatagcagcagtgatgagtatgatgtcgaccgcctggagcagcctcctcgttctacatcatccaaagatgatgagggagatgctcagcctgttttgcagattagaggggagcagatctcaactagagtgcctaagagaaagcgtcatgataaaccctccaaccaactagctattagcaaggaagaaacgacaaaacctaaacctcgacagcggaatcgcccctcagctcgttctccagttgctgaggttgaggttgaagtgacacaaagaaatgacaatccgccagatgtatcgtgcaatgcagctgatggtatgaaccttattgatccaattgatgtggtgggcatgactaaccagccaacgagctctagccatgccccccctacaattggagctttgcagcagcacggagattgtcaagggaattttctatctcctggtgctgtgatcaacaactacaacagcaaccaggctgcaagtgctgctcaatcaagcacttatctgggcgaccatcccctggcttgtgaaggcagcgatattgccaattcatggtctggacactcgtttcggcaggatattggtattgggcctattggttttaatccttcacaagctgttcatcaggatttggcaatgcagcagccactaccactgcctatggatcaccaagcgcctatcattggaacaggagctctcgccacgaatgactcttacagtctcccgacggcaggcagtgggaattctgggacaatagttggtgagacccaccagcagttcatggacgaccctttcttcggcgaggctggagacagcacttttggtggccttcctttcagcctcgttcctttcagtagtccgatgctcaactttgatgacttggtggacgacgatgacttgatgccgtacctgggcacatgacacagtgtccaattcatacctggtaactatggcgtggataggtggttcatgctcgtgcagccagttactgggagagttgggtgacatgctgatggagcagtggaatgttgatgcagctgcagctcgtgacccatttgtggcgccgtcctgagaaggtcattgctttgtaatataacatcaataatgtagtttagggtgctctcttgactgtactggatgtcaaatgctatactgtcgtaagccgtgaacttgtagcctgtagagcaagttaggatttggtggcatcatgctgctggcggagaatttccgcagccgtttaaaggattttattttattt

SEQ ID NO: 186 - DNA, 1214 bp, Sorghum bicolor
cactcactccacctgcactcctacttgagaccggaccgtcaccggcgtccggcggcccgcagcaagcaggagcagcgtccaccggagcaagcgtgcacgcaacagacgacgcgccagccgccaaacggcagcaggtccggacgtccggtcaccttccgcgctctgcgctcgcaccctgacccaccaaccacccatggcgtccgcgccttccgcccccgcctccgccgccgtcaaggccgcggtcgtccccatcccaccggtccacccgccatcctccgtggcagtactggcgcggcgcgcgccgacgccggtgccggccgccctgcgcgccctgggcctgggcggcaacgcgcggcatggcgcggcgctggtggcgtccgccgcgctggatgacctgcgcccggccatcgacgagtaccccgagggcatcctgtccggggagtggcccggcaacttctccctcctcagctacgccgacctccgcgcctacctcgagtcccggatcgtcacctccgaccagatgagcccggcggcaaagctcggggacgtgatgtcgcgccccgtgcaggtggccacgccggggcagcgcctcgcggaggtcgatgccatcttcgccgcggagcagttctcgggcctgcctgtggtcgacgaggacggcaggtgcgttggggtgatctccaagaaggacaaggccaaggcgcccaatgggatggagtcaactgtagttgaagtcatgtcatctcctgcgataaccctgacgcccgagaagacagtcttggaggctgcagcactaatgcttaaggagaaggttcacaggataccggttgtgaatgaacagcaacaagtgatcggaattgtgactcgctcggacgtattccaggcacttgaggccaacaacaacaaagcatgagagtgaggtcccctcccctgttaggcttgttctcgccagatgttgcccgttgtaaatatcagttgaactagtcggtaccccgtgttgccctaggtgcaagcgagaataacggtgggcatgtctactctgctgtgtgtatcatagtttgtgtgagtgtctgtaattcaaaaaaaaaaaactaaagttgcatgtcatcccatatatatggcactttctctgtcctacaaataattatatttctttgacttctatcactcatgtttgatcgttcatcttatttaaaaatttattttatcatgactta

SEQ ID NO: 187 - DNA, 2171 bp, Sorghum bicolor
ggtgcgcagcaaacgcagcagcggccagggtcattatcgccaaatcctatgatgaaccctgctgcttcccctgactccccttccctgtataaagaggaggctccttcctcctctcattgtcgccgcatccctcccaagtcccccaagctcagaggaactcaggcaacggccatacattccggaggccaaaaagaaagaaagaaaaaaaaaagtgtagcctccgcccccgcacaaagctttggctttcctgtcctcgtcctcctcgtcctcgtggcgtcgcaactcgcaagatcactgtatccataacaagaagctaaatcctcaggggatgctgaaagatgtgctttcatagaagagatttctgctgcaacatcaaggacctagctgctctgcaaggtctgctagcctgctcgtctcttcatgtgagtgatcgtctcacctgcatctgcatcaactccacacccttcagactccggcacgaccaagccataagaatgctgttcaccgtcatggaccatgacatgggggaggagggctaaatctttgctgtccacctgattggcaacacaactcaagataaagatatggagatcagagggaagactttgatggagcggtatgagctggggaggttgctggggaaaggcacatttggcaaggtgcactatggaaggaaccttgagtccaaccagagcgttgctatcaagatgatggacaaggacaaagtgctcaaggtcgggctttcagagcagattaagcgtgagatcagaacaatgaggttagtggaacataagaacattgttcatcttcatgaggtcatggcgacaagaaacaagatctatattgtcatggagtatgtgaaaggtggagagctctttgacaagattgacaagagtggcaagctcacagaggctgctgcacacaagtacttccagcagctcattagtgcagtggatcactgccacagccgaggtgtgtatcaccgggacttgaagcctgagaacctgctgctggatgagaatgagaacctcaaggtgtcggattttggactgagcgcgctttcagagtcaaagaggcaagatgggttgctccatactacctgtggaacgccggcatatgtagctccagaggtgatcagcaagataggctatgatggtgcaaaatcagacatctggtcttgtggtgttgtcctgtttgttcttgctgctggttatctccctttccagggcccaaacttgatggagatgtatcggaagatacagcatggtgatttcaggtgcccaagttggttttcacacaaactcaagaagctgttgtacaagatcctggaccccaacccgagcacaagaatttcaattcagaagataaaagagtctacttggttccggaagggtcctggggagatccgtgcagtaaaggagaaaattcttagcgagaatgccaccacaaattctgacccagtgcttgctactaggcgcaagaagattgctcaagaagatatgaagcccctggctgccacaaacctaaatgcctttgaaattatctcattctcaaccgggttggacctgtctggtctatttgtcaaaaaggagtgcagaaaggagacgaggttcacttcagataaacctgccttggccatcatctcaaagcttcaagaggttgcaaaagcactgaatctcaggataaggaagaaagagaatggcattatcaagattcaagggaggaaggaggggaggaatggtgtccttcagtttgacactgagatctttgagattacagcatcctaccatctcattgagatgaaacaaacaagtggtgattcagttgagtaccagaaactgttggaagaggacatccggccagggctgaaggacattgtctggtcctggcatggagatgatctgcagcaaaagcaggagtagcttcggatgtctcacatagattttgttctgaaaattcgttggattttcagctcagagtgattctgttctacatttgatgtcttatttttttagcagctatattctttttatgtattggaggagcatggtgttgatgtgaaccattaggctatatatattttgttgagttgttgtgttacattccgaagattgttccagttttgtaatggctgtaaatatcaataatgaaattaaatgttgttgatcctt

SEQ ID NO: 188 - DNA, 2325 bp, Sorghum bicolor
cacacggattcctcgtcccctccggcaaccccggccgccgccgccgccgtggacggcggcacatgatgccaggttcttcttctgccgcacacgtaccagcagcaggtctcctcctccacgccagcctgggcggtggcggcgatggtggtgaccgcgacctcggagcagccgacctcccgcacctcccatcctcctcccggcgacacgcgtaagcagctgcgcacaccattcctcctccccacgccactgcgctgacccgcgtcctctactacctcgtcgcggtggccggcgcgcccctgccaaaagcctcatcggcgtcgccaggaccgccttcgcgctcccaacgcgccgttcctccggtacatgaacgaggccgccggcacggtcgtctgcggcgacctcatcgtcggcgccatggcgcagtcgtggaggttcctcatgcagggcgtcacgtcgctcttgttcctctgcgcccgcgccgccgctgccgacgacgacgagtacgtccggccgccgccttgcccgctcgtgctcgtcgcgcacgacaagccggcgtggcatcctcagcaggtacacatctcagtcgtcggatccgaccacatgcgcgtctcgtgggtgaccgacgaccgtcgcgcgccgtccgtggtggagtacggcacgtctccggggaactacacggcgtcatcgacgggcgaccacacgacgtaccgctacttcttctacaagtccggcgcgatccaccacgtgaccatcgggccacttgagcccagcacgacctactactaccggtgcgggcggtccggcgacgagttcaccctccggacgccgccgtccacgctgcccatcgagttcgtcgtcgtcggcgacctcggcgagacggggtggacggcgtcgacgctgtcgcacatcaccgccggcggcggcggcgactacgacatgctgctcctcccgggggacctgtcgtataacgcggacacgcagcagccgctgtgggactcgttcggccgtctcgtgcagccgctggcgagcgcgcggccgtggatggtgacggagggcaaccacgaggtggaggcgctgccggggatccccgtggtgggggagctcgtcaagccgttcgtcgcctacaacgcgcggtggcggatgccgtacgacgacggcgacgacgaggcgagtgggtcgtcgtcgtcgtcgacgacgtcgaacctctactactcgttcgacgcggcgggcggcgcggcgcacgtcgtcatgctgggctcgtacgcggcgttcgtggaagggtcggagcagcaccggtggctggcgagggacctggcgcgcgtcgaccgccgccgcacgccatggctgctggtgctgctccacgcgccgtggtacaacacgaaccaggcgcaccagggcgagggcgagcggatgcgcgtcgccatggagcggttgctctatgaggctcgcgtcgacgtcgtgctcgccggacacgtccacgcttacgagcgatttacgaggatctacgacaataaggccgacagccggggccgaatgtacatcaccattggcgacggaggcaacaggaaggccttgctctcaagttcatcaaggaccacaagtcggcgcacctgtcggagtttcgggaggcgagcttcgggcatggccggctgaggatcgtcaacgagacgagcgccgtgtggacgtggcaccgcaacgacgacgagttcgccaccgtccgcgacgaggtctggctggagagcttggccgccgccgcaaaaccaggcctggcaccgtcgatacccgccggtcgtgacattgatgagctctagaatgctataggaatacaggatacacgattgcaaaaatgcatgggtacgaaaggtatccgtagcatttgttggttatgacttcctcatgtcagaaatatagtttcaccaagattcgttccaagtcaagccgttgactgtatcaatatctaagttttttttactgtatatagtcaatatagattgacaaggttagtattactagattgactgtatcaataatatagattgccaacaagatggaagggaaggcgtcgctgtaccctgggcgggacggaggcttcgacgtgcaggtggcgatgctgccggagcacatggcggcgctagagcaggacgaggagctttgggccgccgtgtcgccggacgcggcgccggccggccagggccacgaaagaatgaaactttttttagcccacaatgctctctccgacgtgaaaaatgttgtttaatttgaatcacatgtccgctttttcgtttgttgcgtgtacttttaaattgtaatcaaattgatgatcga

SEQ ID NO: 189 - DNA, 1883 bp, Sorghum bicolor
agcagctcaaaactttagccagagctagcgcaagaaatggctccactactgcttcatgcttctgccataagtcacagtgcccatccagggcttagaagccatataggacccaacaatgagcatatctcacggcacctatcttcttcatcacaaaatactaagcgaaggtgcaacattagccttaggtcacgagctcaaaggataagcagtcagcttggaggccagaagctcgagcactgggaaatccctaaaagggactggttccctcctagctttacctttggtgccgccacttcagcattccaaatcgaaggtggttggaatgaagatggaaagggtccaagcacttgggatcacttctgccacacttatccggattttatagccgacaagagcaatggggacgttgcagcggattcataccatctctatgaagaggatgtaaaattgctcaaggaaatgggcatggacgcctataggttctcaatctcttggcccagaatattgccaaacgggacactcagtgacattaatgaaaaaggcatcgcctactacaataatctgatcaacttgttgatagacaacggcatagagccatatgtaacaattttccactgggacacgcctcaagcactggtagatgactacggcggcttcttagataagagaattataaaagattacacagacttcgctggactgtgctttgaacgattcggtgacagggtgaacaattggttaacctttaacgagccacatacatttacatgtttatcctacggaaccgggatccttgcccctggacggtgctcaccaggaatgaaatgtcccgacccaactggggactcaatcagagagccataccttgttggccacaatcttcttctagctcatgctgagactgttgatctttacaacaagtttcataggggtgagaaggggcgcatagggcttgcgcttaatgtaatggggactgtgccatatggaagtacgtttctcgatgaacaagcccatgaaaggtgtatggactacaacctaggatggtacttggagccagtggttcgtggtgactacccccattccatgagatcatcggtgagggataggctaccccacttcacagaaaaagagcaacagaagctagtgggttcctatgacatgatagggatcaactactactcctcaaggttcgccaagcacgttgacatcacagaaaatttctcgccagagctcaacacgcatgactgctgtgccactgaagaaattacagggcctaacggcaatactattggtcctgctactggaaatgcgtgggtctacatgtaccctaaaggcctaaaggatatccttatgatcacgaagaagagatacggaaatccaccggtctacatcactgaaaacgggatgggggacattgacaatggcgatctatccatggaagctgcgttggacgaccacataaggctagattaccttcagcgccacatctcagtccttaaagattcaatagattccggagcgaacgtgcgtggccacttcacatggtctctgttggacaacttcgagtggtctagtggctacaccgagcgtttcggcatcgtctacgtcgatcgtgagaatggctgcaagcgcaccctgaagcggtcagcaaggtggctgaaagagttcaacggagctgcaaaaaggcctggaaatctgattaagccaaatttcagcgaaataaataagatcaaagttgttacgccagcttagaacactggctgatgtttacccgtagtatttttcatctcaaactacaaaacaatttatgtctatgtaatcgatgttattattttaatttcatgtttatgaattttgtttggtactccaaataacctcgactg

SEQ ID NO: 190 - DNA, 4121 bp, Sorghum bicolor
gcacgcgacgcgaccgacctgtgctcccccttcaccgcatcagcagcttcccctcgcctgcctcgcatccgcccccgccctcgacccccgccccttcttcctcctcttcccgccgccgtccgacgccaccgccgcttggcgggggccgcctctcgcacacgcaccgcagtcgcgagcgacgacgaccccatgactatgatgacgccgccccctctcgagcagcagcaggaggacgacgagatgctggtgccgcaccaggagctccctgttgctggtccggaagccgccccacagccgatggaagttgtggcgcagacagagcccgccaacacagcggagagccagccgcccgaggacccgcagacgtcacgcttcacctggacgatcgagagcttcagccgtcttaacactaagaagcactactctgatgtgtttgtcgttggaggatacaaatggcgtgttctaattttccccaaggggaacaatgtggatcacttctcgatgtatttggatgttgcagattctgggaacctcccatacgggtggagccggtatgctcagttcagcttggctgttgtgaatcagatccaccccaagtatacaattcggaaagatacccagcaccaatttaatgcacgcgagagtgactggggtttcacatcatttatgcctttgagtgacctatatgacccaagcaggggctatcttgtgaatgacacagttgttgtagaagctgaggttgctgtccgcagaatggttgattattggacttatgactcaaaaaaagaaacaggttttgtaggtcttaagaatcaaggtgctacctgttatatgaactctctccttcaaactttataccatacaccatattttagaaaggctgtatatcatatgccaacaactgagaatgacatgccatctgggagtatccctttagccctgcagagccttttttacaagctccagtatagtgacaacagtgtagcaacgaaagagttgaccaaatcctttggatgggatacttatgattctttcatgcaacatgacgtgcaagaactcaacagagttctttgtgagaaactggaagataagatgaagggaactgttgtggaaggaacaattgaacaattatttgaaggccaccacattaattacatcgagtgcattaacgtggactataaatctagcagaaaagaatcattttacgatctacagcttgatgtgaaaggttgtcgtgatgtttatgcatcatttgataagtatgtggaagtggagcgtctagagggtgataacaaataccatgcggagagatatggcttacaggatgcaaggaaaggtgtgctcttccttgatttccctcctgttttgcagcttcaactgaagcgttttgaatatgattacatgcgagatacaatggttaagattaatgaccgctatgagttcccgcttcaacttgatcttgatagagacaatggaaaatatctttctccagatgcagatcgaagtattagaaacctctatacgcttcacagtgttcttgttcatagtgggggagtacatggtggtcactactatgctttcattcggccgacactctcagatcagtggtacaaattcgatgatgaacgagttacaaaagaagacactaaaaaggcacttgaagagcagtatgggggtgaggaagagttgcctcaaataaaccctggtttcaataacacaccattcaaattcacaaagtattcgaacgcctatatgcttgtctatatacgtgagagtgacaaggagaaaataatgtgcaatgttgatgagaaggatatcgctgagcatttgcggataaggttgaagaaagaacaagaagagaaagagcacaagaagaaggagaaggctgaagctcatctctacactatcataaagattgctcgagacgaggatttgaaggagcaaattggtaagaatatatattttgacctggtggaccatgaaaaagttcgcagcttccggattcagaagcagttgccttttacttcattcaaggaggaagttgcaaaggaatttggcatccccgtacagtttcagcgcttctggttgtgggctaagaggcagaaccatacataccggccgaatcgtccattgaccccccatgaggaagcacaatcagttggtcagcttagggaagtctcaaataaggcacacaatgctgagctgaagttgtttctggaagttgaacttggaccagagttatgtccaattcgtccacctgagaaaagcaaagaagacatacttcttttcttcaagctttataatgctgagaaggaagagcttcgttttgtcggtaggctttttgtgaaggctctgggaaagccatctgaaatattgacaaaactgaatgaaatggctggattttctccaaatgaagaaattgagctatatgaggaaattaagtttgagccaaatgtgatgtgtgaacatattgacaagaaacttactttccgttctagtcagcttgaagatggagacatcatctgtttccaaaaggctcctgttccagatggtgatacacaagtgcgctatccagatgttccttcattcttggagtatgtgcacaataggcaggttgtgcactttcggtctctggacaaaccaaaggaggatgatttttctttggaattgtcaaagcttcatacttatgatgatgttgttgagagagttgcacatcaacttgggttggatgatccctcaaagattcggcttacatctcacaattgttactctcagcaacctaaaccacagcccattagatataggggagtagaacatctactggatatgcttgttcattataatcagacttctgatatcttgtattatgaggttctggacattccactgccagaattgcagtgtttgaaaacacttaaagttgcattccaccatgcaacaaaagacgaggttgtcgttcatagcataagacttccaagaaatagcactatcagtgatgtgattactgatttgaaaaccaaggttgaactatctaatcctgatgctgagctccgcttgcttgaagtattttaccataagatttataagatctttccgcctcatgagaagatagagaacataaatgatcagtactggacattacgagctgaggagatcccagaggaagagaagaatctcggtccacatgatcgattgattcatgtttaccatttcatgaaagaccctaatcagaaccagcagattcagaatttcggagatccttttttgatggttatccgtgaaggtgagacttctgcagaggtaatggagcgcatccagagaaaactcagagttcctgatgaggagttctccaagtggaagcttgcattcatatccatgaaccggccagagtacctccaggacactgatgttgtatcagcacgttttcagaggagagatgtatacggtgcttgggaacaataccttggcttggagcacactgatacaacatcgaagaggtcttacacagccaatcagaatcggcacacctatgagaagcccgtgaaaatttataattgagaaaccttcatcacgcttcaatcgattgacaaaggcctcaacaacaagtacgcccaagatgatagggggcttggaacagaaaaaagctggtagaggagtatagttgctgtctgtgctgaggcctacaagcccatcaatgctgcgtcaaccttttagtgttgctgctgttgtctattggcaacggggtattcttttcggggcttttccgacttgcttccaagcaaccaagcatgtgtgttggttttttcatcgtgtctagtatgatggcccctgctaggataggtgtttgcttaatttgtagagcaaagctagtacataagaaaaatattttttagtagggggcatgtatacaggatcatagccgatactgattgctgaatttgcgcctcttgtagctgtgggaacaatggcagagattgtataatgggtttggtattggttccagttttccgtgctgttgacaaatgtaaggataactgcgcggatagtacagttttgagttccgacctaggttgtttgttggtatctgtagccatcttgtaagaaacatcatcctttggtct

SEQ ID NO: 191 - DNA, 1409 bp, Sorghum bicolor
cggagcacacgaccaaagtacactactactactaccagtactagtagaatcagcttgcacacgtacctgcgcgctatactagtagagagcagctccactgcaccccactccacccaccacccaccgctcacgccccgccacctcctcctcggattcgccgatggagaagatgctccacgcagcccccgtccacgcgacgctcccggagtgcttcatcttcccgtccgacaagctcccgcaggccaagtccacctccggcgcggtctccctgcccatcatcgacctgtccctcggccgcgacgaggtctggcgcgccatcctccatgccggcaaggagatcggcttcttccaggtggtgaaccacggcgtgtccctggaggcgatgcgggacatggaggcggtgtgccaggagttcttcgcgctgccggcggaggacaaggccgggctctactccgaggacacggggaaggagacgcggatctactccagcaccatgttcgacacgggcgccgagaagtactggcgcgactgcctccgcctcgcctgctccttcccggacgtcggcgacagccaccgcggctggcccaacaagccgaccaggctccgggagatcgtcgagcggttcacggcgcagacgcgcgggctcgggatgcacatcctccgcatcctctgcgagggcctgggcctccgcccggactacctcgacggcgacatcagcgacggcgacgtcgtgctccacgtcaaccactacccgccctgccccgacccgaccgccacgctcggcctcccgccgcactgcgaccgcaacctcctcaccttgctcctccccagcatggtccgtggcctcgaggtctcctacaatggcgactggatcaaggttgaccccgtcgccggcgccttcgtcgtcaacttcggatgccaacttgaggttgtgacgaatgggacgctgaagagcatcgagcaccgggtgatgacgaacctgggggtggcgaggacgacggtggccacgttcatcatgccgaccacggactgcctcatcggccccgccgcagagttcctcagcgacgacaacccgccggcgtaccgcaccatgacgttcggagagttcaagcgcatctacagcgtcgtcaagctggggttgtcgctcaacctcaccacgaatctcaaggacgtgcagaagcaggtctgatccaattaattaatgtaggatcggagtatatatgcaaccaataaaattaagtcccttgttagacctcacttgcagccatagctaattaatagctagctggggagaagatgcatgtagtctgtgttaattatgttgttactgctacccggacgtcatgttgctgatgatatgaagcaatgaataaaaatgacaaatatgtgtgtacatgcatgtatggcgc

SEQ ID NO: 192 - DNA, 1751 bp, Sorghum bicolor
cagactccagtcgtccctacaatcttcttgcgaacacacactcgggtcactctgcagcttcaaccagcagccatggcgcaccggccggacgccgcggcgccgctgctcgccaagcccgacgccgacgcgacgcctcctccgccgccgaagcgcaacaagtaccccttcttctgcgccgtgctcgcctccatgacctccgtgctcatgggctacaacgtggcggtgacgagcggcgcgcagatcttcatggcggaggacctcggggtgagcgacgcgcagatcgaggtgctctcgggggtcatcaacatctactccctcgtcggcgcgctgctggccggctggacctccgaccgcctcggccgccgcctcaccatcgtgctcgccaacgccttcttcctcgtcggcccgctcgccatggcgctcgcccgcggctacgccttgctcatggtcggccgcttcgtcgccggcgtcggcgtcggctacgcgctcgtcatcgcccccgtctacgccgccgagatcgcgccgccgtcttcccgcggcctcctcacctcacttcctgagatttttatcaacactggggtgatgctgagctacgtgtcgaacctcgccttctcggggctgccggtgcacctgtcgtggcgggtgatgttcgcggcgggcgtggtgcccaccgtgttcctggcggccggggtgctcaccatgccggagtcgccgcggtggctggccatgaagggccgcgtcgccgaggcgaaggccgtgctcgacaggacgtcggacacgcccgccgaggccgagcagcggctgctcgagatccaggacgtcgtgacgaacagcagcagcggcgtcggcggcggcggcgcgtggaaggaggtggcgacgaaggccggcgtccggcgcgtgctggccatggtgctgacgctgcagttcttccagcaggcgtcggggatcgactcggtggtgctgtacggcccgcgcgtgctggccatggccggcgtcacgtccaacaccttgctcctgagcctcaacgtcctgttcggcgtcgccaaggcaggctccatcctcgtcgccatggcgctggcggaccgcgtcgggcggcgcccgctgctgctggtcagcacgggcggcatgacggcggcgctgctcgtcctgggctccctgttcgcggcgttcgcgggggccaaggacgacgccgcggtggccgcggtgagcgtggcggccgtcgtggcgttcgtggtggcgttctccgtcgggctcggcccgctggcgtgggtgtacagctccgagatcctgccgctccggctgcgtgggcagggcgccgggctcggcaccgccatgaaccggatcatgagcggcgtcgtcaccatgaccttcatctcgctctaccagggcatcaccatggccggcgcgttctacctctacgccgccatcgccgccgcgtcgttcgtgttcgtctacgcctgcctgccggagaccagggggcggagcctcgaggacatggaggagctcttccacaccaagtgatttcattttcacatgcgctgatctgatccaaccacgccattggttcagttctggattcggtgccattgcaggtttatttgccattgttggagctggttttgatcttggtagttaacatgatgacacatgcatattgaaatcgattgtttgagcggggtctcgatgttggacatgggaacacattgtaaattttgtattctttctccacaagggtaaggaaatcaaaggat

SEQ ID NO: 193 - DNA, 2577 bp, Sorghum bicolor
tgactagtcactagcactagctggggccgccgcgctgggaggacgcggtccggttcacgccgcctcgactcgcctcggccctcgccgccatggccggcgaggccgcggagagggtggccgccgccgtggaggcggtgggatccggtggctgggagttccggaacgcgtacaggcgccagctgctggcgctgtcgcggcggatccggctcctcggcccctttgccgaggagctccgggaggcgcgccgtgggcggcccgcggaggaggaggaggaacaggagcgggcgctggcgccgctcgccgacgcgctggaggaggcgctcgacctgctccagctcggccgcgatggcagcaggatcttcctggtccttgataggaataaagtaatgaagaagtttcatgaatcaattgctcagctggagcaagccttgtgtgattttccatacgataaattggatatatctgatgaagttacagagcaggttgagttagtgcatgtacagctcaaaagagccaaagaacgggttgacatgcctgatgatgagttctaccatgaattactttcactgtataacaagagccatgacccaagtgctgaattggctatccttggaagattgtcagaaaagttgcacctgacaaccatcactgatctcacacaagaatcgcttgccttgcatgagatggtggcatctggtggtggtaacgatcctggagaacgcattgaaaaaatgtcaatgctattgaagaagatcaaggactttgtgcaaactcagaaccctgaaatgggcccgccggtgactaccaaggtaatggattccaacggggagctaagacctataaacattcctgatgagttccggtgtccaatttctcttgagctgatgaaagaccctgttattgttgctactggccagacatatgagcgggcattcatcgagaaatggatagcttctgggcatcatacttgtccaaatactcaacagaggatgccaaacacgacactgacaccaaactatgttcttagaagccttattgcgcagtggtgcgaagccaacgggattgatccaccgaagcgcccaacggaggctgacaaacccacatcttcatgctctccaagtgaacgtgctatcatcgatgctctcctctccaagttatgctctgcagatcctgaggaacagagatcagctgctgcagagctccggctcctagcaaagcggaatgcaaataatcggatctgcattgccgaggctggtgccattcccttactattgagtctcctgtcgtcatctgacctgcagactcaggaacatgctgtgactgcacttctaaacctctctatacatgaggataacaagtctagcatcatattatctggtgctgtcccaggcatagtccatgttctgaagaatggaagcatgcaggcacgagagaatgctgcagccacccttttcagcctatcggtggttgatgaatacaaagtaacaattgggggaacaggagctatccctgcccttgtagttttgctaagtgagggcagcccacgtgggatgaaggatgcagcagctgctctattcaacttgtgtatttaccaagggaacaagggccgtgctatacgagctggccttgtgccactcatcatggggctcgtgacaaaccccactggtgcgctgttggatgaggctatggcgatactctcaatactctccagccaccctgagggtaaggctgcgatcggtgcagcagagcctgttcccgtgcttgtggagatgattggaagtgggtcaccgaggaatagagagaatgctgcagctgtgatgttgcacctgtctgtgcataacgggcatttagctcgggcacaggagtgcggcatcatggttccactacgggaactggccctgaatggcacagacaggggtaaaagaaaggcggtgcagctccttgagcgaatgagcagattccttgttatgcaacatgaggatactgtttcccaacaattggacgagattgaacgtcaatttgccgccttaggacctaatgttacagaggctgatcttgaacaattgggtgaacaattgggatatctttaacctccacatgctatggttgcatgatgatgatgaatctatcgtcgccacaatactaccaaatgttttttttggataagttaccaaaaggacgagcaagctgtatccgagtcacttggcttctggatccatggtttatgctgaacgagagttcttgtatggcaatgttcaatcggcactgaaatctgtgatgatccgtctggcttggcttcttccatgcttgtgtgctgaagctcccatcgctccatatctgtttctgggtacgtaagctagcccagaatgttgagatgtgtacagtctacttagtatgccgctccaaacgtcatgtatggctatgttttgactagaatatgtacatttttcactatggtactagataaatgagaagttctagcggcagacttgatcagtaaatcttatttcatgctactggatgttggcgtgagtttcagatttcagaatatgttgacgcgtatgcatttgtgattcc

SEQ ID NO: 194 - DNA, 1284 bp, Sorghum bicolor
cgccactcgccacagtgcgctccataacgcgaccgccggtataaacgcagccggccccctcagctccggcctcgaccaagaccaccattgctcaggttgctcccagctcccatccgcgcccctcggggagtacgaggtacgagaaagagagcgactctcctccaagaatggcgggtggcggcgccgacgacgacgacgtggtggaggtgagctgcggcggcagaggcggcggcgaccccggcgcgtacgccgcggtgctcaagaggaagctcgacctgtactgcgccgccgtcgccaaatccatggaagctaaatcacaagaatcttcgttgggctaccccaactcacaagcttcagatacttcgcaattgatttctcaagcttcctttgatggtgacatagatggagcaggccttgtcacaaactctaatgtcataatagaagatgatgattttcaaggcaagccaaccaatagtggtacatcaaaggaactgtcagacgatgatggtgaccttgaagagaacactgaccccactaacgccaagaagatgaggagaatgctgtcaaatcgggaatcagctaggcgatcaagaaagaggaagcaagcacacttgaacgatcttgaatcacaggtttccaggttaacatctgagaatgcatctttgctaaagcgtctggctgatatgactcagaaatacaaggatgcttcccttgacaataaaaatctaacagttgatattgagactatgaggagaaaggtgaacatagccgaggaagctgtcaggagactaactggaacaaccctcatgttatcaaccgcatttgacaagcccatgagcagcacacccttgtcatcatgtgcatctgatgcggcttctgcctctgtcgccattgaagatagcgcgaaacatttcctccatgcgccacttcaaagcggtcagatgaagcttgacatcctgaacgcggcgattcctctgaccagtgaggggataggcaccaagccagcttctctgcagcgtgttgctagcttggagaacctgcagaagaggatcattggagattcgatgcactctgagactgcatcaacattctcagagcctgaagctcttgccgataggtaaacatgagctgtaaagatttgctcctgtgatgaacagctctagtgacctaagttttgtggcaatggaagttgtgcacccatgcgtctgggtgggatctatacagtgattttgtacactattttgaagattaataatctgtggccaaggctgtcatctttgatta

SEQ ID NO: 195 - DNA, 2013 bp, Sorghum bicolor
agtgtctccctctctctctctctctcttcctctttccccaccccggcccctgctctgcttcgtctccactcctcccgccgccgccgccccggccccccggccgcgcgattgggctctagaccctcatcggatccgccgccgcgcgcgtcgccattccccgcgccgccttcccgtctcactccgcccgccggttcccgttgctgcgcctgcggcaggcggtttccttcccgcgcctgccttccccacctttctgtttcctgatcctggtcctggttcgcgggttcccgatttcgcgcgctcgtgcggcggccgatgcccgcgtcctcctccgtggcggcggcgagatccggcccgcgcgtggcagtaaaccgaccccacgtcctcacctgagccggcggaggtttcgtgtcccgttctctcttctgttccgaccagagagagagagagaggatcgccagtcgcgaggctgaggagcaagggagatggcgtctccgtacgccgcctcgccgtacgtgctgtcgctgctgcttctggtgctctccgtcccggccgtcttcctcctcgcgccgcgcctcatcccgccgcgcacgctcccggccatcccggacgccgacgagacggaggacctcgcgctgttccgccgcgccgtgctcctctccgccgccccctccaagaccggccccgcctccgcctccgcatccacctcgcgcttcttcggcgcggcccaccgacagaggaagcagaaggtggcgttcctcttcctcaccaactccgacctcgtcttcgccccgctctgggagaagttcttcgcgggccaccacgacctcctcaacgtgtacgtccacgccgacccatccgcggcgctgctcctcccgcccacgccttccttcagggggcgcatcatcgggggaaaagccaccgcgcgcgcctccgccacgctcatctccgccgcgcgccgcctcctcgccaccgcgctgctcgacgacccggccaaccacttcttcgcgctgctctcccagtcctgcgtcccgctgatgcccttcccggcgctctaccgcacgctcgccgccgacaatgccggcccgcgtggacgacaccgcagcttcatcgagatcctcgacgccgagcccacgctgcacgaccgctactacgcgcgcggcgacgacgtgatgctccccgaggtgccctacgagagcttccgcgtcggctcccagttcttcgtgctcaccaggaggcacgccgtcatggtggtcagggacaggaggctctggaacaagttcaagctgccgtgcctcgtcaagaggaagttctcgtgctacccggaggagcactacttcccgacgctgctggacatgcaggaccccgccggatgcaccaagttcacgctcaccagggtcaactggaccgactcgttcgacggccatccgcacacgtaccagccggaggaggtctccccggagctcatcagggacctcaggaagtccaatggcacatactcccacatgtttgcgcgcaaattcgcgcctggatgccttgcgcccctcatggagattgccgactctgtcattcttcgtgactaggctgcttgcatccctccgtttgcacaactggaagagctgagggttgtgatgtgatgaacaagcgtaagctgatccatccattccctttggaattcttcagagaggaggaaccagcaccaaacctactttgttttgcacctgcagttgctctttggcaaaagttggatgccacgcctcagaggttaatgatggcggtattggtggcgaagggccccagctgcctcttgtgagtatttgttttttgtgagttcttgtttctttttttttttccagtgagagctgagtggtggctaaagatgatggagaagtttgcacgtaatagggtcgtagttagcatgatcatcctgtgtatttgcatggagacaatctgtcggtacatgcagtgatggtttgtagtatctgttgcatatattacatatgtcaatatcatgcc

SEQ ID NO: 196 - DNA, 1041 bp, Sorghum bicolor
gctcctgagccgggccaggtgctcgcggtcgatcggcgccacgagtggtggtctggtttctttcagctcgggagaggtagccatggggaggtcgccgtgctgcgagaaggcgcacacgaacaagggcgcgtggaccaaggaggaggacgagcggctggtggcgtacatccgggcgcacggggaagggtgctggcgctcgctgcccaaggcggcgggcctgccgcgctgcggcaagagctgcaggctgcggtggatgaactacctccgcccggacctcaagcgcggcaacttcaccgacgacgaggacgagctcatcatccgcctgcacagcctcctcggcaacaagtggtctctgatcgccgggcagctgccgggccggacggacaacgagatcaagaactactggaacacgcacatcaagcgcaagctcctggcccgcggcatcgacccgcagacgcaccgcgcgctcggagtcagagccgacgccgccacggctcccggcgccgtcgcggcgcaccaccgggcggcggcgctgctgcaccaccacgcgggcgccgtcgtcgtcccggtggccccggtcaagctcctcgccgtgaagccggcgcccgcggagtcgtcatccgacgacggcggcagcagcagcaccggcagcagcggcggaggcagcgccggggagccacggtgccccgacctcaacctcaacctcgacctgtccgtgggctcgccgccgccggcggcggctgccgacacgcccacctcgctgtgcctgtgctaccgcctcggcctccgcgccggggaggcgtgcggctgcgaggctgacatcacggggcaacaggggtttagatttttcaggccgttggaacaaggctagtagtgccgtaaactacgagcttctgctatcagacttgagaatgagaacccgagaggagagtcgttaaaatagcgggcttgattcactgcaatttgcaggaaggacaggcagttttttctcctaatggacagcactgtttgaggaaaagaggaaaacggattgaaagaaat

SEQ ID NO: 197 - DNA, 2191 bp, Sorghum bicolor
cgcgcacccatagtctttctcgcagcgccgccgctccatcttctgctccttcccctactcgccgtcagcggcgctcaggctcgggcgctcagcgacggaggggcagtcccaggctcggcggcggcgtcagcggctccccctcccgcctctcgtccttcgcctcgcgccctcgcctccgtcctccgcgcaccggccggcgaccctgcgaactctccaccctggctgctggcgggacgccatggaaggggcggctgcgctctcaccacacgacccctcaaagttttcaaatgcagaggctcccttcccagaccaattacatgggggaggaagaggatctccaaacattgaagaagcaggcttccctcaagaagactgtgagaggttgccaccctagagctgtacggcagttgctgcagctcgatagaagagattctgagcatccaatcgtgatagacaatgaagtaaacgaggaatataaggtcagcgctgatcaatcagcaattatggttctccgcagatccccacggtttcatgtggaagataagagtttgggcaagccgctgttgccaccaaatcacccggagacgcctcctaacaaaaagagtaaaagtgctcatttgaaagacaaaaatcaaaagagtctgaaaagtgatagtagaaatgctcgattggagcctttggcaacaatgaaaaggcagaatgagccccagttactttgtcaagatccccgaggcatcaccagcaggaaaaatattgaagatgtatctaacaaaaagagtgagaagaaagagtttatgcccactaattgtaaagtgttgataggaaagaggaagagaggcagaaaaagggcgttgtcatcgaagaagcaaagttgccaagagccaaaaccattgcctacaaatcgccaagaaattgcaccttgtgatgaacccagaaaatctatccacagaaggattgaaaatgaaccgtctattgtggtgatgcctaaaagtggtgatgaggaattgacaaacattgatgaaaacatcagcaaaccaagtgggactgaaagaggagtgggaaaattttgtagctctgatgattggacaaaagagcaggacatggcattgcgcaaagcttacttcactgctcgaccatccccacatttctggaagagagtttcaaaaatggtgccagggagatctgctgaagactgcttcaacagaattcatgctgacctcacgacaccaactccaatagccccacgtcccagaacaagtaaaacaacattttctcctataggaaatttcacattgtctgatccaaaacttccaaatctcttggaatctagagttgcaaggcaaaggaccgctaaacaaaagggtcttacagcacagaagacagtgaggcatttgttgcagaagcattgtgtcattgaccaagctcaagaggctgatcacttctcagtttttgaaagctcaccaagtgccttacaattgaacttatcttttgaagattctcatgggactcctgacagttatacgaattcaggttctctaggcaaatgcagtggaagctcttcagcacgaaagaaaccaatttcaaggttaagaactaagccatctgaaccgagcccagaagttctaaagcctataaagaatgttatcttacatgagaagtacattgatcaattgtcacgtagagaatatacaaaaaggcctcgcaaaagcactcaaggctctaaagctgctgattctgagaaggctctttctgagcagaaagctggtagtctgaaggctgctaaaaatgctcttatctcagaagcaactgactttataagcagttttaagaaggtgcaagcctgttcccttgcgcatgttgtggaaaatagcgaagatgatgagattgaatgtgatgccagtgattacagccatgatgataaagaataaggaggtgcttatggtgttaattcccagcagctcttagcaattattaccttttttgttaatgggcgttagtcatcactcatcagtgcctggtgcttcaataggtagttactagtatgggtggtatggaggtgtattctgcctaatatgtgtcttgttcctagtgccctcggaactgtaagtgaattgagaaagtgttgccttcatcatgccttatgatgattgaaaccaattgaaattgcaacggtcgaacctgtttctcttgt

SEQ ID NO: 198 - DNA, 1014 bp, Sorghum bicolor
cgcaaacgccacgaagggaatgaaaccgacgccgacccgacgagccgttgcttcgcgggtcacaacacctcgctcgccttcccttccacttccacatggccgctcctctccacgcgcgcctcctcccgctccccttgcccccgaaccctagccccggcctccccccgagcggcgcgcggcgggtgctccggcacccgcgccgctgcctcgcgacgccgccgtcgcggaacgggagctcctcctcgccggagaccgagtggtgcccggtgccgccggagcagcgccccgtgaacgagtacgaggcgctcgcggcgtccctgcccttctcctgggcggcgggggacctccgcgtctactgctcccgcctcgcgctcacgggcgccgccgtcgcgctcttcgtcgggctccccgtcgccgccttcgggggacgcggcggggccggcggcgacgctctgcacctcgcgctcggcgccacggggtccgggatcctcgccgtcacgctcgccgtcgtgcggatgtacctcgggtgggcctacgttggcaaccgcctgctcagcgccacagtggagtatgaggagacgggatggtatgatgggcagatatgggttaaaactccagaagttttagctcgcgatcgacttctaggctcattttctgtcaagcctgtgctaaacagagtgaagttcaccttggtgggtctggcaggctccctgatcctttgcattcttctttacgtgaacaccgaaaacccaaaggaaccatatgttaataccggtggaagggctatccctggagtgtacagtgacactgccgcaaggtcatttgagcctgatgcattctgtggagagcctgatctttcgtagcatcgcaaagcttggacgttggaaggtttttagatggtggcatatggtctcatagggtatacaggttgttcccctctttgtcttgtggctcttgcctttgtatggtggatgcttccatttctgtacgggggttttgatccatcgactcagg

SEQ ID NO: 199 - DNA, 1884 bp, Sorghum bicolor
accagacgccaatccccaccaccaccaccgcctcccaagtcccagcctgcctcctccgtcctctcccccaagcccgtctcgtctctgttcccgtgcactcagactcagcggcggcgagatggacagcgccgacgcggcgacgccggcgccgctcggcgcgtgggcgtggatccggggatacttcacgccggccacgctcttcctcgtcgtcaacctcgtcatcggcaccatcgcgctcacctcccgcgccacccagcagcgccgtcgcagggagcactactaccacgacgacgcccacggccccggccaccacctccaagaggaaccgctgcacccgcagatggagcaaccggggtacggacactactaccacccggagcagacgctgtacgcggcgccgcctccgcccgcgccgctcgcgcgcacgtcctctgttcttgaccggctcaggtcgctcggcctctaccgcttccgctccggcgagttcccgcccgagtacggcgctgctgctgcggcggcggcggcgccgaactacgcgcaggatgtgtccgctccggtgggggaggaagagacgaccgcgacggcgcactacgccaggagccggtccgagccggcgccttctgcgcgggaggatgagaggaggccggcgctgcccagggtgaagaagtcgggcccggaggtgagaaaatcacaagtggcgccggcgccgcccagggtcgtcaaggcggtcgccgaggtcgacgactccgtggaggaagcgggggcggaggaagccgtcggcggtttcaggcgggtcccgtcgccgctccagcaagagtaccactaccaggaagattacgttcctcctccggcgcgggcgcgggcgcgggcgccagcggcaccggccccgctgcagcgcacgtcgtccgtcctggaccggctccgctcgctggggctctacggcttcctcgctcccgaccaacccaccgccgccgcgccagttccagcgaccgatgccttcgccacccacggggacgagaaccggcacgcgcactacgacaggagccggtccgagccggcaccggtgcagggcaagaaggagaagaagcaggaggcgaagtcaagaatggcaaagtcgggctcggagacgaggaagacgcccgctccgaggccggtggaggccggcggcgagtgcgtcaacgcgagggcggaggcattcatcgacagcttcaggcagcaacagcagcaggtggtgcagcactaccaggaggaggagtacgtcccgcctccagcgcccgcgccgctgtcgcgcacgtcgtccgtcctggaccgcctccgctccttcggcctctaccgcttccgctccggcgacctgggccccgacctccccgccgccgccgacacggacgagaaggagaaggagcagacggcgcactacgggcggagccggtcggagccggcgcgggagcagggcaagaagacgaacaagcaggaggcgaggatgagcaagtcgagctcgagcggcgtcgtggaggaggcggcggcggcggagacggagcagtgcgtggacgcgcgcgcggacgacttcatcaacaagttcaggcaacagctgcagctgcagcggctcaactcgctgctcaactacaaggagatgctcaaccgcggcggcggcggcggcaagcagtaggagcctagcgtcgccgcatgatcagtcatctgtgcgtgcacggcagagaagggttgcatgcaggaattggctagctagatagtaggatccaaattccaaaaacctactaaaacatcaatctttggtcaactactagagtgtgggttatacagtgctgttcttttttggactggaactaattagtacatgtaagaattgctagtttttcatcttgttaa

SEQ ID NO: 200 - DNA, 2724 bp, Sorghum bicolor
gcgttcgggattagcctctctgtcatgtcgccagtacagcgcgacgctccgcatccacccaaatcggagtagggctgccttgccgcccccacaccctcaaggcgtcactcagtagccgccgcatccggccgccggtcccgctcccgcgcgaggggaggagaagatcacggcggcggcgtcttctgctggtttgaggatttggggacatcagctgccgccaggctccatcatggacacggcgtttctgcgccctccgctcgctcgtaatctggtttatgacgagtttgccgttctgcaccccacaagctacccttttcacactcttcggtatttgagatgcaacccgatgtattcaagaccgctgctaacaacatcaccagcttcaccatcaaggggcttgactcagagaatggccgcactacctgatgttgatgatttcttctgggagaaggatcctactccgatcctggacacaattgatgcacccatccatttgaaaaatttatctagtaaggagctcaagcagttagccgacgaagttcgttctgaaatagctttcataatgtccagaaaatgccaaccatgtggtcctggtcgctcagttgtggagctgacaattgctatacattatgtgttcaatgccccaatggataagatactatgggatgctggtcaacatgcgtatgcgcacaagattctcacaggaaggcgctctcaatttcatactattaaacagaaaaatggcctttccgggttcacgtcgcgttttgagagcgagtatgatccctttggtgctggacatggatgcaatagtctatctgctggccttgggatggcggttgcaagggatataaatgggagaaaaaatcgaatagtgacagtaataagtaattggacaaccatggctggccaggtgtacgaggcaatgggtcatgctggtttcctcgattccaacatggtagttattctaaatgatagctgccataccttgcttcctaaagccgatggccggccaaagatgtcagtcaatgccttctctagtgctctcagcaagattcaatccagcaaaggatttagaaggtttagggaggctgcaaagggacttgccaaatggtttggcaaaggaatgcatgaatttgctgccaaagttgatgagtatgctcgtggtatgataggtcctcatggagcaactctttttgaagaacttggattatattatatcggtcctattgatgggcgcaacattgatgatctcatctgtgtactaaaggaggttgcaagcctagattcaactggcccagtacttgtacatgtaattactgggactgaaagtgacactgatggaaatattagaagtgaaataactgcaagtgaggaagggccttcaaattcgagcaatgatcttcttaaatttttagaaactggactttctaggacatataatgactgctttgtagaagcactaacagcagaagcagagaatgacaagcgcattgtggtagttcatggcggcatgggaatggatcggtcactccgcttattccagtctaggttcccagacagattttttgacttgggcatcgctgagcaacatgctgttaccttttctgctggtttggcctgtggaggtttaaagcctttctgcataattccatccacatttcttcagcgagcatatgatcagatagttgaagatgtggacatgcaaaagataccagttcgatttgctatcacaaatgctggtctggtgggatctgagggcccaactaactcaggaccatttgatattacattcatgtcatgcttgccaaacatgattgtcatgtcaccatctaatgaggatgaacttattgacatggtggcaacagctgcaatgattgaggacaaacctatttgcttccgctatcctaggggtgccattgttgggactagtggaactttaacatatgggaatccgcttgagattggtaaaggagagattcttgtcgagggaaaagagatagcttttcttggctatggcgaggtggtccagagatgcttgattgctcgatctcttttgtctaactttggcattcaggcgacagttgcaaatgcgagattttgcaagccacttgacatcgatctaatcagaacgctatgtcagcagcacagttttcttatcacagttgaagaaggaacagttggtggctttggatcacatgtctctcagtttatttcacttgatggtctacttgatggccgaataaagtggagacccattgtgctaccagacaggtacattgaacacgcttcactggcggagcaacttgacttggctggcctaactgcccatcacatagctgcaactgcattgaccctcctagggcgtcatcgtgatgcacttctgttgatgaagtaggggaaggaactgccaagaagaacggatagataaaggcaatttctgcaaaagttccatacggagaccacttgtcatgctgttccattcacgattgtgttttctggatagaactgaagtgtgccatgggaggtggccaaatgcacaatcccgaagagggacggcgaagcctatagcattatagtgacggtgtacatactataaacactattttgatgatgattaggtgaccctgaaaagaatttacagagcggtgctgtaacgttactactgtgcatgttaatactgaaattctggtacgatgccaactggtgagatgagctggagct

SEQ ID NO: 201 - DNA, 2046 bp, Sorghum bicolor
cgaaaagtaccccaacggccaatgtctcagcaatgcaattacaaattcccgtattccggccacgaatacggcgatgcgcttgaatacgtcgccgtaggcctcagacacgcacacatccacgcatattccccttgccttcttcccccgtcgcctttccctcccctcccggctccgctgcattccattccatccccgggccagccgaaaccaccccaccccaccaccgcgccctcctcctcctccgccgccgcccgccgccggcgacatgaccggcgcggcggcccacgcggtgagcccccgcggcggcgcctccgcctccgcgtccgcgtcccagccccacgccgcagcagccgcggccgcgggggccggagcggcggggtgcgagccggtgcggaaggcggggcccgtgaccatggagcacgtgctgctcgcgctccacgagacggaggccgagcgggaggcgcggatccgggacatgttcgccttcttcgacaccgagggccgcgggcagctcgactacgcgcagatcgaggccggcctcgccgcgctgcaggtgcccgccgagtgcaagtacgccagggagctgctccgcgcctgcgaccgcgaccgcgacggccgcgtcggctacgacgacttcaggcgctacatggacgacaaggagctcgagctctaccgcatcttccaggccatcgacgtcgagcacaacgggtgcatcctccccgaggagctctgggacgcgctcgtcaaggctggtatagagattaatgatgaggagctggcaagatttgttgagcatgtggataaggacaacaatgggattattacttttgaagaatggagggattttcttctactttaccccaatgaggcgaccattgagaacatttatcatcactgggaaagagtctgccttgttgatataggtgaacatgctgctataccagaaggcataagtaaacatgtcaatgcaagcaaatatctcattgctggagggattgctggtgcagcatctcgtactgcaactgctcctctggatcgccttaaagtgatcatgcaagtacaaacgacgcgtactacagtcatgcatgcaattaaagatatctggactaaaggtggcatgctgggattttttagagggaatggattgaatgttgtaaaagtcgctccagaaagtgcaataagattttatgcctatgaaatgttaaaagaatatattatgaagagcaaaggagaaaataagagtgaaattggtgcttctgaacgtctcgttgctggtggtttagctggtgcagtggctcaaacagcaatttatcctatagatttagtaaagactcgtctacagacgtattcaggtgagggtggtaaagttcctagaattggtcagctctcaagggatattttggtgcatgaaggcccccgagctttttacagaggtcttgttccatctttgcttggtatcgtaccttatgccggaattgatcttgctgtatatgagactttgaaagatgtgtcaaagacatatatactgaaggacagtgatcctggtcctctagtacagctaggttgtgggactgtctctggagctctaggggcaacatgtgtttaccctttacaggtcatcagaacaagactgcaagctcaacaagccaattcagaatctgcctatagaggaatgtctgatgtcttctggagaaccctacagcatgagggtgtttctggattctacaaaggaattctaccaaatctccttaaagtggtgcctgctgcaagtattacctatatagtttatgaggcgatgaagaaaaatctgtctcttgattaaattctggagttgttggggaaaaatcagccatcattattggcatggctgactgtagagataatgacaacacatgaattttactggttgaatagttcctttttgaagtcaaagatggtgccttcaatatagaactggaagcagtggtggcattttcgtcctaattttgattcagcagaaatgaagtgataaacatgagatcatcgaggcccatgcctggcatactg

SEQ ID NO: 202 - DNA, 1493 bp, Sorghum bicolor
cgtaccaccggatttctgtccgcgcctccacccgctccttcaaaaaccatcggcaccgcacggcacggcacgccggcgagcgacaccaccacgccgggacggggacgggacgggaggcgcaggtgcggtcggcgtcaactgtcgcggcacgcccggcaggcaggcaggcaggcagggagggatgaagaagtgcgcgtcggagctggagctggaggcgttcatcagggagagcggcgacgacgacgcccgcgccgccgccgccgggcgtagcaatcacgggtgcggcggaccaggcgagcccggagggagcgccgtggtgttctcgcccggcgtcggtttcgccgaatcgaacaccatggatgacagcagttggtggtatgggagcgtccgcacgccgaacccagtcatgtcgcggacagcgtccatctccgccagcctcgaggcaaccacctcagcgaatcatgctcttgaaagcgagtcagactccgacagcgaatcactctacgaggtagagggagttccatatgagcgaggcaacaaatctgtagaaacaaagcgaataagaaggatggtgtccaacagggagtctgcgcgacggtctaggcggagaaagcaggcacaattgtcagaacttgagtcacaggttgaacgacttaaaggtgaaaatgcaactctgttccagcgactttcagaagccaaccagcagttcagtactgcagtcacagacaacagaatcctcaagtccgatgtagaagcattaagagtcaaggtaaagatggcagaggatatggtagcgagaagtgctatatcctgtggcctaggcgatcttggcctggcaccatatctgaactcaagaaagatgtgccaagctttgaatatgctcacaaccacaggtttggatttacttgggagtgatgcgttcagaggtccaaccacagctccacaagtacaaaactcaccagtacaaagcactgcaagcctagagaatctggataatcgaaagtccaacgaggtgaccagttgcgcggcagacatttggccttgagcttcaagccattgatcaggttcaaagcttgcttcacccaaaaaacaacaacagtagttcatcaactcaaataactggtggcttgagcagagcttctggcacaaattcccttgaaccatatttccatagaagctttataggatgcatcactcttttgatgtaactatgtgtgtagtacgtctccagtgggaaagtaccatttactggcagctgccttggcagatagggtaatgtcaaacaaggcacctgtatagtttcaagtagaaaatgaactgtctttgtacagtacaaagctgcaaatgcaaactttagaagtaaaatcaatcgtcctgaataaatgtgtgaagaaggaatgatacttaggtccctttccaggtcaggtgagacagttatgtttacaacaaagggcgatacattttgtttcaaaaccattattaatacataggaa

SEQ ID NO: 203 - DNA, 3028 bp, Sorghum bicolor
aacagttccacctcccaccgtctggtccctagccgccaagagattccacgccgcatcgtccagcacgagtggagaaactgaaacaagatcccgacaaattcagaacccgatttggtggtcacctccaattccgctggtacttaatcccagggacaacaacaagaatcgctcctctcagttctattggagccttatctgatcagtttgggttgggttgataacttgaggttgcgatttttttggagctgcgggagagaaaggaagagatggggcagagcaaggcggagttcttggaacagttcggtggggactacggttatccggacgcgcccaggggcatcgacgagctgcgggccgctgagttcaagcggctggaagggatggtttacctggaccatgctggtgcgacactctactcagaggcacagatggcggatgttgctagagatcttatgtctaatgtctacgggaatcctcatagtcagaatgattcaagcatggctacaagcgacattgttacttctgtgcggcatcaggtcctaaaatacttcaatgcatctccaagggattacaaatgtatatttacatcaggggcaacagcagctctgaaacttgttggtgaatgttttccatggagtagagacagttgctatatgtacacaatggaaaatcataatagtgtgcttgggataagagaatatgcactgagcaaaggagctactgtatcagcagttgatgttgaagaggttgttgatccatcaaataatcatgagagtgataggttttttaaggtttcaaaacactcaaaccaaagaagaggtgatgatttgcttttgcacaattatcagaatgggagcctgacagctatttcaggaaacaatttaaatctatttgcattcccttcagagtgcaatttctcaggacataagttcaacctcaacttggtcaagctcatcaaggaaggaaaatttatggatttctcatcacaacagcggggccagtggatggttctgatagatgctgcaaaaggatgtacaactgaaccaccaaacttatccctgtatcctgctgactttgttgtctgttcattttacaagatatttggctatccaactggtcttggtgccttaattgtaaaaaatgaggctgctagtttactgaacaagacatacttcagtggaggaacggtagctgcttcaattgctgacatcgactttgttcagaaaagaaaaggcattgagcaagctcttgaggatggaacaatctcattcttgagcatatcttctcttcaatatggctttaagataatcgatatactaactatctcagctattgcacggcatactgcgtctcttgctacttatgtgagaaataaaatgctggaattgaagcataacaatgagaaaaatgtttgcataatctatggacaagcttctaaggcaaattatctaaaaatgggtcctacaatcacattcaatttgaaaagagaagatggcacctggtttggatatcgtgaggtggagaaacttgcctcattgtcaggaattcatttgcgtacgggctgcttctgtaaccctggtgcatgtgctaagtatgttggtttgtcgcactcagatctagtttccaattttgaggctgggcatgtttgttgggatgataatgacataataaatggaaaaccaactggtgctgtgaggatatcatttggctatatgtcaacatatgaagatgcagaggaatttctgaagttcctgcagtcatcttttgtgtccaaacctgtgggattgaaaaatggctacatggtgaatacggatacttttaatttagtagatgattggcgccagcaagctatttcagatattcgcttaaaatccataactatctatcctgtgaaatcttgccaaggatttagtgtgcagagctggccactgacaactggtggtttaaaatatgatagagaatggcttctccaaggatcaggcggtgaagttttgacacaaaagaaggttcctgaattgagctctatctgcacattgattgacttggagcttgggaaactcttcttagagtcgccaaaatgcaaggataaattgcaaatctgtcttctagagaatctgactcttctgagtgcagaagtagatgtttatggtcaaaggtatgaggtgcaaagttatggcgacaaggtaaactcctggttcagtggagctattggacgtccttgtacatttgtgagatgctcaagttccaagtaccgttcctgcacaattaatggcaggagagatcgcctctgtagggatactcgaagcaaacttagttttgtgaacgaaggacagttgcttcttgtttctgaagatagtatatctgatctcaacagtcgattaagttcaagtaatggaaatggtaagcaaggggtgttggttgatgcaatgagatttcgtccaaatattgttgtctatgggtccacaccatacaatgaggataactggaaaaggcttcacataggggatgcctatttcacttccatggggggatgcaaccgttgtcagatgatcaacctgtatcagagctcagggcaggtgatcaagtcaaaggaaccgctggcaactttagcatcatatagacgaaaacagggaaagattttgtttggcgtcctgttgaactatgaagacggcatggaaggagaagatgatgccattgtagagagatggctcaaagtggggcaagaggtgtatccttctacataaagacttctgtacatgtgtacccagaagtttctcctgcataagaggctgacgggcaacagttagttatatacgtgaaaaatatggactttctgatataccatgtatgtaataattttattttcatgcctgtatgtaataacacatacgcgcttgaggcctgtattcagaaacaaacatatagaaaacaaatatacagcaatacaacatacaaggaattgtaaaaatatgtaaagctcaaaatggaaaacaaatatatagacaaatgtaaatctttggctagtctg

SEQ ID NO: 204 - DNA, 2799 bp, Sorghum bicolor
atcctaccacctagtctcctctcctccacgccggccggcatggccttctgttcccagcgccagtcacctacctcgccacccgtctccatcccacgcctcgccgcctcggataactactagctgccgtaccgtgggagcgccgcctctccagtctcaccaacacctcctcctgctgctctctgttttggattcccgtgccggattgacaccgctcccgcattacagcggcgctcttcgtgcgtgcgccggggccccggtgctcaggatgggggcgacccacgacgccgaggtggaccaggaggaggaggcgcggcgcatggcgagcctcctagcggcgcgccgcgcgctgcgtgccgggctggagaagtcgcgcgcgctgacccacgcgctggccccgcggctggaggccatccaggcgcgtctcccggccatggaggcgtcggtgcggccgatccgcgcgccgcgggaggcgctggcgacggccgggaccaacatcgaccgcgcgctgggccccgccgccgccgtgctcaaggtgttcgacgccgtgcacggcctcgagccgccgctcctcgaccgcgccgccgtcgccgacgacctcccgggctacctcgccgtgctggcgcagctcgaggccgcgctccgcctgctcgccgacaactgcggtctcgccacgcagtggctcgcggacgtcgtcgcatacctcggggagcgaaggctcgccgacggccgcttcgtggcgggactcgccgccgcgctcgaccggctcagggacgccgccgcgaccgccgacctcgacgccgggctgcttgccgccgcgctcgacttgctcgaggccgagttcaggcggctcctcaaggaccactccgcgccgcttgccatgaaggaccccgccggcggcggctccgacccgccggccgtcgtgccgtctcggatccctgcctccgtcgtgtacaagctcagccttatccttgaccgcctcgctgccaacggccggattgaccactgctcgtccgcgtacgcggacgcgcgaggggataccgtgagcgccagcctccgcgcgcttggacttgattacctcaaggagacatcgggggacgcgcaggcgctcagccccagcgtcgagcgctggggccggcatctggagtttgcggtgcaccacctccttgaagctgagaggaagctctgcgtcgccgtgtttgaacgccggccagaggccgcgccggtgtgctttgctgagattgcagctcgtgctggcattcttgatttcctgaatttcggccgtgccctggctggtgccaggaaggaccccataaagctattgcggctgcttgatgtgtttgattgtttgaacaagctgaggctggacttcaaccgattgttcggtggaaaggcgtgtgtagagatccaaagcaggactagggagcttgtcaagacggtcgtggatggtgctgttgagatctttgaggaattacctgttcaggtggagctgcagcgcaatttgccgccaccagttgacggtggagtgccacgcatcgtgagctttgccgccaagtactgcaatcagcttcttgatcagccgtatcgatctgtgctgacacaggtgatcaccatccaccgcagctggcgcaaagaagtgttcaacgacaagatgctggttgaggcagtgcttagtatcattaagacgctagagataaactttgatacatggtcaaagtcttatggagatccgacacagtcatctctcctcatgatgaacatacactggcacttcttcaaacacctgaagggtactaagctgggtgagctgttaggcgatccatggctccgggagcatgaacagtacaaggattactactcaacaatgtttctgagggagagctggggaacacttgcacccctgttgagcagggagggcatgatcatgttctccaagggccgtgctactgcaagagatttagtgaaacagaggctcaaatcattcaatgctagctttgatgagatgtttcaaaagcagtctaaatgggtgatatcggatagggatttgcagcagaagacgtgccacctcgtggtgcaggctgtagtgcctgtttacaggagcttcatgcagaactatgggccgcttgttgagcaggacgttagtgcgagcaggtatgtgaagtacagcgccgacgatctggataagaagctcaacacactcttcctggccaagccaggcaggccaatgagagctggaagtttccaaatcaaaaattcagatgacaagattaccagcgcaatgaccggactgtatcggagtgcttctactctgaagtagcttcagtgggagtttggaaagactgaacgcacaatttgtgcaataagccaataacttggtaggcaaggatgattcgggccagtaagtcaagatccccacttatgtgggggtgtaataatggtcccatgattagaagagctggagcatataagaagaactgacattgcgggggagaagatgacaggagtgtttcctcagagggtctccttcctgtcgatcatcttttcaccttctattgcattcttatctgtagcaagtatactcaattcattttagaaacttgtgtgggagcagaggatgtgtaatcagttatctggtacatgttagtaggttgtattataggaggtgataagttgtttcatatggttatggtatactatgttttagatcttatgaacatgcagtgaactatatggtataactggtggcgaatgggaattacagcagttaattatatggaatagtatactgttttttccctttcc

SEQ ID NO: 205 - DNA, 993 bp, Sorghum bicolor
atcctctctccatcactcttccttcctcctcgacgacgacgaagaaacactccaagaaaccaagaacaccacacacacacccaccgacacacggcaggcgagaacgaacagacaaggaaacaataatggcttcgtcgctcgcgtcgacgccggtgttccccagctgcggcgcgcggcgcggcgcccggtgcgtggcgcgcgcgtccgcgtccgcggtggcggtggcggtggcgtctccgtcggcggcgaggacgcactacgaggtgctcggggtcggggccggcgccagcaggtgcgagatcaaggcggcgtaccggcgcctggcgagggaggtgcacccggacgccggcggccgcggcgacgaagggttcatccgcctgcacgacgcgtacgccacgctcgcggaccccgacgagcgcgcgcgctacgaccgcgccgtggccgtcgccgcgccggtccggagcggcagctgggccgcgccgtcagggtccgggtcggggttccggccgcggaggtgggagaccgaccagtgctggtagtagcagcatagcaccatcgccacgtagctgtgcggcgctccacgcctgcacgcgtccctccgctcgagcgcggcggccggtggagtcgccggacgccggagcgcggctcgatggtctggtccccgggcccggggccagctcagctgcgaccgacggggatcgtattgaagatgggccgcatggaaaatggaacggatcgcgatcctggcggcccacatgagctggatcgtggacgttatgggccggaggctccgtgggccttggcgccactggcgatgaggatgccgcggcctgcgggccgagagagcaggggtcgcgtggacgcctctctttcttcgtgtccatcttgccatcatagctgcacgaagagaggcatttttaacatctcttgtgtactactagtacttgctaaaatgctgctagtgattgctatgcttgtaaaatacgtgcaatt

SEQ ID NO: 206 - DNA, 6587 bp, Sorghum bicolor
ggtgggctgccaggttgctggtgaaacagtgtcaaagcccgcttgcacggccgcaaggttgcacgacccatgttgctacattcccaaaggagaagagcttggcattgggctattagactgtaaagcttgcaggttggtctacacatccagggtacattaattatcaaacatctttatgatcccggacctgagttaggcattctcttggaggggaattctgtgggtttaacgtcatcagactggggaagaataatttgatcataatgaaagatatgcaaaataatgaaggtcgtacaccttttgaagacttgacaaacaccatcaattgtggtggccagtcaacatcaaattcaggagaacaaattgatgaacgtgtgcaacgtaaaagggaaagagaaaaagcacgaagtgcatcaatgactcaagaacaaagagatgataaaaataaaaaacttagggaaaagtatcatcaagaaaagtctgaaaaaatgcaatacgtcgtgaacgatatcatcagaaaaaaaacatgtaaaccttggtttatgaattcaatattgtcatttttaagtttatttaaaatatactgaagtatatgttgaccagttgtagttgaatcaaccatgaaaaactatgatggcgatgaagatagtgattggctacatcgagacacctcacccatgcatattgataaagataacacatgtatcgatttgggcttttttccttgtactaattttattttcttatgcttgtatgatgtcgaggacaaggttaatacaattttattatatatatgtagatgattactccaatatatgtatagatcaaagcggcatgattgacattacggatgcatcacctgatctaaacctaggtacaatgtagtttcattaatgttaattgtttgaaaaggaaacgtgacctgcgcaatccaattattgttcattctgtattatatttaggtcctataaatgcatccacttccatcaacaatgttgtcacgtgtccaaaagagcgtaagcgtgaggtagaaagagcacgaagggctgcaatgtctcttgaacaaaaggcgttattaaataagagacgacgtgacttgtatgcacagaaaaatgctgcaagaaaactgcaaatgactccacaagaaaagaaggtgaaacgaaaagagagcaagaaaaaatacaatacgatggtgagggaaaaccgagccaacaatttgcatccggactcaattgctatggagagccctcacttcaaccctcaaattatttttcctgcttcacctcaatcgtctgaagcgcctctagatgatatggaaatacctgaattcggtggcacgcctgtccacattgcaccaactgtagttcaaaatccagaagttcagacccctgaattggttgcggcacagaccatacatagacatcgagtgaccaatggcgagagaaatgcccttctatcccgtcgcaatcgggtttttgaagcaaacattggagcaagggctagaggggcggatgaaaaatgcaacgattcgaacggactgactcaaccgagtgttgtttgcaacgatggtgtcacccaacaaactccaattcaagcacctaataattgtaatggcacacaaacacaaccgtctgtagctgacggtacctcttcaatgcctccatatagtgcacaagatcatacatcagactctatggtcgaggatgactatgacgaagatgtcatatttgaggaggacgaggaagaggatgaggcatactttttcgccggtcaagaagacgaggatgagggaaccgatgtcgacacatatgagcaagagaatcatgagcctgatgtcccagatccatatgaccgggtctatgctaatgtcccatcagagtcgcacatgttaccctcggtgccgaactgcaagcactgtaacgcaaagaaattcgatggcgaaccccccggattctgttgtaggggtggaaagattcatctttcaagtcctgagacaccaccagagctcatgaggttgtggtcaagctcggacgctgatgctaggcactttcgtgcaaacatcagatacttcaacggccacttctctttcacgtctttgtactgccacctagatcgtatcaccactaacatgcgaatctgtggtgtctacacatttcgtgcccatggtcagatttaccataacatacgatcatttggtaaagaggagggtgtcgaaaaaagacacctcgaactttatttttatgatgacgacccatccctcgagcatcgcatgagcaagtgtcgtgagcaatgcgcccaaaaagatagagaagttatacaacagttggtcgggatccttgaagggaatccttactctcagcaactaaggagtatgggtcatgttgaaaacctcgaggattaccgagttgagctgaaccttgaccaacgccttgatcaaagaacatataatgtgccgttgacatcagaggtggccgccgtatgggttgagggtagtgagcgtcatggccaattcgagcatagtgttctcctccaagggaaggatcggtctatacatggcatccgctcatataatgcatgctacgactcactatcatacccgttgttctttccaaagggtgagctcgggtggcacaattgcattccaaaagtgggtgtaactatggctcaaattgatcgagctcgagcaacccgtaaaaggcgtgctgagaatggtgacgacgatggagaacctgtttcaaatacatgtgtctcagtacgcgactactattgctacaagtttcagatgcggccagggatatttaatcctatactctatggccgacgccttttccagcagtttgccgtcgacacctacatcaaaattgagagctcacgtttagactacatgaggaacaatcaggatacattgagggctgacctataccaaggcctcgtggatagcatgcattcgggtgaagggtctgctgagaatgttggacggcgtactgtgttgtcttcgtcattcatcggaggaccccgtgacatgaggcgtcgatacatggatgcaatggctctggttcgaaagtatggtaaacctgatatctttctcacaatgacatgcaaccctaattgggatgagatcaagaatgaactttacccaggccagacaccacaggaccgcccagatctcgtcacacgggtcttcagagcaaagttggatgcaatgagaaaaatgttgatggagaaagacatacttggtaaggtgaaggcctacgtatatgtagtagagttccaaaagaggggattgccgcatgcacacttcttgctaataatggaacgaaagtacaagctcacatgtcccgagcaatatgacatgatcattagtgcagagctaccaaataagaaaaaataccctgagctatacaagatggtcacgaagcatatgatgcatggtccttgtgggacgcttaatccatcctgtccgtgcacggcaggccgtgggtcatgcaagaaccgttacccacgaccattctgtgaggcaacatcacagggaaaggattcataccccatatatcggcgacgcaatgatggtcgcatgctaaaagttcgaggccactacttggacaatcaatgggttgtgccttacaacccttgcttgcttcgtaccttcaactgccatataaacgttgaggcttgtgggagcattaaattagtaaagtatttgttcaagtacatatacaagggacatgatagggcatcagttgtgatgagggagaccgacaaagaggacgggaaaggaaacattgatgagatcaaacagtatagagacgcccgttgggtgacgcctccagaagcactatggaggatatatggctttgacttgagcaagaaccatccaccagtacagcagctgcaacttcatctacccgacatgcacatggtggcatttcataaacgggacaaggtcgaaaagatcgttaataggcctggtgtagaagagtcaatgttgacagcatacttcgatgcaaacaagcatgatgaggaagctcgcaaaatcttatatcgagacttcccagagtattttacttggcagtctgatggtaaattctggcaaaaaagaaaaaactctgttttccaaattggtagagtcatctcggcccatcctgccgagggtgaacgctactttcttcgtgttctcttgaacaatgttgctggtgctacctcatatgaacacctcaggacagttgatggggtgctactaccttcgtttcgtgaagctgcagaaaggaggggtctaatcgaagaggataataccctagatgaatgtctaacggaagctactttgttcgagatgcctaactctctaagaaggctatttgcaacaatattggtattctgcgaaccgcatgatgtgatggggttgtggacaaaacactacgatgcaatgtcagaggactatagtcgcaattatccatcctcagatctcgtgcaacaaatggttttgatagacattagaaacatgttgcagtctatgggaaaggacataaggtcatttcctcttccacatattgatcactcatatgatgatgccagccatatacctcgtgagatatttgaggaagctagcgttgagcagaatcctcaagatgtgctattcaaacaaggcgggctattctttgtggatggacctggtgggacaggaaagacatttttgtatagggcactgctcgcaaaactacgtagccaggataagcttgccgttgccacagctacatctggggtcgcagcggccataatgccaggtgggaggacggcccactcgcctttcaagatacccctaactcttcaagagggcggttgttgtagcttcacgaaacagagtggtactgccaagttgttgcagcaagcagctctcataatttgggacgaggcatcgatgacaaagaggcaaaatttggaagcactagacaacagcctacgtgatatcatgggtcggtcacacctaccctttggtgggaagactgttgtccttggtggggatttcagacaagtcctccctgttgtgcggaaaggatctagggctcaaatagtcggtgcttctctacgaaggtcgtatctttgggaatccatgcgccacctaaagcttgttcgcaacatgagggctcagagtgatccgtggtttgcagattatttgttgcgcattggtggtggaacggaagaggttaacggagatggcaatgttcgtattccagatgagatctgtatcccgtactctggtgatgccgagaaagatcttcatagtctgattgacagcatcttcccaaatctgaatgcaaacatggcggacaaagactacatcaccaccagagcgattttatctacacgcaatgattgggtggacatgatcaatatgaaaatgattgatatgttccaaggtggtgagacggtgtatcacagttttgacaccgcggtagatgatccacataactactatccatcggagtttcttaatagcctgacccccaacgggctgccaccacatgtcttgaagctcaagctcgggtgtcctgtcatattgcttaggaatattgaccccgccaatgggttatgcaatggtacaaggttggtggtacgggggttccgaagaaatacaatcgacgctgaaatcgttgtcgggcagcatgctgggaagcgggtattccttcctcgaataccgttatgtccgtctgatgatgagatgttcccattccagttcaagagaaagcagtttcccatcaggctgagctttgccatgacggtcaacaagtcacagggccaaaccatcccgaatgtgggtgtgtacctgcctgcaccggtcttctctcacggccagttgtacgttgcgatgtccagagccacatcaagaacgaatattaagatcctggccctaccagctgatgcagaggcacaagaggaggaggcaaaaaatttagagaagaaaaatgctaaaaaaaataccacgggaaaaaagcctaagaatgcgttattaaataaaaaagataaggataagaagaccctaacaacggatggaactttcacaaaaaatattgtatataaggaggctatcccctcaagtactccatctctcaccttcgtgtgtcacgtcgcccgcctcttcgcgtcccgcgacgccgacgccacactcgtcctcacgcgtgccaacgccgcaaggctcggtggccccgtcgccggcacggccgccacgggcttccgcgtccgtatcatcacgctcacgttcccacagaggccgctgggcttacaggtggccacgagagcgccgacggccttcccaactgggcctttcgccatcgttgttgaccttctcgcgcctctcttcgctgatctcctgcgtcgccagcctgccaacgccgtcgtgttcgacagcatcctcccgtgggcagccactgccgcctcggagcttggcatccggcggtacgcgttcatcggcacggggagcttcgcgctctcggtgcagcgtgctcagctgctccacaacccacagaatggcgtcgcgtccgacacagagtcgttcctcgcctccctaacgccgtgcggctcaccaggttgag

SEQ ID NO: 207 - DNA, 1281 bp, Glycine max
taactttcccctttgaaatcctttctgagttctgcgccaactgaatcaagcagatcgaactccgccatagtcttcatcgagacagagatcggaatctgattcccaaacggcaacagtatgagcgtcatcgacattctaacccgagtcgattccatttgcaagaagtacgacaaatacgacgtcgaaaagcaccgcgatgccaatgtctccggcgacgatgcctttgccagactatacgcctccgtcgacgccgacatcgtggccttgcttcagaaagcagaaagtgcttctaaggagaaaggtaaggcatctgctgttgcgatcaacgcggagattcgtcgtactaaggctcggttgctggaggaggttcccaagttgcagagattggctgtgaaaaaggtaaaagggctttcgtcacaagagtttgctgcccgtaatgatttggttcttgcattgccagatagaatccaagcaatcccagatggggctcctcctgtgccaaaacaaactggaggctgggcagcttctgcctcccgtcctgaaattaagtttgattcagatgggcgatttgatgatgaatacttccaacaaagtgaacaatcaagtcaatttaggcaggaatatgaaatgcgtagaatgaaacaggcatgtaacttaaagcagttgtcagtggaccaaggattggatgtgattgctgaaggattggatacattgaaaaatatggcacatgatatgaatgaggaactggatagacaagttccacttatggacgagattgacactaaggtggacaaggcatcctctgaccttaagaatacaaatgttagacttaaagacactgtgaaccagcttcgatccagtcgaaacttctgtattgatattgttttgttgattataattttgggaattgctgcctacttatacaacgtactaaagaaatgatatgtacaaaggctgatggatgttcgaatggtttgcctttacttgtattttgagaatatcgtctgattttattttttttatctctaccgttgtgaaaatttcctgcgaattgagaggcgtgcccttgtgctttataagcattcctgtgtatgcagtcatgtcagataccattagtatgttaaatagttgctgtgtattttatacacttgttgttttggtgtatattataatgagtttaatgtcaatgtcgtgacagtctatacatgttgggttgtgattagatgattttgtaaaactttttgcactgggttgtgattagatgattctgtaaaacttttt

SEQ ID NO: 208 - DNA, 928 bp, Solanum lycopersicum
ctcattactaaacctttcaatatttcttttatcttataaacctcattcctctcaaacaacatcccatggctcctgctcttgaacaagcaataaccagcgatgcatcatcggacgttaccatcactggaaagatatacacacgagttcgtctcgctacgaaatctgatctttctcatatataccgattgttttaccaaatccatgaataccataactatactcatttatacaaagctactgagtcctccttagccaacttgctctttaaggaaaaccctcttccacttttctacgggccatctgttcttctacttgaagtctctccaaccccttttgacgaacctaaaaatactacagacgaagggttcaagcctgtccttacaacgtttgaccttaaattcccagtcgtagaaggagaagttgaggaattccgatccaaatatgatgataagagtgatgtttacatcgcaggatatgctttcttttacgcgaattattcatgcttttatgacaagcctggattttatttcgagagtctttacttcagagagagttatagaaagttaggaatggggagtttgttgtttgggacagttgcatctattgctgccaacaatgggtttgtatcggtagagggaatagtagcagtttggaacaaaaagtcatatgatttttacgtaaatatgggagttgaaatatttgatgaatttaggtatggaaagttgcatggtgaaaatcttcaaaagtatgctcataactaggacaaaaacggcgaaagggagctgttagctaatatggttttttgtgtactatattgcgcaatttattaatttctatgtttaatattgtaaaagcagaacgctcattgtatttgtaatttgaaaaataaataaattggtacttatcttatattattttaaatccctgg

SEQ ID NO: 209 - DNA, 1814 bp, Solanum lycopersicum
atgtcatgttatatacattaataaaaatcaaatctttagataccctttggtttaaatctataaaaaaagtcataaagttgttgtctttatataacagaaattagttattcctaattttttattttgatgtgttgtttcttgaagtgttgagattgagggaggagggaaaaaaaacaagaaaaagagagatggggtttgagggtatgaaaaagttgaagcctttattgcatttgttgttaccattatgtgttcattggattgctgaagagatgactgtttctgtgcttgttgatgttactactggtgctctttgtccaggcaaaaccacttgttctgaagctatttacatcaatggtgttcaacaaacagtcgttggaatattcaagatgatagtccttcctatcctaggtcagcttgcagatgagtatgggcgtaaaccgcttcttattctcactgtatctacaacaattattcctttcggtttactcaccatcaataagtcaagggaaatggtctatgcttattatgtcttgcggacgatttcctatatcataagtcaagggagcattttctgtatctctgttgcttatgcggcagatgtagttgacgtgagtagtagagctgcagtttttagttggattactggccttttttctgcatcccatgttctcgggaatgtcctcgcacgttttcttcccgtgggctacattttccaggtttcaataggtctcttgatctttgttcctgtttatatgacactgtttctagaagagactgtatcaccaaaaacagaggtgacccgaagttcgacactaaagagcaatacacttaagattgtccaggaacgatataactcaatgagatatgctgcaaatctggtcactagcagcccaacactgaagtgcatttctcttgtatcattcttctacgagttgggaatgtccggcatcagcggtgttttgctgtactatttgaaatcggcttttggcttcaacaaaaatcagttctcagaaattttgatgatggtgggagtaggttccatagtctcacagattgtggtgcttcctcttatcaatcctctttttggggagaaagtgatactttgtctggccttgctttcatcaatagcctatgcaatgctctatggattagcatgggcaccttgggtgccatatttaagtgcttcttttggggtcatctacatcctcgttaaaccttctacttatgctgtaatatctaaagcagcactttcagcagatcagggcaaagcacagggctttgttgctggtattcaatcagtcgcgagtttgttatctccaattgtaatgagtccattgacctcatggtttttatcccgcgatgcacctttcaactgcaaaggattcagtatactctgtgcttctttatgcatggtcgtttcactgtgttatgctagcacgctaaaagttgaggcaccacgagagagaaccttcgatgaaattgcagagaacatagaagcaccacttttgacatgatacttttgagacgttggtgaccattttaccaaaattctctatgctataggcacccgaggatgtccctttatacagcgataataagtccggtctacgatctacgtacgatagagttgtaaatcttatgaagctaagtctgatcttagattagaaagaagtgtattattcatcttgtattaaaatttgtagctcttcaatgtatcacttcatttttttagtctaaatgataaatgttggtttgtactttgtatttttgtatatatgatattggggttatgcacattatattagtgaattcaa

SEQ ID NO: 210 - DNA, 877 bp, Solanum lycopersicum
tcaaaccccgtgtacaataagtgtactcatcttcatttctcaactatataagttacttttaaaaaaaaacccatccaaagaccaaacattttctctgttttttcaacaatgcagaggtcaacaaaacttagtggtgaagaagagttttcaatcatggttgctgctttaaccaatgtgattactggtgctgcaactatttcatcatttccttgtacgagtggtatgtcgccgcccttgtttcgcgtaccggaagaaacagagcgttgtcagtactgcaaaataaatggttgtttaggctgcaactattttgcaacctcatcagctgcagctggtgttgttaacaacaacaaggcattaaagattgttgggaagacgaaaaagaagaagaagaattacaggggagtgagacagagaccatggggaaaatgggcagcggaaattagagatccaagaagggcagctagagtatggcttggaacatttactacagctgaggacgcagctagagcttatgacagagcagctattgaatttagaggtccaagagctaagcttaatttctcatttacagattacacttcaattcaacaacacaatactactacacccatgcaagtgctgcaacaacaacaaccagctccctcgcagttacaacaaggaataaacacagaagaagaagagttctgggatcaattgatgaattcggacaatgaaattcaacattatctttatagagaatcatctgattctgctaatggctatattgctcatagcttctaggaagcattttgcatgcacgttcagtatcaaattaaatttgttttttcaattaagattgtgacataaatagttaggcaacatactggagttttgacaa

SEQ ID NO: 211 - DNA, 1361 bp, Triticum aestivum
ccacgcgtccgcgtagtagtagtagcaggttgcattgttcactagcagttgactagcgtgcactattaatacatgtacgtacctccccttcatcgtcccgtctcaaaactctctccctccctccatctctccctctctctggctaaggtagcagtgtagcgatccgaccgagaagatgagctctattggcatgatggaggcgaggatgccgccggggttccggttccacccacgggacgaggagctggtcctcgactacctcctccacaagctcaccggccggcgcgcatacggtggcgtcgacatcgtggacgtcgacctcaacaagtgcgagccatgggaccttccagaggcggcgtgcgtgggcggcagggagtggtacttcttcagcctgcgcgaccgcaagtacgccaccggccagcgcaccaaccgcgccacgcgctccggctactggaaggccaccggcaaggaccgcgccatcctcgcgcacggcgaggcgttggtggggatgcgcaagacgctcgtcttctaccaggggagggcccccaaggggacgagaacggagtgggtcatgcacgagttccgcctcgaggaggagcgacaccgccaccaccaccagcagaagggcggcgccgccgccgccgaggcgaggtgccagctcaaggaagactgggtgctatgcagggtgttctacaagagcagaacaagcagcccaaggccaccatctgaagaagtctgcacattttttagcgagctggaccttccgactatgccaccgctcgcgcccctcatcgacgcgtgcatcgccttcgacagcggcaccgcgatgaacaccatcgagcaagtgtcctgcttctccggcctgccagcactacccctcaggggatcgatgagcttcggggacctgctgggctgggacaaccctgagaagaaggccatcaggacatctctgagcaacatgtcaagtaacagcaattccaagttggagttgaccccaaactggagccaggagaacggcttgtcacagatgtggacacccctctgaatcttgatatgagactattgtgctgctagttgaagtgtggtggtggctagtaagtaattagatgacatattctttctaatgatattggagtagcattggactattggttgatgcagtgtctgttcctagggatttgatggaagtgtgtgttgatttacaaaccagtagattagtggaatggcttgatatagcatctgtacataggaatgctaagaaatgtcctattttaattttactatttctttctactctccaaatgtaatgtaacctccagctgaaagtaaatactatgtggataacccctatttgtcattct

SEQ ID NO: 212 - DNA, 2118 bp, Triticum aestivum
aagccagttacgctagctagcgctcgacaccgcggcactgctcggctcggtccccttctccctcgcgggagcacgcggagaggcgaccgaggatcgaccgaccgccggccggcgagcgatgtcgagccacgaggcgtgctgcgggaccatgttctgggtgtacctgctgtcctgcgcggggctggtgatgttcgcggggctcatgtcggggctcaccctgggcctcatgtcgctcagcctcgtggacctggaggtgctggccaaggccggcaccccgcaggaccggcgcaacgccgccaggatcctgcccgtcgtcaagaaccagcacctcctcctctgcacgctcctcatcggcaactccctcgccatggaggcgctccccatcttcctcgactccctcgtgccctccttcggggccatcctcatctccgtcaccctcatcctcgccttcggcgagatcatgccgcaggccatctgcacgcgctacaggctgagcatgggggccaaggcggcgcccatcgtccgggtgctcctcgtcgtcttcttcccggtcgcctaccccatcagcaagcttttggattggttactgggaaagggtcatgttgcacttatgaggagagctgagctgaaaacattagttgatatgcacggcgatgcggccgggaaaggtggagagctgacccatgatgaaactactatcattgcaggagcattagagatgactcaaaagagtacaaaagatgccatgactcccatatctgaaaccttctcacttgacataaatgccaagctggatgtgcatacggtgggtatgataatgaccaaagggcacagccgtattcctatatactctggaagaccaagcaatatcatcggtcttatattggtaaaaaacttgcttacttgccgacctgaggatgaggtgcccactagacatgttactatcagaaaaattccaagggtggctgatgatcttcctctctatgacattctaaatgagtttcagaaaggtcacagccacatggctgtggttgttaaacgcactaaagaagacggagcatctgccgaaaagaataacagttttacaccagattacaaaatgaccaacgggcatgctcatgctgatggtctgggtctgtcaccctcgcatgtcaacatttccggaagtcgtcgaaataacaatgacaagtacagtaagaaaattgaaagaaaacgggacaacattcttgatttcaacaccgatccacttcctcactattcaatggatgaggaagcggtgggaataattacgatggaagatgtcatggagcaactgctgcaggaagatatcttggatgaaacagatgagtatgttgatgtgcataacaagatcaaaataaacatgttaccgccaggcaaatcattgtcgcctcttatatctcctagtggtggacctctgtctcaaggactaagaaagacccctatggcttctccgctgtcgccataccataatggcggctccatcttacgttcccctgctgcaaaccatgctcgatcccctgggactttaccgacagccttttctcctgggaggtcaccggcatctcaaacccccgtgcgcagttcgccgacttcaagttgggtctcgaggaattcgtaccgaaatccgtagaaatggtggtgagagctaatgccaaagagctccaggggcaacaatcccagttgagatcactcccaagatcaaatgaaggcattgaagagtgtaggggtcaaagaatgaagaccccacagctctctgctttgttgctggtccttgtttatttatgactttcttgtacatatatatgtgtcccttagcatctgaacctgagtatggatgagctctcaccacctactgtagacgccctttttgccaaacttgtagcaaccattgcagaagaaaactgcggagagaaacgacgtaaacgaaacgcgttctgtatgtatcgcgcatctgcgcatctgtgctggtattcttgtttgtcagccgccattgtactcactgaaactcaagtaaagtagctgttggtgctagtactgctgatggctgcccccatttatgtaagaactgtacaagcttatgtttctaatgagtttcat

SEQ ID NO: 213 - DNA, 2114 bp, Brachypodium distachyon
agtttacagacagaaggaaaagggggaacctgaagcaaacgacagcttgtgagttccctctttaccttgctgtctccgacaaaatcccaacctctctcggcgatggcggagagccccatgtcgccggcgtcgcgggtggacttctacggcttcctcgaccgcatgcgccgccccgccgccgccgacctcttccgctccatcaagagcttcctcgcatccctctccctcgacgagcccagcgccgaggaggacggcgccagggtccaggccttcttcacggcgatggagacgaccatccgggagcaccccctttgggccaacgccactcatcaggaaatcgaccacgccctcgagggcctggagaagtacatcatgaccaagctgttcgaccgcaccttcgtgtcgtcggcggaggacgcggcggccgacgccgaggtctcggagaagatcggcctcctgcagcagtttctcaggccttgtcatctggacatacccaagattctgcacaacgaagcgtcctggctgcttgcagttaaagagttgcagaagattaattccttcagatcaccacgagataagcttctatgtattatgagctgttgccaagtcatcaataacttgttgctgaatgtgtcaatgtcaaatgaccgatcaccatctggggctgatgagttccttcctattctcatttatattactatcaaggctaatcctcctcagctgcactcaaatctaaagtttgttcaactctttagaagagaagcgaaacttgtttctgaagtcgaatattatctcacaaacctcatttcagcaaagatgtttatagttaatgttaatgggcactcgctatccatggaagaaagtgagtttcagaagcatatggaatctgcaaaactaggtactcaaatatcggctgctagccctagtaccccgcaagggttggctacatctacgaggggaccacagaagcaaactgatatggaaggttccgtattcccttacatggagtcagagactgaaagcttgactgcagcagagctcaagcagttgcatgggctctacaggcaagtagtcaccagatacacactgctgtctaaagctttaagaaagttatccgtagacgaggagcgacttcttgcatcagtagatgatccctgaactgatatgaagatgctggccagagatggcattggtttcatcacaaaacatcctccatatccttgtactgatgcacgtgtgatggagtaaacacacatgcggaattttccatcaagagtacaaaccaggttcaaagctcatgctaccacactcgatgcatctgcaaaaagggccccaggaggcactgcagtatctctgcagtttgcatgccgtcattcctcggaacagaagcactgggtgtgttgcggatggcatatattgccgttgccgctgatcctgttcgactgctctgtcgtaccacaagttctctgtgatgaaagttatatccgctgcctcggtgcacctgactggggcatcacaaattcacaagcgacgcctatacctctggtctgctcttgcttctgttgccaatccctgataagctatctgtcaaagttccctgcatcagcgtggcgcagaactgctgcaaattggtgatggggtagtggagtgacccattctatttctacctgagtaatcaactttcaagtggtagcaaggtcatacaacttgctacagggtgtcacatggcattggagtattctcttgtggaattcctggacatacttctgcagtgtcgctatcaaatgtatatttcttttgcgggtagctagtaaatgtattttgtcgaagaatacaaatgtctcaagctcttcctactactaacttttatgtaaaacataagttctgattcacaatatgttgtagtcatgtaagaactcgaggtctgagctttcactactgtacatcatgtcatcattctgagctttctctaactgcaaaacagaagttctgattcacaatatgttgtagtcatgtaagagctcgaggtctctaactgtacatcatcctaagccttctcaaactgtacatcattctcagccttctctaactgtacattattttggtggacattt

SEQ ID NO: 214 - DNA, 2678 bp, Sorghum bicolor
caaccactctgcagtccgctgcgctcgtactcatccgcccatcaatcagctggcgacaaggaatcccaccccactaacgagagcagcgaggaaggcgtgcgctttctctagtctgtgcaggcgccggagcccgccgccgccgcggccatgtcctccgcctcgggcctcggcgggaaggagggtccttcctctgccttctccgtggacctcgcggccgccgcgcgccggctgctggccttcctccgcgcggcgccggccggggtgggcccgcggtccgtgtggaggtacgaggagctgtggatgccgctcgcggcgcgggaggcgggcggaggaggagaggcggcgatgctggtgccgccgcccgacgtgcacctcgtctggctctgccactgcttccaccatgagaactactccgcatactgcacgtcgaggtttggacgcctcatcaaccgtccatcaatccttgatgtggagaatgaggagtatgccgaggaccgttgtcgagatgtctgggctactcatttcccatccgagccatttgatcttgacactaatgagattgatggaaacagtgttgataacataacctgtgacaatgtcgatggtgaaattgtcaaaatggtgagacggtacgctgacctagcagaccgctttgcgtcaccctttgtgtgggaaggtgtctaccatgttgctgctaggcggcgatatgtgcgtttcctggaccttatcaagaaggttgtgtgcggaacccaagtattcacacggcttgtgcctagcctagacatgttactgatgtggcttgctcaccagagttttcctgtgtgttatgccacggatatgctagcgatgggcattagggacaatgttgcaaaagtgggggttggttatggagaagtggtgagtgatgaggaggtagggaggacaaggggactgtgggaggatgcatatgatgaaccatatcatatggctggatcagaggttgatgcgggagcagttagcgcagcaagggaggcattttactgggtgccggcagcatcagaggaggatgccaaccggctatacaagagtttgcagccaagatttattatggaggtatatgtgttattgaagggagaatttgataaggagcccaccagcaaggatttcctacgattgagaacacagaggtgtcacagatcactaaaactcgacaaatcaatgtccactttatcctgcaaaagctggcagaaagtatggcacttgtattgtgaattcgcaacccggggcctcctcattgagttcaggcgtaatctaaatgggtgcttcaggaaaagcaagttcctcaagaacatctcattctcatggagcgatgtgttgcatgagaaagcacttgctctcacagaggaacttgatgtcaggatgagggcgatggcttcaattacccctccagttcaagcaccatacttattgaagtgtgtgcctgatcgagtcactgatgatggtggagccatgatttctgatgtcatattgcgcatgagaaattaccgtccacaagaaggacgttggctgacacgaactgtgcttgatcacagtgggagagaatgttttgtcatccggatgagagtaggtagagggatttggcggagaggtgctgaaactcccatggcagtgaaatgggaggataggagcattgaggttcgagaaggatcatggtcatacattgctagtacaagctccattggttatgctcctgaaaagatagtgggcacagcaacagcgatgaaagatcaacaggagaataaggtagtttggagcttgtcaacaggaggtacactcacagtatgtttgggagatgaactcagctttcagttaaaaaataacagctcggacgaggaggcaaggctgcttgtcgggaggagattgagctacagagtaaacacagacaatgcatccagcaaccttgttgaggaggagcaatacctcacacttgttcgtaagtcaccggatcatggtgacagagcaaccatgcttctaaactggaaattacttgctgtggagttcttacatgaagaggacgcagtttttgttcttctcctatgcatggtgattgcacggaccatgacagagatcaggagagaagatgtggctgggcttttagtgcgacggagaataagtgaagcaagggcagggcagagagactggggctcggtaatgcttcctggttcgctttcgccagatcctcatttgcagccttggtaccggaacgcagctcaggttttgagctctgtggagacaggaccaatgcttgcgaagtactcacctgctgatggaaaggacatgttgtacaggcaagctcttataccctgaagtcctgatagagattattaccatcaggacttgcctgatagataaaaacacacacccaatcttcctgggtattgcagggaaattatttcatttcctcaatgctatgacataggatctttgtacaggacaaattttgtgtttgagctgttgtttcactaatggtgatgggtctttgatacgaatccagtgattgttgtcatatatggtttgaactgagaatttcacatttcattttaaaatggtttggtttctgtagtttgacaatgaactaaaagaagagcttctccatttgaacaaactgattatagaggacaaaggattcaaagtttgat

SEQ ID NO: 215 - DNA, 3368 bp, Sorghum bicolor
ctcacaccatcacgctctcatctcctccacaggcacagcggagcgccaccccggcggcgtgccttttacaaatccgaggggcgcaaggaattccgccgcgtcctcccaccccacagaacaaaaaacaaaagcgacaacacagctcgcccccccgcgggaggagtgacccggcgacagctcactcgcgtgcgtgcgccacccatccatcccccgaccctcagatcccatctcgcgcgcggcggccattccctcccatggccaccgccgccaccgcctcccacccggcctccgcctccacctccggccgcgacgccctcgccgcatcatcctcctcccacgccgccgtctgcctcgtcccgttcaggtggtgggcgcgggtgcgggaggaggaggcggcgggcggggtgcagtacgcggctaccgccgccgcgtccccgtcctactacggcctcaggctgctccacagcttcctgcacccggatctcgtcctgcgcctcgagcgcggggacttccgcgccggtgacggaggcggaggcggccgcagctacgcgctcgtcccggccgacgagctctccagggcgcttgctaggcaaaactctggtttgggtttacaaaataagcattcgtttgctggagatagtgctggtgcttatcctttagtgcttaggatctctgtccgagaaacaagtatattgacactgaagatcagcaaaaaggacaatccagttgagaactacaaacgggctaacaagatttttaatgttgattctcaaccagttcatgtttgggatttttcagggcagacaaacctaatattaatgaatgaatggaatagactacatgactgctgccatgcagatcaagagaatcttctggaagtgcaagtctatgcaatgtctgactccttaacatccaaaattggtggtgatatgaattctgatttgtcctacagaagctttggaagagctggttctatggggttaataggattggagaatcttggaaatacttgctttatgaacagttcaattcaatgtttggctcacacaccaaagcttgttgattacttccttggtgattatgccaataatataaaccggactaatccattgggactgaatggtgaacttgctttggcgtttggagaactgttgaggagcttatggactgacagaaaacccattccacctcatcatttcaaggaaaaaattgcgtgttttgctcctcagttcagtggctttaatcagcatgattcacaggagcttcttgcttttttattggatggtcttcatgaagatcttaaccaggttaaatgtaaaccgtatgaagaagcaaaagatgcaagtggccgtcctgacgaagaagtagcagatgagtattggagcaaccatctagctcgaaatgattctgttatagttgatacatgccatggacaatataaatctacattaacttgtcctacttgcagtaaaacatctgtcacatttgacccatttatgtacttatctttgcctgtaccttccacggcaaagagggtaatgaccgtaacagttttcagcactgatggtagcagagagccatgctcatatgatgtcagtgtgccaaaatttgggactctgagtgatcttgttcaggctttaagcattgcttgcttacttggagatgatgagatcctgctggttacggaggtctacaataactgcatcattcgatacttggaggagccttcagattcagtttcattgctgagggatggagataaactggcagcataccgtctacccaaaagacatgagaaatccccctttgtggtttttacacatcaatattttgatgagcattctagtgatgataatttaactcgacaaatgagggagtttgaggccccacttttggcagcacttccagagacaattaatggattatcccttcaggatatctacctaaagttgttgagtccatttcgactttccaacagggctggttcacttaatgtttgtatggagtctaatagtgactccatcgatctgacggatgcaacgtcttctgattcaggcagtaatagttttcagaacagccaatcggaagacggccctgaaagcagccactgtagtgctagtgaatgtgaaataatgaaaagacctgatgatttatgtgatgggggttctgattctaacaaggaggcacagatggaggagtttgaattttatttaaaaaatgaaaggggtgatggccagcttcagaagatagaaatcaatgagctcgatttacttgagacagcaccaagccggttgcatgtgaatgtccactggctacgaaacgcttcaaaaaaatatgctacctcaatgctgagcaatctacctgagattcacaagcttgagcttatcccgaaaggaactgaagattctgttgcactacatggttgtctggaagcctttctaaaagaggaaccattgggaccagaggacatgtggtattgcccctgctgcaagaagcatcaacaagcaatgaagaaacttgatctctggaggctgcccgaagttctggtgatccacctcaaaaggttctcctacactcagttcacaagaaacaagctggagacattcgttgacttccccaccaccgatttggatctgtcatcctacatcgctgacaagagcaagcagccaagcagccattatcgcctgtatgctattagcaaccactacggaaacatgggagggggccattataccgccagcatctatcacgaggaagggaaggggtggtataagttcgatgatgactacgtgactcctatgagcgaagacagtataaagacctcggctgcttacgtgctgttctacagacgagagtgactgaggatacaatacaatggcattttctgcttgcggtggtttttggttggcaactccagtctaatctccagaacagacctcccccctccctacacactgctgcttcagacgtgtccgagtttcctaacatctcggcatttgaatctctcaagccacactgacacctaccaatgatacaacagcattctgtacagattcatctgccaacaggagagaagagatcccaaagaaagatgtagctgatgcaatgcaatattctttttccccccagcccacacagtatccttatatgggcaacattcttttttcccccccttagctcacagtaattcttatatgggcagtacatggaccagacccccaacattgtaattcctcccaactccattcaccagtcagtgaaaggctttatataatgggtagtagtacatttcttttgtcgccgcgcaccgaatcggaggcggcgatgtaacagttgtgtaaattaactgccaagtgtgagccgtgacc

SEQ ID NO: 216 - DNA, 2612 bp, Zea mays
gcagcagcacagagtggagccagctcgcttcgcctcctcggtcgcctccacttctatatcacttccccgtctggccccttccccgtgcgccaccgcgcacaatcacacgcgcgcgcccacacgtgcggcttcccggattcgcgccgccgcgccagagccagccaggccagcttcggatcgaggaagaggaggtggcgaaggtgaggagtcaacccagcttccgagccatggacggatcggccgcggagctggaggcggcggagcgggtggtgatgcggtgggactcatcctcggcgggcgccggcgcggacgagccgatgctgttcgacggcggcggggaccgggccgaggcggacaggttcctccgcgccgtcgacgatctgcgtcggctcgcgccgccgtcgcccgcggcagtcggcagcccgcgccgcctctcgtcgtcctcggtggcggcgagcggcgccgtgcaggtcgctatggcgcggctcgaggacgagttccgccacgtgctgtcgacgcgcgccctcgacctcgagatcgaggcgctcgccgacctcagctcgctctccatcaacagtgaccgcaccaactcggcctcctccgccgacctccccgccgctgacgaggacgactccgtgtcctcctccatcggccgccgcagcaccgcctaccgctcgctccggagcatccgcgagatcgacctgctacccgacgacgccgtcgcggacctccgcgccatcgcgtcccgcatggccgccgccgggtacggccgcgagtgcgcgcaggtgtacgcctccgtccgcaagcccgccgtcgacgcctccctgcgccggctcggtgtcgagcgcctcagcatcggcgacgtccagcgcctcgagtgggacgcgctcgaggccaagatccgccgatggatccgcgccgcccgcgccgccgtccgcggcgtctttgccagcgagcgccgcctctgcttccacatcttccacgaccttcctatctccaccaccaccatctccgccgcctcagcgtccgccacgcacgacatccctttcgccgaagccgtcaagggcgccgcgctgcagctcttcggcttcaccgaggccatcagcatcggtcgccgctcccctgagaagctcttcaagatcatagacctccacgacgcgctctcggacctcctccccgacgtctccgacatcttcgccgcctccaaggtcgcggagtccatatacgtgcaggccgttgagatccggtctcgcctcgccgatgccgtgagagggatactctcggagttcgagaacgccgtgctccgcgacccgcccaagaccgcggtgcctggcggtaccatccacccgctcactcggtatgtgatgaactatagcagcctcatttgcgactacaaggtcacgctctccgagctgatcatatcacgtccatcagctagcgctcgtctttctgctgagggcaatgagctcgcgccgtccttggccgacctcgagctccctgagcttgagaaccagttaccgcttgcctctcacattgtctggatcattgttgttcttgaacacaacctggagggcaaggcggcactctacaaggatccagctctctcgcatctgttcatgatgaacaatgttcactacattgtccacaaggttaaagattcgccagatctctggagcatgatcggtgataattacttgaaacggcttactaccaagttcacaatggcggccacaaactaccagcgcacctcatggttgaagatcttgaattgtttgcgtgatgaggggctccatgtaagtggtggcttttcgtcggggatatccaagtcggcactgcgggagcggttcaagtccttcaatgctgcatttgaggatgcgcatagggtgcagtcagggtggtgtgtgccagacaaccagctgagggaggagctcaggatctcaattgctgagaagctgctgccagcataccggtcattccttggcagatttcgacatcatatagagaacgggaagcatccagagctctacattaagttctccgttgaggaccttgagatagctgtgagcgatttctttgaaggtgttcctccttccccacataacaggaggaaatcacatggatgagggacttttacctcaggtattcaactggctgatgttgctatttattcttttattcttcacaaagaagctggttctggtatttgggctcgatttcttctgtcctgatagatgtgagtataaatttggtggtcttcaatcagagatggcaaatatgaatacattttgggatctttctgaagctgtcaatcggcccagtgatccctactctgtaagagaaggtgttcatttggtacactataattatataaattttgcaagtagcatgtccatatagaaaattctttcagcaacgttggatagttggaacccatggcatttttgcccctgttttgcaccagcttctgttacccttttcattgttaacaattatcaaatgggtctacgctttgtggattagatgtaaaaagatttctacgactctcatgtaccacatatttttgtaatatgataatatcacgctgttgcaaattcaaaagaaaacttcaagtc

SEQ ID NO: 217 - DNA, 4026 bp, Sorghum bicolor
accgcagatgtggaatgtggtatgccgtctcccacggtgctcccaccaaatccgcatgcgtatcacgcgaaaaaaagagtctctgtccacagattcctccataggtcggcaagcgcggggcgcggcaccgactccgactccatcggggaaccgtcctccaccaaaccgacctgacctgtgccgcctataaatccaacccaccccggcggccttcttcctttcgttgatagatagatgaaccgcgtggtcgggatccctcttccttccttccttccctgttctctcgtcggtgcgccatgggggtggatgggtaagtggtaggtaaggcgcagttgttgttggtttcgatctgacgcgtctctctgtttctcgaattcataaggtgtgacggactgaactagccggatggatggatccatttcttttaggttggatggttgttagctattttctctgtacccgtcgtcgggtgtcctactaattaccatttgctgattgacttatatatctaggttattatgctgttgtttacgatgactagggctgtgcagttattttgattcgattgccgttcattctggtgggaggataaggcgtctcggttggtgatctgttgatagcactttgtgttgagtcagatctatttgattggttagcctggatgtttttggcatgatcggatcaagatgaattgaagggtgtgtggtttttggttcgtccatgctgtgatctgttcagttgctgtgatctgtttcagttgaaggttgttgattggctgcttgtatctcttcttccttaggatgctgattttgtggcaaaaaccagtgcctgttggttgttataggaaactatactggactgctcagaattctgcactgtttggtcctgatcgtgtatccctcgtgatgttgtcagtctagtcacaagatttcttaggtcaactcagaactttttatggagatacgatttagcatgtcatatttggagcaagttatataatcagatgagtactatcagattatttgaaagccttgcaactaaaaatcacatcctgaagttcttgtggttttagtagatataagttgcttcaatgggagccagaacagttcatttagagctgatatgaatgatcacggagatgattatacaattgtactcttcagtaccactttttgataaattcaatttggtggtttcttttaaggagacagggagagtttgatttcatataaggcttacatcctcaagttcatgtgcttttaaataagttggctttctttgggagtgaaaacagttcatttagagctaatatagacatagtcatggagatggttctacaattctcttcaatatcaaaatgatcaattcaaatttggcggttccttttaagattacatggatggattcagagtttgatttgcttctctaaggtttaatttaatgctaggttgtgaacaggattatagaagtgtgcctgttcgaagcttcatttgagtaagatatatggaggaatacttaagttgtggctgctttgctaatttactgttggtattagtttctctggtggtatcatgaggccttctgtataattcctacttccatgggtcttctatttctcaggcacaattagtagtggacatgacttttaggcttctgttactggattatgtgctcattcagagtgttgtagagatcttcaattttgttggttcagtagaactgtaatatatgtacatgtatgatggtgaaatatatttttgcctagagctgtaattattatatgatatggatatatggatattggtatagaacttggcacaatcctgcttatattacaaattgcttgtgacatgacttttttattatggatctgctaaactataacaataacttcattctattgtttcttctcattctaatctcttgcagatcgtattcttgaatcccatgcaaatactacatttattttggtgctgcacaaaactttaatgcaaatactgcaaaattttaatctcctgcagatcgttgcagtttgtttggtatcaaaaaggttttcttggagtaggtaaatcagagtagtctgtaacaaattaaatttctccttaatgcaatggtacatagttaggtcaaatatctcctccttaatgcaatggtacatagttaggtcaaatacttcccattccttatctctcataactgcatgcacaatattttactaaacatgttgtgttggttcagtttcccatgtgtgagacagttgcccatgaaactctcagcctgccatgtcttagttctatcttcctattcattgaactgaattataacataaaccccctctttttttctgtatctactttctctttcatttgagtgcatctttttatagatcgttatcgtttgtttgctatcaaaaaggttttcttggagtaggtaaatcagtgtcttagtctgttaaatttctcctcctcaatgcagcggtacctagttaggtcaaatacttcccatgccttatctcttacaattgcatgcacaatattttactaaacatgttggttcagtttcctagttcaagtgtgagatagttcttagcctgccatgtcttaattatatcttctttctgtaactgaccctcttttttctgtatctactttctctgttttatttgagtgcatccttagcttagtatcatgtggttttgttctcattcaggttagacttcctcttcttccctattaagtactgatgggaccagtatttgtccttttttttgcattgagtcttgactgtagtagtgaagtgtgctataaggttttctgtcagttttgatgcctgttcatgtttacagatctggaagtctggttttctggctaggtcttgaggttgttggtttgctcctattgacttgcttaggattctaacatgtagcatagctgatgcctgacaaattctgttgtgtttttgcttccgtcatgttccttattggggacgagtcagtgccagaaggtagatggttgcttaggtgtggagttcaatcgttttttgttgccaatttgttgttatttctgcatgagctttgatctggatcttctaaatttgtgaactaatttgggttcaaactttggctttacggacccctgtggtccgagcgttcagcttatgttattcatctcctgctgtgttcattataatgtcaaatgagtctttaacttatgtatggtcttgtaacttatgtttctgattgtaagcattcaagacctgtagttaacatggatgtctgtatagaagcattattacaacttgcataaatggaaatgtaaaatcagtcaggtaaaacattagattcatatagcttagcatctctggttctggatcaaagtagaaatgtcaagttattctacactcctatgctttttaagcctaatttgatatcttgtgatctttgcagtgttctttattaagttcaactacaataattgaaatgggttgacaaggctttgattagcgcgtctgaaaaaagcaaggtctcagtgtaggaaatctgattggtttagatttagattttgtatgcatgcagtggattgaagcaactcaatatttgatgagtagtagtgctatatgacaaataatttagtgttaacttggaaagtggtgttagacctttcaatttggtccctattgattgatcgtttgttgtcacaatgatttcttaggtcaaatccagatttattgcagagctatgatgtagtgttagtttatttttagtgttgattaaagagcatgctatttttgagcaagttatacttctagtgttttagataagttgatttatttgggatatttagacttgctcatggagatgattctacaattctgttcttcagtgttatcttcttcatcaatccaatttggttgtgcctaacatgggcacatagtttgatttgatttacattaagagatttgatttacagtaagggtcacatccagaagttttggtgggtttagataagtttcttactttgggagcca

SEQ ID NO: 218 - DNA, 3177 bp, Sorghum bicolor
cgccgccgcccagggtgggcaaggccgcacccgcgcccccagcgccccgatgcccgtgcccctcctggattcgcgccacgcggcccgcccatggcacggacgccgaggatggacgaccacctcgaaaccctaggccccgcccctataaaagtcgtgagcagcgcctcctttctcctggagtccccaaacgccgacgccgctctgctccaccacctagcgccgccactcctctgcttccgggcagcgccgcagccgccgagccgcacccgcgaccccgacgtcgagctcgtgccccatcgcccccgcgcacccgtcaccatcgagccgaccatggagagccaccggccgtgccgagccccatccccaacctcgccccgcgaccagcacctgaacgtgccctgctccaagccaccgacgccgcgcgccaaccccccctgcaccgcgagctcctcgtctacgacaccgtgctgcccacgacgacacccgcgggcagcagcaggccgcccccgcgtcttggacctcgccgtggccgcgtcgcggccagcagaacgagttctccgtcgagccgcgacgttgcgtcctcaccgtgtgctgctccgagccctccaccacaacatcgttgtctgcaacgcaggtcgtggtgaccgcgaccccggccccgtctgccacgacgtcgcgcacggaccctatcgtggccgcgccgagccccgtcactaagcaccactgagcagggagccgtccatgccgcgaccaccaccgggaagctggagccttgctgtgcacacgtcggagccctgtctcacccttcgccgagcgtgacctgggggcaccatcgcctcgatcaccatctgtacagcagcaggcgtccgccaccttcctcgcgttcgtcaaggtcgacctttttgcacctagtcgacgcccttcgcgacgtcgacgaaacccttgttattttctcatacccttgtatgttgatgattcatgatcatagtcatctatccatgtcatacatcttctgtcttgttcgattcaggatttatctatacttgttatatgatctatatccatgcctgtgtcgtgccttcgtgccggtctatttatctatctatccatttctgtcttgtatgctatggaaatgtgctactccgagtcatcgttgtctttgtattgttagcggtcgagtcgtgattctttgtgtgattgtcgtcgtctgtggaccgtgccttcgagccggttgagagagtgatatgtttgagtgttgcgatcgcgagttcgtcttgccatggtcgtaatgctaagcatgtcccttctctcgtgtagtcgttgttctttctgttgttatttgcctgaggactgagccctcgagccggtcggggaagtggtagtgcacttgaccatttcgatcgtgggttcgtcccgccgtgatcgcgatgccgagcgtaactcgtttcccgtgttcagtttgactctgtcgcgctacagtcgttagctttgttcttgtctcgcagacgtggtcatcgtggactcgatgtctttatcgacgcggttcttacccgcacactcaagacctatgtggcctagtctagtgggataagaattaggggacaacctatgtggaacagtcggaagccaactcgttaggtgaggctcatggtcgcgagtcgcctcgccatggccatcgggcttatcccatttttctcgcgtgtttatttattccgtctcgtatgcttatgccacctagacccggacatttcccttagttttcgcggtgacaaccgcatcgcctgaaactataggaatgaccctgtgccaattcagaagcacctaggtcgagaagtgttatgagttggtgtagttcatggggtcgtgtttatttctccaactttcgtttgttccatggcgagttggttgaaagagtgtgatttcgttcttcttctctcttgttctcaatcctcgtcgatccagtaagatgtggattgagcccctttttcttgtttaatgttttgtttccaattctgtgattcctgccgtcgctatggtaagtggatcaatgggaagtgaaacccgtgtcttttcccgcctttttggttctttgtgtttaaactcttgtatgcttgtacctattcgaccgtagcatttccttggttctcgtggtgacaaccgcaccgctaagaaccctggtgatgtcttagtgcattcagtgtacctaggtcatggtaccctacaagtagcttgagcacccgtgttctttgtgtgtcactctttctaattcctcgtctcttaccatggcgagtggattggaaggagtagaccactccccttttcttctccctttgttccacctctcttggctctcgctaactacaatggcgtatggattgagggagaccggaacttctcgtgctcatagtcttttcgattcctgtcgatctctatgacatttggatcgaaagaccgtaagctgtggagttcacttagaatgagttagagtctaagccatttattaaagccgtacaggttgactcagttgacccgggaggtactggctaggctaagactctgacttgtacttagtgaacagtcattcccgtttcttttagcccagggatcggacctccaccgagagggctaagtcattatcctttcggtgctcttttagtgtagttgttctttagtgttcttcgtctcttttcgcagtctttcgaggtctagtggtttgattgtttcgccttgattgttgtttacaaggtagttgcttcggttagcgatgatcgaatcggaaccagtcgaaggaaggacatgcagataggagaaagaccttggatgagtacaactacaagtgaactgaggatcttggaaatgtcactcgacaggttttgaacgtggcccatgacgataactacggagaatagaaggattaggtggtctcgttcctgcgctcaagtttggttcaaagatgaaggctacgcccgctgataaactacgccgactctgatgattgctcgtgaaggaggagccttcactgctgacgcgctacatcgactctgataaagactcgtgtgtgtttccgctagaaaaatgatgtaataccaagagttgtaaagtaaatgtgttgtaatcttgtttttcacgatgtatgactatgatgacagctgatatatgataatgtgatggcttaat

SEQ ID NO: 219 - DNA, 4604 bp, Sorghum bicolor
cactgacccgctgttacttttatccctttcgtcttcctggcctctgcttgctgtgtttatttcctcggcgccgtcgcttccactgttttcccctttcgtctgagctcggcggatccacgctgttcgtgtcctgtccgttgttgctttcgttctttgctttgccttcttctgcccggcctactgtgttgccttggcgtggccgccgtatttgctgtgtctgtcggattcaccatcgctgagctcgccgtaccacggtgggggctttgcccttgccgccgtgggcctatctggtgttcgtttcgtctgtgtgccagatccagatgacttcggcgtctgcccgttggtgtctgtcgttcttgctgggttgttagcttctttggtttctgttcgttggtcagcttacaggcttggtttcttcggtttggttattgtttattgcttgcatcatttcagcgctgcggattgcctaggtaattcctgcctcttcttttaatcacctctgtgcttatcgtcttatgcctttgttttactctgctaactgatgcacgccacttcctgtctgttttcctttccttcttcctactaaatagttagcatcagacatgaatagtcgatgaggtcacagttttgaaattcatcctttatacactgatgagtttttgctaatttgcatcattgttatgctgctcttatcttttgtaactcctttgattatacaactgccattcgtgggctataattttgttgcgctgaatttgtgcttggttcataagtagttgcaggaaacatttaggtctatcaatatccatttctaaaattcagagatacatacagacatatatgcttcacttcataggaaacattcaggtgtatcaaatttgagacactctatcattgcagaccacatgaggcatagaagctcttaatgcccgcgcgctcactcaagcctaaattatcttccaaaccatacatggatacctccaccatgtagacctgaagcagctaacgatgtcatacatggtccagctaatttatgtaaaaagcactagactgtagtatcagctgttacaacttttgtagtatgtcacattggtattatggtgtgcataggatccatatatattatgttgttgctatgtatgcactactaatatatatcaaaatgtatcgttgtgcatgtgttatccatgcacaacagaatcaaacttatatatgtatgctctctaaatatttgttacaagtagctaggacttaatatctctttagtccccaatcaaaagaaattacagcttctcattctttcttcacacaaaatttcagattttttttgtaaacttaattagaagaacctacaccaactcaacaggaagactatgaagcccatagccccatactgtatagcccacttaaaaaaaaaagttggtcctataggcccaacaaagtaaataaaaaaaggacacaaaaaaggcaaaaaaaagatagaactttgaagaggctcctagaaattaggtgagcacactgacaacattaactcatccccacttctccctcatccagacactcccacacatacacctctcacttcggcgccatcaccagacccatcttcttcaccaagttatccaactccgccccctctgctacccacccactggcctccatagctaatcagcaccacacctaaaagcaccctgtccaatccacagtcacataggataggcgaagcaagattgttgcctgcacaggatatcaacattgcagctccaatctctatctctatccacgtggcaccatggcaccaagaatgtactgcgacaacgcctcagtccacattctgtacacttgaatctacaagatcgtcgccgtgcacaaggtcaaagaaacaagatgccagcataccagtaccccaatctcacaataattgaagaaggacaacttcaacgggacgaaagagatgtgtttcaggctgcggtcatcttcgaagtgccaccttcggcgatgcatattataggacacgaagaaatcaacaacgcaatacatcaacaacttcgggtcgacataaatgtacaagacatatcaaagtttggctctaattacttcataaagactaactgtcaacagacaactgccccgatgctacagcacaccttcctcaaagttggctcacacacactaacacttaaaccatggaacccatattacaacgccatcatatttccttgtgagacacagaccaccaacctcagattcaccaatttggccaattcttcccagagaacgctaactgttcagatttctggaataccgccgcatctctgctgtgatttcacagtgaaccggctcctcagtgaaatatgcactatccataccatttcatttgagcccgcgacactatcactcaattgatgtgcatggatcacaaactctcatgcctcaagcagcacatgtagcacttagcaagacacccatggtcctctcctcaacatttggccaatatggtacgacacatatgtacaagaaatgcttggccaactatccccgacaacctatgattggatgccatctttacacatggaggtgacacggatctggacacatagcaaagacatgaagcatgactcaggtatccaaaaactaaacaactgcactcatatataggtgaacagaacgaagttaactctcagccatgaggcggaacgccacacaatccggatacagactcatccattagcatttcaagcgatgacgaacacggatgggaatcagattgaagcataaacattggttgatgctggtgctttgggagaagcaaccaaactgtaaaacccagagctctctttccgtgtgaaatatttttgtatgttatgtaaagtaaggacctaacatcttatgatgctttcgtatggtcagcacaatcaacatgtactaaacttgtttcaaaaaaatatactaaacctgataactgctaaagtatgtagtagtcctctctatatataaccatatcgtctatattatccttccgtaccaccatggctgactccacgattgtctgtactcgcgcgcaaatgcgcgcgtcgaccactagttctcccctaaattctccgacggcttccaggaagagaagcaggtgccacgtcgcctggaattctcgtgtccgtcggatttcccaacggatggccacggttcttcaaagcagattgttccggaagccgattccgctgcttctcgccagattctttcgcttcttacctgcttccgccgcttctcgtccgaatctatataatcaaatatataggccagcttcggcttctcctacccgcttctcaccccttcctctctcctcttcgcgtctctccccgacgctggcaggagcgatggcggctcccgggaccggggctcgacggcggcgcccaccttcctcctcctcctccgttcctccctcctcgcctgcttcgcacctccgttcctccctccccttcatctctctctccctccctcccgaggtggcggcgggcgcgaggtgacgggctgacggcggccctcgcgggcagcgctccgacgcggctgtggcccggcggcccctccctctccctcagcctccacgcggtctcctcgatgcctcctcccgctggggagcatcagcatgtgcttctgtgctcgacgaaaccctagcacatgcagctgtgcaggcgcggcggcccctccatgggcacacctcgacgccgcgtcagtctgcgtttcttcctccagctgttatacgtgctattgcctatggatcaatatgcatgcaattgacagtactccctacggatcaaatatacatgcacttcagaaatttaaagggttcatgttgattcaacttggtcattgtgctgctgttggagctcaggacatgcatcatttgcgcagggatattcggtttagatcacctccaaacaaattagatcagcgatctttttttgtcactttgatttatccaccactctaaattgatttagcacctgagcaagttgtcaatgacatgttagtttcaggattctgcctaggttagtggaggacttggcggacggtagcattgactaaaatttgcccaattttgcctaggttatgggcagatagaagggtttgtttgctgttggaattctgtacagatcctatctcctacagtgcatcaaacaaaaaaaagggcactggaatcttcagctcgtaatggctgaatggaggaaaagaagtaatctagagcgtaggcgtccgtattcaacaacgaaggtgacgatgtaaagggttaatgaagatgggagatgcagaggcgtcagtccgtgtgtatgataaggcgaacttccttggcccatttttttcagataatggcttggttaactttgagaagaaagattcctatgtacagctttcactgtccctaatctcttcaaaatgttaccaacttatgtaacatacatggcttcaaacatatatgtacgtggcttctgttatcagcatgtaaacgcatcagaggctatgcgtgtgtaatagacgcatcctgtacatgtatatctctaggatcattatcttgttacggacaacttgcagtatttactgactcacgc

SEQ ID NO: 220 - DNA, 890 bp, Hordeum vulgare
caatatctcatcagtcatcaccaatggcgcactccagagcctcgaccatgtcatcgccggtgcaccgcctgctgatcgtggccgccgcggcggcgctcgtgtcggcgtgtgcggcggacccggagccggtgcaggacttctgcgtggcggcggtcaccaacggctcggccgaccatccgtcgtacccggggttcccgtgcaagccggcgtcggcggtggtctccgacgacttcttcttcgccgggctggcgaagtctggcgccgccgaggcggccgagagcccgttcgggtccagcgtgacgccgggcaacgtggcggccttcccggggctcaacacgctcggcgtctccatcaaccgcgtcgacctcgcccccggcggcgtcaacccgctgcacagccacccgcgcgccgccgagctcgtgcacgtcgtcgccggccagatgctcgtcggcttcgtcagcaccgccgggaccttctactccaaggtggtgctggagggggagagcttcgtcatcccgcgcggcctggtgcacttccagttcaacaccgggaaggaggccgccagggcggtgaccgtgttcaacagccagctccccggcgtcgtgctcgccgcgccgtcgctgttcggggcggacccggagatccccgacgccgtcctcgccaagagcttccaggtcgacggcgagatcatcaagctcctcaagtccaagttccggaattgatggcgggacatgaatacttcacgtcgaagctgcctgctgttgttaccttgattggtttattgttatacatacactgtacaccagtaaatacggacacccctagagttgttcactgtttcatgtagttttgattggatatttaatgagtcaataaaatttaagttcaaa

SEQ ID NO: 221 - DNA, 2522 bp, Hordeum vulgare
accccagcgcggaggcggacggcgccagggtccaggccttcttcgcggagatggaggcggccatccgggggcacccgctatgggccgacgccacccaccaggagatcgaccacgcgctcgaggggctcgagaagtacatcatgaccaagctgttcgaccgcaccttcgcgtcgtcgccggaggacgccgcggccgacgccgaggtctcggacaagatcggcctcctgcagcgctttgtcaggcctcatcacctcgacatacccaggctcctcaacaacgaggcttcctggctgattgcagttaaagaactacagaagattaattccttcaaatcaccgcgggataagcttctctgtatgatgagctgttgccaagtcatcaataacttgctgctaaacgtgtccatgtcgaatgaccgaacaccatctggcgctgatgaattccttcccattctcatttatattaccatcaaggccaatcctcctcagctgcactcaaatctaaagtttgttcagctcttcagaagagaaactaagcttgtttcggaagtcgaatactatctcacaaacctcatttcagcaaagatgtttataattaatgttaatggccagtcgctatcaatggaagaaactgagtttcagaagcatatggaatctgcaaaactaggtaatcaaatgtctgttgctagtcctagtagtccacaagggttggctacatctacaaggggattacagaagcaaattgatgcagaaggtttcaaattccctttcatggactcagaaatcgaaaatttgacgccagaggaactcaagcagttgcatggactctacaggaagacagtgaccaaatatacactgttgtctaaagccttgagaaagttatccatagatgaggatcagctgcttgcatcagtagatgattcatgaactgatgcagagattattatttgtgccacttgaccgtttgaacaaaaacaaggcaggtggaggagattacatacgtcttgcaagtgtcaaaacatgctatcaagacctggagccgcattcatgttaatcttgtcctcattgttcccaataagcccaactctttggaaacaatatcaaaattcaagatatattccaggaggtaccaaacaatgagaaacaaatctattatcacctggtaatcgatgattggatgaatgggtttatcaactcactggcagctaacgaagcagcagatcagcagcagctcaaggcagagcgaacgaagcagcagatcagcagcagctcaaggcagtatctgttcttggatctggatgatactggggaagaagcaagtagttgacaatcagtctgggaagtagatacctttgagagaaatttgtgttgtacaacaaaactgggacacaagcttccatttgagtttctgaagattgatatgaagaaccttctccttgacttgttatcgcaactccaccagcagaaacggccactacctgtcaattgtgagccagcaccagcgacattaacatcatacctgccaattgtgagcttggcatcaacaacattaatatcatcctcaagataaaaagcatgcagatcagaacatctaatcccattggccgctagaaagggaaagttcaattctggcctgccatgtcgtcatggcagtcctcatgggcgaagaggatcctgcccgctgcgatgtcgtagacgaatcgcgtgtccacctgctgcatcgtgccggtgatggtgatgtgctcgctcggcatcacggtaaggcaggcgtcatgttgggtgaggatgaagagctgctgtggctgaagcacgaggtcatcgtccaagtgcagcgtcaccgtcggcaggtgcttggaggcggcctgggtcgcgctgtggaagcagacgtggtactcatcacgctccactttcggcagccctagcctcctgatatgctcttccacggcctgcaccaggaggtcgtacgcgggcttgataatcatcgtcatgcccgtcccaggttcgatcacggaaccgctggaccacctgtcatcatgcaatttgtggcgctggaataactccctgatcctgccatgtggcaggctcagtcgtagcccgtcgacactgacgcctgtgaggccgacgaagtagggtctgaactccgggtcggtcatgcgcttgtagaggatcttggtgctcctcatgtgccccgtggccgacacgtcggcgccgaaccggaggaagccgtgcatgtttggatgcctgggcccaaggaggcagtaggagaagcggtcgtcgtgcccgtgctggtggagctgagtccagatgagcgacggtttctgtttgcccaggccgaggacaccggcgagcactccgtggttgttgaaccgtggtggaacaacaaaattcataatatcaaatgtagagaaacataacaaaaaatatataatgtattacattcttgtaaaagccggaccttttaagtttgatcatatttgtagagaaacataacaaaattcataatatcaaatctgcacgatcaaa

SEQ ID NO: 222 - DNA, 1302 bp, Hordeum vulgare
ccggagcgtgtgtcctccacactactgccagcctgcttgcttgcttcctaccagctgcctcccgccatctccatcgatcacttgctgccatggccgtgaacgacaccaagctggccgacgccgagaacccgggcacgatgtgccgcgccatcgactccgactccgacgtcgacttcgccggccgcgccaactggctgcgcgcggcggtgctgggcgccaacgacgggctggtgtccacggcgtcgctcatgctgggcgtgggcgccgtgaagcacgaggtgcgcgccatggtgatctccgggttcgcgggcctgctggcgggggcctgcagcatggccatcggggagttcgtgtccgtctgctcccagcgcgacgtggagatcgcgcagctcgaccgcgacggcaagcgcggcggcgacgaggagagggcgctgcccagcccgatccaggcggcggcggcctcggccctcgccttctccgtgggcgcgctgctgccgctgctggcggccgggttcatcgtcggctacaagctgcgggtggccgtggtggtggccgtggcgacgctggcgctggcggcgttcggggtcgtcggggccgtgctggggagggcgcccgtggtgaggtcctccgcccgggtcgtcgtcggcgggctggccgccatggggctcaccttcggcctcatgcggctcttccgggccagcggcatatgacgtgcgcgcatgcggtcgatggacgagttttttcttgttgatcgtcgtctcgtccatgcatgctttccccgtgaccctacgtacgtacgtggtgccaacgtcttcttccccggccggccggctgatgacctgacgtccgtgcatggaatgtgcatgccccgccgtccgtgtgcgtctctcttcttccctagttgattctctgctgcttaattctcactctctctctatactgctatcactagtctttgcatcatgcatgcatgccacgctgatgtaacattggccagctgctgctgcatgcatgctatagtagtatttttactcgtgccatattattgtaaggttaccagtagcacgtacctactagtacttgattgggaggtggaagaaggtgacaaggttgttgcaagaaaggcaagctatatatatgtaagctaattattaatttgagtttccatgcaagtcaagccgtgtcatggatatgttcattgttcaagtaatcttgattgattaattagctatatatatcttgagaacaatatcagcagtgtggcagcgcaggcaaagaatcaggttgtacatatgctactaa

SEQ ID NO: 223 - DNA, 699 bp, Hordeum vulgare
gatatttgggtttgcatatggtggcccatttgggcatttcctgcataaaatgttggattatatctttaaagggaagaaggataccaaaactgtagctaagaaggtgttgctggagcagatcacttcctcaccctggaacaatttactcttcttattctattatggatatgttgttgagaagaggcctttcaaggaggtgaaaattagggtgaagaaacagtatctgtcagtgcaattgtctgcttggatgttttggccagtagttggttggataaaccatcagtacgtgcctttgcagtttcgggtgattgtccacagctttgttgcatgttgctgggggatatttctcaaccttcgcgccagagcgatgtctttgaagcagtcatagacatttagttggtgtataacactccatcatggttcaaacttggccggagaacaaggatggtgtttgctatgtaatataccgttgattgtcctagggtatttaaatagttagaggatttcgatacttgtttgcaatcaagttgcagatttgtttgtcaccgcatgggaggccgcttatctgatttctctgctggcaccatttaagctttgtgactgaaacgtatctgacttgtattagctatggatttatggggtctacttttgggagcaaataatggttttgggtcttttacaactgtgcccctaaccgac

SEQ ID NO: 224 - DNA, 2255 bp, Hordeum vulgare
gccggggcaggggcgtgtctttctcttctcctcgggaaaaagcgtgcccccagccgcgacctactcaactcaactcaacttgaagcttgctcacccgccgtgttggaagagaactcattaatccattccatcacccacatcacttgaagccttcaagcccagcccagctcccccatccccatccccaccccaaccccagccccaaccgctgccgcacggcgacattcggttgaccttccagcttgacatcgaggctccgctcggcgcctcggctacacgctccgatattatttatagcctcggccgggggggagagggaggaagaagaagccaagcgagcgagcgatagggagggggcgatcgaggaagaggacaagcgcgagtcgccgaggtgatctgctggtggaagcgcaagcaaacaagcgagcaacaacgacccctgctacgtaccgtacctgcctagctaagctagccacggggtacgagggaaatccaagaaggagaagaagaagaagaagcccaccacgtacgggcgggcttccatggcgtctagctgctgcggcaaggggcgcgcgccggtcgtcgtccccttgctagcgctgctcgccgtctcatgcgccttgtcggtgtcggcgagcggcggcgccgggggcaacggcacgcggacggcggagttccgctccggggacgaactgcgagcttaccggaccatcctggcccggatggtcaggatgaacaaggcctccgtcaagaccattcagagctccgacggcgacgtcatccactgcgtgccggcgcacctccagccggcgtttgaccaccccaagttgagaggccaaaagccagaggctgagcccgtggacaggcccaagatcgtcgtcagccacgacgctgccggagaagaagaagaaggggacgccgagttcccgcaggcgtggagcgacggcggcgagtcgtgccccggcgggacggtcccgatacggcggaccacggagagcgacctgcggcggtactccggctccctccggcggtacggcatgaagccccgcgccgccggcgtccggcgcgactccaccagcgacggccacgagcacgcggtggggtacgtgaccggcgaccagttctacggcgccaaggcgagcctcaacgtgtggccggccagggtggcctcggcggcggagttcagcctctcccagatctgggtcatctccggcaccttcggcaacgacctcaacaccatcgaagccggctggcaggtgagccctcagctgtacggcgacaacagccctcgcttcttcacctactggacgagcgacgcgtaccaggcgacggggtgctacaacctgcactgctcggggttcgtgcagacgaaccggcggatcgcgatcggggcggcaatctcgccggcgtcggcgtacaacggccggcagttcgacatcagcctgctcatatggaaggacccgcggcggggccactggtggctgcagctggggtcgggcccgctggtggggtactggccgtcgtccctcttctcccacctcggcggccacgccaacatggtgcagttcggcggcgaggtggtgaacacgcggccggcggggtcgcacacgcccacgcagatggggagcggccacttcccgcgggaagggttcaaccgcgccgcctacttccgcaacgtgcaggtggtcgactgggacaacaacctcctcccggcgagggacctccggctcgtcgccgaccacccggcatgctacggcatccagggcggctacaaccgcgcctggggcgactacttctactacggcgggccgggaaggaacgtgcactgcccctagcgcttacgttacctgccgatcgtcgccggagacggagaaggagaagaaggagatccatccatcgatctacttatgattgatgagaacagtacgtactgctgattgatcgttgattcttactggtgctacgtacgtgatgatcgttaccgaggaacggacggcgacggcatcgatcatactatataggtagctagctggctggtggtttctcgatcgggttgacgcgtacgttcgtggcgcgcgcggtgcttcttttgatgtggttgaggcttgttcttttttttccttttcaccttttgagctacctagcgtgtatacgtgaagaaactgacatatatatagagagagtgtattgtggatttgtgatcctcttgtgtagtacttccttcctaaactaatataaaagcacttaaaacatcc

SEQ ID NO: 225 - DNA, 1473 bp, Hordeum vulgare
tgccccgcggcggccgagctcgccgcgtcgtggggcgtcgacctcctccctggcggcggtggcgccgccgcgttcggttgcggcctcggcactggcgccggccaggaggatgaggacgccttcttcttctcgtccttggactactccatgctggttgaccccgagatgcgcgacctctacgtgccctgcaacccgccggaggtggctgtctcggcaggcggcggtcggcccctcaagggggaagcgctgtgcgaccagctcgcggagatggcgcggcgagagacggacacgtcgcagccgcaggggtactcggatctgagccccaggactcctcgccggtcctccgccgggtctagcgggcgcttgcctgacaagcagcctcccccgccgctgcctcctgctccagaggtgccgtgtccgtacacgtccctgctgatgatgccgtcagcccactgcgccgagcttgtcggcaacgaccggctccctgatgacgacgaagaacaacttcgatgggagttcgccccaccctcatcagtgccacccacccagatatgggatttcaatttaggaagatcaaggaaccacaatgaaaaatctgcacatgaagttggatttggttcaaacaatggaggctttatgatcaagagttacagtgacatgctcaaggaaatttcttgtgggacaacgaaagatctggaagatatttacgactcaggatacggtgcagctgctgaagatatcatgtcaacaaatatctgccaggtgccatccaaaaatgttagcacagcgagcaacaagcgaatgaaggttagctcatgcacctccacaatggatggcccaacaacctctgggagcaacgtgcctgcttcagggaccttggcgagctcttcccatgacagaggagcagctcccactagggagatctcctttggtgatcaaacaatcgtcccgactggagctgagaggcctaccacaaggatcgacagtgagactctcgccctaaacagggatagcgcgatgcagcggtacaaagagaagaggaagaatcgcaggtacgagaagcacatccggtatgagtcccggaagctgagggcggatacccggaagcgcgtgaaaggccgttttgtcaagtcgaatgaagcgctcaatgccggcagcaatggcggatgagccttcttccttgctcgcagcacggagatgacatcctgcgccgcacctaagcatgatgccgtgcattgctcagctatttttttgtgttcgttatcgttttcagcatcgtgatccagaggatcatattcacggtgtttttttttgtaagagacctctacttttctcctcagaacacatagcttaattttacactggtatataaggtgcatatacgctgtctcatctttcatgctcatgatttcatgagtttatagtgctgcttaacctaccaactagtaactgagatccaaaacgacaaataat

SEQ ID NO: 226 - DNA, 2665 bp, Hordeum vulgare
acacaacctctgtgtgccgccatggcgcccgccgcgaagaagccgccgctcaagtccagctcctcgcacaactccgccgcgggggatgccgccgggaagaccatcgaggagatgtaccagaagaagacgcagctggagcacatcctgctgcgcccggacacctacgtcggctccatcgagaagcacacggcggcgctctgggtctacgagaaccgcgccatggtgaaccggcaggtcacctacgtccccggcctctacaagatcttcgacgagatcctcgtcaacgccgccgacaacaagcagcgcgacccctccatggactccctcaaggtcgacatcgacgtcgcggggtgctgcatctccgtcttcaacaacggagacggcgtgcccgtcgagatccaccaggaggagggcatctacgtgccggagctcatcttcggccatctcctcaccagcagtaactacgacgacaacgagcggaagaccaccggcgggaggaacggctacggcgccaaactcgccaacatcttctccacggagttcgtcatcgagaccgctgacgggcgccgccagaagaggtacaggcaggttttctctgagaacatggggaagaagtcggagcctgagattaagaagtgcaagcaatcagagaactggaccaaagtgaccttcaagcctgaccttgcaaagttcaacatgaccgagctcgaagctgatgtcgtggcactcatgatgaagcgagtagttgacatggcgggcacccttggcaaaaccgtgaaggttgagttgaatggcgagaaggtggcagtaaaaagcttctcagattacgtgcaactgtatattgactccgcttccaaagaaggaatcgacctaccaagaatttaccaaaaggtaaatgatcgttgggaggtctgtgtgagtctaagtgaaggccagttccagcaggtcagttttgtaaatggaattgcaaccataaaaggtggaacacacgttgactacgttgcaaaccaaattgccagccatgtgatgggcgttgtgaacaagaagaacaagcaggctaacatgaagtcgcatgtagtgaagggctacctatgggtatttgttaatgcgctcattgacaaccctgcatttgattcacagaccaaagagaccttgacgactcgtcaaggaagctttgggtccaagtgcgagctccctgatgattttcttaagaaggtctctagctcgggagttgtcaacagtctcctttcttgggccgagttcaagctaagcaaggaacttaagaagactgatggaaccaagaagacgagtattgttggcatccctaaactggaggatgcaaatgatgctggtgggaagaactctgacaagtgcaccttgatcctcactgaaggagattcggcaaaggctctagctatggctgggataggtgtagtaggaagggaccactatggcgtgtttccactcaggggtaaattattaaatgtgagagaagcaagccataagcagttaatggagaatgcggagatccaaaatataaagaaaatattaggtctgcagcatgaaaaaaattatgatagcacaaaaggcttgagatatggccacctcatgataatgacagatcaggaccatgatggttcccacatcaaagggttgctgatcaatttcattcacaaagagtggccgtctctcctcaaagttccttctttcttggtcgagttcatcactccaattatcaaggcaactaagggcaaaactgttgagccattttactcgatgccagactatgaagcatggaaagagtccttaggaacaagtgcaagttcgtggactataaagtactacaaggggctgggaaccagcacagctgaagaaggtcgggattactttgaacaaattacccgtcacaagaaggattttgtctgggcggatgacaaagaagatggtgacgctattgagttagcgttcagcaagaaaaagattgctgagaggaaggattggctgaccaactatcagcctggtacttgtcttgaccaacgtgagaaacgcatcaagtacagcgattttatcaacaaagagctgatactcttctcgatggcagaccttgaacggtcaataccttcaatggttgatggctttaaaccaggacagaggaagattttgttttgctcgttcaagaagaatttgattaaagaatctaaggtggcacaatttattggctatgtgtcagaacactcagcataccaccatggtgagcagagtctagcaagcacaattgtaggaatggctcaggattttgtcggcagcaataatattaatcttttggagccccgtggccagtttggtaccagaaatgcgggtggcaaagatgctgctagtgctaggtacatcttcaccagattaaatcctatcacccgcttaatttttccgaaagatgatgatgttcttctgaactatttgaatgaagatgggcagtcaattgaacccacctggtatatgccaatcattcccatggttttggtcaatggaagtgaaggcattggcactggatggagcacctatgtcccgaactacaatccaagagatattattgctaatctgaaaaggttgcttaatggggaggctattgtaccaatggttccttggtacagggggttcaaggttg

SEQ ID NO: 227 - DNA, 1183 bp, Brachypodium distachyon
gcatggaggacggcggcgtttgggctctacggcttcacccagttcaccaaatcaggattcgcggaacatgccaagaaatttagagaggaggatatgcagatccggttggatgggaaaaattgcctggtaactggagcaaattctggcttaggttttgctacagctgagggattggcttcgcatggggccactgtttatatgctttgtcgtaacaaggaaaggggtgagactgctcttaaacagataagatccaaaaccggcaatatgaatgttcatctggagatatgtgacctttcatctattaatgaaataaaatcatttacgacaagattctcttcaatgaacaagccactccatgtcctggttaacaatgctggcttcctggagcacaagcgtgtgactacaccggaagggttggagctcaattttgctgtgaatgtggcagctacgtacacgttaacagagctagtgatgccattgttggaaaaggcagcacctgatgctcgtgtcattacagtttcatccggaggaatgtacactgagccattgaataacaatttggagtacagagaaagtgactttgacgggaccaaacaatatgctcgaaacaagagagttcaggttgcactcactgaatggtggtctgagaaatacagcaacaaggggatcggtttctactctatgcatccaggatgggctgatacgcctggagtctccaagagcttgccgggactttcagagaagttatcgggaaacctgagatcaaatgaggaaggggctgacacagtggtctggttagccttgcaaccgatggacaagttagtggcaggagctttctactttgaccgagctgaagcccaaaaacatttgaagttcgctgggactgcagcctcccatgcgcagataggttccattgttgatagcattcgctccatctgtggcctgcagcctcccatgcgcagataggttccattgttgatagcattcgctccatctgtggcctcccatgcgcagataggttccattgttgatattcaaaaacatttgaagttcgctgggaccttctcattgatgctttaggagaaaaaagaaaagctactcgttgaaaggaaaaatttgcaccagccgggaatcgaacccgggtctgtaccgtggcagggtactattctaccactagaccact

SEQ ID NO: 228 - DNA, 2113 bp, Brachypodium distachyon
gggggaaaaggagcagaagcatcgcatctcgaatccgcgtcctgccatctctattcttccccttccttccttccgttcctcgccttcttcctccttccccaaggcgagcatcagcggcagattgattcgatttcgatcccgtccccagattttcttcacctcccgatcgctccagacagcctccgcaatcccctccccgaggagcccccccacaacgtgcgtgctcgcacactcgcactcggctccattattaattccccttccccgtccgtacttccaaaacctccccgtcttcctctcctccatctcgttccactcccgcacggccgcattgctcggccgcgtcgcagcggcttcatccctgcattttgttttgggtttgttggatttggtttggtttggtttggttgcgaggagggtttgttcgatcggagcgggcgaggggaggaatcgagaaatgtgggcggtggagcgggtggtgggggagcggcggatgcgggagatccagcggttcgcccggaacgccaagctcaccgtgctctgcctcctcctcaccgtcgtcgtgctccgcggcaccctcggggccggccgcttcggcacgccgcagcaggacctcatcgagctccgccaccgcttcatctcccacccgcagcgcgcgcttgccgagcaccacgacgccaggtccagggcctccaactccgccgcggggaaggtcgccgaccgggatgacgagccggacccgccgccgaggactctcagggacccgccctacaccctgggccccaagatctccgactgggacgagcagcgggccgcctggcaccgccgccacccggagtccccgcccttcctcaacgacgtcaagccgcgggtgatgctagtcacggggtcctcgcccaagccctgcgagaaccccgtcggcgaccactacctgctcaagtccatcaagaacaagatggactactgccgcatccacggcctcgaaatcttctacaacatggcgctgctcgacgccgagatggctgggttctgggccaagctcccgctcctccgggcgctgctcctcgcgcacccggaggtcgaattcctctggtggatggactccgacgccatgttcaccgacatggcattcgagctgccatgggagcggtacggcccctacaacttcgtcatgcacggctgggatgagatggtctacgacgacaagaactggattggtcttaacacgggtagcttcttggtgcgcaactgccaatggtcgcttgatttccttgatacctgggcgccgatggggccgaagggtcctgtccgtattgaggctgggagagtgctcaccaagcacttgaaggaccggccagtctttgaagccgacgatcagtcggccatggtgtatatccttgctacccagcgcgagaaatggggtaataaggtgtatcttgaaaatggatactatctccatggctattgggggatcttggtggacaggtatgaagagatgcttgagaattacaagccagggcttggtgatcatcggtggccactggtcactcactttgtcgggtgcaaaccgtgttcgaaattcggggattaccccgttgagagatgcctcaagcagatggaccgtgctttcaattttggagataaccaggtcttgcaaatgtatgggtttgagcacaagtctcttgcgagcaggagggtcaagagaatcaggaacgagaccagcaacccacttgaggtgaaagatgatcttgggttgctccatccatccttcaaggccatgaagactactacgtgataattatagtaaaatccacttattttgttggttcgttctagatcctcttggatcaaaatcttataagttctttttgtagactcagggtgaaaacaaagtttgggttggtatcacgggatggatatctatgttgtactgtgagattttagagcatgatgttatgtttattgttggcataatcgatgtctcacacttctagaaattgagttagtgaagggaattcttcagttaattggtcactactctctagtctctatataatttatctgtagaattcctacttttggttgttggctgaatggtttggattttcgtgtt

SEQ ID NO: 229 - DNA, 2689 bp, Brachypodium distachyon
tagtccttccccatcaaaacctctcaaacgcaccgccgaactcaaccggctagtcgcatccgctcctcctcctccctccctcccctctcctctcctaccttccgcccgaagtctccacgctttccgtccatttaaaaccttcgcttcgtctcgactccacttggccattttccctcgccaaatctccgcgcgcgtcaaaccctaggggtcctgctgactcccacgcgccccctccagatccaatgggagcggcgccgtcgacgccgaggcttggcgaggtgggcgccgcgccgccgggcgcggcggagcagatgttcgcggcgctggtcggcgacaaggcctacccgatctcctccgagttctggaagcagctgttcgagctgcccctcaccctgcagtggccgcgggagcgcgtgctgcaggcgtgccacgcgttcgcccagaacaactacaatacgaagcatctcacaaagatcttgatccatttggtttggtgtttgcaagagtgcacgtcagcttcttcagtgtcttatggcgtttatagaaaggccatcaatgctgcctatatatcatccatatttctcaagtttattattgagaacgccaaggcagataattggcaagagctatgccttcacattgacaaggatgagaaggggctggagaattttccttctgatcaaacagtggagtattttctgatgaaaggggtgctgaactacattggtagtgtagatgtaagcccagagtcgtgctacctacatcatgagcttctaaacttgatgttagttcttatgtcgactcagttatgttctggaccatctccagaaccaaaagatgtgcatccttttattgatgcagctatgcttcaggagagtaccacagtgggctctgtagttcaaaagttacttctaaatttcgtgagacgaccacagattcctttaaatggttcacaccctgttttctctgataatggtgggcctggtgttctgcaacgagttggctcagcagctgcaaatttggtactgctgccatattatactttcaactatcttgtaaatgcaagtgctgaaggggcaacaagtcaattggcagataacagtttgcttgttctgcttattctgattcactaccgaaagtgcatttcaatgaccgagtccattccaatcgacaatatctacatgagcgattcaaataccaatattaaggatgcgccatcttttcatgagaacccttattgcaaggcattaaataatgccaaggacattcaatttgatcgtgctgatgttgagggaaatgctcaaaatggacctgttgtcaggttgtcttttgcgtcgctgtttgatgctctcggcacatgcttaaaagacgagagctcagttttgttgctctattctttggtccatgggaattgcgactttcaggagtatgttctggttcgaacagacttggatactttgctgatgcctatcttggaaatgctttacaatgcatcaaggaagacttccaatcagatctacatgttgttgataattctcctgatactgagtcaagactcaaccttcaatgctagtgtgcacaaattggtgcttcctagcgttccttggtaccaggagcgcctcatgcaccaaacatctctgggatctttgatggttgtgatactaattcgaaccatcaagtacaacctctccaagctgcgagatgtctaccttcacacaaactgtctcgctattctagcaaacatgggccctcatgtgcataggctgagcgcatatgcatctcaaaggctggttagcctcttcgacatgctttctcgcaagtatgccaaattagctgagttaaaaaatgacaaggcttcaaaaattatatccgatcaaattgaaccagacaacatctcagatgatacgtcaacagagcttcacatatacactgacttcttaagaattgttctggaaatcgtcaacgcaatccttacgtatgcactgcccagaaatcctgaggttgtgtatgctattttgcaccggcaagaggtttttcagccctttaagaaccatccacgtttcaatgaattgcttgagaatatatacacagtattggatttcttcaatagccggatggacatgcaacagttagatggggaatggtctgtggacaaagttcttgagctcattaacaaaaattgccgttcatggcgtggagaaggaatgaagatgtttacgcagttacgatttacatatgagcaagaaagtcatcctgaggaattctttattccatatgcatggcggcttatcctatcacggggattttctttcaatcctggtgccataaatttgttccctgtggagattcatgttgatgatgcacaaccgggtgaacaaaaagtttagggacaatctggaaccgttggggttctgacaagtgacaccaacacagaaatatttgacctgtttcataggttgtggcgaagagctcgttgtatataggcggcatataccagataatcaaagtgtattctcattctttttgtgttaatatttccattgtcccatgatgtaatgcgacaagataggggtgggggaaattgcaagggattgtatctggttaaaaatgggtagagtgtaggatatcatagacaattctttcataagttattgctggacttcaagctgaaggtctctgctgtctattg

SEQ ID NO: 230 - DNA, 2299 bp, Brachypodium distachyon
aagcaattcttgttccgcaccgcaccgctttgccactccccttcctccttccgggccttccccaggccacattcccatctccgcctccgctcccacccccggcccccgtctcgggcgcggccgcatcccacaaccgccaccgccacctaatcctctggagcggcaccgaagagggttcgccaccgcgagtccatccatgggccgacccacgcgccgcgccagcgctccaacatagggtttgcggctccctgcgccctgcatgttaaggtggggaggaggcgacctggggttgtctgggggaagcgggagcggggtctggggtgccacgccggcggatggacgccgatgaggccgcggggagtagcaggaggatggatctgaacctatacctcggcctaccccgcgccccgcgtccgcgccgctccgacctcggctccgacctcgccctcagcaccccgatgccctcttcgccctcctcttctgcggcctccgtcgacgcccctccaccgccggagcccccgcatgccatctactccccacctcgcgccgacctttctcctcgaacaccggaggtatattcctcgcaccatctcgacgacgctctttctgcggacgcgcacctactgtatgcgcctcctccggcgccggtcatccgtgaccgtgagctcccggacgaaatcggatttggcttccaggccccgcccccgcccccaccaccgctggtgcgagccagcgaactgctgggctgggaggaccggccgtcttcctcgacggcctcctcctccttcctccctgacattgccacaaggtacaggcggctgctcgagcaaactggaagccggtggctccgccctcgcccaagaaggtttagatcagaccttccgcctctcagcgcagaggctcaacctatagggcaggacgcagcagtacctgtgccccatcaggagatgacaaatgatgatttcggtgacaataaggtaatcgccaatggagcggaactaggtgcctccgaggagtcggaggagcggggcaagagtgctgccacattcgagtgtaacatatgctttgagatggccggagagccggtggtcacttcttgtggccacctcttctgctggccttgcttataccaatggcttaatgtttactccaaccacaaggaatgcccagtttgcaaaggcgaggtgacagaggcaaatattactcctatctatgggagagggaattcctcttcagatgtagagaaggctgtggaagaaggtaagcagccaggccctacagtaccaccaaggccacatggaaatcggcttgaaagtttcaggcagcagttccagcacttacgaccgatgtcaagaaggctcggtgacgcacatggaatactgtcatcatggaggcgccttcttgatcaacagattatgaatagtgtgagtaggtttgaaggtccacctgaaccagctgttcatgaaacaggtgatactgctcaacccgctagtcgcctaggtacattgcccataaggatgagaccaagacgacggtatcagatggaggcggatgaccttcctgatggtggttccgttgcccctgatagtggtttacctgggaatagtgcaccagatccacacagacatggtccgagcccgcttttaccagaaggaattgatttgttgcaacgacttacccttattggccttgcaaatacagaaagattggcaactgccatgagtgacctgagaaggatagctgcccctaaccaatatggagcatctgcgtcgtcatcgaacccgtcgaatcccgagccagcagttgacggagcacatgttggtgcagcaccttctacagatcaagcatcgaactcgagcaccattgcagtgatacagggggatgctggtatttctgagactgcaggagagcctagtaatgcaggatcttcaagatccctgaggaggagagggaggagcaatgccttggcttctttagatgtggatggtgggcctccccagcgcatcaagaggcggaggatgaactgaaccttctcagtttcggtgtttctttaaacttcataatgtgctttgctaattttcagttttgcatttcgtttctttcggtgctacctgttatattgtagttgtaatgttgtgtcttctcttccatttgtttactagtgtcacccaaatggttctgtttagttcctttgtagcctgtacctctttaatctatcatgaagttattggtcaaagctaattgtggaggaaactaaacagttgtcgacttgtcgtgagatgaagattttcctgttgat

SEQ ID NO: 231 - DNA, 1023 bp, Brachypodium distachyon
atggtagcggcggcgggaggagcgaggcggcgcgccacgaggcgtgcgccggcgccgccgaccagggccgtgcagcggctcttccaggcgagccgcgccgtcttcaggggccccggcaccgtgccggcgcccgccgaggtcgccctgctccgcgccatgctcgacagaatgagaccggaggacgtcggcctaagcgcggatctcagattcttcaaagccagagaagccgccgaggggaagacccccacgattacacataccaccatatacaaatctgagaatttctcgatggttatcttgttcttgccaccgaatgcagtcatccccctccacaaccatcccgggatgacggtgttcagcaagctgctccttggatcgatgcatataaagtcctatgattgggctggtcctggtcctgatcctgccacgagcggcgctaattcgttgcctgacgatcgattgagactggcagagctggttgtggacgatgttttcacggcgccgtgcgacacatcggtcctgtacccaacagctggaggcaacatgcaccggttcaaggccattgcgtcatgcgcagtccttgacattcttggccctccttactccatagaagaagaccgggattgcacgtactacacagagattccatactcccaccaaccgagcagtgaccttgtcgataacgaacaagaacgccggcgtctcgcatggctgaaagagatcgacatgccgaaggagctgaagatgtgcagcgtagcttacggcggcccgccgatctccgacaggtgaacccccaagtcagccagctgatgtcagaactgccaacctttgtggatatatcagcaacacaatggagctcttagcctggatttcagtttgtacatgatgtcagtgatagcatgtcatgatgtaatgtgcgaatgttttgcttgctttgtttgtgcatgcaccgtcagtgtgggccttgtccagttcctttcttgatcttcggttaatacatactcatccatagatttcacttaa

SEQ ID NO: 232 - DNA, 2180 bp, Setaria italica
acgaagccgagagcagaggaagcacggaggatttttctgcgtcggcgaggaagcgaagcggaccggatcgcggcgccatgtcgctcgacgagctcgccgacaaggagcagtcatcgcccgaggaaattcagctggattccaagttcaggagcttcaacccagggccgattccgatcccagctgctccgaccatcagatcattggccgactcggtttctgatgagagagtggatgtcatggcctcacatcaaagtgaaaatggatccggatccatctctacggctagttctactgttagttcaatagaatcagagaaagcagcctatgaataccttgctcaaactcctatcaagtcgactgatgcacaccttgttgagttttcagaggctatgagaactgttgcaaaggccttacggcgagtagctgaaggcaaggctgctgctcaagcagaggcggcagagtggaaacgcaagtatgaattagagatggcgcacaagcaacagagtaaaatcaaaggctgtggcagttgtatcagtaatgacttagacaaactggccagtcaactaaccctggagacatcagcatctgatcaattaggatgctgtggaaagcatggtatatgttcacatgaggttctccaggacgaagttcctggacctatcccaagatctaatcacaagatggtagggagaaaggcatcatttaaactttcatggggatgtaatggagataaaaatggccagcataagcatgattttgtgtcctttgaaaaaggtgatataacaacagcagaacggagtaataagcagatcttactgaaatgggaatcaacaccacaaacagtgcttttcataaccaaacctaattccaactctgtgcatgttctttgtgcagaaatggtcagatggcttaaggaacataaaaatataaatgtctttgttgagccacgcgttagcaaggagcttctaactgaggattccaactataacttcatccaaacatgggataatgatgaggagatgaagctgctgcacacaaaggttgatctcattgtaactcttggcggtgatggaactgtactgtgggctgcatcattgttcaaaggaccagttcctccagttgttgcattctcccttggatcactcggcttcatgacacctttcccaagcgagcaataccgcgattgcttggacaatgttctgaatggaccatttagcatcacattgagaaaccgtctacagtgtcatgtaatccgagatgcagcaaaggatgaactcgtgaccgaggatccaatattagtgttaaacgaagttacaatcgaccgaggaatatcatcttaccttacctacttggaatgctactgtgacagttcttttgttacttgcgtacaaggagatggactaatcatatcaactacatctggaagcacagcatattcactagcagctggaggatccatggttcatccgcaggtcccagggatccttttcactccaatctgtccgcattccttgtcattcagacctttgatactgcctgaatacgtgactctgcgcgttcaagtgccttacaatagcaggggccatgcctgggcatcttttgacggcaaagatcgaaggcagttatcacccggcgacgctctgatatgcagcatttctccttggcctgtgccaacagcctgcgtgatggattcaacgaccgatttcctgcgcagcatccacgagggtctccactggaacctgaggaaatcccagtcgtccgacggcccgcgtgattgatgcaacgatttttcagttatatcagtccagtgccagaattctaagttggctaaggcactgatgggtttgttctcccagaacagaagcatttcctccatccaagtgctgctaacggcgagaggataattgtacctacgcgagtgtgttctcctttaccattacatacatactatagaaggttgcatacatgtagagggtatagtgcagaatccaaatgtaccacgagtgtgtagaggcacttgaacttgataacagcacatgtggcggatgatgccaataccatacactgatctggataaagtatgggggatggcaacaaaacgtagagtaagcgccaccaatgtatgtgtatatacatgtgatgtgcccccatgatggaaatgaaataatttgtgtgagcca

SEQ ID NO: 233 - DNA, 2082 bp, Setaria italica
cccggccggcaacgtcgagctcctggggtgagttcctggcggaatggaggtcttcggccccgtcacgccaggccaggtgtcattcttgctcggtgtgttccctgttctcattgcatggatttattcagaaatcttggaataccgaaaatcgtcatccattaaagttcatgctgattctaatttggaaaaggaaactgtcagagaagatgataaggcagttttgcttgaaggaggcctatcaaaatccccatctacaatgcttcggaacatgtctacgaaaacaaaaattatacgatttataacgatggaggagtcctttcttcttgaaaaccgtgccgtaatgagagcaatggctgaatttggcattgtgctggtttacttttatgtttgtgaccggacaaacacatttcctgaaagcaagaagagttacaaccgtgatctgtttctatttctgtacatccttctcatcatagcgtcagcattgacttcacttaagaaacacaatgaaaaatcagcattttcagggaaatccatactctaccttaaccgccatcaaactgaggaatggaaaggttggatgcaggtcttgtttttaatgtaccactatttcgctgccacagaaatctacaatgcaatccgcattttcattgctgcttatgtctggatgactgggtttggaaacttctcgtactattacattaaaaaagacttcagcctggcacgatttgctcagatgatgtggaggctcaattttttcgtggccttttgttgcatagtccttgataatgattacatgctgtattacatatgcccaatgcacacactttttacacttatggtatatggttgccttggtctgttcaacaaatacaacgagataccatctgtgatggctatgaagattgtgggttgcttcttagtggtgatcttgatatgggagattcctggtgtatttgagcttttgtggaggccttttacatttctgctgggatacaaagacccagaaccttcaaaagcgaacttaccccttttgcatgagtggcatttccgatccggtcttgatcgttatatttggattatcgggatgatctatgcttacttccatccaaatgttgaaaggtggatggaaaagcttgaagaatctgaaactaaggttaggttgtcaatcaagggaaccattgttaccacttctgtggtggctggttatttgtggtatgaatatatttacaagctagacaaacttacgtacaacaagtaccatccttacacatcgtggattcctataactgtttatattgctttacgtaattgcacccagcagctgaggagtgcctcattgactctttttgcctggctcggcaagattacactagagacctatatctctcagatccacatttggctcaggtctagcatgccaaatgggcaaccaaaatggcttttatctttcattccgggttatccgatgctcaactttatgcttgtcacagcaatataccttcttatatcttacagagtgtttgagctaacaaccatcttgaagtcagcttttattcccagtagagacaacaatcgtctatatcaaaattttgtagctgggatcatcatctccttatgtctatatttctgctcagttatacttctcaagattacagttgtataggaacatgatcttgatacaaggccatttctgtgaaatgttgtcttacctaggatgatcagtcgctgcctcatttccacgttgcagttggagagaaagaaagaggcttattaaggtatgtcgaatgcttatacgcctgagtgcagatgctccagattttttttttctgtttaccagttattgtacacaattaggcagtcggtgcattcctttgggagttgtaacagctggttggacttgcattcctacgtgtttacaaatgcacgagagatttatgttgcatcgaagtttttcttctcaaccatataatggtagattcgtttactgatgtaattttagaatagctatactccatcgtgtactacacaaatcaatacaaatgatacaatgttgttcttcctgaaagctcttgtggctgtttg

SEQ ID NO: 234 - DNA, 1265 bp, Setaria italica
cctcagccgccgccgcccgccgccgcagtggctcgtgctcgccgacgacgacaccgccttcgtgctcccgaacctgctccgcgccctccgcaggtacgaccaccgcgagccctggtacctcggcgcgcgctccgagtccgcggcgcagaacgcctggcacggcttcgccatggcatacggcggcgccggcatcgccgtcagctggcccctcgcgcgccgcctcgcccgctccctcgactcctgcgtcctcaggtacccgcacctctacggcagcgacgccaggatctacgcctgcctcgccgagctcggcgtcgagctcacccacgagccaggcttccaccagatcgaccttcatggggatatttctggcctgctaagagcacatccactttctcctttagtttcactgcaccatcttgataatgtgtatcctctttaccctggtatggaccggacaagagcaatgaaacatttcttcagggctgctaatgctgatccagcgaggatcctgcaacaaacagtgtgttatgacagcaaaagatcccttacagtatcaatcgcatggggctattcagttcaggtgttcaaaggcaatattctgctccctgacctccttgctgtgcagaaaacatttgtgccatggaaaaggggtcgcaatgttacagatgtctatatgtttaacaccaaacatgttcccagagatgagtgcaaaagaggagctcttttctttctgaaaagcatttcttcgggggaaggcaagacacaaaccacttacaatagacagccaccgagaaaatgcttgcctgacttgataccattgaagaatctaagtctgataaaagtgacggctgaacaactgcaactgattcctgggaaggccttaaaacggcattgttgtgacattgtaccttcttcatctgataccaccatggatgttaacatcagaaaatgcaaagatgatgagttgatcgcgatgcattcatagtcattcttctgtcagatggacgctcatctattgcagaggtcatcatccaccccaatcgtgtcctgaaactgagccatgctctttgaagaatcatcatggatgaacactagatttattatagtatagacagagacagaaacagcaaagaaatacagatacatacagagtctagacagaggtaggaacgtaggataaattagcaatttagcatctctattccttcaaatagcagagttggggcatcagcatttgattgttccatagtctgacttgtaacatc

SEQ ID NO: 235 - DNA, 2478 bp, Setaria italica
ggtggctgcgatcgacccgccaaccgcccccacgccgcgcacgcactctcgcacagcgcacgccactagaaattccaaaacgagcacggccggccacgaggccgccctgccagtgccggtccctccctcgctcggctggtgctggcctggatcctcctccacaccacgccgcgccgcgccgtaatctctctgctctgctcccgtctagcccagtggcggtggtggtggagtgcacagatccgcccatctcgtacctggattggctttcgtcttcgcccattgctgttgattgctgcggcgtatccatggtttgattactttcttcttcctcttctccggcgctcaagatcgacgccagcaggactgttgcgtgttcagctgagtcagccactgggccacgcagatttaggatggctagcatcagccaccattgctgagcttcttctccagtaaaacattggatttttcacgccgccccaacctgtacttgatgatcaaaagatgtcatcaaactccagtctaaccgagtctctacatgagaaaacaattgtctttggcctcaaactttgggtcgtgattgggattgctgttggagcgtccctcttgggtattcttctcattcttctcatatgcctcaccattcagagttgtatcaagaggtcacgcaagccactcaatgaccgtccaacgatccagatacctcctgcatacaaagatatcaaggaagtggggacggtggatcagttttcagctaatgattttgttgtacatgatgggcttctactcactattcaaaatgagcctgagcctgttgagtccgtcaatagagatgcagttcagttggctcaggaggaaaagttgaaacaaagagaagagaacaatctttctggttcgttccgcattacagatggctgtgatgtaattcagattgtttcttctgaggaacagtcttcaacacatgctactgtcgactcagcgccattggcgggcttacctgaattttcttatcttggttggggccattggttcaccctcagagatctagagcttgcaaccaaccgttttgcaaaggataatgtgattggtgagggtggatacggtgttgtgtatcgtggcagattatcaaatggcaccccagttgctgtcaagaaaatccttaacaatttagggcaggctgagagagaattcagggtggaagttgaagcaattggccatgtccgtcacaagaatttggtccgccttttgggttactgcgttgagggtactcaaaggatgcttgtgtatgagtatgttaacaatgggaatcttgaaagttggctccatggggaattgtcccagtacagctctctcacatggttggctcgcatgaaaattcttttgggcactgcaaaggcccttgcttacttacatgaggcaatcgaaccaaaagttgtgcaccgtgacatcaaatccagcaatatcttgatcgacgatgagtttaatgctaaaatatcagactttggtttggccaagatgcttggtgctggtaaaagtcatattgctacacgagtcatgggtacctttggctatgttgcacctgagtatgctaacagtggacttctgaatgaaaagagtgatgtctatagctttggggttgttctgttggaagctattacaggtagagatccaattgactatgagcgtcctccaaatgaggtaaacctagttgactggcttaaaatgatggttgccaacagacgttctgaagaagtagtggatccaaacctagagagaagaccttcaacaaaggagctaaagcgtgcccttttgacagctctgagatgtattgatttgaatgctgagaagagacctagcatggaccaggtggtccggatgctggattctaacgaacccatacctcaagaggaaagaagacaccgacagaaccgaacccctgagacttcggaaactgagccattgaggggcaagaacaacagtggcaggagtgatgcccctgagcacgaagcaaggccacctcgacctaagagtcgaacattttcttccaaatgagacaaacaagaaaataaaacagaaggcatactaggagatacgatataggcaactggagtgcggcacacgaaacacacattgtgggaagcaggaaatttcgatacatgaccaattgatgaatttcattcttggctgcaatggttgataatacatttttgtgttccttgacacatgtacagtggtgtgtgatagttgaagggtgtatagtactagtagtttgtaaaaacttaaaatggtgaacacgttcctacaacaaaaaaagaaaaagaaaaaagaagataggcgtgtgtggtggccggtgacagtaactgttgtgtggttgctgatatgaactacaaagtgcgagaggagaccaatgtaaccttggatattgcttgtattgtatcatttactcgaagagtataaagagaagattgctattttgtgggc

SEQ ID NO: 236 - DNA, 3157 bp, Zea mays
attcggggctgatttgcccccctatggcgaggatttgagtggactcgagaggaacaagtagaggggagtcctgatttgggcccctgccgtggtatgtgccatgaggaagctcttcttctccgagtcggcctgcaaggagaccaagctccactgcgcgccccactcatggctgcccctcgagagggggaagctctccaagttctccggccatgccgccgccggctcctccatagaggcattgatgaagatgccggagccggcagtgcttccgtacttcaagcccgcgaactatgtcgacatactggctcagatacacgaggagctggagtcctgccctcctgacgagaagtcctgcctgtacctgctccagttccaggtcttccgcggccttggggaggccaagctgtcacggaggagcctccagtctgcgtgggagaaggcgagcaccatacacgagaagctcatctttggggcgtggctcaagtacgagaagaaaggggaggaggcaatctccgacctgctcagctcgtgctgcaagtgctcacaggagttcaggctgctggattttgtgtcgcaagtctccactgggtcacacatgatgaactatgatgatgatgatgatgagtctgatgagtttcggggttctgcggtggttcatttccggataagagatgatatgattgcatgcgatcgacggaaacttgcagctctgtcaactccactgtatgcaatgcttaacggtggatttagggaatcctatctggaggtcattgacatgtctagaaatggtatctcccctattggcatgagggcaatcagtaaattcagcctatcaggaagactaccttatttgtcagcagatgctatcttggagatgcttgattttgccaataagttttgctgcaagggcctcaaggatgcctgtgagcgaaagcttgcttctttcatctcttcaaggcaagatgctatagatttcatggagtgtgctcttgagctgggctgttccattcttgctgcttcatgcttacaagtgctcttgaatgagcttccagagtgcttgaatgatgaacaagtggttaggatattctcctctgcaaataaggcacagagattgacaatggttggcaatgcatctttctccctatattgccttctcagtgaagtctccgtgagtaccaacccaacatcggatgtcactgtgagtttcttggaaaaactggtagagtcggcatcagattctaggcagaagcagctggccttacatcagctggcatgcaccagatttttaaggaaagattaccctgaatctgagtgcttgttcaatgctgccttttctgctggccatctttattcgttagtgggtttggctagattggcctctctgaggggtaataagcattttgctctcaagttgctagactctgtgatgtcatctcggtggcctcttggatggatgtatcaagagagagcactctatttggatggtgataacaagttagaaaatcttaacaaggctactgagttggaccctacccttacatatccctatatgtttcgagctgcatctttgatgaaaaggcaaagtgttgaagctgcattgatggagataaaccggatccttggatttaaactggtgctggagtgcttagaactaaggttctgttgctaccttgcccttgaggattatagggctgccttatgtgacgtgcaggcaatcctcactcttgccccagattatcgtatgattggtggccgggttgctgccaagcagctgcgaatgctagtgctagagaatgtagagcagtggacacctgctgactgttggatgcaactttatgatcgctggtcgtctgtggatgatatagggtccctctctgttatatatcaaatgctggagtcagagactgccaaaggagttttgtactttagacaatctttgcttcttctcagattaaactgtcctgaggcggcaatgaggagtttgcagcttgctcgtgagcatgctgcaagtgatcatgaaaggcttgtctatgaaggatggatattgtatgatactggccactgcgaggaaggactgcagaaagcggaagcatcaattgcaatacaacggtcatttgaggcattttttctgaaagcttatgctttggctgattcgagtcttgatccttcgaccacagcaacagttgtatcacttctagaagatgcattgcggtgtccctcagatagacttcggaagggtcaagctctaaacaaccttggaagtgtttatgtggattgtgggaagcttgacctggcagctgaatgctacattaacgccctaaagatcggccacaccagagcgcaccaaggccttgcgagggttcatttccttcggaacaacagagtcggtgcgtatgatgaaatgaccaagctgatagagaaggccaggaacaacgcgtcggcatacgagaagagatctgagtactgcgagcgggagctgacgaaaacggacttgcagatggtcaccaaactcgaccctctgcgagtctacccctacagataccgtgctgctgtgctgatggacaaccacaaggagaaagaggccgtcgcggagctgaccagggcgatcgccttcaaggcggacctgaacctgctccacctgcgcgcggccttccacgagcacatcggcgacatctcgagcgccctccgggactgccgcgcggccctcctggtggaccccaaccaccaggagatgctggagctgcaccaccgggtgaacagccaggaaccatgagcggagcgccgccatggtgtacatacaggacgtgataggaagcccctcatagccaaccccccgccataccagtgtatgttttgtaccatacacagcatgtcaatgtaaggatagtagaaaagccactttaggtccctccctggctccctccccttgcaaaccaaacacctacattccttgtgtgcctagttagatatgttgtttgccatatagcctttcccttagtaaattattgttgtcgactgtgattaagcctcctaattgtacccgccacgtggcccgtgctgccagaatcaagaagttttgactgtaccttctgtatgtaaatgcaatgggggaaaaatgatgaatggaagcttttgtcaagcctgcaggcaacttgct

SEQ ID NO: 237 - DNA, 759 bp, Zea mays
gttcctgtagaagatgtcgacccgctgacattaaaccttgctatatcagctccagttgttgcgttagcttctccttctgcactgagggcatggctaaatcttatctcaaaatctgataactggaacaactccgtcgcctgcatcggtgagaccactgcgtctgcagcgaagaaactgggcctgaagagcatatattacccaacgacccctggacttgaggggtgggtcgagagcattctcgaggcgctcagagtccacaggacagcatcaaaagaggccccaaaacgttgaaaacgggcggatggcggagcttcttcttggcgttggtagccgtccgcagtgtcgaagaaattctttgcttctttgacgacaattgccccccgttgagggaggtggtggtgtcaagccatggctttccactggcccagtttgtaatggattcttgggccgaaaggcccatctctacatgtcttgactcgcaaggcgattgcatcagtccatccatccatttcatggagggttttagcagtgccgtctctgtttcgctaatcggtgatggcagccagccttgttgtactttgtgggtttgttgacgcagccggtcggattcttcttattgccggattggttgcgtaacgctaggtggttctgaatatcggcgacggcgaggctgtggaatctccgccctccaccgaagattccctgtcgtcgtttctgaatttaattaacaacatggcatgatgaccaatcaaagctcgc

SEQ ID NO: 238 - DNA, 2042 bp, Zea mays
tgcttgctgtgctgacttcattggagagagagacagtgaagagtagaggagagagagagagagagagagagagagagagagagagagagagagagagagagagagaaaatgggcgtggcgacggtgacagagctgaagcagagcatctccgggaagaggacattccggccgagcctcatcagccgccacgccaatgagtggcctccgaccgacgtctccagcgacctcaccgtcgaggtcggcacctccagcttcgcactccacaagttcccgctggtctcccggagcggcaagatccggcgcctcgtcgcggaggccaaggacgccaagctggcgcggctcagcctgcacggcaccccggggggcgcgccggcgttcgagctcgccgccaagttctgctacggcgtccacgtggacgtcacggtcgccaacgtcgccatgctgcgctgcgccgcgcactacctgcagatcaccgacgacttctccgacaagagcctggagctccgcgccgaggccttcctccgcgacgcggtgctccccagcatcgccagctccgtcgccgtgctccgcagctgcgaggcgctgctcccggccgccgaggacgtcggcctcgtgccccgcctcatcgccgccgtcgccaccaacgtgtgcaaggagcagctcacctcggggctgtccaagctggaccagtgcgcgcagctcaagcccgcggcggcgttcgccgacctcgacccgccggccgactggtggggcaagtccgtggccgcgctcggcctcgacttcttccagcggctgctctccgcggtcaaggccaaggggctcaagcaggagacggtcaccaggatcctcatcaactacgcgcagaacgcgctgcacgggctcatggccagggacgtgcacagatgcggcggcgcggacgccgacgccgtcaagaagcagcgcgccgtcgtggaggccatcgtgggccttctcccggcgcagtccaggaagagccccgtgcccatggccttcctctcggggctcctcaagacgtcgatggcggtgtccgcgtccagcatctgcagggccgacctggagaagcggatcggcatgcagatggaccaggccatcctggaggacatcctcatcgccgcgggcgccgccgtgggcgcgccggccggtcagcagcacgcgctgtacgacacggacgtggtggcgcgcatcttctcggtgttcctcaacctcgacgacgaccataacgaggaggacgacgggttcgactacgacagcccgcgctcgccgaagcagagcctcctggtgaaggccgccaagctgctggacagctacctcgcggaggtggcgctcgactctaacatcctcccgtccaagttcatctccctcgccgagctgctcccggaccacgctcgcgtcgtcaccgatggcctctaccgcgccgtcgacatcttcctcaaggtgcaccccaacatcaaggaggcggagcggtaccggctgtgcaaggcgatcgactgccagcggctgacgccggacgcgtgcagccacgcggcgcagaacgagcggctcccggtgcagatggcggtgcaggtgctctacttcgagcagctgcggctgcggagcgcgatccaggccgggggtggcagcagcatgggcgggcacgacggggcggtcttcttcgggtgcgccgcggccgccgcgtcggtgcagggcagcgtgaacatgcgctccggcagcggcgtgggcagcggcgccatgtcgccgcgggacaactacgcgtcggtgcggcgggagaaccgggagctgaagctggaggtggcgcggatgcggatgcggctcacggacctggagaaggaccacgtgagcatgaagcgggagctggtgcgcgtcggccccgccaaccgcctgctccggggcttggcgcgcagcctcggcaggctcttccgcatgcgccccgccgccgagccggggctgcagcagctcggggccaaggctaccgccgacgccaaggtgctcttccagcgccgccgccgccactccatctcatgatc

SEQ ID NO: 239 - DNA, 2724 bp, Zea mays
catggcctcccctcccttgagacgcaccaccaccccggcccagagcactgcactgcttctccctctctgttttacggaggacgaggaggaacaggaagcagcagggtgcaacaatggtgaagttctccaagcggttcgagggccagctggtgcccgaatggaaggacgccttcgtggactactggcagctcaagaaggacgtcaagaagctgcaggccgcggcaggagaggctgccgtggcggcgccggcgagggctccggctcactgggcgatgaggctgcccttcttccacccccttgggcagccgcctgccgccattcaggcatgcactgccactgtcaccaaatactacgtactgtaataataacatactaacatgcatatgccgcgtgtgcaatacaatgcaggtgcacaggaagctggccacagacaggagcgtcgacggcgcggtggccggggaggtgtacgatacggcggtggcggatggcgccgggttcgcggacgccgaggcggccaaggccttcttccagaggctggaccagcagctcaacaaggtgaaccggttctacgagagggaggagcgggagttcctggagcgcggcgagtcgctccggcggcagctgcagatcctcctcgagctcaaggctgccgtcacccagcagcagcaggcacggcgcggggggagcgctgccgacacggatgacccctccgtttcttggtccattcagctcggaggccaatctctcagggtaattgcagagaaagaagaagagtgtgaagaaaagctcaacggcggcgatgctaccgccaagataagcagtggtgaaggacccgtgtctcaaggtctcagtgaatctgggagactttgcaagccgaatgaagaaatgacgaggacactctccggccagggcaggagtgtgaggatcaacatcccggtcaccacgccttccaggactgtcaccgccatacgcgaactgctgttcggggacatgccgagccagtccaagaagactggcgcgcatggtaccgacggcagtgagaagctgagcatcaacaagaggaaggtgcaccaggcggagaagatgatcagaggtgctctggttgagctgtacaaaggactgggctacctcaagacgtaccggagcttgaacatgatggcctttgtgaagatcctcaagaaatttgacaaggttacaggaaaggaagtgcagcaaatttacctcaaagcagtggagagctcctactacaacagctctgacaaggcagtcaggctaatggacgatgtggaggagctgttcttgagacatttcacagaaggtgacagacggaaagcaatggtgtatctgaagccaaatcagcgggaagagtcacactgtactacgtttttcattggagtatccactggcggcttcatagcattgttcataggttactgtatcatggcacgcgttgctggaatgtacactcagcagtcaaacaaggtgtacatgtcaacttcttatcctgttcttagcatgttcagcctcttcttcctgcatctcttcatctatgggtgtaacatcttcatgtggagaaagacacgcataaaccacacattcatatttgaattcacgcctactaaagagctcaagtaccgagacgtgttcttgatatgcactgcttccatgacaattgttgttggtgcaatgtttgcgcacctggcaataattgttaaaggaaattcatcaggcgttgtccaagcgataccagggtccttacttctggtgttcttgttcatattagtctgccctttcaacatcgtctaccaatcaagccgttaccaattccttagagttatcagaaacatcattctgacacccttttataaggcaagttgtcatggttgatttctttatggctgatcagctctgcagccaggtaccactgctcaggagcctggagtatttggcatgttactacataacaggcagctacatgacacaagactatggatactgcacaagagttaaaaactttagagaccttgcttatgcagtatccttcctgccttattactggagagccatgcagtgcgcacggagatggtttgatgaaggggatataaaccatattgtcaaccttgggaagtatgtgtcagccatgcttgctgcaggaacaaaggtggcatatgagaataacaatagtactgggtggatgtcacttgttatcattgtatcaagtattgcaactatctatcaactgtactgggactttgtcaaggactggggtcttctacagttcaactccaagaatgcctggcttcgtaatgatttgatacttaaacaaaaatacatttatttcgtatccatgggcctgaaccttgtcttgaggcttgcttggcttcagactgtcatccaccctaatattggaagcctggattctagagtaactctgttctttttagcagcacttgaagtgatacgacgaggtcactggaacttctacaggctggagaatgaacacctaaacaatgcaggcaagttcagagcggtgaaggttgttccacttccttttcaagaagtggaagaggaataacaaaacagggccaccactggagcatgttgtaggttttaagaatacaaacagttcgtatgtaacacaccaactaatgctagaaagcatgcactacattaccataataagattcatttttgtatgagcaataaaaaccattccacgctgtt

SEQ ID NO: 240 - DNA, 914 bp, Zea mays
agactcgagtactagactagagtctcaactcttgagcaggggaaacgagagatccttggagtcagcaatggagtctaccgcgctaatgaccgcgagactaccactgctgacctctggctcccgttccaaacccctcccctttgcttccttcaccagggcggcttgccgtctcgcctccgccccctgctccggcagcggcagcgtcgtcctgctgtcgcgccggagccgcgattatgctggcgttggttccttggtctccgccgcggcggctcctggggatacggcggacgccggatccgagtccatcctgctcagcgtccaggggatgatgtgcgacgggtgcgccgcgagcgtgaagcggatcctggagagccaacccgaggttacttctgctaccgttgattttaaggaagcaagcgcagtcgtgtggacaacagatgaggccaaggggacacaaggttggcagaagcagtatggagagaagcttgctaagcaccttggcacttgcggatttgagtctcgcctacaagatgatcaacgaacgatcacgtgaagttacatgctagaagccaaagagtaaggtgaagccgaaccgatattgaagttcagatcagatgtcaccttaatggtcaatttataccaggatatatgttaaatattttgtctctatggattgcagttgtaggattagtctcggtgcttgtctggtggcataatactacatacctacctttcacatgatctttagctagattgtttcgaataggatgatgtcctaaaattgtaggtgtaggccactgttgcgaggaaggagtttgcggctgggctattgttaaatccggtcttcccgttgcttcgaagatataaagtgatactacctctataactcaaaataaatcgattttttaaactca

SEQ ID NO: 241 - DNA, 2564 bp, Medicago truncatula
acactctgctctgcttccttacttgcttcatcccgtgacttagaagtactgctgcttcggttcaacctgggtttgagtttgaagttgtgaagtgaagatgtttgggttctctcgtagacgcaccaaattcggaagatttaaggttcagcagctttctgatggtactagaagtccagtttctgttcggcatcccaaacgaattccaaactccattctcaatggagaaggagaagaagatgggattggggatgcagttaccggctcaagtggccattctcatgaaattgataatgaaattgttagcagcaccgatatcagtagttgtagctcaggcggatcggagaattgggtattattgtcaatttctggagataagcccgctcctagattcaatcatgccgccgctgtaattgggaataagatcatagtggttggcggagagtcttctactgggttgcttgatgatgtgcaggtgctgaattttgaaacattttcgtggacaacggcatcgtcaaagctttacttgtctcccagtagtctgcccctaaagattcctgcatgcaagggccatagtttggtatcttatgggaaaaaggcacttctcattggagggaaaacggatcccggaagtgacagaatttcaggttcaattcgtggtcttctcatgtatatttcacgctgtgaagttgctctgattatctttttggtgtttgcagtatgggcgtttgatacagaaagtgagtgctggtcactcatggaggcaaagggagacataccggttgctcgcaatggtcacagtgttgtcagggcaagctcttatttgatattgtttgggggtgaagatgcaaaaaggaggaaactgaatgatctacatatgtttgatctcaagtcgttgacttggcttccacttcactacacgggaacagcaccttctccaagattgaaccatgtagcagctctctatgatgataaagttctttatatatttggaggatcctcaaaatccaaaaccttaaatgatttatattcacttgactttgaaacgatggcatggtcaagagtaaaggttcgaggtttccatccatcacctagagctggttgttgtggcgttttgtgtggtactaaatggtatattacagggggtggaagcaagaaaaaacgacatggagagactctgatttttgatattgtaaaaaatgaatggtctgtggcaattacatcacctccatcttctatcactaccaacaagggtttcagcttggtacttgtgcaatacaaggaaaaagactatcttgttgcatttgggggatccaaaaaagagccgtctaatcaggtggaagtattggaattggataagaatgaatcagcacttagaagacgttcaactcccagtaaaggtcctgcgtctatactgcttgaaaaacattcatcatccactagattagcctctcagcttaatcactgttcccaacgcttagttgactctgttgctagacaaaatttagcatctgcagttgaacatggttctggaaggaaatctctttccgaatctgtagatcccaattaccccccaagcaatgtctcccttcgtaagcaatttgatcgcgatgaagaatacaatgcagatgtcaagatggacaagaactcagatggaagttctttacctcaggtggcagatcacagaacaaatgaaaatgaccgtcgtaaactgatgaacattagtggagccaaggttaatattgaaggacaagtgttgttgtctgggatgtcaaatcaacaaaaccaagtatttgaaagtgatgcactagaaagtgaagttgtgtcttttcctgagaatgataaatcaggatcactttcttctacaaatatctatcaatactatgaaagtaaagtagcagccctaataaggaaaaatggaatgctggagggtcaactggcagcttccatggcaagcagagaagctgcagagaaaggcttatcatctgtccataaaagcagacaggaaatggagaaaaaattggctgatgcattgaaggaaatggaattactgcgagagaagctagccggtctagagttggcccaagaagaggccaacaacttatcaaacattgtccactctgataatgttaggctcgagcatgatgtggccttcctcaaggctgttttagatgatacacagaaggagttgcactcgacacgaggagttattgcaggagaaagagctagggcattccaactacagtatgaagtttttcatcttaaacagagattgcaatctatggaaaatcggacatctactacacccaggaaaccgtttcacgtgcagtgaagtagataattggagcagctcaccacttcgttcctagtttttccgcgactttgtcatctctagaagcatctgattgtgtataattttgtcaaacattaggaggaaatatgtatattaagtgtatttgtatattcagctcgacctcttaagctctatctatccttcaattagcaacagtgtatcgagaacaactactaataacataacatattaagaagtcacagttaactagata

SEQ ID NO: 242 - DNA, 852 bp, Oryza sativa
gacctcatgtcctcatcatcatcaatggagtgcaccggaaacatgtcggcggcgccattgctcgtcttgacggtggcggtgctcgccgtgctagcctccacctgcgccgccgacccagagccgatacaagacttctgcgtggccgtgccccgtgccggcggcgaggcgtcgccggcatacccgggcttcccgtgcaagccggcgtccgcggtcgtctccgacgacttcttcttcgccgggctcgccgccgccggcagcacggacaacccgttcggggccagcctgaagccgggcaacgtggaggcgttcccggcgctgaacacgctcggcgtcgccatcaaccgcgtcgacctcgcccccggcggcgtcaacccgctgcacagccacccgcgcgccgccgagctggtgcacgtcatcaccggccggatgctcgtcgggttcgtgagcacggcggggaagtactactccaaggtggtcggcgagggggagacgttcgccatcccgcgcgggctgatgcacttccagtacaaccctgggaacgcctccgcccgcgccatgacggtgttcaacagccagctccccggcgtcgtgcccgccgcgacggcgctgttcggcgccgacccggagatccccgacgccgtcctcgccaagagcttccaggtggacgccgagatcatcaaactgctcaagtccaagttcaagaagtgacactgacgtctcatccgccatggctacagcatatctgttttgctttagctgtcctagatacagtaaatagagttgtttcacgtttgatattttggtccgatatttgcccatttggcacatcaataaagtaaatttgaattgtcc

SEQ ID NO: 243 - DNA, 1658 bp, Oryza sativa
attcaagtgtttgtacttggctttgctggcctgtttctgttttgattactcgagctccagagcacagcagcagagagacgcgagctgttcgtggtcgtcgtcgtcgtcgatggacgcggcgtggcgcggcggcgttggctgctcgccggtctgcctcgacctctgcgtcgggctgtcgccggtgcgggagccgtcggcggcgaggcacgagctgcttgaccggccggccggctgccgcggcggtggggattccaagtcgatgaccaatgacgaggcgaagatcgtcgaggcgaaggtcactcagatgagcgaggagaatcggcggctgaccgaggtgatcgcccgcctgtacggcggccaaatcccgcggctcggcctcgacggctcggcctcgccgccgcggccggtgtcgccgttatcgggcaagaagaggagcagggagagcatggagacggcgaattcctgcgacgccaacagcaacaggcatcagggcggcgacgccgaccacgccgagagcttcgccgccgacgatggcacctgccggaggatcaaggtcagccgggtgtgcaggcggatcgacccgtcggacacctccctggtggtcaaggacgggtaccaatggcggaagtacgggcagaaggtgacgcgcgacaacccgtcgccgagggcctacttccggtgcgccttcgcgccatcgtgcccggtgaagaagaaggtgcagcggagcgcggaggacagctcgctgctggtggcgacgtacgagggcgagcacaaccacccgcacccgtctccgcgcgccggcgagctcccggcggcggcggggggggccggtggctcgctgccgtgctccatctccatcaactcctccggcccgaccatcacgctcgacctcaccaagaacgggggagccgtgcaggtggtcgaggcggcgcatccgccgccgccgccggacctcaaggaggtgtgccgggaggtcgcgtcgccggagttccggaccgcgctggtggagcagatggccagcgcgctcaccagcgaccccaagttcaccggcgcgctcgccgcggcgatcctccagaagctgcccgaattctagcttcctttacaattctccaattcttcttacaggaaaaaacatagaggcgcatttcaatagagattagagcttaatctccccccaaatttgaaaattttatacagggtaagaattccgaatgcttttctgctgcttttaggatgtgaattgtactctctcataataacctgttggtccttgggccgtcggaagaagattgcgggcttctatcgggcctcacgatcctgagcccaattgcgaggctccttgagcttattaggcctcatgttcttctttatctctttgggctgcaaggtcctcgttatgcgcttgtgggcttattgggccgcaatgtcatcggagggattgttgggccgaacactccttatgtgggagctcagcccacccggcccaacttaaaaccattatgtccaaagcgtgaccaccaaaatctaaatgcctggttagcatttcacaaaccgaagaaagtaccagattcagtattcatagtagtttaatttaaataaaataccatgataaataccctagtcctgcacagcagatcggatttcaatcaccagagcag

SEQ ID NO: 244 - DNA, 1822 bp, Sorghum bicolor
ctggcgggcggcagctccggaggtgaagatgatccgtcttcagacgtacgcggcgttcagcctgctggcgacggcgtcggcggtgtactacgccttcagcagccgggagcagttctacccggccatggtctacctctccacctccaagatctgcttcgttctgctcctcaacacgggcctcgtcgccatgtgcgtcgcctggcagctcgtcaagcgcctcttcctgggctcgctccgggaggccgaggtcgagcgcctcaacgagcaggcctggcgggaggtcgttgagatcctcttcgcagtcaccatcttccggcaggatttctcggtctctttcctcgccatggtcgccgcgctgctccttattaaggcactgcactggctggcccagaagagggtcgagtacatcgagacaacaccttcagtgcccttgctctcacacatcagaatcgtctccttcatggcgtttctcctcattgtcgactgcctcttcctgtcaaactcgctcaggtcactcatacagaagtgggaggcatcggttgccatcttcttctccttcgagtatatgatactagcaacatcgacagtatcaacatttgtgaagtatgtattctatgtcagtgacatgctaatggaaggtcaatgggagaggaaggcagtgtatacattttacttggagctgatcagtgaccttgtgcacttgtcactatacatgctcttcttcatagctatcttcctgaactatggtgtcccacttcacttgattcgtgagctatatgagaccttccgcaacttcagaattcgcattgcagattatgtacgctacagaaagatcacttccaacatgaatgaacgctttccagatgctacagcagaagaactcaatgcgagtgatgctacatgtattatttgccgtgaggagatgactacagcaaagaagctgctttgtgggcatctgttccatgtgcattgcttaaggtcttggctagagcgccaacacacttgccctacgtgcagagctccaattattcccccagacagtggacgttctgcatcagcacgacaacatggaggtcaacctggtgttcagcctgctgcaggtactgacactccagcctcagaagctgcgcaaggtgacaatatgagcaggcgccaagcaaaactcgaagctgctgctgcagctgcttctttatatggaagatctcttgtttatcctccagcaaacaccctaaataggtcaggtcctcagtctacatcaagtacaccacaatccgaagctagtaactccaatcaatcacagaaagaccaagaactccagatccaaaactcaagtgatggtttagcaccttcgccttttagcgcacatggtgccattggttcaggaccaagcaccagcaatcttgaaaattcactgcagaaggcacaggaaaactttataaagagccagatagagatgttacaaatccaacttcaaatgattcggcgcggtgctgctgtgtcggtgactaacagtgggaatgacgagcacaaaaggaatgactgaagctgtaaataggcaggcggaaatgaggacagaattaaacgacaagaattggtaaatacctagggggcaactgttacatgatgcctcgttgcccagattttgtactttcatgtttctgcactcttactgataatgtttcttttctctttgtaataccgctgatagatagaggctgtcgtgttgtaacaatggttagtttcacagtaattatgagattaaacaaaatccatctgccgataaatagaatggagctttttgatccgtgatataagatgtttg

SEQ ID NO: 245 - DNA, 2175 bp, Sorghum bicolor
cccacgaggtaaaagttttttttttccctctcctcctcctctgttaaacacgcgcagcgaagcaacgcagcagcaacaaaagagacgagccttttcgctcgccgctgccaccaccctcgtcgtctcgcctccgcctcggcctccgcacgcgcgcgcgcgcgggatctcgcgcgggctcgctagactccccgcgggaccagcccgcgcgcgcacgcgcaccgaggagggcgcacccaccacccgcagggtttgggggcgggggcgatccggcggcgatggcgagccgggtcaaggaggacgagcggcacgagaagatcatccgcggcctgctcaagctgcccgccaacaagcgctgcatcaactgcaacaatttgggaccacaatatgtctgcacaaatttctggacctttgtttgtaccaattgcagtggagcacatcgagagttcacgcatcgagtaaaatcagtttccatggccaaatttaccgcacaagaagttactgcccttcaagaagggggaaatgagcgtgctagagaagtatttttcaaggaatgggatcctcaacgaaatggataccctgacagcagtaatgctgacaaattgagaaatttcatcaagcatgtgtatgtggaacggagatacacaggagaaagaagtactgataggccaccaagggcaaaggatgacaaggatgagtatagtgaaaataggagatctgatgggaattggggtggttcaagaagtccgccaaatggaagttactctgatcgtcggagttatagtggacggagtgatgacagaaattccagatattcctatggggaccgtagtcctggctatgaccaaaatgactataagaaaagtcctcgctactttgaggttgtcgatgatagatctggaaaaataactccagttcaaaggtttgaagaccggaggttttcggagcccagaaagccagatagtgggtctccagacttccagaaagaagctgatggttctagtcctgttgtacggccagtgagggatatattgggtgacaacgctcctcagcttcgggttggtgagccttcaaagccagctgctgaacctccaaagccaagtgtagtcagaccacttgatcctccaaagtcaagtgtagtcagaccaattgatcctccaaagccaaacggaaccagggcaattgatcctccgccactgacaaagacaatatctagtgccagcagcattggttcttcagaagggacatcggaacagacaaaggtggcaactgcagtgagtttaattgattttagtgcagatcctgaacctgcatccacagcaccaccacagccgacccctatgccacaacagcctccagttaatgcagcagcaccacagcctgttcttgaacaagggaagagtgctccttctgtcagcggtggtgactgggcatcttttgatgcttttggccaacaacaaacaccacaaacaagcaccagtgtaaatcctcttgagtctgcacttgcacagctgtcattctccgaagcaccctctgcaccgaatgcgtcagcttatcctgcttctcttgatcccactgtgaaagcaaatgatggaggacattcatctgtgctagaccattcacattccttgtttgatgcgccctttggaatctcaggcaaccaggcctcaacagtaatgtctggccaaggatcatcggttcaacaatctcctctagctgcccctacggctggatttccatctcaagctactgcaaatccgcaaggaatcagtggtattcaaggagcagcctcttctactgacagtaaattcagtggcaggaaagaacttccagcggatatcttcactgcactatatccaccatcaactccaatgatgcctggttggcagagagctccccaatttggaatgggatacgccatgcaatatccagctggagtgttccagggaatgcaagcatatcctcatggagcatttcctcagcctacatatcagcaacctatgtattcgcaacatgcatattcccacccccagcctgtgaaagcttcgaacccttttgatcttgggaatgagtcagctccaattcaagctcacatgcccccatctgggccaccaggagcatcagcaggcctagcttctgcaaccttaattggcaactctagttttggtgttcctccac

SEQ ID NO: 246 - DNA, 2282 bp, Sorghum bicolor
tgtttttaactttttaagatatattttagccttactctgagaagttaaaatgcttatgttatgattatttgtgagtttttttattatatagcatgcatgattatgtttccttctataataagagatgtctgtttctctgctcatcagctgaagcacagaactttaagcagtttttgaagttcttacctgggaattgagtagccttctgattttattatgcttcataatatttaagtttagtgttgatttattttatatctgatggtatgatttatatgccaatttgattgctgttgcagttcatgatggcctcatagttgcaactaacacttgcacagtactttctatatgttcatgttctgctaggacaaccatgaatcagatgccagaaaccataagtggctcacagttgggatgtaatgtttaaatttgctagatacaaactttccatggatttttctcagaagcatagaatggagatgtagaggttccagcatagcctattctcatgaagtagctaatattctctagttattttctattgcattccaacttatgttgtaccatttcatctgtctctgatttttctttctgctctgaaactttccatttagcaagcatgataataaatcttctttaaatccaaccaggaggagggaataactaatgatattccaacaactcttcataggagcaaagctgattgccctgtaccagaggagatggtaactgtcagcgtggatggttctgtacttgacaggattgctaaaattatgacataccttcgacttggatcttcagggaaggtcttaaagaaaaagaaaaaagagagagatataaaagggaagaacaatttggcaagcggtgactatgacgaagcagtaaaaccttcacaaactaatggttctgctctgaaacatcaatcagatatgccaccaccatcagctccaccccctcggaacaataatttcaatggaaaggagaaacaatcggcccctattgctagagcagacgatgatgacatttttgtcggagatggagttgattattcagttcctaacaaggaaatgagccaaagccctggttctgaggatatggaggaatcaccacataaccatcagaagcagtcctatttcactgaacccatgtatggcccagtaccaccatctgaatctgctcaggcttggcaacagccgaatgagtatgatgctgctcaagcccagatgatagctgctggatatcaaggcgattggtcaggctatgtgtatgcagaacagccattgggttatcaagaacagtatgcgcaacaaagcactcaggaatatgatgtactggctgaccctagtatatcccaggatccaaggttcatgactcaagcagacaaggatcggggtctaggttctgtttttaaacgtgatgatcaaaggcttaatcagctgagggaaaaagatgcacgggagagagatccaaattttatttcggatagttactcagagtgttatcctggttaccaggagtataataatgagatcgcagggagtgatgatgaagatgatttatccaagatggatatgggtggacgggctaagggccgtcttcacaggtgggattttgagacggaagaggagtgggcgaagtacaacgaccagaaggaagctatgccaaaggccgccttccagtttggggtgaagatgcaggacggcaggaagacgaggaagcagaacaaggaccagaagctcacaaatgacctccacaagataaacaagatcctggctcgaaagaagggtgagaaagatgggggcgatgatggcggtcattacgatgatgatttgcctagcgcaaagaaacaacgtggctgaagttagtcgatcatttttttgtttctcctagcaatggtgtaacttataatgtactagttacagcaccatgtttagctggcagctgtgttcaaggtgccactgccagcgtgaaatgtgttgacctcttgagctgaaaatatggaagaaatatgtctgtatatgtaaccttttcttgattagaaaaaggcaaagccctttttgcaatgaatcagttatgtgcactgtccgaaggtgtcgtgttgcaggcatttataatccggtgaagttgtgaatagctgttgttgaaggaatgctggcaatattatcatctgcttttggaaaccctatcccctgctgcttttgttgattctattctgtactttgaacgaatgtcatgtttttacatgccttctaaatgtgcactcctcattttccgaatcccat

SEQ ID NO: 247 - DNA, 828 bp, Sorghum bicolor
ccgcgcggctgccgaacgctgactgtgctcgcccggagcccgtgccgcggggcgccatgcacgcaacggcatagccggtgcacgctccccgctgcgcctcgccgcgtgccgccacacactgcccgcgccggcggtgcgctataaagcccaccacacgcggccactgcctctccgtgcaaatcggaacaaacaccagcgacaccacaggtagctagcagcctagcactagcataccgcatccacagctcccatcagccacagtagcagcttcttcgttctacctagctagactcctctagagcaagcagctatcttgccttagaccaagcaagagcttagcttgcttccctctcactttggtagcttgcaatttgctcgatcgcacacactgcgatggcaccagtgtcggaggcggctagctacctcgagctcgtccaaggcggcagcattgcctcctcgtcgggcgccgtttacgccgcgccatgggatgggcgctgcagcgcgcggggaaggatggcagagaccgacagcgacgacgatgacgacgactacgactgcgctcctgctgcctgatcgagaatcaatcgatcgttcgggtgaaactgatctgtgttcagtgttctgagataatgagatgtgctgcgcgtacgaggcgcgcggtaggcgaaccgacgaagagcatgcgtactactattactccagagtagagtacgtgtgctgcttcaagctaataaaattttttgtttaatttctactcctagtaggtacgtaggtatatatgtatttcgggtagcttaattatgagccagtgtggttttcgtccgggga

SEQ ID NO: 248 - DNA, 2011 bp, Sorghum bicolor
catgcctggctgcaccacgccaagcccagcatcaacaaccacaaccgaggcagacaatgccgaggatctctccgaggctgttgctgatgatgcagtccttgcttacatcaaccagttccttcttgaagatgaggatgaggagtcctatcctgttaccagtgtgcctgtggaggattcagtactcctcgccgctgtcgagaaaccattcgtcgacatcctcaagtctgctaaccatatcacagcaaaggcctatgaagtaaaatcctggatcactgatgattgccattccacgggaagtggaagatttcatgatgtggtcacaagtactctggactccacccaattggcccctgaaatggttcaaggggatgtagttgatgctgttcataagggtcagaagaacccacgtgacaatgacttggaggtggagaggaggaagagcaaacagtccgcattgtgtgatgaggagactgtccgagagatgtttgacaaagtgctgttgtgtaccgataagaattgtgcgttccactcaccaatgccagccgatgcacaaaacagcgggggatatgtgaaaggatctggaaatagaagagggcgaaggaagggaagatccggtgctggtgcagagcaggagccagtcgatctcacaaccctacttattcattgtgctcaggccgcggctattgatgaccacagaaactcaagtgagcatctgaaacagattaggaagcattcttctgctactggagatgctggccagagattggcacactactttgctgacgggctcgaggctcgcctagctggcactggtagcagcatctaccgttcacttgctgcaaagagaacttctactggtgatatgctgaaagcgttcaatttatatgttaaagcatgtccatttaggataatatcacactatgttgcaaatacgaccatcttaaatgctacgaagagcgtgacaaggttgcacattatagactacgggataatgtatggtttccagtggccaatcctcatgcagcggctctcaaagagatctggtgggcccccaacccttcgaatcactggtatagactttcccctgtcaggattccgccctgcagagcgtgttgaggcgacagggcgacggttacatgagtatgcccgtatgttcaatgttccgtttgaatatcaggccattgctgccaagtgggatactatccaagttaaagatctcaatataaagagcgatgagttcattgtcgttaactgcctttaccgaatgaggaacatgatggacgagacggcaacagatgacagcccgagaacaagagttttgaacacaatcagaaagttgaatccccatttgttcgttcatgggattgtcaacggtacttacaatgcacccttctttgtgacacggtttaaagaggctatgttttttttctcttcaatctttgatatgcttgaagcaaatgcctcacggatggatgaacataggctgctgatagaaagagaattctttggacgggaagctattaatgtgattgcttgcgagggtacagagaggattgaaaggccagagacctacaaacaatggcagatgagaaacctcagggcaggcttcaggcagctacctctggacagagagataatggcgagagcaaggtacaaggttagcaagacctatccgagggatttcctcgtggacgaagataacctacaaggttggaagggtcgtgtcatatatgctctttcagcatggagtacctagacttgtaaatcctagttagcttagctgacatcttcccttaatatcttgatttttcactatttcattttgttgtattatgattacgttaatgaatctgtccctcgtctaggaaccaaaattttgtaagtttgaattgactgccataaagatttttgtctgtgtgcctgacatatttgccgaatagtgtaagaggtttctctttgtccctatatatcatataggacagaagacagtagcatttttttttgggtatca

SEQ ID NO: 249 - DNA, 2566 bp, Sorghum bicolor
ttgtgtgtatatatacacatacacacgcagtgggagtggatacagagcagttggatcgaagagaaagggctttgctttccgttttcctctccaaatggctcattagctcttgaccggaagagtgaagggtggtggtgtggtgcgggtaggggtagatggttgccactcgttggtgtggacagtgctgggttccttggagcttagcgtgaacttcagaagacgccatttccttggtcttggatcgtccggactccggagctctcactcgtgctcggcttcttcctccctgctactgagttccgggcgctggccactaggcaacagcaactgatctctctctgccacggcatggaggtggaggctctggagaagaaggggcacacagcttttgccaaggcgatgaaatctttcagttcttcagaaaggtacaagcgatccaagaggttggtgtctgcgggcttctgcatagttttttgttcagatggcaacaatgctcaaaatgtgattaagcggtttttgaatggcagctattttgaggatatgtatgctacagatgctttgcgttcttcagacaaaacaattgttctacctatgccgcaagttgtaaaagctaaggtgaaaagtgatatcagtaaggaagctcaacctgggaggggagcacaaagcaccttgagaaaggagattcttcagcttgagaagcacctaaaggatcaacaggttgtgcgtggtgcactggaaaaagctttagggcctaacgctgctcaagtcaacttgtcaccagagaatccaatgccaaaggcagctaatgaattgatacgggagattgccacattggagctagaggtgaagaatatggagcagtatctcctgacactgtaccggaaagcatttgagcagcaagcgcctgcattttctccccctgatgctgctcctgcattttctccacctgatcgacgggaagcttcgaagatgtcagtgagctcacgttccgggcagctccgggaaacgcccgtggcaatgaagtcttgcaagagcagaggggatgcagcgctccggtcaagttacccgccggtgcataagaaattgaatgatccattggcagattgctgcacatccgctcgctctgatagagcgattgattcagatgtcctccgctgccagtctgcgttgtcataccgtggagttttttcgtctaggatattgccttcagaggatgatagtcttgcaagggctcttcgctcgtgccattcacagcctttctcattcgtagaggaaggagagactggtgcatcaggaatgataagcttagcagagtatctaggaactaatgtagctgaccacatccctgaaactcccaacaacctgtcagaggagatggtgagatgcatggcggggatatactgcagacttgcagatcctcccttggttcaccatggctcgtcgtcttcgccatcgtcgtcgttctcctcaactagtgcaatctctccacagtatgtgggggacatgtggagtccccattacaggagagaaacaactctggactcccgtttgataaacccattccatgtggagggtttgaaggagttcagtggaccttacaacacaatggttgaagttcctatgattagccatgacagtcggaggctgaaagaagctgaggacctgctccagacttacaagttgattttgtatcggttggaagccgttgatctgaggagaatgacaaatgaagaaaagatagcattctgggtcaacatacacaatgctttgctgatgcatgcttatctgaagaatggcgtcccacagaacaatctaaagaaaacatccctacttgttaaggctgcctgcaaaatagctggacgtaacatcaacgctgccgttatccagagcattgttcttggatgtaacacacattgccccggacagtggctacggacgctgctttacccaaggatcaaaagcaaagtgagcaaagcagggcatgagtggcgagcctttgccgttgcacaatcagagcctcttttacgctttgcgctttgttccggcagccattctgatcctgcggtgagggtgtacactccgaagcggctgttccaccagctggaggcggccaaggaggagttcatccgggcgacggccggcgtgtggaaggagcagaagctgctgctccccaagctcgtggaggcatacgccaaggacgtgaagctctcgccgcagggcctcgtggacatggtccagcgctacctcccggagagcatgaggatggccgtgcagcggtgccagcagggcggcaggtcgtcgggcaaggtcgtggagtgggtgccctacaacccggccttccgctacctgctcgctagggacctcgcgttccctcacctcagctgaccctgacttaggtgttagtagtatatgcgtgtcatagggctagaagtagagaagggatcatgtgcagtttttgtgtggtgattatcaactgcgtagcttgtaaagatgcttttgtagatgatgaacagaagaaacaggggagaagaaatgagaagcacgtttgaccattgactctttgtga

SEQ ID NO: 250 - DNA, 2240 bp, Sorghum bicolor
tgtcagtacactcactacatatagcgacgtagccagcacaactactggggctcacacgagtgcagttagctcatcaagagccctcgtgtgtgtggtcgtcccggccgagaaccaaccaaccggtggacatggtgttcgtcggcggcgaccgtgccatggggggcgcccctggcgccgacgccgcgagcacgatgcggttcgcgctgcacgtcatgcgcggtcggtggttcatgttcttcgcgtccatcctgatcatggcggcggccggcggcacgtacatcttcggcatctactccaaggcgatcaagacgtcgctcgggtacgaccagcagacgctcaacacgctgagcttcttcaaggacgtgggcgccaacgtgggcatcctcccggggctcatcaacgaggtcaccccgccgtgggtggtgctcctctgcggcgccggcatgaacctggtgggctacctcatgatctacctggccatcaccggccgcacggcgcagccgcccgtgtggctcatgtgcgtctacatcgccgtcggcgccaactcgcagtcgttcgccaacaccggctcgctcgtcaccgccgtcaagaacttccccgaggaccgcggcgtggtgctcggcctgctcaagggcttcgtcggcctcagcggcgccatcttcacccagctgtaccgcgccatctacggcaccgacaacgacggcgccgacctcgtgctgctcatggcgtggctccccgccgccatctcgctcgtcttcatccccaccatccgcatcatgccgcggcagcgggacgccgccgccgccgccgcgcgcggggagcgccgccagcgcgagcgcaaggccttcttcctcttcctctacgcctccatcgtgctggcagcctacctgctcgtcatgaacgtcgtcgagctggaggtgatccacttccccaagacggcctactacgtcacggccgtcgtgctcctcctgctcatcttcttcccgatcgtcatcgtcgtcaagcaagagctcaagacctaccttgcggcggcgccggcgacggcgacaacctcgtccgccaccatcgtgacgatcaccgtcgacgacgagaagacgcgggcgtcgaacaataacgtggcaccggagtcgtcgtcgcccgatcaccgtcgtggccatcatcaggcggccgtcgccgccgaggccgaggacatcagccgccgctcgccgtcgtgcttccaggacgtgttccggccgccggcgcggggccaggactacaccatcctgcaggcactgttcagcgtggacatgctggtgcttttcgtggccaccatctgcggcgtcggcggcacgctgacggcggtggacaacctggggcagatcgggcagtcgctgggctacccgcagcggaccatcagcacgttcgtgtccctggtgagcatctggaactacgcggggcgcgtcgtgtccgggttcgcctccgagtacgtgctggccaggtacaaggtgccccggccgctggcgctcacggtggtgctcctcctggcgtgcgtggggcacgcgctcatcgccttcggcgtcggcaacgggctgtacgcggcgtccgtgatcctgggcttctgcttcggcgcgcagtggccgctgctgttcgccatcatctccgaggtgttcgggctcaagtactactccacgctctacaacttcggctccgtggccagcccagtgggatcctacatcctcaacgtccgcgtcgccggacgaatgtacgaccaggaggcgctccggcaggcgggcgggcggcggggcagcaaggacctcacctgcatcggcgtgcgctgcttcagggagtcgttcctcatcatcaccggcgtcacgctgctgggcgcgctcgtgtcgctggtgctggcctggaggaccaggaacttctaccgcggagacctgtacggccagttcagggaggtcggcatggccgccggagcagcagcagcagaggacggaaaggtgcacgaggccgaggcgagtagcagcagtggtggtggtgccagtgactctgacaccaaggacactgaggccgttaatggcagcaaggtctgaattgttgacgtgtagtcgtgtactgtagtgtctctgtcagggttaattgacttgacctgaatatatgcatatttgaactactcgccggcgccggccggtccaaaggcacgcgcggcgcggagctcccggcgtccggcgagccggcggggaacaaaatcgtaagcgatc

SEQ ID NO: 251 - DNA, 2699 bp, Sorghum bicolor
tgataatcaggtgagaggcaacctaaatatgtaaaagtgcccttcttcgcctcctccccgtcgctctctccctctcggtctccgtcccgacgccgcgacggccgacgcgagcgggcgccctcctcctccacgcccctccccccctcgcgctatatgacacacaaagtgtaggtgctcacctgagctctaggcaaggtcaccgtattgctcgacgtttggcacgcaacctgaactcgtctcgcccgcggccgatctcctccatccgctcgccgcgccgcaatccggagaggagactacgctaggtcgagcaccacctggggctcagcgttctcgcaaccagttccggcgcagcgtccgccctctgcagccactcgccacctttggccggcgacgagcaccaccaggacagcaggttgcttcagagactaagctgatgaagcatcctaattgggtccacgttggcaaagaatcggtaactgacttaagagagcaaattctccgactcattgagcatgattctcacgatcaagaggaaaaatcacgggcagagctactggagaagctcaagagctgtaaaagagatacgctaattgaactgtgtcattcatttgatgtcattggctcaagcgctaataggaaggaggatctggtatgttttctgatggaatttattaaggatcagtgttctggtgatggcataaactctgataagaaattcaagaaaagaaggcgtgtaaaagaagacgaaaatttgtctactggtaaaccttcgaagaaaaagaaacgagaaggtgaagaggaagcagatgagaggaagggtgtggaggatataggaaaacattctgactgtgatttgatggacaacaaatatacatgtgctgatagtaagaagggattcccaaatgaacagaccaactttgatccttctgagaggataaatgactctatgtcacagaaagatggagcatcactcagcgaagcgccaattcttacagatgaacagttaataataaccacaccacctacaaagtttgttacagctgctacgggtgacagtattgacgtgaaggctttaaaagggaaaatgtcttctattaccaagaaaaaagcaactcctaaggaagattgcaaagtcaaattctgtggtaaacaggagtctaaaggagacgcaaaacctcgaaaacaggcaatcaaaccaagtaaggatgagctgagggaagctgtctttcttatcttggataccgcggactttgccacgatgacctttggagatgttgtaaaagaagtcgacaaatactttggcaaggatctgtttgagagaaagccactaataaggtgtcttatagaagaggagctctttaagctagcagacgaggctgagaagaaggaattggaagagttggaagcagcagaggcgaaggctagagctgagcaagctgccaaggagatggcacaagttcaaacagttgaatcgggtatcaacaagcaacatgtacttcaagctggtcgagatagcaacactaaagacagtctaaagaatgcaaatgacagtactaacaaaataagtatcgatggtggggcatctgtggagtctgctttcaagagaaacagctgttatgctgccgaaggttcaggcggccacaaagctgacactgatgcaaagaataaagtcataactaaggatggcaatggtgaaaaggttgccctcgcacccattgcaaacagtgattgtaccatacaactacaaggttcaagcaatgtcgtagctgagctgatgaataacaacaatgttgaaatcctagaagggtcaaaagatggcaaagtgaaaggcgctagcagtggagaaaacaatgacactgaagatggtagcaatgaaaaaaacaggagtgagaatgtcggtagcaatgcagaagctgccaatggttgtgaagctgaagagtctaacaatcatggaaataatgaacgtgtagaacacacagaaggtgacaaagctcaggaagctaaccataatgagaacagtgcaaatgtagaaatccatgctgatggagacggcgaagcaaaagaaggcgatatagatgcagaacagagtcaagcagacggtggcagcaataatacggctgaagatgctgagcacaatgagaacaccaaagttgatgatgccaattcaagcaagaatggtactgccgagaatggaaagactgatgttgatgtgaaaggcaacagcgatggcacagctgaaggaagcccgctagcgtgatgagatgggcgtagattgtaagagagttcgaataagatcccgcttatgtagattgtaagagagttgatgtagggtcccacgtgagagactatcactgatgccctaactcttgtatgatagcttatcatgcagagccatggcaagtgtaaggtctagaagcctagaacctagagatggccagattgtttgtattgtaaaatatgcacgggtctagcttgctcttgatgtgtatagcactggactactggaaacctagaccagggaatccatccagttgcgctgttgtatgttggaaccaagcaattcagagcaggatgtgtttccaaacattacctttgtgtatcagaaatccgaatggtctccttttgtgctctcctcggttcatcttgtggtggtggtggactgagtgcagtgtcctaggtggcaaaccggccatttgcgc

SEQ ID NO: 252 - DNA, 2186 bp, Sorghum bicolor
caccactctgctgctcaaaacgtagactagagtagctctgatgatgaagcacccaattgcaattgcaaggcttctctccatccgtcgtcttcttcttcttgtcctgcagcagctctgcctcctcgtcccgctcgtctccgttctatccgccgccgcagccgtcccgccgccgccgccggcgcaccggcgtccagaaggctgcccatcgaggtgcggcgacgtcgacatcccgtacccgttcggcatcggcgatcagtgcgccatcgacggcggcttcgacctcagctgcagtcttgtgaacggcacccactacaggcctttcagcgggccgttcgaggtgaccaacatctccatacccgacgccaaagcttggacgaagatgaacatctcatggcggtgctacgattctcgcaccaacccgacgacgtggtccacgaggagagagaacttcacacacacgcccttcaggttctcgcaccaggataacaaaatctttgtcgtcggatgcaacacgctcggctatatcaccagtgaatattatagcataggttgcttgtccgaatgctacaataaaccgaggaacatgagttcgtgctctgttggcagtggctgctgtgaggcggatgtcccaatcgacatggggtatagtcgatctttcttcaatccagagtataactacactggctgcggctatattgcagtgatggaagagaagatgttcagctatagcacgacgtatagggactcatcaacatcgttttttgatgcatacaacggcacagttccagttgtaatggactggaggattagacggtacacatgcgaggaggctaaattgaacatcagcagctcatatgcatgcattagttacaatagccaatgtgtcaacaccaccaacgggccaggctaccgctgcaaatgccaggacgggtatcaaggcaatccatacgtcagggatggatgcacaggcgcaagtgttggcctagttgtccttgtcgttaccttaacctgtgcatacttgatacaacaaagaaagctacatcacaccaaacagagatacatccaacagtacggagatatgtggatttttgagaagatgaaatcacaacaaggtttcaaaatattcacagaagcacaactccaagaagccaccaacaagttcaatgaaaaacgagtgctgggtcatggaggacaaggaactgtgtacaagggacttgtcgaaggcaacgtcgaagtagctgtaaagaggtgtatgtccgttgatgagcagcacaagagagaattcggcaaggaaatgctaatcctttctcaaatcaaccacaagaacatcgttaagctactcggttgctgcctcgaagtgcaggtcccgatgctggtgtacgagttcatccccaacggcacattgttccagctcatccatggaaaccatggcaggcagatttccttggcaattcgcatacagatcgcccatcagtctgccgaggcgcttgcctacctgcactcatgggcatccccaccaatcttccatggagacgtcaagtcatcgaacatcctcatagatcgtgactacactgcgaaagtctcagacttcggtgcttctatcctggcaccaacagatgagtcgcaattcgtcacatttgttcaaggaacttgtgggtacctagacccagagtacatgcagacatgccaattgacggacaagagtgatgtgtacagcttcggggttgttcttctagagctgctcacacgcaaaaagccattcaagtttgatgggcctgaagatgagaagagcctagcggtaaggttcatttcagttgcaaagcagggaaagcttgaggagatcttggacgatcacatcaagaaagacgagagcatggaggttctccaagaggttgcagagctagcaatgcaatgcttggagatgtccggtgcaaataggccgaccacgaaggaagtctccgagaggcttgatagtttgagaaaggtgatgcaacatgcacagcagcagcacaacaaccctgaggagatggagcccttgcttggagagtcatccttggcaagctctgatgaggtggttgtcagcactggaaatctaagcattgagatggaagctgccaggagtctagaacggggacgttgaccacaaattcaccgtctagtaaagtagtaatctcaaagtgtgtatg

SEQ ID NO: 253 - DNA, 1059 bp, Sorghum bicolor
cgcgcgcccccgatcaatcaatggcggccaaggtggcgtcgccgctcgcgttccgccgcgacgtgcgtggcccgctcggccggcctcatccgagcggcggctgccggagcgggaccgggatgccgggggtgctgtactggagcagcggcgccggcggcagcagggtgctcgcggcgcgggcgcgcgggcggaacaggttcggcggcggatcagggcggacggccaaggacgaggcggcggacgaggacgaggaggaggtcgcggacgtggtgatcgtcgacgccggggacgaggaggagttcgcctccgacgagctgtccgggttcaggggcctggttcttgatctctcctacaggcctgtcaatgtcgtgtgctggaagcgcgccatctgcctggagttcattgggaaggccgatgtgttggagtactatgatcagaccgtctcttcgcctagcggatccttctatatccctgcagttttaagggttccacagttgctgcaagtagtaaagagaagaagagtcaagcagagcctaagccgtaaaaacattctttacagggatgatttcacctgtcaatattgctcttcaggggacaacttgacaattgaccatgttattccgatttcgcgtggtggtaaatgggaatgggagaatttggtgactgcctgtgccagatgcaactccaggaagggtcagaagacaccggagcaggcaaacatgaagctgcttaagatccccagggcgcccaaggagtacgatattatggctgtgcccttgacaaaatctgcattcagaacgctcaagaggaaccatgggcttcctgaagtgtggctgcagtacctttccagaccatctccatgaccaaaactccaagagcctcctgatcttacgggccagcatctcagtgtatattaacattatactatgctgcgcacagccaaagactgcagatcctattctgttcaaagctctgtacatgaaaatagtataagaaataagaattgctgtaagctggtgcagaaccagcctaacaactcaaatctaatttaatttatct

SEQ ID NO: 254 - DNA, 709 bp, Sorghum bicolor
ggcaaaacaaaagcaggccattagccgcatattccaatccagacaggcgactgggaagataagccccagacttcggtccactcacagaacctctcggtcgcctggtccaatgcaactccaatccagcatggcgtctctggccctccaccccatcatcccggccaccgccgcttcatccacgaccctcgcggtcgtcgtcggctcccgccacgccgccacactccaccgctgctttcgcccgcggcggcgcctcatcaccacctgcaaggcggagccgagcgggggcaacagcaccgtggagctagccgcaggggccgccgggctggcatcgagcgcggtcgtggcgtggtccctctacacgctgaagacgacggggtgcggcctccctccaggccccggtggcgccctcggcgcggcggagggcgtcagctacctcgtcgtggcgggcctagtcgggtggtcggccaccaccaaggtgcgcactgggtcgggcctcccggctggcccctacgggctcctcggcgccgctgagggcgttgcctacctcaccgtcgcggccattgccgttgtcttcggcctgcagttcttccagcagggatccatcccgggtccgttgccatcagagcagtgttttggctgactctgtaactcattcggttgatgtttgttaccgagtgtacgctgctatatgctactccgtatctgttta

SEQ ID NO: 255 - DNA, 1869 bp, Sorghum bicolor
aagcgcaaagtgaataggaacaaattagagccaacggtcaggcaacaagacatgagcatctgaagtactcaatccatcccaaatttgtgcacaccacacacgggcactgcgctaaagttagcactagcagatcggccggacgacagtcctagccagtagctagctagcaatggttgaccttcgtctccaggtcgtcgccaccgtcctgggcatggtggccctggcggccgctgccggcggcagcagctccagcggcaagcagtccgagttccaggaggtcaccgtggacgccatccatcagggcttcaagaacggcagtctcacctcgacggcgctcgtccggttctacctggaccagatcgcccgcctcaacccgctactccacgccgtcatcgaggtgaacccggacgcgctggcgcaggcggcgcgcgccgacgcggagcgctcggcctcccgcggccgctgcgccgtcggcctgcacggaatccccgtcctgctcaaggacaacatcgccacgcgcgacaggctcaacaccacggccggctccctcgctctgctcggctccgtcgtcaggcgcgacgccggcgtggtggcacgcctccgccgcgccggcgccgtcatcctcggcaaggctaacccttccgagtggtccaacttccgccccgtcgagtccggctggagcgcccgcggcggccagacgctgtgcttgctatgcgtgaaattacagaatccatacgttctgtccgcgacgccatgcgggtcgagcgccgggcctggcgttgccgcggcagccaacatggcagcggtgacactgggatccgagaccgacggctccatcctctgcccatcgtcgttcaactctgtggttggcatcaaaccaactgttgggttgacaagccggtccggtgtcatccccatcactcctcttcaagacactattggaccaatgtgtcgcacagtatccgatgccgtccatgtgttggacgtcattgtcggctatgacgagcttgatgctgaagccaccggagcagcatccaaatacatcccgcacgggggatacacgcagttcctgaggatccatggattgaagggcaagaggatcggtgtcctcgacgtgttctttcaaggatacgatgacatgcaattggcggtttacgagaagcatctcgatacaatgaggcaacaaggcgctgtcgtgatcaagaatcttgacattacaacaaatttcactgatctgggtgagcaagagattctgctcatggctgcagagttcaagttaagcatcaatgcgtatttgtcggacctactgtactccccagtccgctcccttgcacagatcatagccttcaacaaagcacatcctgtagaggagagactcaaagattttgggcagccagacctgattgccgcggagaaaaccaacggcattggcaccagggagagagctgccatccagcggctcaaggagatatccaccaacgggttggagaagctgatgaaggaacaccagctggatgcgatcgtggcggccaacagcgacgcctcctctgttctcgccgtcgggggctatccgggcatcgccgtgccggcagggtacgacaagcagggagtcccatttgcaatatgctttggtgggctcaggggctacgaaccaaggttgattgagatcggttatgcgttcgagcaggctaccaaagtcagaaggccaccaacttacaagagctagcaaacaagattgtaactagcatgatggcacgccataaggaatttaattgaaataattcagtggaaacaagcaccttgaaaaagctttttggattgtttttatttgaacaatcacttgatatacaatagaattattcattgtga

SEQ ID NO: 256 - DNA, 2326 bp, Sorghum bicolor
atggaaaattcagacgccagagcggttcgccgcgtgagatgccccaggtgcccctgcgttcttgaggagccccgcgctccggtgtaccaatgcggtggatgcggcgctacccttcgagcaaagaaccgcaccggcaccggcagcgcgggagacgcggccacggcgtcgccgtcgcggagcggtctgcctcctcggagcaggcacctggacgccagcgacgtcgcgagcaccagcaggtccagcaccccgactcctcctcatgtcgcgagcaccagcaggtccggcaccccgccccctcctcatgtcgggaccagctggcaccgagccaccaccgacgcgacaagcagccggcacggttccggtgatctcgctctcgtgtcggccgggacgcgtgcgtccggtgacgtcgcgagcaccagcagtactcctgacgccaccgcgagcagcaggcgccaaggcaccgacgcgacgagccggcgcgggtcgggtggtcctgtgtccgccgcgaggagccgtgcctccggcgatgtttccagcaccagcagcacccctgacgctagtgccgccatgagtatcgggcgtccgggcgcggacaccacgagccggggcgagtccggtggcccggcgaggaatcgtgtccctgagcaagtggcactgatcgagaagagaagccgcgaacagatcgcggtcggtcaggaagtccgtgacgactctgaaggctgcggaccaagtgatgccggtggtgcagagtcgggcgtcggtggtgccggcttctccggaggaaacagagaggccactcctgaatcgcaggatgacacagagaaggggatgaaacgccaggccgaatcgaccgatgctgcgagaaagaaacattctggtgaagctgctgtgcagccgcagaacccccatgaccgtcgccaagaacttgcgccgaagtcatcagctcaacccgcagctgctcaacctgcacgggatgatgccggcgagaaggcgcggagtccatctcgccatgagattcaagaagaacatctggggcccttgcggaagaagattctgaagacggtggatgagctgaaaggcgacctctctgaacttttcaccaagtccccagagctcaaccagccacgcgcgcgccctgctcgtcttccaaagcaagaaggctacgtgtctcgtgcggcggcggcggcggcctcgggcttccctgccagagctcgtcacgccgctgctgctaccgacggtcaccgtggtcaccatgtcagcgcagctcgtgcggtgaagccccgtcaagccgctgctcctccccgtggccttccgtcacggcgctaccgtcagtgcagagcacacccgtgctgccatgacgtggagccgaggccgtgccatcacgggcacggctgctgccgccaccacggcaaaccggagtgcagcagctgccgaggatactgctgcaggcccagagcgcaggagccgtccgcgccgcggaagccaccggcaggcaaggagcccaagcggcgcctgccgccccgcaaccactgccggccggtgctgaagggcgcgccgttcatcgtctgctccagctgcttcaagctggtgcaggtgcccgccgacttcgccgtctcgaccaggacagtgcgcaagctgcggtgcggctcctgctccaccgtcctctcctactcctacagggacccggccaggaagaaggcctaccaggactccgtcgaccagtgcagcatagacggctccgagctgcacgtcggcaaaggcgacgaacgatccgacccgttcgcgccgttcatcgatgccttcgggctcagcagttactcgacggaggacgaacagcggctgcccgtctcgaggaacacgtcgttcgacaccctcgacgggacgaaaggcgtggggcggctgcatcgactgatggggaaagggaaaggcgtttgcatcgacgacggagacggcgacgacgactacgacgtcgatgactcggatgaggaagacattggtgcgctgaagagatcagcgaggaaagggtccggttgggcgctcccatggatgcccggcaaggggactccagcagcgggagccatcaggatcaagtaaatagcagcaaaggcttgtgtatattgcaggaataggttcaggttttggaattcgaatgggaattcttcttattataggtatatatagtttgactattcattttaggtgcggtattggatttataggctgtttgtttgccattttttgaagcgtgacaatgctgtataatgaaatgtgtaaatatccagcattgagagtctgagaaagaataagcatcatggccttgtttggg

SEQ ID NO: 257 - DNA, 1682 bp, Sorghum bicolor
tcccatccgcttcgccccttgtcccccctcagctcgccgccacgcctccgtcctgtcccgtgccttctggcaccacctaccatggcgacgctcccgagcgccagccggtggtcgtcgtccaccgcgtggccacggagggccgctggagcggcgtcgacggcgctggccgccgccgtcttcgcggtcctggacgtcgccgacgcgctcctgtgcttcgtgtacgccctcctggatggcatcctcgaggacagccccgtgcgctgctactgccacaggagctacgacgaccaagtggatggcggcgaccacgagcacgaggaggtctccggtacgctgtacgcgcgcggccggaggagcgccgtcagggacgcgatcctgtacctcctgcgacacgtcgtcgggaggaggggacgggcgccgccagatgagacggtggcgccgtgcaagtggcgcagccccaggtggtcagactgcgcgtgcaagtcgtgcgtcgcatggcggggcggcgaaggcgaaggcggcggcggcggcggcgaaggcggccggcttcacgtcgtcgtcaaagagccgcagccgtatcgaaaagatgcaggaagaaaacagagtgagacgacgaccactcgtgaccccgagaacgccatcttcgtgcacggcttcacgtcgtcgtcgtccttctgggcggagacggtgttccgggagtcctcctccgtcctccacgactacaggttgttcgcggtggatctcctcggctttggccgcagccccaagcctgcgaattgcaagtacagagtgagagaccacgtcgaggcgatcgagaggagcctcggcgagccgccgcagagcctgatgagcggcagcggctccttccacctggtcgcgcactccatgggctgcatcatcgccctcgccttggctgccaagcacccgacccgagtcaaatccatcacgctcgttgcaccgccgtacttcctggcgtgcgagcagaagcaggcgagccaggtggcgctcaacaggctggccgagaagaagctgtggccgccgctgctgttcggctccgcggtgatgtcgtggtacgagcacgtcggcaggaccgtctgcttggtcgtctgcaagaaccacctgctctgggagtggctcttcagcctcttcacgggaaacaacacgggcgtggatttcagggtgagggatctgacgaagcacacccaccactcggcgtggcacaccatgcacaacgtcatctgcggcggggcggcgctgcaggacacgaacctggaggccgtcgcggcggccggcatcccggtgcaggcggtccacggcgccgacgaccaggtggttccggtcgagtgcagccgccatctcaaggcgaagctcccgcgcgccaagctccgtgtcaatgtcatggacaggcgcgaccacgcgacggtggttctgggcagggagagggacttcgccgaggagctcaaggcgttctgggtctgggggtcagcaactccttcaacgaagcggaggttcagaggatgctgattgttagcagggccacgggccaagtagtagcaggccagagtgcgttcttgggccaagcccaaaggcttctccgatccttttcttaaagggccttgtttacttcgaaaagttttgtaaaatagaaatagtatcgctttcgtttatatatttgataaata

SEQ ID NO: 258 - DNA, 1557 bp, Sorghum bicolor
aatagcccggggccagcccaagaaaagtcagttacccctcttcagtttagcccagctgcggcgcatatgaatgaggtctccttcagcccagcccagaccagcccgacccggccgttccaccctaacagaggcaggcgtcgcagcgcgctcccgactcccgagcgagtagcgacgacggcgcctgcgtcttccgtggcggcgcccctacccctcgaacccgtccggccgacctcgcctcctcggctagctacctagccgccgtgcccaccagcgtccactggtcagcaggcgcccagccctcagccggccaggcggtaggctcctagcccccaagcgaccgcagtgccccctgcaggctgcggcctagcccttgcccggttgccccctgctgctgcacagtgagccagacagcaagctttgtttctttccattcagtagcgtggagatcaaactagccaagggcagcccaaatttggggatttttcaagtgaatccccctgtatagagatagttcgaagatgatgaaccagcacagagaggaggatgccttgagaggtcaagcagtcaaaaaccagaaggcgatatgggacaagaccctggaaatgagattcttgctgcagaagggattttccacttccaacaagttgccccaggaacccatcagaacaaggttttgcaatcatgataagcagatagagcaagcctatgatgatctgttgaattcatcaaagcagactttgagcagcatgatggagctgcaggaggctttgctcgagagtaatcaggctacaaagggtgccaatgaaattccttctgccgcaaatggagacaatgacgagtggtcagaagtacagagattgcagacaaggataacaacattcagaaatactgagatagataaatggcagaggaaaatacaggtgacaacaggtgctgctgcacttaaaggaaagctacatgcatttaatcagaacattagtgaccaagttgctggttacatgagagatccaagccggatgattaacaggatgtacttgtccaactctgctgttagtgtatttggaaaggatgtgggagaacccagaacagctgaggaggggcacattatggaaggtgatcctgaacttattgacgattctgagttttatcaacaacttctcaaggagtttcttgagtcatgtgatagaggggcctcagagtcggcactttatgccctaaaaaagcagcaggttaaaaagagaaagcttgttgatcgtcgtgcttcaaagagcagaaagatacggtatcatgtccatgagaagattactaatttcatggccccagagcccatggttgttcctccaatggccccgaagttgtttgagaatttatttggcaatggcaactagaatcaacttaagcttggattcaaatgtcacattacttggtgcagcttttttgtacttttataaattgcagtaggtatgatgtcactagacttgggactgagttgaaagttttgatggcctcgtcagttttgtgcgtagagtaaaacagaaattatacttcgatttgggc

SEQ ID NO: 259 - DNA, 1292 bp, Sorghum bicolor
agtcgccacagcctcgcctttgattggctcccctccctttcgtcctcaccagagacgaacccctcctcctgctgctgctgttgtcggctccggagccatcctctgctccgaccacgcaaatccccgaccccgaggcagacaccggccaggccccgcgatggcaaagaccaacgacaacgacgccttcagtccccctgtttcccaagaaagggttgtggtaacaaacaaacatggtgagaggcttgtggggctgctgcatcacaccggatcaaacaagattgtggtcttgtgccatggttttatatcttccaagaatgacagcctcattcttgacctagcggcagcattgacaaaggaagggatcagtgtcttccgcttcgatttcagtggaaatggagaaagcgaaggtcagtttgagtatggcaactacaggaaggaggctgacgatttgcattctgtcgtattgtatctctatcaaaaaagttacgatatagcagctgttgttggtcatagcaaaggaggagatgtagtgattctatatgcttctatttacaatgatgtcagcaaaattgttaatttatcaggccgatttgatttaaaacaaggcattgaagaacgaataggggaagggtctatcgatagaataaataaagaaggctaccttgatgtcaaggacaaatctgaacatgtcaactacagggtaaccaaagaaagtttgacggaacggcttaatactgatatgcatgctgcaagtgtttccataagtaaggaatgcaggttcttaactgtccatggttcagctgacaagaccatacctgtagaagatgcccatgagtttgcgaagcatatacccaaccataaactgcatatcatagaaggagcaaaccataactacaccgcacatcgcaaagaagttgctgatgcagtagtagatttcatcacgtccgatggggtttaaggctgaggagcccacgtctccaaggtgaatgttcattccagactgtttaacacttggtcatacacctattcccattggtggacatgagcggtacagctccaaattggacccttcaatactagggcaataatcgacacagacttgcatggtactaggtgtgcattatcttctgaaccgaaaaaactcatgccttgcaggtttgagtgtttttttttgttttttttttgaaacgaggtttgatatgatgttactggtatgtgctttaagaattcctataaatatctaactcctggtaggacttgtatgtcgctgttgtataactgatgaagtttca

SEQ ID NO: 260 - DNA, 2869 bp, Sorghum bicolor
ccctcatcgtctcggttacaacgcagacactgccgccgctcgcagacactactctgctctctctcaatctccctctctcatggcggactcctcgacccgcgggacgaaaccctaatggagaactggcggcgccgccacgtccccgcgccgtagcctagcagcagcgagctccgtctcaaggataacgccagtgcttgccgatccggtggggaaaagtgggagcacggagcagcctcgcctcggcggggacgcggcgcccaccatggggagcgatctcaaggagatgaagtacaggcggaggattggggtggaggagcggccgcaatgcagcgacccgaggggcggcggcgcggactggcccgcgctgcagcaggaccccgtcgagctgctgcgcaagctggacgagctcagggaccagatcacgcgctcctgcaacgtcgtcggccagccgcgggagcaccgcagggtcagccgacgtgcggtctccatgctccccgagcaacttgagccaccgcctctgccggcgtaccaccgctcccgctatggcgggcggtatgggcacggcttgccaccaccgagcccatacgcaccgccacgccctgaacatggggaaaggtatgtgcggcagtctagtgggcactaccgccagtaccctgcgactgggaggcagtcggagaacggtgggatggggcctgggggctaccatcactatgggtgtgcctgtccacactgtcttcatgggcagaggcctttgcagcaagaggagaacatcccaatggcgagatactttgccgggcagcatgaatcataccggttccagaggtcgccatcagtgtcatccgattatgataggaggtctgtggcgtcatcactttactctcatcggtctgtatcaaagaggagggcagagtacttcaggaaaaaggcagaacatatctgccgtccagtggatggtgctgcacctttctctgtatgcagttcatgttataaactactgcagatgcctatgggaaaatgcatagggaggaagcagaatcggtttcaatgtggatcttgttgtcagataattagtttgaagcatgaagaagaaaatggtattccctttgtgccatcatcatccttatatgctcctgaaatggagcaatgctcaagtgaccagatgaggagagattctgcccatcaacgccatgaggatttcaattctatgttctacaattcaattgatcatagcaacatgcaaaacaacatggatttcaccgatgataattcactttcttcgaccatgagtaatgacaggattgaaaaagagtgtggttcaactagaagcattcagtcaaaagctgagggtctctctttctctccaagtaggtctgtagacattggtagcccaaaggatatattgtgtgagagggaggcagactgcaaggtggagccttctgtagatggtccacttggcccacgatctccagctttagaggacaaacttgttgacccattgtgtgcccaagaaaatggtaacgatgaggatgatcaaggcatgccttacagatcagacctaacttgcaaaggagagtatgatgttagtgatgagtatgatgtgggcattagtacaagaagcaaacaggagagcaatgaagatgacaaagatgccactgaagatgaaaggtcatacagaagttatgaacagaagagcaagagcaaggaagatgactgttgcaatgttgaggatagtagcaaaacatacaggcagaatagtggagaagatgacgctagtagtctagtagatggaagtgaaaagtacgactaccgtgctggtttttggggtgtcatgggacgagagtgtatcggcattgtccctccatttattagagaatttaattatccgatggccagagattgtgccggtggggatactggtgtttttgtcaatggcagagaactgcaccagagagatttagatttacttgtaggaagaggattaccgcggatatctggaaagtcatattctattgagatgtcaggaaatgtaattgatgaagcaactgggaaaaaactacgcagtcttggaaaacttgctcccacgattgagaagttgaagcgtggttttggcatgcacgtccctgaagagtttagataactggttctagtacaggtcttggctttgctaatagtacactcttcaaagattaccatggggtgcaaacctatgatttctgcggattgtggtattaaatctcagatttctctgaattggactggagctctacaagcaatacttaagatccttggtgtgaagcgaagggtggcactcaagaagccaagataatgtggtctaatgccttaactaccaatagtatccctcctgctaattccattactttaatggaaagcacgtttgctagtgactctagtctatcaggcagttcttaacttcactgctctgcctgtacatgctattcctcaaatgtgttatcattgtcggtacattgccccatcacaggcaacataagtgttgttagatgtatgagccattgtcggcttgtaatatattggtagagatatgcttcccctaacatttttttatatgtatatatgtgctcttgattcatgaaactcttgccgatatgattggctttcggctctcctgaaccctgttcgagtcttatgttgaaggctgaaacgcccctggccatctaccattcaactgtattcatcagacctgatggggtgctgttgtgaatctgatgcctacggttttcaaaaccacaggcatggacgtggagttgcgcaggcacagtatacaccagaaaatctgctaactattcaacagctttttctcttataaaaaattcagcgaacagtactttta

SEQ ID NO: 261 - DNA, 2624 bp, Sorghum bicolor
cgctctcggtttttgccttctgcgctcagtattcaactagtcaagtcaccaaaccatcaaagatagttaactgcaaggagctaaaccagaattagagctaccaacctctccctcttcttcctccgttgccaagctctctgaggagaagaatggctgcgctgctctatctcgcccttcttctactgctgacctttccggtttgctctggcgcttcgccatggcaaaccatgaccaccggctcgcacatacgaggagaggaccatgacaaggtcatcctcctctcgcctgatgctaccttctcctgcggcttccatgaggttggcacgaatgctctcaccttttccatctggtacaccacccatgccgccgagagaaccgtcgtctggacggcgaatccctattccgcagagagaggaggatactctccagtgaacaaatatggctccagggtatcgctaaaccgcgacggcaacctgatcctcacagataccaacggttccatggtgtgggagagcaagacatcgtcaggcaagcacacgacagtcaccctcctcaacagcggcaaccttgtgatcagtgactccagtaacaagatcatgtggcagagcttcgattcgccaactgacaccttgcttccggggcagaacctgacaaaggacacaaggttagtctctggttaccatcacttatacttcgacaacgataatgtcctgcggatgttgtatgacggcccagagatcacaagcatctactggccaagtccggattacgacgctcaaaaaaatggccgcaataggtttaacagcaccaggatagcagttctagatgacatgggtaatttcacatcaagtgacgggtttaagatagaggcttcagattcaggtccaggaatcaagagaaggatcacaattgattatgatggcaatttcagaatgtacagcttgaatgcatcaacagggaaatgggacatcacagggcaagctgtaatacagatgtgctatgtgcatggactatgtggaaagaatgggctctgtgactacttgggtggcctcagatgtagatgtcccccagattatgagatggttgatccaacaaattggaacaaaggatgcaaaccaatgttcttgactgatggaaaccaagcacgtgaggaatttacatttattgagcaacctcatgctgattactatggctttgatctatcctccaataagtccatcccatttgaagcatgccggaacatctgctggaacagcagcacctgcttatcattcacatacaagggtggggatggttggtgttacactaaagatttactctacaatggtcaggtgttcccatatttccctggggacaattatatgaaagtaccaatgagttttaacacttcgacgtactcaatctccaagcaaaaaaccctcacctgtggacccgcaggttctgagaatatgctaggaccagcaagtatgtacggaacaaagaaggacaacataaattggacatacttctatgtctttgctgcaatactgggagctctagagttgcttgttattgttacaggctggtaccttttcttcaagaagcataacatacccaaatcaatggaggatgggtacaagctagttacaaaccagttcaggcggtttacataccgagaattgagggaagcaactgggaagttcaaagaagagcttgggagaggaggtgctggaatcgtctacaggggagtgcttgaagataagaaaatagtggcagtaaagaagcttacagatgttcgacaaggagaagaagaattctgggcagaagtgacccttattggaagaatcaatcacataaacttagtcagaatgtggggattttgctcagaagggacaaagaggttattagtatatgagtatgtggagaatgagtcactggataagtacctctttggtgagagaagtactgaaagcttgcttggttggagccaaagatacaagattgcactgggcacagcaagagaaaacatacttctaactcgagatttcgaagccaagatagcagactttggattggccaagctcgcaaagcaaggtagcactagtttcaatttcacccatatgagaggtacgatgggctacatggcaccagaatgggcattgaatatgccaatcaatgcaaaggttgatgtgtacagctatggggtagtgcttctggagattgtgactggaatcagggcttcaagtggcataatgttagatgaaagacaaatagattttctggagtttgtccaggaggctaaacagattctatctaccgggaatgtcagtgatattgttgatgatagattgcacggacactttcatacagagcaagcaattgcaatggtgaaaatagccttttcatgcctcgaagaaagacgcaagaggccgacgatggatgaaattgtcaaggtgctcatgtcatgtgatgatgaagacgactaccatcctgcttattcatattgacttgcaacagatgcaaagtggcaggcataacaagtttcatgccaattgtacctttggtcatgttactacaggaacaatgatttaagatgaactgaactgactgatgaaacatattgtaaagtgtggcaaattgtgata

SEQ ID NO: 262 - DNA, 412 bp, Sorghum bicolor
cggccgccatacccggcccagcacagccgtagggtttattggcatctctctccgtccctgcactcctccactgggggagtcgcgccggccaccacagcgcagaagaacacagcacccgcctgcctcgccgccgcaatggccgccgccgcctcagctgcgagatccttcctccggtccagcggctcatcatcactccgcagcgcggcagccagagccgcctcgcgtgccggaccggctccgctgccgaggcggatgcccacctctgccccccgcgcactcctaaggtcgccggtggagatgagcagcgtgtgcctggagtccctgatgcccatgcacagcgccacggcttcggcgctcatgacgtcgctactcgctgccccggcttgcaagggattcggttggctatcagaag

SEQ ID NO: 263 - DNA, 3620 bp, Sorghum bicolor
aatctgcatccgctgttgagaaccaacttgtgccagatacctccacatccagatttacatggtgtattgaaaatttttctaggcgcaatgttagaaagcactactctgacgattttattgttgggggatacaaatggcgagtgcttgtcttccccaggggaaataatggtgaccacctttcaatgtatctggatgttgctgattcaaacttgctgcctcctggttggagtaggaatgcacaattcagccttgctgtggtaaaccaattagacagcaaagcatcattaagaaaagaagcgatacaccaattcaattcccgtgaaagtgattggggttttacatcttttatgcctttgttggatctgtatgattcaagtaaaggatatgttgtgaatgataaatgtatcatagaagctgaggttgctgtgcgtaaaacttttgatttctggaactatgactccaaaaggatgactggttatgttggcctgaagaatcaaggggctacctgttacatgaactctcttcttcagactttataccacattccctactttcgaaaggctgtatatcatatgcctactacagagaatgatacaccttcagggaacattccattggctttgcaaagtcttttttataaacttcagcattgtgataacagcgttgctacaaaagagctcaccaaatcttttggatgggatagctatgattcgttcatgcagcatgatgtccaagagttgaatagggtcctatgcgaaaagctggaaaacaagatgaagggaacccccgtggaaggagcaatacaaaaattgttcgagggtcaccatatgaattatatcgagtgcattaatgttgactcaaaatcgaccaggaaagagtcattctatgatctcgcacttgatgtcaaaggatgttctgatgtctatgcatcatttgataagtatgttgcacaggagaggttagaaggcgataataagtatcaatctgaggaacatggtctacaggatgccaagaaaggaatgctttttattgacttccctccagttttgcaacttcagttgaaacggtttgaatatgattttgtgcgggatacaatgctcaagataaatgaccgttatgagttcccacttcaattggatcttgatagagatgatggaaaatatctttctccagatgcggatagaagtgtgcgtaacctatatactcttcacagcgtgctggttcatagcggcggagttcatggaggacattactatgccttcattcgcccgaagctgtctgatcaatggtacaagtttgaggatgaacgagtgacgaaagaagacatgaagcgggcattggaggaacaatatggtggtgaagaagagcttcctcataccaatgggcttaaaaatgctcctatcagatttacgaagcattcaaatgcttacatgcttgtttacatccgagaaagtgacaaagagaaaatcatctgcgatttagatgatgaagatataccagaccaccttaaggttaggttaagaaaggaacaggaagagaaggaatgcaagaaaaaagagaaggctgaggctcatatgttcactgcattgaaggtggcccgagactctgatttcaaagagcaaattggaagacacatgcattttgatctcgtggactttgacaaagttaatagcttccgtgcacctaagaacatgtcaatcaacgatgtcaaggaggagctttcgaaagaatttggcatcccagtagaatcccaacgattttgggtgtgggcaaaacgacagaactttacctacagacccagtcggccattgaccttcctggaggaaacatctgctattgggtatctcaaagacgcaatagtggcaaagttaccaaattctgaagtacggttgttcttggaggttcatttgggacaggagaatcaaggaattgcttctgggaagaccaaagaagatatattaattttcttcaagctctatgatcctgaaaaggaagacctaagatatgtaggaaatttttttgtgaaagcatcaggaaaaccatctgatatagtagaaaggctgaatgagatcgccggatttccgtctgatgaagatattgagctctatgaggaagtaaaatttgaaccagcggtgatgtgtgtaccaattgagagcaatatttcgttccgttcaagtcagattgacaatggtgatataatatgctaccaaaaacgctgtttgccagattcaatggatcgataccgatatccaagtgtcccttctttctttgaatatattcataatagacaggttgtctacttcagattgcttgataaaccaaaagaagaaggcttctctctggagctttcaaaacgctccacatatgatgatgttgttgagaaggttgctcggcaactacgtctggacgatccttctaaaatccggcttactcaacacaacctatcgtctcagcaacccaaacctcaccacatcaaatacaggagtcttaattatctttcagacatgctacataatcataatcagatgtgtaacattttatattatgacgtcctggatattccgttgcctgaactagaatctacgagatcactgaagatcacttttgaaaacgccacaaaccatgagatgtcgtttcacactatgcggttaccaaaaagtaacactcttcttgatttgattgaagacttaaagtcaaaggttgaactttcttgtaatgatgctgaatttcggttttttggagtccaccttcacaagatatgcaaggtgtatcaacctggagataagatagattcagttaacgaacccttgtatattgaagaggttcctgaggaagaaaaaaatgctgggcctcatgaccgtttggttcatgtctatcacttcgaagataatcgtcatgttcagtattttggagaacctttcttctttctaattcgtgatggtgaagctttgtcggatatcaaagtacggattcagaagagacttcaagttcctgatgagcagtttataaagtggaaatttgctcatgttacattcagtaggccagaatacctccaagattcagatattgtattgaaccgattccataaacagaaacctgtttatggagcttgggaacaacaccttggattggagcatacagccactaccccaagaaggtcgtactttggcagtcagaaccgccattcttttgagaggcctgtgaagatttacaactaaaactggcaatattttttgcatgtgatgaatgatgaacaggatatgatggcagtcttgttccaaaaggagtctcttatgtttttggtgatgtacatggtggaggttttgcatagagtagtttatgtggcaatttatcagaagaattttcatttggtggatgtacagggttcgtatagcaacatttccttgtagcaagttgaagctgtatatcgagggtcgataacctgtgtttttgtcgtttcgtccccaagcctctggggagctgtgaaccatagcctcatacaatttgcgttgcagttgattcagtgtttttatcgttggtcattatgacctagcctgattcgcaagtgcgtcgtgttgggctctggcaaaagattttgacttgtcatttgtctctgggtc

SEQ ID NO: 264 - DNA, 4886 bp, Sorghum bicolor
atggactcctcctcccccttctcccctgacgaccagaccgacgccgacttcttcgacaagctcgtcgacgacgacgacgaccccgccccgccgcccgccaccgacttgcctcggcccgtctccgccaccagcctcaacgctgcagacgacccacccgccccggagccgcagcctccggtgccggcgcctcccgaggggtcaggcaagggcggagccggcgtccacaccgcggtcaagcaggtgcagtgggcctccttcggaggtggcgcggacgacggtcctgatccgttcgctgatctctcgggaggcgccggcgacgacgacggcttcctcgggagcacggccgggacccagacggcctcgggtcaggacttcttcgctgggaccaactcctcctccgatcagcagaatgtcaatggtcagcacgatcagggaggtggcaccagcactgcagtggacccagcagatcccaagtcttgggaggccatgtaccctgggtggaagtacgacgaggcatcgcagcagtggtaccagcttgatggcagtgtaaattcaaccgggaatgcagctcaggtgctggagaatagcaatcagaatgcgcagcagcagctcaacacgtcttacctgcacaattcgtcgcatgcggggctcgagacaattgctgaggagggcactgccgcagccggtgctgtctcaagttggggccaaggggccgcctcagagtacccacccaacatgctcttctacgcagaataccctggttggtactttgacaccaacactcagcagtggcactcgcttgagtcgtaccagcaggctgctatgcaggctggaacagctagcacgggtcagactgttgttgcaaacgatgttgttgctgcgaattcctcctcgctgacaggctataatgctgcacaaactgaggatgttgctgcccacaatcaggtgacccatcacaattcattctcaaatagtttcactctgcagaaccaatggcagactacggatgcatttggtaacaatgtacgatctgaaagtgctacagataacagcctggctagtagtttctatggttttgaacaaaacaggaatgctgagactaccacttcctctacgagccaacaggctggttttaacacagttgaaactgttacagatcactatggtgcacgcaagggctttgaatcatcaagtcttcagagtggttatagctcatctgacagtcaacaatccagttacaaggcattcgaaccttccacgcgttataaggctggttacaaagcgtttgaacctgccatggataaccagagtggctacaaggcattcaaaccttctacgggtcaccatagtgcttcccagggattcatgccctccacgggtcaccggactgatttcaagggttccagagcttccacagttcaccaggctggttacaaagagtttgaaacttctacaggttacagtacaagtttcaaggcatttgaaccctcttcatctcaacatgctggttacaagggttcccaacctaactacacgggatttgacagttctgcaaaccaccatggttatggtgatgccaatggtgttgtgagtactcaaggctttgtcccaatgcaaaccacgtaccaaggccagaaacaagtaaatgcaacctcgcaagggcacctgtcaaatagttattttggtactgaaaactccatgaactttaatcagcaacaatttctgggtgcaaatgcgtcaaacttgcaattcgatcactccccacatgaaggcaggtcatcggctggtcgaccaccgcatgcccttgttacttttgggtttggagggaagctcatagttttgaaagaaactagctccatgcccgcaagctttaacactggaaatcagttcaagggtaactctagtagcacagtttcagttcttaatctgtcggaggtggtcattgatagagttgatccttcaagcatcactaatggtagtgcacttagttatttccatgctctgtgccatcaacctgttcctggccctctggttggtggaagtgctgcatcaaaggatgtaaataagtggcttgatgaaatgattgcatggtacgagtcttcctctagtgaattccagaaaggtgatactcgcaagttgcttatttcattgttgaagatactatctcagcactatggaaaactccgttcaccttttgcgtctgacccattgcaagaggagacaaatggtccagaaatggcagtaactaagctattttcatcgtgtaagagaagcactgctcatatgggagattatggatccattgttccgtgcatgaaaaatattgcttcagaaagtcagatgcaggctgttgcacaagaggtgcaaagtcttctagtttctgggagaagaaaagaggcccttcagtgtgcccagagaggtcaactttggggacctgcaatcatactggcattgcagcttggtgatcagttttatgtggatacagtgaagaaaatggctcacttccattttgtatctgggtcccctctgcgaacgctatgccttctcattgctggacaacctgcagatgtttttaatgtagagaacaatgtcaacagtgactatggtacatcccgtcaacctatggagcctggtcctaatggtatgttggatgattgggaggagaatttggctataattactgcaaacagaacgaaaggtgacgatctagtaatcacccatcttggtgattgcctctggaaagaaaaatatgaggttgcagctgcccattcatgctatttagttgctgaactaaatattgattcatactcggaaagtgcaaggttatgcctcattggtgcagaccacttgaagtgtcctcgaacatttgccagccctgaagccattcagaggacagaggtttatgaatacgcgaaggtgcttggtaattctcagtatattctactaccctttcagccatataagctgatatatgcatacatgcttgtggatgtggggaaggtttctgattctttgaggtattgccaagcatctatgaaggtgctgaaagcctctggtggtgcccctgaattggaggtgtggaaacaattattttcttcactggaggagaggatacgcactcaccagcagggtggatatggaacaaatcttgccccagcaaaactagttgggaagatttttacctcgcttgataaatctatatcccacatgatgggtacaccatctgcaccacttccaccattaccacatggatctgttagtgatagagagagccactctatgcctgcagcagcaaaatttggaaatagccaatcggcaatggccatgtcatcgttaatggcatctgcttcaatgcagtcaatgactgagatagcagagaatagtggtggcactggcaggacaattgcacagaacagaagtgtttctgagccggagttcggtagaacatcaaaacagggtgctggatcagatggcacacagagtagtgcatcaggatctggtagttctcgatttggttggctagtgcagaagactatggatttagtgtcgaaatcccaccgccaggcaaaattaggggatcagaacaaattttactatgatgaaaagttgaagcggtgggtggaagaaggtgctgctgttcctgccgaggagcctcctcttcctccacctccaacaaaaccatctttccagaatggtatgccagaccataagttgaatggccccgtgagtgtaaaccatgctcccaatggagtcacagaatggaaatcctcaaattcttcggatcaaggaggtctgggtatgcctccaattccacctagccaaaaccagttttctgctcgtggacggatgggtgtccggtccagatatgttgacacattcaataaatcgggtgcgtctggagcagtgccatcatataacaaaccagctgctccatctgtgacaccaccagctggtgccaagttcttcatgccgactgcagcacctgctgctgcagatcagatggtgccacaccaagcggcagagatacacagtgaaaccatccatcaggatgagcggtcagcctcaccaccagcagaaacatcaatttcttcaaccccaccacccacacaattttcatcacccccaccgcacttgcaattttcatcaccaatgcaatcaacaattcatcggcaatctagtatggagaatatctccaccccttacctgggttctggggtatcatcattaagcagcagcagctcattctcaaaatcacgagccgcatcctggagtgggacatactctgagcagtatagtgcttttgcgggcactcaatcacctgacagacagacgatgccttcaccactcatgcctggcaaaccatcacacagtcgttccaacagcaactcatcactgcagctcaatggattggcagaggatcttcatgaggttgagctctaactgatcactgctcagcatgacctcatgtcttgtatccacaaagacagccatggcaaccgctgacggttccagaaaccccaaagcgggtgtcagaaaagaagctgccctcacaatgctgatcacagggatgacacagttggaatgggttggtgccactttgcacgggattctgggggcgcgctctaaaccaccgaggtgcgtcagacctgtactaacagaaatgcagggtttttgaacattttgtagttatatctcctatacaactaaaaagaagaaaagtaagatcaccaaatggtgcgataattttttgggttgcccccacctctccttgcgattctaaggtggaagggtgcaaaaacaaataaagaataagaatggattcctgatgtaaatatacaatagagaaacaatatataaatgtggaggtggaagggaaaggattcctg

SEQ ID NO: 265 - DNA, 2996 bp, Sorghum bicolor
ccatgattgaacactaattaccaaataaaaaaatattaaatttaacatcccaaccaaacacgacccaagacttttgaagacactgtctccgatcctttgaagacttttggtgtaaactagtacttaacacacaatcaatttttgtgccacgtatataacaagacaattgatatgatatcttgttatgctagaaaatctctagggtccgccaccgctcacaactaacgtgcgaacgcagcagtttgcatcccatggtgcccttaattgggccgtccatgcgcgatctgcgtgcagcacttaactgcggcccaccacagaggacaaactagagtctccagagcatcttccgcgcgccttccgaattccctttgcctgtgctcgttccccgacgctggctgcggagtacggattgccttgctattccacttccaccccaatccccatccgaccacgacgctgccgcggtccgcaggtcttctcctacaaaaccaccagagaaagagaaacacacacggacaaggccgccgggcaggcaccacgcgcaaaagcgagagactacctggagctatgccactccgcttgcccgcctgccgcgtcttcctgctcctcgccacggccgccgccgtctcagcgtcggccgagtccaacagctccgccaactgcaccttccgtgacggagacatcatccgcgcggcgttcagccaggtcgccaacttccccttgccgctgcctgctcctgctggccgccgccgccgcgcgtcgtgccgccccgtcaggcggctccacttcccgtcgcggaacctcacgggcgccgtgaactgggccgagctcgccaacctcaccagcctcctcaccgtcgacctctccgacaactccctccacggccgcatcgacgacgacgcctcgttctggcgcgcgccgctgctccgcgccgtggatgtctcccgtaaccacctccaaggcgtcctccgcttcgacgacgacccgggcacgcgcctcgcgtcgctcaacgtgtccggcaaccggttcacctccgtccacggcgtggccgggctctcccgcgtggtccacctcgacgtgtcgaggaacgccatcggaacggtgccggagggactgcggagcctgacgctggtccgcgtgcttaacctgtccgggaacaacatgaccggggtgttccccgacgacctgccgcctctcgccggcatccaggtcttggacatctcgcacaacaacttctccggcgcggttgacgccgccaccgtccttaagttcggcaactcctccttcttccaagccggcaacgcgttgcgagtgatcgacgacgtcgcaccggcttcttcgccggcgctggcgccgtcgtctaatggcggagacatgaacaggcgtgcggtcaccatagcgctaatctcagtcggcgcaacggtgaccctggcgtgcttggccgcgtgcgccttgacgcgtcgtcgccggaacaagaagaagaagaagaaggacaaggacgggaaaacagcggtgtgggaggacgaggaggtggtggtgggggcggtgaaggtggccgcggcggcgccggtggtggtgctggagcggccgctgatggagctgacgctggcggacctggccgcggccacgtccgggttcgggcgcgagtcgcagctcgcggacacgggcggccgcagcggggccgcgtaccgcgccgtgctccccggggacctgcacgtcgttgtccgcgtcgtcgagggcgccgtggctggagttgcggaggacgccgacgccgccgccatcgaggccgggttccgggagcttgcacggctcaggcatcccaacattctcccgctccttggttactgtattgcagggaaccaaaaacttgtgctttacgagtacatggagaaaggcgacctccaccggtggctccacgagctgccagtggggagcatggacaccgaggacatctgcatggacaccatggaagccatcgaggacagaaaacccgccggcgactggccgactcggtaccgcatcatcctcggcgtcgctcgaggtctcgcgttcctgcaccaggggtggacgggggcggccgccgggtccggccggcggcggcggcccatcgtgcacggccgtctggtgccgaccaacatcctgctcggcgacgacatggagccccggatctccgacttcctgcaccgccccggcggcggcggcggcggcgacgagacggcgacgccggcgagcgacgtgtaccgcttcgggacggtggtgttcgaggtggtgacggggcaggcgaggtggggcgacgcggcgaccacgagctgggcgcgcggcgtgatccggaaccgcaagggcctcaacctcgtggacgaccggctccgggacgagacggcgggcacggacgccgagaaggagatggccgagtgcctgcaggtcgggttcctctgtaccgccggcgcgccggagaagaggcccaccatgcagcaggtggtcgggctgctcaaggacgtcaggccgccggcgacgaccgccggagccggaggagtgccgccgctcggggtctcatgagatgcagcgtagcgatgagcgcacgcacgcgactacggtcgggaatgtggtggtagctgcaggctgctttttttcgcacggtagctcacaaatccaagaagattcgtggtgatttttggggcagggagataccgcttctctgtgcgctgctttttgggggtcccctttgttgggttgtgtgttgtttccatcttgtgttcgttgaaggtaggatgacactttttttggttggtacgaacagcagctttgcttgtgacagcatgcaggactacacgtttggagcgactgtcattgaacacgaggtgcctggagtgagagttcgttttgattgcaccaacatttgcttctgacacattcattctatgctttgtcttcaccggaatggggaacgcccatgtcaacatagggtttagggttttgaccaaagctgctttattcgt

SEQ ID NO: 266 - DNA, 1110 bp, Sorghum bicolor
tcttcctcgccgtattgacctccatcaactggtgctaggggagaggaattactagtagaagaaaaacaaaattaaatcgcgagttagggcggcggagatgaacgttgcggaggaggaggaggtgagcatggcgggggaggagaagggcggcgctagcggcggtgttcgcgatggcgaggtgaggacggcggcggcgggtgcgggggcggtgagcctggagacgctgcggaagcggatggcggacttcgcgacggagcgggactgggagcagttccactccccgaggaacctccttctcgcgctggtaggggaggtgggggagctgtctgagatattccaatggaaaggggaggtgcccaaggggctgccaggctgggacgataacgagaaggagcacttgggcgaggaactcgccgatgtgctcctctatctggtgcggctgtcagacatgtgcggcgtcgacctcggcaaggctgccctgcgcaagatggagatcaatgcccgcaaatacccagttgggcagtgcaagggttcatccaagaagcacactcactacggctccactaacaatgttagcgacaatgctaacaccgtgaacaaggagaacagcaatggcgtctaaaacgactcggagctccttgaatgatagtttggctggtcggacatgatctaggttatgtgctgatgaaatagggatgctctattttggtggtaaaggaacaagtctgtgggttcaagtttcactatatattagatgcctaatgaaccaagtgttaaccacaaatcttcgtaggctgtagttccccttatattctaattgaactggcattttgcttctgctgtttcagttatgcagctgagtagtatgatgcgaaagcaaagctgaccatatttacttggtgtagtgctagtattgagtactgacactactttatgatgcaaagcgactttctgacaatgcaaagttgtcagtgtagtctatgagccggtgttggactgtcggtgattggtgaatgtctttgacgctctagtcctttatcagtacagatgaacaaagattattatgaggcctttatgaacataggttgataagtggacctgagtcctgac

SEQ ID NO: 267 - DNA, 1763 bp, Sorghum bicolor
atgctctcgcagtctcgctctcctctcgctttctcctctcttgttcttgacacttcttgtgatcgccaccggcctcgacctcacttactagtatatttccagctcgagagaagcgcacggcaggcgagaagaaaaggcgctgacgcctcgtttccgtcgcacacactactcgccagattggatcactccccttccctgctcttccgtcttccgcgggccgggcaaagctctctggcgcggcgacacttcctccaagacctcgccgccggcgtgaggggcagtcgccgccggcagtccgcggcgcggagcatcaaggccgcagcaaaagggagagcaagtgggcgaagtggtactgttgcggtattctccggaacactctctccatccccatccccatccaccaaagcagcagccagcagcaggtgttctcaaaatgcagtcatctgtgatggcgttcttccctagtgttgccacagcaaaactggagctgaattctctgtacaggaaatatgtggacatgtttggtatatcgttaaacaactctaccgttggctgccatctcacccgcaaaatggcgcaccttcctgttctgttgatcgatcgtacatttttcagtactggttctgctattcagagtattgccaccagctacggagctcttattcgtaggtggttactgaacagaacttctgttgtacagcacacgctgatttccagtgctatgaactcactgtcttggtgtggctccttgccattctttgtcagcattggtgttctaatcaccaagctctgtgactgcactatgaccccgaaccgtttttgtggtcggcaatgcatccttagtcatagtgctaacctccgtggagaatcagttttggtcatggacaataatgaactgggcaatgatcagagcttcttatcaagtttccttgggcgcaagcgagattatgtcgtcctagcgcttcagtgcatctgttaccctgcttgtctgaaggttgttgatgtcccccacaagaagctcagcttcagcaggcagtggatacggactggccatgacacaagtgcaatttggaggatcatggcaaggaatgaacaatacttggcatgcatgatagtcctggcagccttgcaagttttcctgcggctaaccagagtgaatgttaccattctgttcttgccaatgctgtcccgagccataagttccaggagcagcccagcagtgatcggtaacatcgtgctggttttggtgaactcctgtggagttcttggatctgcactttcagtgaaacagcttggcagggaggtgacgttcgccatcagtgccatcgtgatggtaatttgccaggtcgcaattccattgatcctagaagttcagatcggagttggtggtggaactcgcatgccgatgggttacacaacagcgatgttcgtcctgacttgtgttgtctcctgcggcctcagctggtcatggggttcattcttctggaccttccctggtaggaaggttcactcggctggacaggttctggccatggctgtgaacctgggcgtctgcttcgcccagatgcagtacttcctgctggtgctatgcaggctgaagaacgccactcttgcctactatgcactgtggatctggtcatgattgggattcagctgaggaaaatgcgtagctagatgagtgtgtgttaactctggttacttgagtgggttagtttggtggatgtaaatatttctcttcccacttctttatcttggcctggttt

SEQ ID NO: 268 - DNA, 1303 bp, Sorghum bicolor
cgtcaatggcgtcctcctctgccgccgagcccagctcccgcctctctgatcgagcgaagaggtcgtcgctgggactcagattcatggtgctcctgatgcacttgctgttcgttggcgctgtcttcatcctcgatccgaccctcgactggcgaatccacgaggagccgtggtatatagggttgtatggagtgcttgtcctgctcacgttagtgcaatacttctacacagctggctcatctccagggtatgttgttgatgtaatgagagctggttccatgatgcatgcaaccttcgtcaacactactgctctttcaaagcagtcaaattcaagaaatggaaacacaagttccccgacgagtcgtgctcaactacagaaacttagcacgatgactcctacatcttcgtgggcacagatggttatggatctttatcctccagggtcaagcagcagggattggacctgcacttactgcagggttgttcagccacctcgtacccggcactgccatgactgtgataaatgtgtccttcaatttgatcatcactgcatatggcttggaacatgcattggcaaaaagaaccattgtcgtttttggtggtacatatttgaagaaacaatcttgtgtatctggactgctgctctctacatcgagtcattgcgtttagatatggacaaggcctggtggaaggactttgttggtgtaatcctgttggcagtgcttatttttatcctaatattcctactactattgtggttgtttcattcgtacattgctctaacaaatcaaacaacctacgaagttgccagaagaaagcgaatattctacctaaggggagtacctgaaagagttcatccattcagtagaggcatatgcagaaatctctacgacttctgctgttctagccagaagggatatattctggaagctgtgcccccaagtgaggagctggaagctagagctgctcgttacacgtgccgagatgtcatttgctgccgttgctgctgataggctgtacaatagcattctgcccatatagccagttccgctgttctttgtccaacctttcgctaatggaagcaaattttagtgacctgcgaccgttagatactctagagttcattatttgtgcatagtcatttgtacatttcactcagaaaatgtgtgccctgagatcaagttgttgacagtttgtctgtaaaattctgtatggccctgcattcaaataggttttaaggacagataggattgatctgtacttttcagttctggtgtcgaatgtacattcgaggtttggttggtaa

SEQ ID NO: 269 - DNA, 1433 bp, Sorghum bicolor
gatgcgaagaacgcacatgtgcaatatgttttcgtctaccctccccaaccatgacctctcaggctctcacagtcccagccggccagcccagcgccccgtggtataaatacgggcacccaccgtacatgccaaggtcacagtccactagctgcagctgaagctgaagcaggagcatcgggacacagcacatgggacgcgtcaccatgtcgtcgtcctccgcctgcggtgatgaggaggaggaggagcagcagcagctggtctgcgtgaccggcgccggcggcttcatcggttcgtgggtggtcaaggagctgctccagcgcggctaccttgtcaggggaactgcaaggaaccctgagcacggcaagaacgcgcacctgctggctctggacggcgccaaggagcgtctcaccctgtgccgcgccgacgtcctcgacagcgcctccctccgcgccgccttcgtcggctgccacggcgtcttccacgtcgcctccccggtctccaacgacccggagctggttccggtggcggtggagggcacccggaacgtcatcaccgccgcggcggacgagggcgtgcgccgcgtcgtcttcacctcctcctacggcgccgtccacatggaccccaaccgcagccccgacgccgtcctcgacgagacctgctggagcgactacgacttctgcaagcgatcagacaacctgtactgctgcgccaagatgatggcggagatcacggcgacggaggtggcggcggcccgggggctgcagctggcagtggtggtgccgtgcataaccttggggccaatgctgcagcagacgctcaacgtcagcacccaccacatcttgcgctacgtcatgggcaccaagaggtccatccccaacgccgtcgccgcctacgtcgacatccgcgacgtcgcgcgcgcgcacgtcctcgcctacgagcgccccgccgcgcgcggccggtacctctgcatcggcaccgtgctgcaccgcgcacagctcgtcgccatgctcagggacctcttccccaagtaccccgtcacggccaagtgcgaagacgacggtaagccaatggtgaagccgtacaggttctccaaccagaggctcagagacctgggcttggaattcactccgctgagggagagcctgtacgagactgtggtgtgcttgcagcagaagggccacctgcctgtcatcaaacaaaaacaacgtgcgtgcttgtaaatcagtggacatatgccgggatttcccagataatatagtcagtaatcagtctcaacccgggcaaacatcttttccattgcttgattgctagtagtctatcgtcttcctaaggcacccgtaggataggaaatgatgatcatataaacagggaaaacaccacagaaaaaggggaatgaagtacaagaatacatcaatgcaagttctacgcgtgat

SEQ ID NO: 270 - DNA, 1947 bp, Sorghum bicolor
accacacacgatactcatccgtagatgattttgcaaattcagacagtagtattataaccgtaatacaccgatgtatacacaataactttctatttctgatttccgtacaagggctattctaactactttgaactgcaaaaagattcatctctacaacaacattccaaacagtccgacactgcccccctttttggtggttagcgagcccaaaggtcaaagctcaggtcgcttgagtatcactactttttccagtgctggaccatatagccatgtgctggcgtgttgctagcagcattgccattgtacagtctcaaaaggtgaccataaaagaggagagctaagcactcggctcctgaagaaagaatgaagacagaggccactcacaaggcgatagcagcaggtggcaagatgacggtgctccactctccggttggagtgaggagcatcgtcacctccatggtggctttcttcatcttagccagctccatcgtcttcctccttgacagaggccaggaagagcaagtgcaaatggcaatcgagcatggacgccaagaagtgcaggtgaagctggaagctgggctccaagaaccagcgatcagagggacaactgacgagggggacgccagcaatgaggagtgcaactggtcgagggggcggtgggtgtacgacaacgtctcccggccattgtacaacgggctcaagtgcaccttcatcttccccgaggtggcctgtgacaagtatggaaggaaggatgtcatgtatcagcactggagatggcagcctcacggatgcgacctcccaagatttgatgccatcaagctgcttgaaaagctgaggaataagagattggtgtttgtgggtgactcagtcaacaggaatcaatgggtctctcttgtgtgcatggtggaggcctcaatacccgatgacaggctcaagacacgcatcttcaatggctcactcatctcctttaaggcattggaatacaatgcaacaatagatttctactggtcaccactactggtggagtctaacagcgacaaccccattatccaccgggtggagtaccggatcataagggcagatagaattgagaagcatgccagtgtctggagggacgctgacatcattgtcttcaattcttacctgtggtggaggaagcagaaggatgacatgaggatgaaggtcatgtatggttcatttgaagatggtgatgcaaagttagacgaaatggaaatggttgatggtttcgagatagctctcaagaaactaaccgaatggcttggggaaaatattgacaagaacaagactaggatcttttttgcaggatcatcaccagcacattcctgggctagcgactggggcggagaagacaagaacaaatgcctgaatgaaacagagccgatctacaaaaccggatacaaagctgcaactacggactacagcttgatggccacggccaagtcctatttccgaacactggagccgaaaggcatacatgttcagatactgaacatcacagagctgtccgactaccggaaggacgggcatccgaccgtgttcaggaaacagtttgctcctctaacgaaagagcaaatcgcggacccagccagctatgcggattgcacgcattggtgcctccctggagttcctgatgtctggaacgagtttttatatggctacctcgtgcaccaaatgatgagtaaattgtaaaatgtcaggtttgttttaccccttatatataataataataataataatgtacagatggcatactccatttagattaggatgctcttgcgcagagaatggttggacctattacatttacatgtacatgtacagacagagaaaagcaaggatctgtctgcgcatcacctaatgggatcactggtgtactatttctttatacacatataaccgagcaacatggttttgtaagaaatttgt

SEQ ID NO: 271 - DNA, 1911 bp, Sorghum bicolor
ggtgtcctcccaggtccagcaggtctccgccgacctcaccgtcaggatcgccgactccgtcttccctctccacaaggcggtgatggtgcccaagtgcggctacatccgccgggccgtggcagcggcggcggcggtggcgacgagccagacgcagggcccggggcccgcctccgtcgagctggacctctcggcgctgccgggcggcgccgacgccttcgagaaggcggcgcgctactgctacgggggcagcctggagatcacggcgcgcgacgcggcggcggtccgctgcgccgcggcgttcctcgacgccccggacctggcgcgccgcgccgaggactacctcgcgcagaccgcgctccggtcgctgccatgcgccgccgccgagaccggcgtcgcgcgccgcgccgcggacgccgtcgcgctcggggtctgcaacgaggcgctgttcccgacggcgcgggcggcacctgggtggtgggtggccgagctcgccgcgctgtcgcccgcgtcgttccggaaggtggtcaccgcgctgcggtgccgccgcgcgggtccggaggtggtggccgccgcggccgtcgcgtacgcggagcgcgtcctggccggggtcctcgcacccgctgcgcccggccgccgggacgccgtcgtcgtcgtcgcgaggaacgcggacgcggacgcggaccggcgggcgctgcttgaggccgtcgtggacgcgctgcctcccgcggccgacgcgccgctcccggccgcgttcctctgccgcctcctgcacgccgtggtcaccgccgaggcgtccgccaagacgtgccgcgacatggagctccgcgtggcgggcgtgctgcaccaggccaccgcgggggacctgctgggcgtcgcgctcgacggcgccggggagcgcgtccggaacgcggacaccgtgcgccgcgtcgtggccgcgttcgtcgagcggccgcagacgcaggagggccggcgggcgtcgctggccggaggaccagcagcaggcgagctcggcgcgctggagaaggtggcgaagacggtggacgaggtggcggcggagatggcgacggaggagtcgctgggcatctccaagttcgtgggcgtggcgggcgcggtgcccaaggacgcgcgggcgtcgcacgactgcctgtaccgcgccgtggacatgtacctgaagacgcacccggggctggacgagatcgagagggagaaggtgtgcagcgtcatggacccgctcaggctctcgtaccaggcgcgcctgcacgcgtcgcagaacaagcgcctgccgctgcaggccgtgctcagcgcgctctactacgaccagctcaagctccgcagcgccgacggcggcggcggcgatggtgcggagggaggagcagggtgggagccgcagtcggccgccgggaaggctcgagcgcaggcgcgggcggacgcgtcgctggcgagggagaacgaggcgctgaggtcggagctggcgaggatgcgggcgtacgtgtcggggatgcagcagcacagcaaggggagcgggtcgaggtcgtcgtcggcgtcgctggtgccggcgtcggcggcggggaagaaggcgagcttcttggggtcggtgtcacggacgttgagccggctgaacccgttcaagggcgggtgggccaaggacacggccagcatcgccgacggacgtgacaggagcgccatgcatgtggtcaagcccaagaggagaaggttctccataggctaatttagtttgtgatatatgaatatggaatgtgatattgtttgtgattatgtttttttattactgtaattagaaaaaggttgtgggtgctttgtagtttcaatgttacctttgtttttttaatttcttactattatagtggtccagtgtgcttaaaatttttgtatttgtttatgtcaatatgt

SEQ ID NO: 272 - DNA, 931 bp, Sorghum bicolor
cgaccgaccgaccaccgccgcgatgaggcagtggaagtccctggtcccggccgcgctgcacctgcacggctcggccgcgtcctgcttcccgcacccgccgtcgtcgcccagggccgccgcggaggagacgacgacggacgacctgcagctaccgtctctaggcgctgcggcggcgaaaggcacggcggtgcggctggtggggtgcgacggccgggtgcgcgcgtacgcgccgcccgtgacggcgcgggagctgatgcaggagcacccgcggcacctggtgtcccgcgccgacgcgctgctgatcggggagaagatccccgccgtggcgcccggcgaggagctgcagcccggggaggcctacttcctgctgcccgcgcacctgttccgctccgtcctctccttcgtctccctcgcctcctcgctgctgctcctgctgtcgtcgtcgtcgtcgtccaccaccaccgccgccggcgcgggtgccggtgccggtgccgggaagaaggccggcgccggcaggccgttcgagctccaccgcacggcgtccggcacgctgcagatcaagttctccgacgacttcctcctcgcggacaacggcaatggggaggacgaggaggaggaggacgaggcgcccgcgcagaaggagcagcagcagcgcgccgtgctgctgcgcggcgacgaccgcctcgccaaggactacgaggagctggtcgggtacagcaagtcccgccgctgggcgcccaagctggagacgatcgaggaggcggttccgcccgccgccgccgcggcccccgagtccgccggcgccgcgtcaccgaaggcccagcgcggcggcaggaagagccgcgcgcttccgttcctcggccgcctgggcagccgccgccgcagccgcgaccgcgacgcctgcagcgccgtcgtggcctgctccggctag

SEQ ID NO: 273 - DNA, 889 bp, Sorghum bicolor
gccgccaaggccaagcgagccccgtagcctctcctccgcctaacaacgcctcgacgcggggtgccagctgccacgaatccgacgacccagtccatgtccagcccagcgatggcaatggccgtgatccgcctcgcgcgccccgccgccatccgcccgccgtcggccccgtcgctacggccgaccgcgcggctgctgcgccgcctccgcgtcgtgaggtgccgcgccggcggcggcggcaacggggagggagggaaggggaaggaggagggggaggccgcggaggcgcccgagtcgctcttcgccagggagctccggcggcgcgggatggcgccgggggccgccgccgcgggcgctaataaggaggcggaggagggggcgccgccggaggccggggccaagcgccgggtggcggccgccgagttcgagcgcgccgccgccgccgacggccagcgccagcggtccatggcgctcaacagcgagggcctcgagggtcttgttcctcgggcaaagttactactatcacttggcggtaccttctttctggcatttgggcccctgattcttgtgaccgtttctctttttgctggtttatatgtgtactttggaccgagttttgtacatgatgcaagcaagacaccggtgtcggtgccaccatacattgatccatacgagctgcttgaggacgagaggctcagccgaccctccccagatgtgttctgaacctgaatagtgcaagaaccagtgcagaaatgtttacaagaaatagtcatacatagcccaacattctctttttttactagacgtgtagttgtaaatgcaactatagctgtagactgatataatcaaaaaaagcttcaatacgcagtgttccatccattgatttcacatc

SEQ ID NO: 274 - DNA, 318 bp, Sorghum bicolor
atggcaatggagcacgtggcgaggctggcgtcggagcgcgcggtggtggtgttcacggcgagcaactgcagcatgggcgacgtcgtgacgtcgctgctgagcagcctgggcgtgaacgcggcggtgcacgacctggacagggacccccggggcatggagatgcagcgggagctggccaggaggctcggcgccggcgccaccgtgccggcggtgttcgtgggcggcgacctcgtcggcgggaccagcagggtcatggcgctgcacctctccggcgagctcgtgcccatgctcaggaacgccggcgcgctctggttgtag

SEQ ID NO: 275 - DNA, 2589 bp, Sorghum bicolor
aaccaagtagctagaagacagagagtgtgtagtagcacccacagacgaagcaaaccaaccaaaattgtcatgctcccacacctacaccagtgattgtgtgaagtgataacacaggggagaagagcgagagagagacagagacagacagaagaaaagatacacagatagatcgccatgccgcctcagctggagcaccatgagcagcagcagcagacagccggaggtggtggccaccgagcagctgcacctcctcctcctcctcctcccaacagcatgcccacctttagcagcagcagtagtagcagcagcagcagcggcactccctctcctacttctgtttctgccaccaccaccaccaccaacgtcccctccggcgccgtcgtccatcccaccacctccagcccgccgtcgtccgccgcctccgcccgccctgccgccaactccttccctctcgtcctaaagttcgaggaagtggtgtacaaggtgaagctcgggaagccgacggccggatggtgcgacaagctgtcggcggccgcgtcgaacatggcgtccttcggcggcggggacgggagcaagaacaagaaggccactgcgtcggcggcagggtcgtcgtcgtcgtcgtcgcgggcgcgggcgcgggagaagaccatcatcagcggcatgtccggggtggtgcgcccaggcgagatgctagcgatgctgggcccgtccgggagcggcaagacgacgctgctgacggcgctaggcggtcgccacggcgggcgagcggcggtgctgtccggcaagatcacctacaacgggcagcccttctccggcgccgtgaagcgccggaccgggttcgtgacgcagcacgacgtgctgtaccctcacctgactgtctccgagacgctgtggtacacggcggcgctgcggctgccgcggtcgctgagcgccggcgagaagcgcgcgcaggcggaggccgtggcgcgggagctcgggctggcgaaggtggccgggagcatggtgggcggcgtccgcggcgtgcgcgggctgtccggcggcgagcggaagcgcgtcagcatcgggctggagatgctggtggacccgagcctgctgctcctggacgagcccacgtccgggctcgactcgacgacggcggcgcggatcgtcgggacgctccgccggatggcggcgcagggcggccgcaccgtggtggtcaccatccaccagccgtcgtcgcggctgtaccacatgttcgacaaggtgctgctgctgtccgccgacggccgccccatctactacggccgcgccgccgacgcgctcgactacttcgcctccgtcggcttcgcgtcgccgctctcactcaaccccgccgacctcatgctcgacctcgccaacggtatcgcgccgcagacgacgagcggcgacggcgccgcggacgggatggcggcggtgaccagcggcagcgagagcgagcacaaggaggtgcgcgccaagctggcggcggcgtacgagcgccacattgcgccggcggtgaagctggacatctgcgcgcgggagacgacgtcgacggcggcgttgccgccgggcagcagcggcgccgggcacgcgacgacgacgtggacgacggggtggtggacgcagttcctggtgctgttccagcgcgggctcaaggagcgtcgtcacgagtcgttcaacaagctgcgcgtcttccaggtgctgagcgtcgcgacgctggcgggcctcctctggtggcgcacgccggcgtcgcacctgcaggaccggacggcgctcgtcttcttcttctccgtcttctggggcttcttcccgctctacaacgccgtcttcaccttccctctcgagcggcccatgctggtgaaggagcggtgctcggggatgtaccgcctctcctcctacctcgcgtcgcgcgcggcgacggacctccccatggagctcggcctgcccacggcgttcgtgctcatcctctactggatgggcggcctcgacccgcgcccggcgccgttcctcctctccctcgccgtcgtgctctacagcgtgctcgtggcgcagagcctcgggctcgccatcggcgccgtgctcatggacgtcaagcaggggaccacgctggcgtccgtcatcaccatggtcttcctcatcgccggcggctactacgtgcagcacatcccgccgttcgtcgcgtggcttaggtggctcaactacagcttctactgctaccgactcctgctcgggatccagttccccaacggcggcggctactacgactgcggcgacggacacggcaagctctgcgccgtcgccgagttcccggccatcaaggccgtcgggctcaacaaccactgggtcgacgtctgcgtcatggcgctgctcctcgtcggataccgcgtcgtcgcgtacattgccctcgatcgcctcaagcccaggtgatgatgatcagcggccattgtctgcagctgcagtggccgagagctgcctgcccaaacatgaaaatggcatgcatccggccatggatggagcagtagaagagtctgattaatcagtcagctccaagaccaagaggcattacttaactggaagaagagttagttaatt

SEQ ID NO: 276 - DNA, 2512 bp, Sorghum bicolor
aatcaaccagacgatttgctgccagtccgccacgtactatagtagaggctcaaaagacgaagaggcaacccacaccaacgacgcgcacagctgcactgcacacaagacactcgtgcactccagcgatgctggcctcagcctgcctatccgcttattccttgtcttcctccccttccaccgccgccacacacggattcctcgtcccctccggcaaccccggccgccgccgccgccgtggacggcggcacatgatgccaggttcttcttctgccgcacacgtaccagcagcaggtctcctcctccacgccagcctgggcggtggcggcgatggtggtgaccgcgacctcggagcagccgacctcccgcacctcccatcctcctcccggcgacacgcgtaagcagctgcgcacaccattcctcctccccacgccactgcgctgacccgcgtcctctactacctcgtcgcggtggccggcgcgcccctgccaaaagcctcatcggcgtcgccaggaccgccttcgcgctcccaacgcgccgttcctccggtacatgaacgaggccgccggcacggtcgtctgcggcgacctcatcgtcggcgccatggcgcagtcgtggaggttcctcatgcagggcgtcacgtcgctcttgttcctctgcgcccgcgccgccgctgccgacgacgacgagtacgtccggccgccgccttgcccgctcgtgctcgtcgcgcacgacaagccggcgtggcatcctcagcaggtacacatctcagtcgtcggatccgaccacatgcgcgtctcgtgggtgaccgacgaccgtcgcgcgccgtccgtggtggagtacggcacgtctccggggaactacacggcgtcatcgacgggcgaccacacgacgtaccgctacttcttctacaagtccggcgcgatccaccacgtgaccatcgggccacttgagcccagcacgacctactactaccggtgcgggcggtccggcgacgagttcaccctccggacgccgccgtccacgctgcccatcgagttcgtcgtcgtcggcgacctcggcgagacggggtggacggcgtcgacgctgtcgcacatcaccgccggcggcggcggcgactacgacatgctgctcctcccgggggacctgtcgtataacgcggacacgcagcagccgctgtgggactcgttcggccgtctcgtgcagccgctggcgagcgcgcggccgtggatggtgacggagggcaaccacgaggtggaggcgctgccggggatccccgtggtgggggagctcgtcaagccgttcgtcgcctacaacgcgcggtggcggatgccgtacgacgacggcgacgacgaggcgagtgggtcgtcgtcgtcgtcgacgacgtcgaacctctactactcgttcgacgcggcgggcggcgcggcgcacgtcgtcatgctgggctcgtacgcggcgttcgtggaagggtcggagcagcaccggtggctggcgagggacctggcgcgcgtcgaccgccgccgcacgccatggctgctggtgctgctccacgcgccgtggtacaacacgaaccaggcgcaccagggcgagggcgagcggatgcgcgtcgccatggagcggttgctctatgaggctcgcgtcgacgtcgtgctcgccggacacgtccacgcttacgagcgatttacgaggatctacgacaataaggccgacagccgggggccgatgtacatcaccattggcgacggaggcaacagggaaggccttgctctcaagttcatcaaggaccacaagtcggcgcacctgtcggagtttcgggaggcgagcttcgggcatggccggctgaggatcgtcaacgagacgagcgccgtgtggacgtggcaccgcaacgacgacgagttcgccaccgtccgcgacgaggtctggctggagagcttggccgccgccgcaaaaccaggcctggcaccgtcgatacccgccggtcgtgacattgatgagctctagaatgctataggaatacaggatacacgattgcaaaaatgcatgggtacgaaaggtatccgtagcatttgttggttatgacttcctcatgtcagaaatatagtttcaccaagattcgttccaagtcaagccgttgactgtatcaatatctaagttttttttactgtatatagtcaatatagattgacaaggttagtattactagattgactgtatcaataatatagattgccaacaagatggaagggaaggcgtcgctgtaccctgggcgggacggaggcttcgacgtgcaggtggcgatgctgccggagcacatggcggcgctagagcaggacgaggagctttgggccgccgtgtcgccggacgcggcgccggccggccagggccacgaaagaatgaaactttttttagcccacaatgctctctccgacgtgaaaaatgttgtttaatttgaatcacatgtccgctttttcgtttgttgcgtgtacttttaaattgtaatcaaattgatgatcga

SEQ ID NO: 277 - DNA, 1262 bp, Sorghum bicolor
cggagcacacgaccaaagtacactactactactaccagtactagtagaatcagcttgcacacgtacctgcgcgctatactagtagagagcagctccactgcaccccactccacccaccacccaccgctcacgccccgccacctcctcctcggattcgccgatggagaagatgctccacgcagcccccgtccacgcgacgctcccggagtgcttcatcttcccgtccgacaagctcccgcaggccaagtccacctccggcgcggtctccctgcccatcatcgacctgtcctcggccgcgacgagggcattcgacacggggaaggagacgcggatctactccagcaccatgttcgacacgggcgccgagaagtactggcgcgactgcctccgcctcgcctgctccttcccggacgtcggcgacagccaccgcggctggcccaacaagccgaccaggctccgggagatcgtcgagcggttcacggcgcagacgcgcgggctcgggatgcacatcctccgcatcctctgcgagggcctgggcctccgcccggactacctcgacggcgacatcagcgacggcgacgtcgtgctccacgtcaaccactacccgccctgccccgacccgaccgccacgctcggcctcccgccgcactgcgaccgcaacctcctcaccttgctcctccccagcatggtccgtggcctcgaggtctcctacaatggcgactggatcaaggttgaccccgtcgccggcgccttcgtcgtcaacttcggatgccaacttgaggttgtgacgaatgggacgctgaagagcatcgagcaccgggtgatgacgaacctgggggtggcgaggacgacggtggccacgttcatcatgccgaccacggactgcctcatcggccccgccgcagagttcctcagcgacgacaacccgccggcgtaccgcaccatgacgttcggagagttcaagcgcatctacagcgtcgtcaagctggggttgtcgctcaacctcaccacgaatctcaaggacgtgcagaagcaggtctgatccaattaattaatgtaggatcggagtatatatgcaaccaataaaattaagtcccttgttagacctcacttgcagccatagctaattaatagctagctggggagaagatgcatgtagtctgtgttaattatgttgttactgctacccggacgtcatgttgctgatgatatgaagcaatgaataaaaatgacaaatatgtgtgtacatgcatgtatggcgc

SEQ ID NO: 278 - DNA, 1678 bp, Sorghum bicolor
tttctttgtgttgttcagacatatgagcgggcattcatcgagaaatggatagcttctgggcatcatacttgtccaaatactcaacagaggatgccaaacacgacactgacaccaaactatgttcttagaagccttattgcgcagtggtgcgaagccaacgggattgatccaccgaagcgcccaacggaggctgacaaacccacatcttcatgctctccaagtgaacgtgctatcatcgatgctctcctctccaagttatgctctgcagatcctgaggaacagagatcagctgctgcagagctccggctcctagcaaagcggaatgcaaataatcggatctgcattgccgaggctggtgccattcccttactattgagtctcctgtcgtcatctgacctgcagactcaggaacatgctgtgactgcacttctaaacctctctatacatgaggataacaagtctagcatcatattatctggtgctgtcccaggcatagtccatgttctgaagaatggaagcatgcaggcacgagagaatgctgcagccacccttttcagcctatcggtggttgatgaatacaaagtaacaattgggggaacaggagctatccctgcccttgtagttttgctaagtgagggcagcccacgtgggatgaaggatgcagcagctgctctattcaacttgtgtatttaccaagggaacaagggccgtgctatacgagctggccttgtgccactcatcatggggctcgtgacaaaccccactggtgcgctgttggatgaggctatggcgatactctcaatactctccagccaccctgagggtaaggctgcgatcggtgcagcagagcctgttcccgtgcttgtggagatgattggaagtgggtcaccgaggaatagagagaatgctgcagctgtgatgttgcacctgtctgtgcataacgggcatttagctcgggcacaggagtgcggcatcatggttccactacgggaactggccctgaatggcacagacaggggtaaaagaaaggcggtgcagctccttgagcgaatgagcagattccttgttatgcaacatgaggatactgtttcccaacaattggacgagattgaacgtcaatttgccgccttaggacctaatgttacagaggctgatcttgaacaattgggtgaacaattgggatatctttaacctccacatgctatggttgcatgatgatgatgaatctatcgtcgccacaatactaccaaatgttttttttggataagttaccaaaaggacgagcaagctgtatccgagtcacttggcttctggatccatggtttatgctgaacgagagttcttgtatggcaatgttcaatcggcactgaaatctgtgatgatccgtctggcttggcttcttccatgcttgtgtgctgaagctcccatcgctccatatctgtttctgggtacgtaagctagcccagaatgttgagatgtgtacagtctacttagtatgccgctccaaacgtcatgtatggctatgttttgactagaatatgtacatttttcactatggtactagataaatgagaagttctagcggcagacttgatcagtaaatcttatttcatgctactggatgttggcgtgagtttcagatttcagaatatgttgacgcgtatgcatttgtgattcc

SEQ ID NO: 279 - DNA, 2331 bp, Sorghum bicolor
cgcgcacccatagtctttctcgcagcgccgccgctccatcttctgctccttcccctactcgccgtcagcggcgctcaggctcgggcgctcagcgacggaggggcagtcccaggctcggcggcggcgtcagcggctccccctcccgcctctcgtccttcgcctcgcgccctcgcctccgtcctccgcgcaccggccggcgaccctgcgtacgcacctccctctcccctcccgcctctgctgtaccgtgggagcccggccagctgcccagggtggccgggccttggctccgccggtggctattgccctcattcctaaaattatttctggatccactactatcaaccaggaactctccaccctggctgctggcgggacgccatggaaggggcggctgcgctctcaccacacgacccctcaaagttttcaaatgcagaggctcccttcccagaccaattacatgggggaggaagaggatctccaaacattgaagaagcaggcttccctcaagaagactgtgagaggttgccaccctagagctgtacggcagttgctgcagctcgatagaagagattctgagcatccaatcgtgatagacaatgaagtaaacgaggaatataaggtcagcgctgatcaatcagcaattatggttctccgcagatccccacggtttcatgtggaagataagagtttgggcaagccgctgttgccaccaaatcacccggagacgcctcctaacaaaaagagtaaaagtgctcatttgaaagacaaaaatcaaaagagtctgaaaagtgatagtagaaatgctcgattggagcctttggcaacaatgaaaaggcagaatgagccccagttactttgtcaagatccccgaggcatcaccagcaggaaaaatattgaagatgtatctaacaaaaagagtgagaagaaagagtttatgcccactaattgtaaagtgttgataggaaagaggaagagaggcagaaaaagggcgttgtcatcgaagaagcaaagttgccaagagccaaaaccattgcctacaaatcgccaagaaattgcaccttgtgatgaacccagaaaatctatccacagaaggattgaaaatgaaccgtctattgtggtgatgcctaaaagtggtgatgaggaattgacaaacattgatgaaaacatcagcaaaccaagtgggactgaaagaggagtgggaaaattttgtagctctgatgattggacaaaagagcaggacatggcattgcgcaaagcttacttcactgctcgaccatccccacatttctggaagagagtttcaaaaatggtgccagggagatctgctgaagactgcttcaacagaattcatgctgacctcacgacaccaactccaatagccccacgtcccagaacaagtaaaacaacattttctcctataggaaatttcacattgtctgatccaaaacttccaaatctcttggaatctagagttgcaaggcaaaggaccgctaaacaaaagggtcttacagcacagaagacagtgaggcatttgttgcagaagcattgtgtcattgaccaagctcaagaggctgatcacttctcagtttttgaaagctcaccaagtgccttacaattgaacttatcttttgaagattctcatgggactcctgacagttatacgaattcaggttctctaggcaaatgcagtggaagctcttcagcacgaaagaaaccaatttcaaggttaagaactaagccatctgaaccgagcccagaagttctaaagcctataaagaatgttatcttacatgagaagtacattgatcaattgtcacgtagagaatatacaaaaaggcctcgcaaaagcactcaaggctctaaagctgctgattctgagaaggctctttctgagcagaaagctggtagtctgaaggctgctaaaaatgctcttatctcagaagcaactgactttataagcagttttaagaaggtgcaagcctgttcccttgcgcatgttgtggaaaatagcgaagatgatgagattgaatgtgatgccagtgattacagccatgatgataaagaataaggaggtgcttatggtgttaattcccagcagctcttagcaattattaccttttttgttaatgggcgttagtcatcactcatcagtgcctggtgcttcaataggtagttactagtatgggtggtatggaggtgtattctgcctaatatgtgtcttgttcctagtgccctcggaactgtaagtgaattgagaaagtgttgccttcatcatgccttatgatgattgaaaccaattgaaattgcaacggtcgaacctgtttctcttgt

SEQ ID NO: 280 - DNA, 1901 bp, Sorghum bicolor
gacgccgtggtcaccgcaccagacgccaatccccaccaccaccaccgcctcccaagtcccagcctgcctcctccgtcctctcccccaagcccgtctcgtctctgttcccgtgcactcagactcagcggcggcgagatggacagcgccgacgcggcgacgccggcgccgctcggcgcgtgggcgtggatccggggatacttcacgccggccacgctcttcctcgtcgtcaacctcgtcatcggcaccatcgcgctcacctcccgcgccacccagcagcgccgtcgcagggagcactactaccacgacgacgcccacggccccggccaccacctccaagaggaaccgctgcacccgcagatggagcaaccggggtacggacactactaccacccggagcagacgctgtacgcggcgccgcctccgcccgcgccgctcgcgcgcacgtcctctgttcttgaccggctcaggtcgctcggcctctaccgcttccgctccggcgagttcccgcccgagtacggcgctgctgctgcggcggcggcggcgccgaactacgcgcaggatgtgtccgctccggtgggggaggaagagacgaccgcgacggcgcactacgccaggagccggtccgagccggcgccttctgcgcgggaggatgagaggaggccggcgctgcccagggtgaagaagtcgggcccggaggtgagaaaatcacaagtggcgccggcgccgcccagggtcgtcaaggcggtcgccgaggtcgacgactccgtggaggaagcgggggcggaggaagccgtcggcggtttcaggcgggtcccgtcgccgctccagcaagagtaccactaccaggaagattacgttcctcctccggcgcgggcgcgggcgcgggcgccagcggcaccggccccgctgcagcgcacgtcgtccgtcctggaccggctccgctcgctggggctctacggcttcctcgctcccgaccaacccaccgccgccgcgccagttccagcgaccgatgccttcgccacccacggggacgagaaccggcacgcgcactacgacaggagccggtccgagccggcaccggtgcagggcaagaaggagaagaagcaggaggcgaagtcaagaatggcaaagtcgggctcggagacgaggaagacgcccgctccgaggccggtggaggccggcggcgagtgcgtcaacgcgagggcggaggcattcatcgacagcttcaggcagcaacagcagcaggtggtgcagcactaccaggaggaggagtacgtcccgcctccagcgcccgcgccgctgtcgcgcacgtcgtccgtcctggaccgcctccgctccttcggcctctaccgcttccgctccggcgacctgggccccgacctccccgccgccgccgacacggacgagaaggagaaggagcagacggcgcactacgggcggagccggtcggagccggcgcgggagcagggcaagaagacgaacaagcaggaggcgaggatgagcaagtcgagctcgagcggcgtcgtggaggaggcggcggcggcggagacggagcagtgcgtggacgcgcgcgcggacgacttcatcaacaagttcaggcaacagctgcagctgcagcggctcaactcgctgctcaactacaaggagatgctcaaccgcggcggcggcggcggcaagcagtaggagcctagcgtcgccgcatgatcagtcatctgtgcgtgcacggcagagaagggttgcatgcaggaattggctagctagatagtaggatccaaattccaaaaacctactaaaacatcaatctttggtcaactactagagtgtgggttatacagtgctgttcttttttggactggaactaattagtacatgtaagaattgctagtttttcatcttgttaa

SEQ ID NO: 281 - DNA, 3316 bp, Sorghum bicolor
cgaaatcacaccgtttccgccccaaaatcaccaccgcgagtccgcgacccgctggccgcaccctgccagatttccagccacgccgacgccgcggcctcgtctccggatccgcctgcctggcgccgccgcctgcctcggtcgcgcggcccctgcccctgccgagccccacgtccacctgcgcccgcctttccgcccgcgtcccaacagcaacaaaagaaggaaacgggcgcacgcggccggcgcctccgccctccccctctcccctctccctctccctctcctcggccgcgcgcccggggcgagccgcgagcgtcctcttccgagccttcttcctccctttccttcctccccacatcgagccaaaagactcccgtctctttcccctcctcctttctcgctccccccctttttttttttccaacctaaacccccactctttccttccttcatcctaccacctagtctcctctcctccacgccggccggcatggccttctgttcccagcgccagtcacctacctcgccacccgtctccatcccacgcctcgccgcctcggataactactagctgccgtaccgtgggagcgccgcctctccagtctcaccaacacctcctcctgctgctctctgttttggattcccgtgccggattgacaccgctcccgcattacagcggcgctcttcgtgcgtgcgccggggccccggtgctcaggatgggggcgacccacgacgccgaggtggaccaggaggaggaggcgcggcgcatggcgagcctcctagcggcgcgccgcgcgctgcgtgccgggctggagaagtcgcgcgcgctgacccacgcgctggccccgcggctggaggccatccaggcgcgtctcccggccatggaggcgtcggtgcggccgatccgcgcgccgcgggaggcgctggcgacggccgggaccaacatcgaccgcgcgctgggccccgccgccgccgtgctcaaggtgttcgacgccgtgcacggcctcgagccgccgctcctcgaccgcgccgccgtcgccgacgacctcccgggctacctcgccgtgctggcgcagctcgaggccgcgctccgcctgctcgccgacaactgcggtctcgccacgcagtggctcgcggacgtcgtcgcatacctcggggagcgaaggctcgccgacggccgcttcgtggcgggactcgccgccgcgctcgaccggctcagggacgccgccgcgaccgccgacctcgacgccgggctgcttgccgccgcgctcgacttgctcgaggccgagttcaggcggctcctcaaggaccactccgcgccgcttgccatgaaggaccccgccggcggcggctccgacccgccggccgtcgtgccgtctcggatccctgcctccgtcgtgtacaagctcagccttatccttgaccgcctcgctgccaacggccggattgaccactgctcgtccgcgtacgcggacgcgcgaggggataccgtgagcgccagcctccgcgcgcttggacttgattacctcaaggagacatcgggggacgcgcaggcgctcagccccagcgtcgagcgctggggccggcatctggagtttgcggtgcaccacctccttgaagctgagaggaagctctgcgtcgccgtgtttgaacgccggccagaggccgcgccggtgtgctttgctgagattgcagctcgtgctggcattcttgatttcctgaatttcggccgtgccctggctggtgccaggaaggaccccataaagctattgcggctgcttgatgtgtttgattgtttgaacaagctgaggctggacttcaaccgattgttcggtggaaaggcgtgtgtagagatccaaagcaggactagggagcttgtcaagacggtcgtggatggtgctgttgagatctttgaggaattacctgttcaggtggagctgcagcgcaatttgccgccaccagttgacggtggagtgccacgcatcgtgagctttgccgccaagtactgcaatcagcttcttgatcagccgtatcgatctgtgctgacacaggtgatcaccatccaccgcagctggcgcaaagaagtgttcaacgacaagatgctggttgaggcagtgcttagtatcattaagacgctagagataaactttgatacatggtcaaagtcttatggagatccgacacagtcatctctcctcatgatgaacatacactggcacttcttcaaacacctgaagggtactaagctgggtgagctgttaggcgatccatggctccgggagcatgaacagtacaaggattactactcaacaatgtttctgagggagagctggggaacacttgcacccctgttgagcagggagggcatgatcatgttctccaagggccgtgctactgcaagagatttagtgaaacagaggctcaaatcattcaatgctagctttgatgagatgtttcaaaagcagtctaaatgggtgatatcggatagggatttgcagcagaagacgtgccacctcgtggtgcaggctgtagtgcctgtttacaggagcttcatgcagaactatgggccgcttgttgagcaggacgttagtgcgagcaggtatgtgaagtacagcgccgacgatctggataagaagctcaacacactcttcctggccaagccaggcaggccaatgagagctggaagtttccaaatcaaaaattcagatgacaagattaccagcgcaatgaccggactgtatcggagtgcttctactctgaagtagcttcagtgggagtttggaaagactgaacgcacaatttgtgcaataagccaataacttggtaggcaaggatgattcgggccagtaagtcaagatccccacttatgtgggggtgtaataatggtcccatgattagaagagctggagcatataagaagaactgacattgcgggggagaagatgacaggagtgtttcctcagagggtctccttcctgtcgatcatcttttcaccttctattgcattcttatctgtagcaagtatactcaattcattttagaaacttgtgtgggagcagaggatgtgtaatcagttatctggtacatgttagtaggttgtattataggaggtgataagttgtttcatatggttatggtatactatgttttagatcttatgaacatgcagtgaactatatggtataactggtggcgaatgggaattacagcagttaattatatggaatagtatactgttttttccctttccaaatttctattgccacactgttacatctttcttcctcctttatggaatggtttactttttgatctgttg

SEQ ID NO: 282 - DNA, 6553 bp, Sorghum bicolor
ggtgggctgccaggttgctggtgaaacagtgtcaaagcccgcttgcacggccgcaaggttgcacgacccatgttgctacattcccaaaggagaagagcttggcattgggctattagactgtaaagcttgcaggttggtctacacatccagggtacattaattatcaaacatctttatgatcccggacctgagttaggcattctcttggaggggaattctgtgggtttaacgtcatcagactggggaagaataatttgatcataatgaaagatatgcaaaataatgaaggtcgtacaccttttgaagacttgacaaacaccatcaattgtggtggccagtcaacatcaaattcaggagaacaaattgatgaacgtgtgcaacgtaaaagggaaagagaaaaagcacgaagtgcatcaatgactcaagaacaaagagatgataaaaataaaaaacttagggaaaagtatcatcaagaaaagtctgaaaaaatgcaatacgtcgtgaacgatatcatcagaaaaaaaacatgtaaaccttggtttatgaattcaatattgtcatttttaagtttatttaaaatatactgaagtatatgttgaccagttgtagttgaatcaaccatgaaaaactatgatggcgatgaagatagtgattggctacatcgagacacctcacccatgcatattgataaagataacacatgtatcgatttgggcttttttccttgtactaattttattttcttatgcttgtatgatgtcgaggacaaggttaatacaattttattatatatatgtagatgattactccaatatatgtatagatcaaagcggcatgattgacattacggatgcatcacctgatctaaacctaggtacaatgtagtttcattaatgttaattgtttgaaaaggaaacgtgacctgcgcaatccaattattgttcattctgtattatatttaggtcctataaatgcatccacttccatcaacaatgttgtcacgtgtccaaaagagcgtaagcgtgaggtagaaagagcacgaagggctgcaatgtctcttgaacaaaaggcgttattaaataagagacgacgtgacttgtatgcacagaaaaatgctgcaagaaaactgcaaatgactccacaagaaaagaaggtgaaacgaaaagagagcaagaaaaaatacaatacgatggtgagggaaaaccgagccaacaatttgcatccggactcaattgctatggagagccctcacttcaaccctcaaattatttttcctgcttcacctcaatcgtctgaagcgcctctagatgatatggaaatacctgaattcggtggcacgcctgtccacattgcaccaactgtagttcaaaatccagaagttcagacccctgaattggttgcggcacagaccatacatagacatcgagtgaccaatggcgagagaaatgcccttctatcccgtcgcaatcgggtttttgaagcaaacattggagcaagggctagaggggcggatgaaaaatgcaacgattcgaacggactgactcaaccgagtgttgtttgcaacgatggtgtcacccaacaaactccaattcaagcacctaataattgtaatggcacacaaacacaaccgtctgtagctgacggtacctcttcaatgcctccatatagtgcacaagatcatacatcagactctatggtcgaggatgactatgacgaagatgtcatatttgaggaggacgaggaagaggatgaggcatactttttcgccggtcaagaagacgaggatgagggaaccgatgtcgacacatatgagcaagagaatcatgagcctgatgtcccagatccatatgaccgggtctatgctaatgtcccatcagagtcgcacatgttaccctcggtgccgaactgcaagcactgtaacgcaaagaaattcgatggcgaaccccccggattctgttgtaggggtggaaagattcatctttcaagtcctgagacaccaccagagctcatgaggttgtggtcaagctcggacgctgatgctaggcactttcgtgcaaacatcagatacttcaacggccacttctctttcacgtctttgtactgccacctagatcgtatcaccactaacatgcgaatctgtggtgtctacacatttcgtgcccatggtcagatttaccataacatacgatcatttggtaaagaggagggtgtcgaaaaaagacacctcgaactttatttttatgatgacgacccatccctcgagcatcgcatgagcaagtgtcgtgagcaatgcgcccaaaaagatagagaagttatacaacagttggtcgggatccttgaagggaatccttactctcagcaactaaggagtatgggtcatgttgaaaacctcgaggattaccgagttgagctgaaccttgaccaacgccttgatcaaagaacatataatgtgccgttgacatcagaggtggccgccgtatgggttgagggtagtgagcgtcatggccaattcgagcatagtgttctcctccaagggaaggatcggtctatacatggcatccgctcatataatgcatgctacgactcactatcatacccgttgttctttccaaagggtgagctcgggtggcacaattgcattccaaaagtgggtgtaactatggctcaaattgatcgagctcgagcaacccgtaaaaggcgtgctgagaatggtgacgacgatggagaacctgtttcaaatacatgtgtctcagtacgcgactactattgctacaagtttcagatgcggccagggatatttaatcctatactctatggccgacgccttttccagcagtttgccgtcgacacctacatcaaaattgagagctcacgtttagactacatgaggaacaatcaggatacattgagggctgacctataccaaggcctcgtggatagcatgcattcgggtgaagggtctgctgagaatgttggacggcgtactgtgttgtcttcgtcattcatcggaggaccccgtgacatgaggcgtcgatacatggatgcaatggctctggttcgaaagtatggtaaacctgatatctttctcacaatgacatgcaaccctaattgggatgagatcaagaatgaactttacccaggccagacaccacaggaccgcccagatctcgtcacacgggtcttcagagcaaagttggatgcaatgagaaaaatgttgatggagaaagacatacttggtaaggtgaaggcctacgtatatgtagtagagttccaaaagaggggattgccgcatgcacacttcttgctaataatggaacgaaagtacaagctcacatgtcccgagcaatatgacatgatcattagtgcagagctaccaaataagaaaaaataccctgagctatacaagatggtcacgaagcatatgatgcatggtccttgtgggacgcttaatccatcctgtccgtgcacggcaggccgtgggtcatgcaagaaccgttacccacgaccattctgtgaggcaacatcacagggaaaggattcataccccatatatcggcgacgcaatgatggtcgcatgctaaaagttcgaggccactacttggacaatcaatgggttgtgccttacaacccttgcttgcttcgtaccttcaactgccatataaacgttgaggcttgtgggagcattaaattagtaaagtatttgttcaagtacatatacaagggacatgatagggcatcagttgtgatgagggagaccgacaaagaggacgggaaaggaaacattgatgagatcaaacagtatagagacgcccgttgggtgacgcctccagaagcactatggaggatatatggctttgacttgagcaagaaccatccaccagtacagcagctgcaacttcatctacccgacatgcacatggtggcatttcataaacgggacaaggtcgaaaagatcgttaataggcctggtgtagaagagtcaatgttgacagcatacttcgatgcaaacaagcatgatgaggaagctcgcaaaatcttatatcgagacttcccagagtattttacttggcagtctgatggtaaattctggcaaaaaagaaaaaactctgttttccaaattggtagagtcatctcggcccatcctgccgagggtgaacgctactttcttcgtgttctcttgaacaatgttgctggtgctacctcatatgaacacctcaggacagttgatggggtgctactaccttcgtttcgtgaagctgcagaaaggaggggtctaatcgaagaggataataccctagatgaatgtctaacggaagctactttgttcgagatgcctaactctctaagaaggctatttgcaacaatattggtattctgcgaaccgcatgatgtgatggggttgtggacaaaacactacgatgcaatgtcagaggactatagtcgcaattatccatcctcagatctcgtgcaacaaatggttttgatagacattagaaacatgttgcagtctatgggaaaggacataaggtcatttcctcttccacatattgatcactcatatgatgatgccagccatatacctcgtgagatatttgaggaagctagcgttgagcagaatcctcaagatgtgctattcaaacaaggcgggctattctttgtggatggacctggtgggacaggaaagacatttttgtatagggcactgctcgcaaaactacgtagccaggataagcttgccgttgccacagctacatctggggtcgcagcggccataatgccaggtgggaggacggcccactcgcctttcaagatacccctaactcttcaagagggcggttgttgtagcttcacgaaacagagtggtactgccaagttgttgcagcaagcagctctcataatttgggacgaggcatcgatgacaaagaggcaaaatttggaagcactagacaacagcctacgtgatatcatgggtcggtcacacctaccctttggtgggaagactgttgtccttggtggggatttcagacaagtcctccctgttgtgcggaaaggatctagggctcaaatagtcggtgcttctctacgaaggtcgtatctttgggaatccatgcgccacctaaagcttgttcgcaacatgagggctcagagtgatccgtggtttgcagattatttgttgcgcattggtggtggaacggaagaggttaacggagatggcaatgttcgtattccagatgagatctgtatcccgtactctggtgatgccgagaaagatcttcatagtctgattgacagcatcttcccaaatctgaatgcaaacatggcggacaaagactacatcaccaccagagcgattttatctacacgcaatgattgggtggacatgatcaatatgaaaatgattgatatgttccaaggtggtgagacggtgtatcacagttttgacaccgcggtagatgatccacataactactatccatcggagtttcttaatagcctgacccccaacgggctgccaccacatgtcttgaagctcaagctcgggtgtcctgtcatattgcttaggaatattgaccccgccaatgggttatgcaatggtacaaggttggtggtacgggggttccgaagaaatacaatcgacgctgaaatcgttgtcgggcagcatgctgggaagcgggtattccttcctcgaataccgttatgtccgtctgatgatgagatgttcccattccagttcaagagaaagcagtttcccatcaggctgagctttgccatgacggtcaacaagtcacagggccaaaccatcccgaatgtgggtgtgtacctgcctgcaccggtcttctctcacggccagttgtacgttgcgatgtccagagccacatcaagaacgaatattaagatcctggccctaccagctgatgcagaggcacaagaggaggaggcaaaaaatttagagaagaaaaatgctaaaaaaaataccacgggaaaaaagcctaagaatgcgttattaaataaaaaagataaggataagaagaccctaacaacggatggaactttcacaaaaaatattgtatataaggaggctatcccctcaagtactccatctctcaccttcgtgtgtcacgtcgcccgcctcttcgcgtcccgcgacgccgacgccacactcgtcctcacgcgtgccaacgccgcaaggctcggtggccccgtcgccggcacggccgccacgggcttccgcgtccgtatcatcacgctcacgttcccacagaggccgctgggcttacaggtggccacgagagcgccgacggccttcccaactgggcctttcgccatcgttgttgaccttctcgcgcctctcttcgctgatctcctgcgtcgccagcctgccaacgccgtcgtgttcgacagcatcctcccgtgggcagccactgccgcctcggagcttggcatccggcggtacgcgttcatcggcacggggagcttcgcgctctcggtgcagcgtgctcagctgctccacaacccacagaatggcgtcgcgtccgacacagagtcgttcctc

SEQ ID NO: 283 - DNA, 1569 bp, Solanum lycopersicum
taattttttattttgatgtgttgtttcttgaagtgttgagattgagggaggagggaaaaaaaacaagaaaaagagagatggggtttgagggtatgaaaaagttgaagcctttattgcatttgttgttaccattatgtgttcattggattgctgaagagatgactgtttctgtgcttgttgatgttactactggtgctctttgtccaggcaaaaccacttgttctgaagctatttacatcaatggtgttcaacaaacagtcgttggaatattcaagatgatagtccttcctatcctaggtcagcttgcagatgagtatgggcgtaaaccgcttcttattctcactgtatctacaacaattattcctttcggtttactcaccatcaataagtcaagggaaatggtctatgcttattatgtcttgcggacgatttcctatatcataagtcaagggagcattttctgtatctctgttgcttatgcggcagatgtagttgacgtgagtagtagagctgcagtttttagttggattactggccttttttctgcatcccatgttctcgggaatgtcctcgcacgttttcttcccgtgggctacattttccaggcatgttggtgtctcttgatctttgttcctgtttatatgacactgtttctagaagagactgtatcaccaaaaacagaggtgacccgaagttcgacactaaagagcaatacacttaagattgtccaggaacgatataactcaatgagatatgctgcaaatctggtcactagcagcccaacactgaagtgcatttctcttgtatcattcttctacgagttgggaatgtccggcatcagcggtgttttgctgtactatttgaaatcggcttttggcttcaacaaaaatcagttctcagaaattttgatgatggtgggagtaggttccatagtctcacagattgtggtgcttcctcttatcaatcctctttttggggagaaagtgatactttgtctggccttgctttcatcaatagcctatgcaatgctctatggattagcatgggcaccttgggtgccatatttaagtgcttcttttggggtcatctacatcctcgttaaaccttctacttatgctgtaatatctaaagcagcactttcagcagatcagggcaaagcacagggctttgttgctggtattcaatcagtcgcgagtttgttatctccaattgtaatgagtccattgacctcatggtttttatcccgcgatgcacctttcaactgcaaaggattcagtatactctgtgcttctttatgcatggtcgtttcactgtgttatgctagcacgctaaaagttgaggcaccacgagagagaaccttcgatgaaattgcagagaacatagaagcaccacttttgacatgatacttttgagacgttggtgaccattttaccaaaattctctatgctataggcacccgaggatgtccctttatacagcgataataagtccggtctacgatctacgtacgatagagttgtaaatcttatgaagctaagtctgatcttagattagaaagaagtgtattat

SEQ ID NO: 284 - DNA, 801 bp, Solanum lycopersicum
aaagaccaaacattttctctgttttttcaacaatgcagaggtcaacaaaacttagtggtgaagaagagttttcaatcatggttgctgctttaaccaatgtgattactggtgctgcaactatttcatcatttccttgtacgagtggtatgtcgccgcccttgtttcgcgtaccggaagaaacagagcgttgtcagtactgcaaaataaatggttgtttaggctgcaactattttgcaacctcatcagctgcagctggtgttgttaacaacaacaaggcattaaagattgttgggaagacgaaaaagaagaagaagaattacaggggagtgagacagagaccatggggaaaatgggcagcggaaattagagatccaagaagggcagctagagtatggcttggaacatttactacagctgaggacgcagctagagcttatgacagagcagctattgaatttagaggtccaagagctaagcttaatttctcatttacagattacacttcaattcaacaacacaatactactacacccatgcaagtgctgcaacaacaacaaccagctccctcgcagttacaacaaggaataaacacagaagaagaagagttctgggatcaattgatgaattcggacaatgaaattcaacattatctttatagagaatcatctgattctgctaatggctatattgctcatagcttctaggaagcattttgcatgcacgttcagtatcaaattaaatttgttttttcaattaagattgtgacataaatagttaggcaacatactggagttttgacaa

SEQ ID NO: 285 - DNA, 1229 bp, Triticum aestivum
aaaaacttgcttacttgccgacctgaggatgaggtgcccactagacatgttactatcagaaaaattccaagggtggctgatgatcttcctctctatgacattctaaatgagtttcagaaaggtcacagccacatggctgtggttgttaaacgcactaaagaagacggagcatctgccgaaaagaataacagttttacaccagattacaaaatgaccaacgggcatgctcatgctgatggtctgggtctgtcaccctcgcatgtcaacatttccggaagtcgtcgaaataacaatgacaagtacagtaagaaaattgaaagaaaacgggacaacattcttgatttcaacaccgatccacttcctcactattcaatggatgaggaagcggtgggaataattacgatggaagatgtcatggagcaactgctgcaggaagatatcttggatgaaacagatgagtatgttgatgtgcataacaagatcaaaataaacatgttaccgccaggcaaatcattgtcgcctcttatatctcctagtggtggacctctgtctcaaggactaagaaagacccctatggcttctccgctgtcgccataccataatggcggctccatcttacgttcccctgctgcaaaccatgctcgatcccctgggactttaccgacagccttttctcctgggaggtcaccggcatctcaaacccccgtgcgcagttcgccgacttcaagttgggtctcgaggaattcgtaccgaaatccgtagaaatggtggtgagagctaatgccaaagagctccaggggcaacaatcccagttgagatcactcccaagatcaaatgaaggcattgaagagtgtaggggtcaaagaatgaagaccccacagctctctgctttgttgctggtccttgtttatttatgactttcttgtacatatatatgtgtcccttagcatctgaacctgagtatggatgagctctcaccacctactgtagacgccctttttgccaaacttgtagcaaccattgcagaagaaaactgcggagagaaacgacgtaaacgaaacgcgttctgtatgtatcgcgcatctgcgcatctgtgctggtattcttgtttgtcagccgccattgtactcactgaaactcaagtaaagtagctgttggtgctagtactgctgatggctgcccccatttatgtaagaactgtacaagcttatgtttctaatgagtttcat

SEQ ID NO: 286 - DNA, 2695 bp, Zea mays
ttttttggataaaagaaaaggaaaaattggaaatgtcgtgggttcgtagctctcgcttcctggtcgtcgcgagtccaaacaaaaagaagttcacaatcaccgcgagcacgcagaaatgaacggaggcttgcgcttgcctgtatcgcgcgaccggagctgagcagcagcacagagtggagccagctcgcttcgcctcctcggtcgcctccacttctatatcacttccccgtctggccccttccccgtgcgccaccgcgcacaatcacacgcgcgcgcccacacgtgcggcttcccggattcgcgccgccgcgccagagccagccaggccagcttcggatcgaggaagaggaggtggcgaaggtgaggagtcaacccagcttccgagccatggacggatcggccgcggagctggaggcggcggagcgggtggtgatgcggtgggactcatcctcggcgggcgccggcgcggacgagccgatgctgttcgacggcggcggggaccgggccgaggcggacaggttcctccgcgccgtcgacgatctgcgtcggctcgcgccgccgtcgcccgcggcagtcggcagcccgcgccgcctctcgtcgtcctcggtggcggcgagcggcgccgtgcaggtcgctatggcgcggctcgaggacgagttccgccacgtgctgtcgacgcgcgccctcgacctcgagatcgaggcgctcgccgacctcagctcgctctccatcaacagtgaccgcaccaactcggcctcctccgccgacctccccgccgctgacgaggacgactccgtgtcctcctccatcggccgccgcagcaccgcctaccgctcgctccggagcatccgcgagatcgacctgctacccgacgacgccgtcgcggacctccgcgccatcgcgtcccgcatggccgccgccgggtacggccgcgagtgcgcgcaggtgtacgcctccgtccgcaagcccgccgtcgacgcctccctgcgccggctcggtgtcgagcgcctcagcatcggcgacgtccagcgcctcgagtgggacgcgctcgaggccaagatccgccgatggatccgcgccgcccgcgccgccgtccgcggcgtctttgccagcgagcgccgcctctgcttccacatcttccacgaccttcctatctccaccaccaccatctccgccgcctcagcgtccgccacgcacgacatccctttcgccgaagccgtcaagggcgccgcgctgcagctcttcggcttcaccgaggccatcagcatcggtcgccgctcccctgagaagctcttcaagatcatagacctccacgacgcgctctcggacctcctccccgacgtctccgacatcttcgccgcctccaaggtcgcggagtccatatacgtgcaggccgttgagatccggtctcgcctcgccgatgccgtgagagggatactctcggagttcgagaacgccgtgctccgcgacccgcccaagaccgcggtgcctggcggtaccatccacccgctcactcgctagcgctcgtctttctgctgagggcaatgagctcgcgccgtccttggccgacctcgagctccctgagcttgagaaccagttaccgcttgcctctcacattgtctggatcattgttgttcttgaacacaacctggagggcaaggcggcactctacaaggatccagctctctcgcatctgttcatgatgaacaatgttcactacattgtccacaaggttaaagattcgccagatctctggagcatgatcggtgataattacttgaaacggcttactaccaagttcacaatggcggccacaaactaccagcgcacctcatggttgaagatcttgaattgtttgcgtgatgaggggctccatgtaagtggtggcttttcgtcggggatatccaagtcggcactgcgggagcggttcaagtccttcaatgctgcatttgaggatgcgcatagggtgcagtcagggtggtgtgtgccagacaaccagctgagggaggagctcaggatctcaattgctgagaagctgctgccagcataccggtcattccttggcagatttcgacatcatatagagaacgggaagcatccagagctctacattaagttctccgttgaggaccttgagatagctgtgagcgatttctttgaaggtgttcctccttccccacataacaggaggaaatcacatggatgagggacttttacctcaggtattcaactggctgatgttgctatttattcttttattcttcacaaagaagctggttctggtatttgggctcgatttcttctgtcctgatagatgtgagtataaatttggtggtcttcaatcagagatggcaaatatgaatacattttgggatctttctgaagctgtcaatcggcccagtgatccctactctgtaagagaaggtgttcatttggtacactataattatataaattttgcaagtagcatgtccatatagaaaattctttcagcaacgttggatagttggaacccatggcatttttgcccctgttttgcaccagcttctgttacccttttcattgttaacaattatcaaatgggtctacgctttgtggattagatgtaaaaagatttctacgactctcatgtaccacatatttttgtaatatgataatatcacgctgttgcaaattcaaaagaaaacttcaagtc

SEQ ID NO: 287 - DNA, 1841 bp, Sorghum bicolor
aaaaaaagccccacgaggccaccgcagatgtggaatgtggtatgccgtctcccacggtgctcccaccaaatccgcatgcgtatcacgcgaaaaaaagagtctctgtccacagattcctccataggtcggcaagcgcggggcgcggcaccgactccgactccatcggggaaccgtcctccaccaaaccgacctgacctgtgccgcctataaatccaacccaccccggcggccttcttcctttcgttgatagatagatgaaccgcgtggtcgggatccctcttccttccttccttccctgttctctcgtcggtgcgccatgggggtggatgggtaagtggtaggtaaggcgcagttgttgttggtttcgatctgacgcgtctctctgtttctcgaattcataaggtgtgacggactgaactagccggatggatggatccatttcttttaggttggatggttgttagctattttctctgtacccgtcgtcgggtgtcctactaattaccatttgctgattgacttatatatctaggttattatgctgttgtttacgatgactagggctgtgcagttattttgattcgattgccgttcattctggtgggaggataaggcgtctcggttggtgatctgttgatagcactttgtgttgagtcagatctatttgattggttagcctggatgtttttggcatgatcggatcaagatgaattgaagggtgtgtggtttttggttcgtccatgctgtgatctgttcagttgctgtgatctgtttcagttgaaggttgttgattggctgcttgtatctcttcttccttaggatgctgattttgtggcaaaaaccagtgcctgttggttgttataggaaactatactggactgctcagaattctgcactgtttggtcctgatcgtgtatccctcgtgatgttgtcagtctagtcacaagatttcttaggtcaactcagaactttttatggagatacgatttagcatgtcatatttggagcaagttatataatcagatgagtactatcagattatttgaaagccttgcaactaaaaatcacatcctgaagttcttgtggttttagtagatataagttgcttcaatgggagccagaacagttcatttagagctgatatgaatgatcacggagatgattatacaattgtactcttcagtaccactttttgataaattcaatttggtggtttcttttaaggagacagggagagtttgatttcatataaggcttacatcctcaagttcatgtgcttttaaataagttggctttctttgggagtgaaaacagttcatttagagctaatatagacatagtcatggagatggttctacaattctcttcaatatcaaaatgatcaattcaaatttggcggttccttttaagattacatggatggattcagagtttgatttgcttctctaaggtttaatttaatgctaggttgtgaacaggattatagaagtgtgcctgttcgaagcttcatttgagtaagatatatggaggaatacttaagttgtggctgctttgctaatttactgttggtattagtttctctggtggtatcatgaggccttctgtataattcctacttccatgggtcttctatttctcaggcacaattagtagtggacatgacttttaggcttctgttactggattatgtgctcattcagagtgttgtagagatcttcaattttgttggttcagtagaactgtaatatatgtacatgtatgatggtgaaatatatttttgcctagagctgtaattattatatgatatggatatatggatattggtatagaacttggcacaa

SEQ ID NO: 288 - DNA, 4847 bp, Sorghum bicolor
cactgacccgctgttacttttatccctttcgtcttcctggcctctgcttgctgtgtttatttcctcggcgccgtcgcttccactgttttcccctttcgtctgagctcggcggatccacgctgttcgtgtcctgtccgttgttgctttcgttctttgctttgccttcttctgcccggcctactgtgttgccttggcgtggccgccgtatttgctgtgtctgtcggattcaccatcgctgagctcgccgtaccacggtgggggctttgcccttgccgccgtgggcctatctggtgttcgtttcgtctgtgtgccagatccagatgacttcggcgtctgcccgttggtgtctgtcgttcttgctgggttgttagcttctttggtttctgttcgttggtcagcttacaggcttggtttcttcggtttggttattgtttattgcttgcatcatttcagcgctgcggattgcctaggtaattcctgcctcttcttttaatcacctctgtgcttatcgtcttatgcctttgttttactctgctaactgatgcacgccacttcctgtctgttttcctttccttcttcctactaaatagttagcatcagacatgaatagtcgatgaggtcacagttttgaaattcatcctttatacactgatgagtttttgctaatttgcatcattgttatgctgctcttatcttttgtaactcctttgattatacaactgccattcgtgggctataattttgttgcgctgaatttgtgcttggttcataagtagttgcaggaaacatttaggtctatcaatatccatttctaaaattcagagatacatacagacatatatgcttcacttcataggaaacattcaggtgtatcaaatttgagacactctatcattgcagaccacatgaggcatagaagctcttaatgcccgcgcgctcactcaagcctaaattatcttccaaaccatacatggatacctccaccatgtagacctgaagcagctaacgatgtcatacatggtccagctaatttatgtaaaaagcactagactgtagtatcagctgttacaacttttgtagtatgtcacattggtattatggtgtgcataggatccatatatattatgttgttgctatgtatgcactactaatatatatcaaaatgtatcgttgtgcatgtgttatccatgcacaacagaatcaaacttatatatgtatgctctctaaatatttgttacaagtagctaggacttaatatctctttagtccccaatcaaaagaaattacagcttctcattctttcttcacacaaaatttcagattttttttgtaaacttaattagaagaacctacaccaactcaacaggaagactatgaagcccatagccccatactgtatagcccacttaaaaaaaaaagttggtcctataggcccaacaaagtaaataaaaaaaggacacaaaaaaggcaaaaaaaagatagaactttgaagaggctcctagaaattaggtgagcacactgacaacattaactcatccccacttctccctcatccagacactcccacacatacacctctcacttcggcgccatcaccagacccatcttcttcaccaagttatccaactccgccccctctgctacccacccactggcctccatagctaatcagcaccacacctaaaagcaccctgtccaatccacagtcacataggataggcgaagcaagattgttgcctgcacaggatatcaacattgcagctccaatctctatctctatccacgtggcaccatggcaccaagaatgtactgcgacaacgcctcagtccacattctgtacacttgaatctacaagatcgtcgccgtgcacaaggtcaaagaaacaagatgccagcataccagtaccccaatctcacaataattgaagaaggacaacttcaacgggacgaaagagatgtgtttcaggctgcggtcatcttcgaagtgccaccttcggcgatgcatattataggacacgaagaaatcaacaacgcaatacatcaacaacttcgggtcgacataaatgtacaagacatatcaaagtttggctctaattacttcataaagactaactgtcaacagacaactgccccgatgctacagcacaccttcctcaaagttggctcacacacactaacacttaaaccatggaacccatattacaacgccatcatatttccttgtgagacacagaccaccaacctcagattcaccaatttggccaattcttcccagagaacgctaactgttcagatttctggaataccgccgcatctctgctgtgatttcacagtgaaccggctcctcagtgaaatatgcactatccataccatttcatttgagcccgcgacactatcactcaattgatgtgcatggatcacaaactctcatgcctcaagcagcacatgtagcacttagcaagacacccatggtcctctcctcaacatttggccaatatggtacgacacatatgtacaagaaatgcttggccaactatccccgacaacctatgattggatgccatctttacacatggaggtgacacggatctggacacatagcaaagacatgaagcatgactcaggtatccaaaaactaaacaactgcactcatatataggtgaacagaacgaagttaactctcagccatgaggcggaacgccacacaatccggatacagactcatccattagcatttcaagcgatgacgaacacggatgggaatcagattgaagcataaacattggttgatgctggtgctttgggagaagcaaccaaactgtaaaacccagagctctctttccgtgtgaaatatttttgtatgttatgtaaagtaaggacctaacatcttatgatgctttcgtatggtcagcacaatcaacatgtactaaacttgtttcaaaaaaatatactaaacctgataactgctaaagtatgtagtagtcctctctatatataaccatatcgtctatattatccttccgtaccaccatggctgactccacgattgtctgtactcgcgcgcaaatgcgcgcgtcgaccactagttctcccctaaattctccgacggcttccaggaagagaagcaggtgccacgtcgcctggaattctcgtgtccgtcggatttcccaacggatggccacggttcttcaaagcagattgttccggaagccgattccgctgcttctcgccagattctttcgcttcttacctgcttccgccgcttctcgtccgaatctatataatcaaatatataggccagcttcggcttctcctacccgcttctcaccccttcctctctcctcttcgcgtctctccccgacgctggcaggagcgatggcggctcccgggaccggggctcgacggcggcgcccaccttcctcctcctcctccgttcctccctcctcgcctgcttcgcacctccgttcctccctccccttcatctctctctccctccctcccgaggtggcggcgggcgcgaggtgacgggctgacggcggccctcgcgggcagcgctccgacgcggctgtggcccggcggcccctccctctccctcagcctccacgcggtctcctcgatgcctcctcccgctggggagcatcagcatgtgcttctgtgctcgacgaaaccctagcacatgcagctgtgcaggcgcggcggcccctccatgggcacacctcgacgccgcgtcagtctgcgtttcttcctccagctgttatacgtgctattgcctatggatcaatatgcatgcaattgacagtactccctacggatcaaatatacatgcacttcagaaatttaaagggttcatgttgattcaacttggtcattgtgctgctgttggagctcaggacatgcatcatttgcgcagggatattcggtttagatcacctccaaacaaattagatcagcgatctttttttgtcactttgatttatccaccactctaaattgatttagcacctgagcaagttgtcaatgacatgttagtttcaggattctgcctaggttagtggaggacttggcggacggtagcattgactaaaatttgcccaattttgcctaggttatgggcagatagaagggtttgtttgctgttggaattctgtacagatcctatctcctacagtgcatcaaacaaaaaaaagggcactggaatcttcagctcgtaatggctgaatggaggaaaagaagtaatctagagcgtaggcgtccgtattcaacaacgaaggtgacgatgtaaagggttaatgaagatgggagatgcagaggcgtcagtccgtgtgtatgataaggcgaacttccttggcccatttttttcagataatggcttggttaactttgagaagaaagattcctatgtacagctttcactgtccctaatctcttcaaaatgttaccaacttatgtaacatacatggcttcaaacatatatgtacgtggcttctgttatcagcatgtaaacgcatcagaggctatgcgtgtgtaatagacgcatcctgtacatgtatatctctaggatcattatcttgttacggacaacttgcagtatttactgactcacgcgcgcgatggcgcgcgggttgtactagtatatgtttctttcccccgccacgaaaaggaaaagaggtgaggcgcacgatttccaaaacgctgcgtgttttatagacatttgactgataagttatggcagaaagtactgttggctgatttatttatgagtggcagattcgactgataagctcaagcgaacaaggtggtcataataggaatagatccaaaccccaatgcctgattactgaatgagat

SEQ ID NO: 289 - DNA, 1970 bp, Hordeum vulgare
aaagtcgacagctctttgccgcgtttacccgcctcaccgacgctagggtttcgatccgtgccggcgtccgcgggaggcgtgcttgccagccagagatggaggtggagcgtctcctggacctggccgtcgattacggcttcgaccgcgacttcgccgtagccgccctctcccgcctcgtccacctctacggagagggtggccaagatttcattactgtggagaactgtggcgatgattttattgctgcattggctgatgcaacacaacctactgatgactgggatgacctcaatgcaatagagactgaagcttgtggcaatttgaatgaaatgatgaggaagggtgtaaatgatgaaaaaggaggagttgttcttgatacccctttgttcaaaagggcagactcctccagtaaacataatccgaaagattttgacatatttaatgaaacaaacacccaccatgataatcccgtgggtacccagaagaaggcacaaaccagaaactctaaagctcagacaagaagctcaacaaaatctactgtgaccaaagcaaccaagagatatgaatcaacaactctaacttcaaatagagagggacagccaaatgcatgtctttggaagagaggaattctgagttatgagcagctttcttctctagatgacatcaatttggcaaatgctgtcatctttggcaacaaaagttttaggcccctgcagtatgaagcttgtagtgctgcactggataataaagactgttttatacttatgccaacaggtggtggcaaaagcttgtgttatcagctccctgcaacattgcatccaggtgttactgttgttgtgtgtccattactgtcacttattcaggatcaggtggttgctttaaccttcaagtttgggatacaagcagcattcttgaattctcagcaaacttctgcacaggcatctgcagttatccaggagcttagaaatggcacaccttctttcaaacttctgtatgtcacacctgaaagaatggctggaaactattccttcatggagatcctcaaaggcttacaccagaggggattgctagcaagatttgtgattgatgaagcacactgtgtaagtcaatggggacatgactttcgtccagattaccgaggcttaggatgcctcaaacagcacttccctagagtcccaatcatggctctaactgcaacagcaactgaagctgtccgtaaggacgtcctcaataccttgaggatcccaaacgctttggtacttaagaggagctttgacagacacaacctcaactacatggtgattggcaagactagaactccccagatgcagctgggtgatttactgaaagagcgtttcatgaacatgtctggcattgtgtattgtctctcgaagaatgaatgtgcggacactgccaagttcttgagggagaagtacaagataaaatgtgctcattaccatgctggcttggcggcccgtcagcgaagcagcgtccaagaaaagtggcacagaggagaggtcaaagttatttgtgctacaatagccttcggcatggggattgacaagcctgacgtgcgctttgttgtccacaacacgctgtcgaaatcgatagaaagctactatcaggagtctgggcgggctggaagagacgatcttccagcgcattgtgtggtgttatatcagaagaaagacttcagccgcattgtgtgcatgctgaggagtgctgaaaacttcaagagtgaaaccttcaaggttgcaatggaccaagcaaagaaaatgcaggcatattgcgagctgaagactgagtgtcgcagggagactcttctgggtcactttggcgaacagttcaacagtcaaaggtgtaaagatggcccaagcccctgtgacatctgcctgaaggaagcttcgcgagggcactaagaaagtgttggtcttaactccatgatggcttggaacttatagaggcctttt

SEQ ID NO: 290 - DNA, 1000 bp, Hordeum vulgare
cacctcctcggctcattctacccggccgatcggacgcgcaggcgccggattaatccctccgtgtccgcggcaatggagagcgtggagggaaacggcaccggccgcgggaacctgcagctcgtggtgtcggagctgtgccgcatccaggagctggtgcggcagctggagctgcacctgcacgcgccggacacctccgtcgacctatgtcgcgccctcaccgctcagatcttcgcgctcaccgacaggtccatcggcttcgtcgccgccgcacattcctccgacgccccgacgacgccctccagcacgtccagctccctcagcggcgtctccgaccagcctttcaggaccaacaccaagaagaggaaggcgacggcgaggtggacgagccaggtgagggtgagtgcggccggcggcgcggaggggcctggcgacgacggccacagctggaggaagtacgggcagaaggacatcctcggcgccaagcacccgagggcgtactaccgctgcacccaccgcaactcgcagggctgcaccgccaccaagcaggtgcagcgcgccgacgaggaccccgtgctcttcgacgtcgtctaccacggccagcacacctgcaggccgacaggcggcggcggcggcggcaggaggccgccgacgaaccaacacaacccgcacgcggagagcctgctgcagagcctcagagccggcctggccgtggacgccgatcacggcggcctgaacaccagcgtctgtgtctcacctccgatgacgtcgccgtcgatggcctcgcctgtggcgtctggctccaacgggggtccgaccatgtcgccgtacccggccggcgcgtacacggagtggccgttggacggcgacctccaggaggtggtgtcggtgttcacagccgtgtcagccccgagcatggactaccttttcgagttcgacccgaccttcgacgttgatgcgcccaacttcttcatgtgaggacgacgaacagagcatatctgaa

SEQ ID NO: 291 - DNA, 1949 bp, Hordeum vulgare
cctcttaacgagaacgcagagtctcttttgaatctttgtggcagcggacaggccttctttaaccatgtgctccggcccgcgcaagccgtcgaccccgccgctggcggcgccggcgcccaaggattccgcggccatggcctcgctcctcctcgagctggccgcggcggacgacgtggtggagttcaggcgggttgtcgaggaggagaaggcgtgccttgatgctgcggcctcgtggtatggcccgtcggcggttggcctgggccggctcggcgcggagagccggacgccggccatggtcgccgcgctctacgggagcacggccgtgctggcgcacgcgctgtccgtcgcgccgggcgaggcctgccgcgcgtccgacacggacggcgccaccgcgctccatatggctgcggctggtggcgcggcgaacgcggttgcggccacgcacctgctgctcgccgcgggggcctccacggaggcgctctcggtgtccgggctccgcgccggggacctgctcccgcgcgccgcgggcgtggctgagaagcctctacgcctgctgctcaagtcccccgccgtgtcaccctcctcgtcgcccaagaagtccgcctcgccgccggcgacggtggctgccgcgcaggagcccaggaaggagtacccgccggacctcacgctgccggacctcaagagcgggctcttcagcaccgacgagttccgtatgtacagcttcaaggtgaagccctgctcccgcgcctactcccacgactggaccgagtgccccttcgtgcacccaggcgagaacgcgcgccgccgcgacccgcgccgctactcctacagctgcgtgccctgcccggagttccgcaagggcgggtcgtgccgcaagggcgacggctgcgagtacgcgcacggcgtcttcgagtgctggctccacccggcgcagtaccggacgcgcctctgcaaggacgaggtcggctgcgcgcgccgcatctgcttcttcgcccacaggcgcgacgagctccgctccgtcaacccctccgccgtctccgtcggcatgatgcagccggtgtccccgcgctcctcgccccccaacgggatggacatgggtatgctcagccccgcggggtggccctcgtcgccggccagccggctcaagacggcgcgggagctcgacttcgacctggagatgctcgcgctggaccagtaccagcagaagctgttcgacaaggtgtccaacaacgcgcactcgccgagggcgagctggggcgcgcccaacggcggcctcggctcgccgcgcgcggccgcagggtcgcccgccagaaacatgccggactacaccgacctgctcggctccatggacccggccatgctctcccagctccacgcgctctcacttaaacaggcgggcgacatgtcgccgtacagctccatgccggacacgcagctgcacatgccgacctcgccgatggtgggcgcgaacaactcgttcggcctcgaccactccatggccaaggccatcatgacctcccgcgcctccgcgttcgccaagcgtagccagagcttcatcgaccgcggcgcgcgcgccccggccgcgcgctccctcatgtcgccggcgacgatcggcgagccatccatgctgacagactggggctctcccagcggcggcggcaatcttgactggggctcacccggcggcaagctggactggggcatgcagggagacgagctgcacaagttccgcaagtcggcgtccttcgggttccgcgggcagtccgccatgccggcggcctccgcagccacctcggccgaacccgacgtctcatgggtgaactctcttgtcaaggatggccacacaggcgaccattttccgcagtggttggagcaggagcagatggtggcctgatcccaccccgtcgacgacgatcgatcgatcgatcactggctcatagcgtctagct

SEQ ID NO: 292 - DNA, 764 bp, Hordeum vulgare
aaagtcgacgggatcaatcaagccaaagagaaaggatggcatcaggcttgcaagtgtttggccagccagcatctaccgatgttgccagggttctgacatgcctctttgagaagaatttggagttcgatcttgtccgcattgacacattcaagagggagcacaggcttcctgagttcattaggctgcgggatccaagtggacaagtgacattcaagcatggtgacaagactcttgttgatccaagggctatttgccggtacctctgtacccagttcccaaaccagggaaacaggaacctctatgggactggttctctggaacgggcctcaatagaacagtggctgcaagcagaggctcagaacttcaaccctcccagctcggccctcgtgtttcagctggcatttgctcctgttttggaaatccctcaagaccacatggtcattgcagagaatgagaggaagcttcagcaagtcctcaacgtctacgatgaaatactctcgaagaacgagtacctggctggcgatgagttcaccctggctgacctctgtcaccttccggactcgcagtacattgtgagctcggagagggggatgaagctcttcacctccaggaaaaatgtggcgaggtggttcgaccaaatctcgagccgcaagacgtgggagcaggttgtcaagatgcaaatggagcatcctggcgcgttcgagtagcgccttggtggtcgcaagcaagtgtcgagctcatatcgaagagcttaggaattcttt

SEQ ID NO: 293 - DNA, 906 bp, Hordeum vulgare
caacctaccacatggctgtatgtataatactgtactccactgcagcagaagcgaggtgctcgtgaagtcgacgtgatatccagtccagtggccgatccgtgatccgtgttggagagagcgagggagagaagatgcggccgcggctggtgctcttcggcgactcaatcaccgagcagtcctttgcctccggcggctggggcgccgccctcgcggagcacttcgcgaggcaggcggatgtggtgctgcgcgggctcagcgggtacaacacgcgctgggcgctgaaggtgctggacagagccatggagggggcggccgacggaggcgcggacccggcggcggtgacggtgttcttcggcgccaacgacgccaccctgcccgaccaggcgcaggcgcaccagaacgtcccgctcggggagtaccaggacaacctacgcgcgatttgcgcctacttcaagaataagtggccctccgctgccgtcatactcatcacccctccaccgatccacgagccggcaaggattcgagacatatatggagataatgacccttcaagacagcctgaaagaaccaatgaagctgctggcacttatgcacaggcgtgcatagctgttgctaaagaattgggtcatccagttatagacatctggacgctgatgcagcaatttcctgattggcaaacatctgcattaagtgacgggctacatttcaccccgtccgggaacaaaattttgttcgacgaggtgctgaagacactggaaagtgttggtttcagccagcacagtctccggtccgatctccctctcttccatgaaattgaccccaaggacccgctgaaagcctttgaaatttgaagaaggtattcgccgcatggttctgaaaacaagctatgcttggtttggtgactga

SEQ ID NO: 294 - DNA, 1157 bp, Hordeum vulgare
aaaggatccgtgaatcctacggctattccagcccctgaacctgaaccctcccccctttccgtgccatactgcaaagcgcaaggcaccttttcgcttccgcccctctccttccttctccccctccgccgcctgctcgccgtcctccgatccgccgcccccgtccgtctccatgggtctcctctccaacaggatcgggaaggagagcctgaaggcgggggatcacatctactcgtggagggccgcgtgggtctacgcgcatcacggaatatacgtgggcgatgataaggtgattcattttacccgaggaagggaccaagaggtcggaacaggaacggtcattgattttcttcttgtgagttcgggccctaataggagcagcacaccatgcttggtatgcagcagcgatgaagttaccgccgccacggagacaaatggtgtgacttcctcttgcctcagctgtttcctgtcagggggtgctctctaccgtttcgagtatgatgtcaacccagcacttttccttgccaaagtacgaggagggacctgcacgcttgcggccactgattccgacgaggtggttgtccgacgtgccaagtacttgttgagcaatggtttcaggtgctacagcctcttcaagaacaactgtgaggactttgcgatatactgcaagactggtctgcttgtggccgagggtaacgtcgggctcgggcagagtgggcaggctgtctccatcattggcggtcctcttgctgctgtggtttcgacgcctttccgcctagtcaccacgaacatctacggaatggcagtgatggctgtcggggtgtactgtgttagcaggtatgcaggtgacattggcaaccgccgagacgtgctgaaggtagaggtggaggagctgacggccgggctcgcaagcggacggattcgtgcggcgaacatcactcagctggcaactccgggacaagtccaggctccggcggtgaccacactcgttgctgcttagaatgcagcaccgatgttgtaaaatatggagatgtatacatcaccatcaccattgctatatttaccacctgttcaaaccttctaaaactgtgccgagattgaacttcccgttcagcaatggctgtgggacgagtgttgtatctgccaccaacggtaccttt

SEQ ID NO: 295 - DNA, 845 bp, Hordeum vulgare
gagagaaatccagaggcgaagcttcagggtttgtaaattttccggatctaatcaactaacccaaaaaagcaaaaaaagaaaccatgagccacttcgccgccatgaagagccccgtcccggtcgccgccgccgccgccaccgacgcgaagagcccactcttctgccccaagccgcgccgcccggtcgcacccctccggtgccaccagagcagcaactccgacgcgggcgccggcatggatctgctcgacctactcctgtcaaagggcgacgagagcaatctttcggcggcgtccccgcagccgcctctgttctgcggctcgcctccgcggcgggcctcgaacccggtggtgcacgacagccggttcggcatggactgtccgtccagtcccctgccgtggtggccggtgatgtcgccagccaccccagcgccggtggtggtccgtcctaccccacgcccggcgggaccgccgatgtcgccccgttccgcagcagggtgcgctcgcgtgttccagccagccgtccgcgttgagggttttgactgcctcgacggcggccgtagcggccgtggccatggcatcgccgccatggtctagatgcacatacaacatcgaataaccaggaaatcttctcccctcggtagtggcaaaaagctttggagggagagagatgagagtgaggagatgagtgagaggagcaagcttaagtccgaaatttaacccctaaaaactatataatccatcaatcaaatcccataagtataatgagtctaggtaattttaccacaaatctttttgtatgtaaataaatttcaggttcagatgcaggtgcccttcttgtaaatttgg

SEQ ID NO: 296 - DNA, 1103 bp, Hordeum vulgare
gtgtgatggagctgcaggggctggggaggtactggggcgtgggcgggaggaggtgcggggcgtgcgctgggtcgccggccgcggtgcactgccggacgtgcgatggccgcagaggcggaggggacggggcgtacctgtgtgcggggtgcgacgccgggcacgcgcgggcggggcacgagagggtgtgggtctgcgaggtgtgcgagctcgcaccggccgcggtcacctgcaaggccgacgccgccgcgctctgcgctgcgtgcgacgcggacatccaccacgccaacccgctggcgcgccgtcacgagcgcgtccccgtgctgcccatcgggtcctcgtcgcctgaggggcaggagcaggacgcgttcgtgatgtcgttcggcggctcggtggacggggagaagcaggacgccgtggtgaacctgaacgacgctctggaggccggccccgacgggaaggagaacgtgaagctggacttcctgttcgcggacatgatggaccctttcttcggctccgagctcccgcgcttcccgcacgctgacagcgttgtccccagcggtggcgcggtggaactggacttcggtggcgttgccgccgccgcagccgtcgtttccaacccgtcctacagctcctacacggcggcgtcgatcggtggaagcggctcctcgtcggaggtcggcttggtgccggacgcgatctgtggccgaggcggcggcatcatcgagctggacttcgcacagtccaaggccgcgtatctgccgtacacccccacgcctagccacagtactgtctcctcggtggatgttgggcctgtgccggagcggagcgaaagcgccgtcgcggcggcgacgccggcgatgggggaggggagggaggcgcgtttgatgcggtaccgcgagaagcgcaagaaccggcggtttgagaagaccatccggtacgcgtcccggaaggcctacgccgagagccggccgcgcgtcaagggccgcttcgccaagcgcgccgacgacgccgacgccgacgccgtcgcagcggccacgatcaccgcgccgcgtccctgcgtgctcgacttcagcggctacggcgtggtgcccaccttctgatga

SEQ ID NO: 297 - DNA, 399 bp, Hordeum vulgare
aaagtcgaccttagctagcgtcagccttcttcctcgagctcatccaccatgggcgactcctcatcatcctcggcttcctacatcagaatggtgcaccatctgatagagaagtgcatttgcttcaacctgaacaaggaggggtgcatggaggccctggagaagcatgccaagatcaacccggtcgtcacttctactgtgtggaaagagctggagaaggaaaacaaggagttcttcgagtcctacaacaaggaccgggtggagaggaacatcgaggcggagacgatggagcggatccagaagatgctcaccgacgcggctgcctccaaaagctcagacgatgacgagggctagaaggctgctgctactacttatctccaagctcatgcgtaggaattcttt

SEQ ID NO: 298 - DNA, 1801 bp, Hordeum vulgare
acacacaggccaatcaatccatcaatccaaggtcagacaatggcggttccgacgccgcagcggcgtctcctggcctgcgcggcgacgctgctcctcgccctcgccttgtcctcgtcgtgcgccgtggccaactacgcggggccgatcaagacggtggtggtggtggtgatggagaaccggtcgttcgaccacatgctggggtggatgaagcggctgaacccgacgatcgacggcgtgacgggcgccgagtggaacccggcgaacgcgtcggacccgtcgtcgggccggcgcgtctacttcggggacggcgcgcagttcgtggacccggacccgggccactcgtaccaggagatccggcagcagatcttcggctccgacgacgcgtccggcccgccccggatgaacgggttcgtgcagcaggcggcctccatcggcggcggcaacatgaccgacgccgtgatgaacggcttcgcgcccgacagcgtcgccgtgtaccgggagctggtgtcccagttcgccgtctgcgaccggtggttcgcgtccgtgccctcctccacccagcccaaccgcctcttcgtccactccggcacctccggcggcgccaccagcaacaaccccgagttgctggccagggggtacccgcagcggaccatcttcgacaacgtgcacgacgcgggcctctccttcggcgtctacttccaggacgtgccggcggtgctcttctaccgcaacctgcgcaagctcaagtacatcctcaacttccaccccttccacaacgcgttccgcgaccacgcccgccgcggctccctacccaactacgccgtcatcgagcagcactacatggactccaaggaccaccccgccaacgacgaccacccttcacacgacgtctaccagggccagatgttcgtcaaggagatctatgagacgcttcgcgccagcccacagtggaacgagacgctcatggtcctcacctatgatgagcatggcgggttcttcgaccatgtgcccacccctgttgacggtgtgccgagccccgacgacattgttggcccgccgccgtataacttcacgttcaacaggttgggggtgcgtgtcccggccatcttgatctctccatggattgagaagggaacagttgtgcatgggccgaacggaaatccaacttcgacgtcgcaattcgagcattcgtcgatccccgcaaccgtgaagaagctgttcaatctgccacaggatttcctgaccaaaagggacgcgtgggctgggaccttcgaaggagtagtgcaaaccagaactgaaccaaggacagactgcccagagcaactcccgatgccgacgaggatccggcagacagaggcgaacgaggaggcgaagctgagctcgttccagcaggagatcgtgcagctggcggcggtgctgaacggggatcaccagctgagcagcctgcaggagaggatcagggagaggatgaacgtgagggaaggcacctcctacatgaggtcggccgtgcggcgcttcttcgaggccggcatgtcggccaagaggatgggcctcgccgacgacgagcagatcgtcaagatgaggccctcccttaccaccaggatcacctcctcccctgcagatcaagatgatagtccgtagagagcacacatgcatatatacataggtcgaaattggtgtttgggatcatcaaaattagtggcactacacatacatagaggatcgatacggtgtgtgcttgtagcgtagccagtacgatatggtgtgctcgtgctacatgtaatggaagcgctgtaggatg

SEQ ID NO: 299 - DNA, 2114 bp, Hordeum vulgare
aaagtcgacaataccgaggctcagttgtttgcatctgctgcatagaggaatttctttttgtaacctgactacaccattcgatgggttccaagaggagttgtcttctgatcacttactccccggagatagtagatggcgtgcctttgtatgtgtcatctaattgcctgcctgttaaagcttccaagtatgaacctgctggtcattctttccatgcggtggcactgaagcttcgtggtctcgacgagaaagaagacactgaaactgatgaccgcagtgtgtcatcagatgacaagagccaagatttttctgctggttcagataacttcagcagcaaaggaaagaagaagtctggttctggaagtcaacaacaagatcactatgcattgctagggctgggcaacttgcggttcttggccactgaagatcagattcgtaagagttaccgtgacatggctcttaagcatcatccagacaagcaggctgctcttcttctccacgagacaacagaggcagcaaagcaggcaaagaaggacgagatagagagccattttaaggccatacaggaagcttatgaggtcctcatggatcctaccaagagaaggatttttgactcaacggatgagtttgatgatgatatcccaacagactgtgcaccgcaagacttcttcaaggtctttggcccagccttcatgaggaatggccgttggtctgttagccagccgattccttctttgggagatgattctactcctgtagtggatgttgaccagttctacaatttctggtataacttcaagagctggagggaattcccacatgaagatgagtatgacttggagcaagctgagtctcgtgaacataagagatggatggagaggcagaatgctaagatacaagaaaaggccaaaaaggtagaatatacgcgagtacgtaatcttgttgacaatgcctacaggaaagaccctaggatccagaggagaaaggaggaggagaaggctgagaaacagaggagaaaggaggcaaaatacatggccaagaaactgcaggaggaggaagctgcaagggctgcagaagaagaaaggaagaggaaagaagaggaggcgaaggtagctgcagcagctgctctcaatcaaaagaagttgaaggaaaaggagaagaagttgctacgcaaagagaaatctcgtctgcgcacacttgtggcaccagtagttgcagagcccagcttcagtctgtcagcggatgatgttgaaacagtatgcacatcacatgatgttgaacatttgaagaaactctgtgatattatggaggacaaggatacagctgaaaaggccaggttgctgaggggtgcactgaacaaagaagaaaactcctcgaatacctcaaaagaagagaaaattcatgccaatggtgtggcgggttctactccaaaatccacagccccacaaggccctccaaaatccacagccccacaagtcattacactaggcaactatgagaaaaaagagaaaccgtggggaaaggaagagattgaattgcttaggaaagcaatacagaagtatccgaagggaacttccaggaggtgggaggttgtttcagagtttattggtaccggtagatctgttgaagagattctgaaggccacgaaaaccgttcttctgcagaagccagactctactaaagcttttgactcattccttgagaaacgtaaagcagctccatctattgtatcgcctctttccacaagagatggtactgaaccatccaagccggctggtggctcaactttgggagctggcagtgagccatccaaggcagctgaacaacctgctgccagcagcagtcagacagccaatgagaaaactggtgctgatcctgtccccgaagaggcaccttctgcaacagatccagatgcctggtcagaggctcaggtgctggcccttgttcaagctttgaaggcgtttcccaaggatgcaaaccaaagatgggagcgagtagctactgctgtccctggtaaaacagtggtgcagtgcaagaaaaaggtttcgtcaatgaggtcgaacttccggaccaagaaggcggagtagaacagaccaccactgaggtaaaggcctttt

SEQ ID NO: 300 - DNA, 1217 bp, Hordeum vulgare
aaaggatccgcggagaaagcaagtaatatcggccatctcttttccaagtgcagaggcaaagttgtgcacgagacacctgcagagggaaccgggaaggagggcgcgcgtgcggcatcgaccaactgcagcgcagcggcgtcgtcccgtccgtggtgccaggactagaagacacaatggaaggaagcatccacggctcatcagagaaaagggttgcggtggtgaccggagggaatcgggggatggggctggagatatgccggcagctggcggagcacggggtcaccgtcgtcttgacggcgagggacgggaagcggggtgctgaggcagcagaaaggctccgagaggaagggctatcggatatcgtgtttcatcagctggagatcagcgagcccgccagtgccgctgatctagctgctttcatcaagggcaagttcggcaagcttgacatattggtaaacaatgcaggagtgctcggggtgacgactgatgtcggtgacccagcaactcttcagcagacgcttgcaggcaaggatgggatggagagagccgaatggctgaggcaacggaccacgcagaccacccaggatgcagaggactgcctgaggatcaactaccacggcaacaagaccgtcacggacgccctcctgccgctcctccgctcctcctccgacggcagagtcgtcaacgtaacctcagcctgggggctgctcaggtatttcagtggcgaggagctccggcgggagctggacgacgtcgacaacctcacgacgcagcggctcgacaagatgtcggccctgttcctcgaggacctgggcaagggcaatggcgccctggagcgccgcgggtggccggctgacacggtgtatgcggcctacatggcgtccaaggcgctggtgtgcgcctacaccagggtgatcgccagggaggagggcgccgcgctgcgggtcaactgcgtgcaccccggctacgtcgtcaccgggatgaacgactacaccggcgtcctcaccgccgcggagggagccgccgccgcggttgcagttgcactggcggagaaggggggcgtcaccggcgcctacttcgatcgcactgaactgggagcgtcctttgtgtgatttctccgtggagcagttgctagcttgctatctttttcaataaagttcagtctacttaatattacttgatctttgcaataacacagtggcatgagtggtaccttt

SEQ ID NO: 301 - DNA, 1905 bp, Hordeum vulgare
ccttctcgtggatctgaatgagctcttccttctggggcggtgaggagtagacggacggacgggcggttcccgaaatggcggtgtcggccaaggagcgcaagctgagtaggctcggaagtggtcaggcggcaaacgggggaggaggcgggagcttcggcgcgaggggcagtcaccggtcttcggcggcggggggacggcggcggctgtttgcggtgttcttcgcgttcctctgcgccggcgcggtggtcttcggcggcgtgcacgtcattggagcgtcctttcggccggtgctcatgacggcttggccgtcggcgaccctgaatgccctctcctcggagcgacgggtgcagcaagctggaggaaacagtgccggcaccgtttcaccctctgtccaaatccggcacgccgtcgttctgccggaccatgttctcgtaatcctcggtgacggatcatcgctgccagctcctgggcattttgagtgcctctactccactgccaactcaacgcagctacgtcgtcgtcccctctcggtcgctgcattgccagatgaacccagcctcgtgcattgccctgccgcaccgccagggatggctgtgtccctatcgctgtcccagtcgcctccggtgacaccattccagtgggatcagctcgtgtacaccgcacttcttgacagccgggataactccaccgttgtgtttgccaaagggatgaacctccgtccaggccggctcggtgtgccatcacggtatgagtgcgtctttggccgggacctgtcgaagcccaagttcgttgtcacctcccctgtggtttctgctgctcaggagacattccggtgtgtgacacctgtccgcattcgccggtacctcaggatgacagctgatggaaacagcaacaggaacagtgatgggaagcccatgttggtctccatcaggactaagggccgggggagctctacactcccctcaatcgcgcaaccagagccacttcctcggtataacaggcatcggcatacaaggcatcggcggcagcagaaagcacactcaatgtgtgtgtgcaccatgctgcgcaaccaagctcggttcctgcgggaatggatcatctaccactcccatatcggagtgcaacggtggttcatctatgataacaacagcgatgacggcatcgaggaagtccttggttccatggatccatccgcatacaatgcgacacgccacttgtggccttggatgaaatcccaggaggctggatttgcacattgtgcactcagggctcgggagagctgcgagtgggtggggttcatcgacatcgatgagttccttcacttccctggcaaccaaactctacaagatgttctccggaattactcaagcaggccaaggattggtgaactcaggactgcatgccacagctttggtccatcaggtcggactaagattcctaagaaaggcgtcacaacaggctacacctgccggctggctgcaccggagcggcacaagtcaattgtcaggccagacgcattgaacccatcactgatcaacgtggtgcaccatttccatctgaaggaagggatgaagtatgcaaatgtcggtcagggagtaatgctgatcaatcactacaaataccaagtctgggaggtgttcaaagagaagttcgccggccgtgtggcaacttatgttgccgattggcaggatgaggagaacgttggatccagggacagggcgccaggtctagggaccaaacccgtggaaccggaggattggccgcgtcggttctgtgaagtatatgacactggtttgaaagattttgtgcacaaagaattcatagatccacagagtggaagtcttccatggtagatgggtaagcacggtatttgatcagcacagcacagcacatggtacatgacaa

SEQ ID NO: 302 - DNA, 2844 bp, Hordeum vulgare
cttcttgaggcgcttctccggagcatttgctggcccggctcggggctgctcggaccccggaggctgtgggagcggttggcggcggaggggcgtcgatctcggccggatctcggcgaatgcccgccgcggggcgctccggtggaccggggcaggtcaacattatgacggggaggaggaagctgcatgtggtgactttggcgatcttgtgtttctggtcatctgctggggtctgcaaagcacaaacagtggatttcaagcctgccgacagctacctggttgactgtgggtctgccaagggcaccacggttctcgggaggaacttcgctgccgatggggcatctccggtgaccgtgtccacctcccaagatatccttgccggcacctcggccaacggtgtgtcttcgttcgacaacccggtgctttaccagaccgcccgcatcttcacgagcccgtcatcctatacttttcctatccagaagcaggggcggcattttgttcgtctctacttctaccccttcatctaccagacttatgatctctccaccgccaagttcaccgtgtcgacccaagatgtgctcctgctcagtgatttccagcagccggacaagacggcccctctgttcaaggaatactctttgaacatcacccgtgaccagcttgtcatttccttcaagccgtcaaacggaattgcattcatcaacgcaattgaggtggtttctgttccagatgatctcatagccgatgtagccaatatggtcaaccctgtgcagcagtacagcggtttgactacacagtcactggagacggtgtatcgtgtcaacatgggtggtccgaaggtcttcccaagcaatgacaccctctcgaggacttggcagaaggatcagaagtacatactgaaccccagtgtgaccaaaactgctcaatatggcaaggctatcaactacaggaatggcggggcaacttcactgacggccccagatattgtgtacagtacagctacggaattggctgcttcaaacacatccaacgcacttttcaacatgacatggcagtttgatgtggatgcaggctttagctatctgataagatttcacttctgtgatatagtcagcaaggcattgaaccagctctacttcaatgcatatgtgggaggcttctttgcacagcatgatcttgatctctcagagcaatcagtgaatcaactggctacagctatctatgttgatgtggttctttcttccaatgatgcatctagcaagctcagcatcagtattggtccatccactttgaacaatgcattgcctgatgggattctgaatggccttgagattatgaagatgggcagtggctctggttctgctttcactgttgggaataatggttcaaacaaaaagttgcccataattattggctcagtccttggggttgttgggcttctgataatcatccttgtcgtggtactgctttgccggaggaagaagaccgatgacaagcagcactccaagacctggatgcctttctctatcaatgggctcacgtctctcagtacaggaagtagaacttcttatggtactacactaacatcaggcctgaatggaagctatggatatcgcttcgccttcaatgtgctccaagaagcaacaaacaattttgatgagaactgggtcattggagtcggaggttttgggaaagtctacaagggagcgttgagggatgacacaaaggttgctgtgaagcgaggaaaccccaagtctcagcaaggtctcaacgagttccggaccgagatcgaactcctttcacgtctgcgtcaccgtcacctggtgtctctgattgggtactgtgatgaaaggaatgagatgatcttggtctacgagtacatggagaacgggaccgtcaagagccacctatatggttcagacaacccctcactcaactggaagcagcgcctggagatctgcattggagcagcaagggggctacactatcttcacactggttctgcaaaggccattatccaccgtgatgtcaagtctgcaaacatcttgcttgatgagaatctccttgccaaagtcgctgactttgggctgtcaaagactgggcccgagctggatcaaactcatgtcagcactgcagtgaagggtagctttgggtaccttgaccctgaatactttcggagacagcagctgactgagaagtcagatgtctactccttcggcgttgtcatgctggaggtgctctgcgcgaggccggtgattgacccttcgctcccaagggaaatggtgaacttggcagagtggggaatgaagtggcagaagagaggggagctgcatcagatcgttgaccagaagctttccggcgcgatcaggccggactctctaaggaagttcggcgagacggtggagaagtgcctggcagactacggcgtggagcggccgtcgatgggggacgtgctctggaacttggagtatgtcctgcagctccaggacgcggattcttcgaccgtgtcggacgtgaacagcatgaaccggatcgtcgacctgtcgtcgcaggttcagcacgtcggtgccatggagagcatcagcgtgacgatggcggaggacggagcttcgcacgagcctgaccacgacctctccgacgtgtcgatgagcagggttttctctcagctgatcaaagccgaggggaggtgaaaacgcgcctgatgatctgtagggtaccgttaggggtgtgagcaagccttggattttttttcttttcttgttgaagtttacctgaaacgtgtcacgtgtaattggttgtttcatcccttgtaattgtgtactgaactacggtttcgatttctgatgg

SEQ ID NO: 303 - DNA, 284 bp, Hordeum vulgare
gatcgatggcgtcggcggctagcaggaaggcgccgtcgctggtggtggcggcgagcgtgggcgccgtggaggcgctcaaggaccaggcgggcctgtgccgctggggctacccgctccgctcgctctaccgacacgccgccgccgcgcccagggtccgcgccctttccgcctcgctctccgaggccgccgccgccgccaccgctccccggccggcctctttgtcggcggaggacacgaagctgcgcaaggcacaccacctcgtctgctgggggcccaactgatga

SEQ ID NO: 304 - DNA, 772 bp, Hordeum vulgare
aaaggatccgccgtgtaaacccataaagttctgttttaagcgcacattgaactttatggacatatctcaggagcaacaacaagattttggtgtgctactaaagcagggggctgaaggaagggtatttgtttccacatttgttggacgaaaatgcgtaatcaaagagcgcttttcaaagaagtaccgacacccattgctggactcaaagctgactctaaagcgcttaaatgctgaagctagatgcatgacaaaagcaagacggcttggtgtacctacaccagttctgtatgctgtggaccctcttccacatacattaacctttgagtatgtggatggcttgtgcgtcaaagatattcttattggatttgggtcaaatgggataaatgaagaacgtcttaatgacattgccacacagatagggaatgcagttggcaaactacacgacggaggtcttgttcatggtgatttgacaacttcaaatatgatgatcaagagcagcaccaatcaactggtgcttattgattttggtctgagctttacatcaactattcccgaggacaaggcagtggacctatatgttcttgagagagccttgatttcaatgcattcttcatgtggtgatgtgatggagaagatcctcgcagcgtaccgaaaagcttcaaggcagtggtgcgccactacgaacaagctagctcaagtcaggcaacggggcagaaagcgaacaatggtcgggtaaaacttgacccggagttactgaatgctaggtaccttt

SEQ ID NO: 305 - DNA, 1799 bp, Hordeum vulgare
ccatcctacgccagataatctacgccgccgcctcccccttccatcccgtatcgccgcaaccagctcaacctcgccccactgtctcgccgctgcccagctcgccgccgactagctcccgaagctcaaaacgaggccttgggcaggcgcccttttcgctctaccccagggccggccccgatggcttgtgcggcttacagcatcaggggccatctcaagcttgccacggggcacggtctggccagtagtcacctgtgcggtggccggaagccttcgctatcttgccctgtttctcgggcatggggtagcaatgtctccactgatgcagcccagcgcgtcgcctcccgttctcatttggctgtccggagttcagaaagatggcccccaatcccaaaagcttcgccggcggacggggccgtcgttgctgaagagaggataactgtactcgtcattggcggtggaggaagggagcatgcgctctgttatgctttgacccgttcgccttcttgcgagacagttttatgcgcccctggcaatgctggtattgctcaatccagggatgcggtctgtataccggacttggacatttccagcagtgattctgttatatcgttctgccgcaagaggggagtgggaatggtggtagtgggtcctgaaggtcctctcgttgcgggccttgcgaatgaccttgtcaaagctgggataccgacatttggtccgtcgtccgaggctgcagcattagaaggatcaaaggactttatgaagaggttgtgtgataagtacaatatccccactgctcagtatcacacattcacagatgctgcaaaagctaaagagtacatcaaggatcaaggggcccctattgttgttaaagctgatggattggcagctggaaagggtgtcgttgttgctatgactttggatgaggccttcgaagcaataaactctatgatggttgacgagtcatttggttctgctggttcgcgggtcgtcattgaggagtatctggagggcgaagaagcctctttctttgcattagtagatggtgaaaatgctttgccacttgaatcagcacaggatcacaagagagttggtgatggtgatactggtccaaacacgggtggtatgggtgcatactcccctgcgccaatagtcaccgaagagcttaagagcgtgataatggaaactataattattccaactgttaaaggtatggctgctgaaggatgcaagtttgttggtgtattatatgccgggcttatgatagagaagaagtctgggctgcctaagcttattgaatataatgtgcgattcggggatcctgaatgccaggttctgatgatgagattggagtctgatcttgcacaggtcctgctatccgcatgcagaggggaactgggcaaggtttcgctgacctggtcacctgaaatcgcgatggtggttgtgatggcgagcgaaggataccctggctcttataagaagggaaccgtaataaaaaacattgacaaggccgagcaggtttctccagctgtcaagatattccatgctggaacagctttggatggagatggcaatcttgtagctgttggaggccgggttcttggcgtcactgcaaagggtaaggacatcgaagaagcgaggtcaagagcgtacgatgcggtagatgtcgtcgactggccagaaggattcttcaggcgagatatcggctggagggcactgaaacaggagcagacggctaactactgattagtccggttttcctgaatctggggtgagcttccagcgtcaagtgaaatgaagac

SEQ ID NO: 306 - DNA, 1056 bp, Hordeum vulgare
atctcaccaccgttcactgccacaatggcttccgagggcttcgccgcgcccgtcgtcgtggacgactgccggggcgtgctgttggtgtacagcgacggggccatagtgcgcggggacgcgccgggcttcgccacgccggtgcgggacgacggcactgtggagtggaaggacgccgagttcgacgcgccccgcgggctgggactccggctatacaggccgtgccagcggaaccagctcctgccggtgttcttttactaccacggcggcggcttctgcatcggctcgcgcacctggcccaactgccagaactactgcctccgcctcgccgccgagctcgacgccgtcgtggtcgccccggactaccgcctcgcccccgagaaccgcctccccgcggccatcgacgacggcgccgcggctctcctctggctggcctcgcaggcctgccccgccggcgacacatggctgaccgaggccgccgacttcactcgggtgtttatctccggcgactccgcggggggcaccatcgcccaccacctggccgtgcgtttcggctccgcggccgggcgctctgagctgggcaacgtccgcgtcaggggctacgtccaactcatgcccttcttcggcggcacggaacggacgaggtccgaggcggagtgccccgacgacgcgttcctcaaccgcccgctcaatgaccgctactggcgcctctcgctgcctcccggcgccacggtcgaccacccggtctccaacccgttcggaccggacagcccggcgctggaggcggtggagctggccccgacgctcgtggtggtcgggggccgcgacatcctccgtgacagggccgtggactacgcggccaggctgcgggcgatggggaagccggtgggggtgagggagttcgaggggcagcagcacggcttcttcaccatcgacccatggtccgcctcgtccgcggagctcatgcgcgcgctcaagcgcttcatagacaccgacggacacttcgactagacccgttccatcgcctccaccattttcctcaactcgtcaatgtgacat

SEQ ID NO: 307 - DNA, 1282 bp, Hordeum vulgare
aaaggatcctacgcactagccacacagtcccggagcggcatgaaagctgggagccccagcactaatgccagcaaaaggcagggggagagcggcatgcccacacgccacgccctccgcacctgctcgacccatcgatccgctagctataaagcacgccaccggagcgtgtgtcctccacactactgccagcctgcttgcttgcttcctaccagctgcctcccgccatctccatcgatcacttgctgccatggccgtgaacgacaccaagctggccgacgccgagaacccgggcacgatgtgccgcgccatcgactccgactccgacgtcgacttcgccggccgcgccaactggctgcgcgcggcggtgctgggcgccaacgacgggctggtgtccaccgcgtcgctcatgctgggcgtgggcgccgtgaagcacgaggtgcgcgccatggtgatctccgggttcgcgggcctgctggcgggggcctgcagcatggccatcggggagttcgtgtccgtctgctcccagcgcgacgtggagatcgcgcagctcgaccgcgacggcaagcgcggcggcgacgaggagagggcgctgcccagcccgatccaggcggcggcggcctcggccctcgccttctccgtgggcgcgctgctgccgctgctggcggccgggttcatcgtcggctacaagttgcgggtggccgtggtggtggccgtggcgacgctggcgctggcggcgttcggggtcgtcggggccgtgctggggagggcgcccgtggtgaggtcctccgcccgggtcgtcgtcggcgggctggccgccatggggctcaccttcggcctcatgcggctcttccgggccagcggcatatgacgtgcgcgcatgcggtcgatggacgagttttttcttgttgatcgtcgtctcgtccatgcatgctttccccgtgaccctacgtacgtacgtggtgccaacgtcttcttccccggccggccggctgatgacctgacgtccgtgcatggaatgtgcatgccccgccgtccgtgtgcgtctctcttcttccctagttgattctctgctgcttaattctcactctctctctctatactgctatcactagtctttgcatcatgcatgcatgccacgctgatgtaacattggccagctgctgctgcatgcatgctatagtagtatttttactcgtgccatattattgtaaggttaccagtagcacgtacctactagtacttgattgggaggtggaagaaggtgacaaggttgggtaccttt

SEQ ID NO: 308 - DNA, 756 bp, Hordeum vulgare
ctcagagccagacaccagcttccatggcaggaggaatcggaggagttgggggaggaacagggggagaggactccttggctcgcagggcctggaggcagtacctgctccagctgcagcgccacccactccgcaccaagatgatcactgctgggttcctcgcaggcatcagtgactccgtggcgcagaagctctctggatatcagaagattgagaagcgccgcctcctgctcaagatgatatttgggtttgcatatggtggcccatttgggcatttcctgcataaaatgttggattatatctttaaagggaagaaggataccaaaactgtagctaagaaggtgttgctggagcagatcacttcctcaccctggaacaatttactcttcttattctattatggatatgttgttgagaagaggcctttcaaggaggtgaaaattagggtgaagaaacaatatctgtcagtgcaattgtctgcttggatgttttggccagtagttggttggataaaccatcagtacgtgcctttgcagtttcgggtgattgtccacagctttgttgcatgttgctgggggatatttctcaaccttcgcgccagagcgatgtctttgaagcagtcatagacatttagttggtgtataacactccatcatggttcaaacttggccggagaacaaggatggtgtttgctatgtaatataccgttgattgtcctagggtatttaaatagttagaggatttcgatacttgtttgca

SEQ ID NO: 309 - DNA, 2639 bp, Hordeum vulgare
aaaggatccgtgcaagaaagatgcggccgtcatggggggatctcgccgtcgtctggtgctgcttcttgctcctcctgctcctccctttcctgtcccatggcaaggacatgcccctgggctccaccctcacgccgggcggcaactcggcggcgtgggcctcgcccaactccaccttctccctcgccttcgcgccgtccccgacctccccgtcgctcttcgtcgccgcggtcacctacgccggcggcatctccatctggtccgcgggcgccggcgcgcccgttgactcgggtggctcgctcctcctctcctccaccggcgacctgcagctggtcaacggctccggcgccgtgctctggtcgtccggcaccgccggccggggcgtctccgcggccgccctccaggagagcggcagcctcgtgctcaagaactccacgggcggcgccgtgtggcagtccttcgaccacccgacggacaccgtggtcatgtcccagaacttcgcgtccggcatgaacctcacctccggctcctacgtcttcgccgtcgaccgggccaccggcaacctcacgctcaagtgggccaacgccggctccgccaccgtcacctacttcaacaagggctacaactccaccttcaccgccaacaggacgctcagctccccgacgctcacgatgcagaccaacggcatcgtctccctcaccgacggcacgctcaacgcacccgtcgtcgtcgcctacagcagcaactacggcgagagcggcgacatgctgcgcttcgtgcgcctcgactcggacggcaacttccgcgcctacagcgccgggcgcggcagcggcacggccaccgagcagtggtccgcggtggcggaccagtgcgaggtgttcggctactgcggcaacatgggcgtgtgcggctacaacggcacgtcgccggtgtgcgggtgcccgtcgcggaacttccagctcaacgacgcctccaacccccgaagcgggtgcaggcgcaaggtcgagctccagaactgcccgggcaactccaccatgctccagctcgacaacacgcagttcctcacctacacgccggagataaccaccgagcagttcttcgtcggcatcaccgcgtgccgcctcaactgcctctccggcagctcctgcgttgcctccaccgcgctctccgacggctccggcctctgcttcctcaaggtgtccaacttcgtcagcgcgtaccagtcggcgtcgctccccagcacgtccttcgtgaaggtctgcttccccagcgatcccaacccgcccgtcagcgccggcagcacgtcctcctcgcggtcctccggcctccgcgggtgggtcgtggccctggtcgtcctcggcgtggtgtccgggctggtcctcgccgagtgggcgctgtggtgggtgttctgccggaacagcccgaagtacgggccggcgtcggcgcagtacgcgctgctggagtacgcttccggcgcgccggtgcagttctcgtaccgcgagctgcagagatcaaccaaggggttcaaggagaagctgggcgccggcgggttcggcgccgtgtaccgcggcgtgctggcgaaccggacggtggtggccgtgaagcagctggaggggattgagcagggggagaagcagttccggatggaggtggccaccatcagcagcacgcaccacctcaacctggtccgcctcatcggcttctgctccgagggccggcaccggctgctcgtctacgagttcatgaagaacggctcgctcgactccttcctcttcggcgccggcagcaacagtaacgacagcggcaaggcgatgtcgtgggcgacgcggttcgcggtggcggtgggcacggcgcgaggcatcacgtacctgcacgaggagtgccgggacaccatcgtgcactgcgacatcaagccggagaacatcctcctcgacgagcagcacaacgccaaggtgtccgacttcgggctcgccaagctcatcaacccaaaggaccaccggcaccggacgctcaccagcgtgcgcggcaccagggggtacctggcgccggagtggctggccaacctgcccatcaccgtcaagtcggacgtgtacagctacgggatggtcctgctggagacggtgagcgggcaccggaacttcgacatctcggaggagacgaaccggaagaagttctcggtgtgggcgtacgaggagtacgagaaggggaacatcctgcccatcgtggaccggcggctggccggggaggaggtggacatggcgcaggtggagcgcgcgctgcaggtgagcttctggtgcatccaggagcagccgtcgcagcggccgagcatggggaaggtggtgcagatgctggaggggatcatggagctggagcggccgccgccgcccaagtcgtcggacagcttcatgacggtgaccacggccaccacgggcggctccgccagcggcgtcagcagcagcgtggcgtccacgttcgcctcgtcggtggcggcgccgccggcgcccgtgccgtcgccgaacgtcgagcaggagatgtccgtggggcggtcggcatccgcccggacccgcgagatcgcgtcgctgccgctgcgctcgtcggagccatacatgacaatgtagtaacaagtgctgctggaattcttt

SEQ ID NO: 310 - DNA, 1617 bp, Hordeum vulgare
cactagcagtagcagtgagcaaagatttgatttttgcttctcgccggccatagaccaagacaagaagaggaacaagatagggcgatggggatcccgagcccgagcgacgaggtggtccaaatccggcacggggacgcggcgggggacccgaccgtggtcaccgtgagctgccccgacaagaccggcctgggctgcgacctctgccgcctcgtcctcctcttcggcctcaacgtcctcaagggcgacatgagcaccgacggccgctggtgctacatcgtgctctggctcgccgcctcgccgccgccccgggcccggaccgtcgcctgggacctcctcaaggaccgcatcgtccagctctgccccgtccccgcgcccttcggcgtagacaccgcatacctcgccgccgcaggcctcgcgcttgccgacggggagccccaggtcttcctgctcaagttctgctgctacgaccggataggcctcctccacgacgtgacatgcgtgctgtgtgagatggagctcacaattaggagggtcaaggtctccaccacgcccgacggcagagtcatggaccttttcttcatcaccgatgctagagaacttctacacacaaagagcaggagggaagaggcctatgaaaagttgcagagcgtcttaggcgactcggtgacgagttgcgaaatagaatctgcgacacaagacatgtcttcttgcctccaagcatccgcgttgttgccgcctcttgtccttgaacaaatgttcagcgaggtggatgtcgtagatgagcaatcgaaccgctcacggtccgacagtagactgtcggtcacgatggacaactccctcagccctgtgcacaccctgattcagatccagtgcggtgaccacaagggcctcctgtatgacatcatgagaacggtcaaggactgcaacatccaggtctcgtatggccggttctacgcgggccagaagggccggtgcgaggtggatctgtttgctgtgcagtcggacgggaagaagatcctcgaccagcagaagcagaggacgatgtgctctcgactgaggacggagctgctgcggccactccgcgtggcgctggtgaaccggggtcccgacgcggagctgctggtggcgaacccggtggaggtgtctggcaagggcaggccgctggtgttctacgatatcacgctcgcgctcaagaacctccatagacgggtcttcttggccgagatcgggcggcacatggtgaacgatcgggagtgggaggtgtacagggtgcacctgggcgaggacgaccacgagctctcgtgctcggtgcggagcaagatcgtcgacagcgtcaccaacatgctcatgggctgggactgactgactgacttactggtcattgtcttgcaaaagacagagaccggtttaatttgtttgttttgtgtaatgtaggtgccatcgactcagttgtacataggcagggatgttgatggctgctgctgctgcttctgtttgtaaattaaagtggtttcaggttgtttttcactgcctagttaggtcatgctgcatcagtctgaaatactacgattgcctagttaagtgttgttgttaggcaatgatggtgcatagacctgt

SEQ ID NO: 311 - DNA, 1400 bp, Hordeum vulgare
aaagtcgaccaacccaaccacgaggacaacacgccgagatgcagcgcgcggcggcctccctcgcctcctcccgctcagcggccgcctgggcgtgcacctccaccacctcgcgccatgccggcaccggcgcctcctactacgcgcgccgcgacgccgtcgtgcctctccgaattcgcggtcaggaacagccgcccgccgccctccccatgtccctgtcgctgctctcgcggagacggccagcgcggacggcaaaggcggcggctgctgcggcggagctgaccccgtcggcggacgaggtggccgcgggcggcggcattgccggcacggtgcagctcggcgccatgatcgtcgcatggtacctcctcaacatctacttcaacatctacaacaagcaggtcctccaggtgctgccattgccgctcccctacaccatcaccgccttccagctcgccttcggctcgctcgtcatcttcttcatgtgggccgctaggctccaccccgtgcccaagctctccgccgcacagctggccaagatcgcgccgctggccgccgggcacatgctgggcacggtgttcaccaacatgagcctgggcaaggtggccgtctccttcacgcacaccgtcaaggcgtcggagcccttcttcaccgtcctgctctccgccttcttcctcggcgaggtgccgtcgccgctggtgctgggctcgctggtgcccatcgtcggcggcgtcgccctggcgtcgctgaccgaggtctctttcaactgggccggattctggagcgccatggcgtcgaatctgctcaaccagaccaggaatgtgctcagcaagcggctcctcggcggcgaagaggaggagttcatggacgacataaacctcttctcggtgatcacagtgctgtccttcctgctgtccgtccctctgatgctctttgcagaaggggtcaagttctccccagcgttcctccagagcaccggcctgaacctgcaggagctgtgcgtgagggcggcactggccggcctctgcttccatggctaccagaagctgtcgtacatgatcctggcgagggtgtcgcccgtgacccactccgtggccaactgcgtcaagcgagtggtggtcatcgtctcttccgtcctcttcttccggacgcccatctcccctgtcaatgcactggggactggtgcagcactggcgggagtttacctgtactccaggctcaagaaaacgaagcccaagagttgatgaagatgttttttccctgttccagatacaggtttttgatatagaagactaggtcgagaaaatgtattgagatagtaggttgtacagaacttgccacagcccgtagtacacctgtactacagcctacagcagcttctttcaatagtggccagaggatccttt

SEQ ID NO: 312 - DNA, 2266 bp, Hordeum vulgare
aaaggatccccgttcggcaaagatgaagctcgggtgttctcggtttcttttgtcttgccatgttcttctctgcctttcggcgatttgggtgccggccacggccgatgtgccggtagcccaccttaccggctgccaggccaagtgcggcgaggttgacatcccattcccgttcggcatcggcgagcagtgcgcgttgcaccgcggctttaacatcaactgcacgaccgtcaatggcatcctcaagccttttgcgggatatgtcgaggtgaccaaaatctccgtgccagacggcaaggcctggataaacgccacgaccatgtcgtggcggtgctatgatgtggccactgacactatgagctaccaaaacgaaggcctggacctcagaaatacacctttctgggtatcggaggtggataacaaaattatcgtcatcgggtgtaatactctcgcttatatgaggagctttccgtacgtaataggttgctcgtccatatgcgaagacgttaccctcgagaacgacaaatgctctggtgccggctgctgccaagccgatgtcccgaaaggcgtacggtattataacggctatttcaacacaaactacaacgcgaccaaaagctgcagcttcatggcagtgatggaaaaggcagctttcaagttcaacaccagctataccgaatccacggtgttttgggatacatacaatgggacagttccacttgtcctggactggctggcatggccgtcgacttgcgacgtagctcagaacatgagctcctacgcatgcgccagcacccatagtgagtgtgtaaattccaccatcgacgagccaggttatcgttgcacgtgcgctgttggatacaaaggcaacccttatgtccagaacggatgccaagatattgacgagtgccttgaagatgctactctctgcgtctctggaagtggaacctgcacgaacacggcagggaattacacctgctcatgtccccgagggaaggattgggcgaatggcagttgtcaatcccattttcctgtgatacctgtcgtaggtacaactgttggactagtcgtcttagtgattgttttagcctgtgcgtgcatgatccaagagagaagaaaactacaaaagatgaagcgggactactttcggcagcatggtggtctaatattatttgaggagatgaggtcaaagcaaggtattacatttaaaatcttcacagaggaagaactacagcaagccacgaacaggtttagtgagcaacaagtattgggtcaagggggctatgggactgtgtacaagggggttcttgagggcaacgtggaagtagcggtgaagagatgcaagaccgtcgacgagcaacaaaagaaagaatttggtaaagagatgctgatcttgtctgaggtcaaccataaaaacattgtgaagctcctcgggtgttgcctcgaagtggaagtccctatgttggtatacgagtttgtcccaaacggcaccctcttccagctcatacacggtaaccatggcctacgtatctccttggctactcgcttggggatcgcccatgagtccgctgacgcgctcgcctaccttcactcatcggcttcgacaccaatcctccatggtgatgtcaagtcctccaatattcttcttgacagggatcacaaagctaaagtagctgactttggcgcctccatcctggcaccaactgataagtcacaattcatcacacttgtacatggtacatgcgggtatctcgatcctgagtacatgcaaaccaacctgctgacagacaagagtgacgtgtacagctttggggttgttcttttggagctgcttacgggcaagttgccatttaatttcagtcaagatgtcgctgcccgcgagaagagcttatcgatgatgtttatgtatgcgatgaaggtgaataagcttgaggaaatcttggatgatgatatcaagaacgaggagagcacagaaattattgaagaggcggcggagctagcgatgcggtgcttagagatgtgtggtgacaataggccatcgatgaaggaagttgcggagaagcttgatagtctgaggaaggtgatgcaacatccatgggtgcagcgaaaccctgaagagatggaatgcctacttggggagccctcgtcaatggtcagctcgacgataacaagtgctgaatatttcagcatcgagaagaaagctgttaatggtctgcagtcaggtcgttaagtaatcacactattgccttgctttgtttagggtaccttt

SEQ ID NO: 313 - DNA, 1338 bp, Hordeum vulgare
taatattcgtcgttcgggtagggggtcgttccgtccacgcttcacgcgggctgttccttattgttggccggaaatggcgggggagcaccagggcgcgggcgccggcttctggctgccggacgagttcctcgacgacgacttcttctccgacgagaaggcggcggcggcggcggctgctgcggcgggcgcggccaggagcgacagcgacgacgaggacgcggggctcggcggtctctcgcgccgcgtggccggcctcgactgcgacgccggcgaccgcgccgttcccaaggcggaggtgatgtccgggtctccgcagtccacgctctgcgtgctgcaggcttcaggggaggacagccccaccggcggcgcctcgcaggtcagctcgccgccgtcctcgccgctggagcagcagccggccgacccatgggacctgctgcacgaggcggccgggcaggtggcccgcctgcgcgtcgacagcatccccgtgcctgtggttaaccctgctcccatccatggcgccgccgtcgcgccgccggcgaggaacccctctccgccgccgctgcttccgtccccgaagcccgtcggcccttaccagtacccgcccaacaactcgttcgcccagcgccaggctcaagtcgctcgttttcatctcctgaagcagcagcagctgatgaagcaccagagggagcagcagctggccatggctgcggccatggcgtggggctccgccgacgtcgggccgctcggcctgaacccctcggcctggccgccgctgcagaatcccccgcaccacgctcctccgtccgcggccggcatgcgcgccgtgttcctcaccccgcccggagcgaagcgggagtgcaccggcaccggcgtgttcatcccccggcaggccggcgcgcccgccgagcccaggaagaaaccaagctgctcgacggttcttctcccggcgcgcgtcgtgcaggctctcaatctcaacgtcgaggacctcggcgcccgcccgtgctaccccgggaccttcgttcttgatcacgacgcgctggtgagccggagcaacgcgatgcaggcgagccagaagcgcgagcacaatgccaatgccaatgccgatgccgccgccgcgcactcgccgccgctcgccgtggcctgcgaggtcaatctcccgcaggagtggacgtactgagatgcgtgttgccgctctcaagcgtcgttggtctccccccgttttcatggattactatctaatactattacttatttctgttatcatcgatggttagcgctaggtagatgttagctagaggtaggacgcggtggcagtagcatcagcgttaggtgttcttt

SEQ ID NO: 314 - DNA, 2399 bp, Hordeum vulgare
tagaaatggatgaaacaccaactagttctgggcgatctgaagctacttcatgtgaacctagttggtggccgccagactttttggagaagatagaatctgttgccttagcaagggaacaagaagttttggctgaaaaagaatcccgattcaatctgtcaaattcaaagtcctcatcctggaaggcttctcagttactgtggtcaactggaacttattcagggtttattccaaatggtttctattcgatcatcccggataaaaagctgaaggagattttcccaacaataccatcactaaacgaccttcaaagtcttgaagcagatgggcttaagcctgaaataattgtcgtagatgctgaaaaggataagaagattttcatgttgaagcagcttagtggcgcacttgtgaaaggattgaacaatccagctctagtgataaagaagatagcaggtttggtttttgactgcttcaagggccaaaactctgatgcaagcccaggaagagcttcaaccgaagatattcacttcttcggaaatagaggaccacaacttcttgggcagataaggcatggatcatgccgaccccgagctatcctatttaaagttcttgccgatgctgttggccttgagagtaaactcgttgtgggtctacctgatgacggtgcagttggatttgtggactcctacaaacatatgtctgtggtagttccgctgaattctatggagctacttgttgaccttatgcgatttcccggccagttgattcctttttcagccaaggccatctttatatcacatatctctgctgcgggtgagagcgattcagctgaaaatgactcgtgtgattctcccctggagcccaacagccctctatatggattatctgataaagttgaagctgaaggaaccgaagcttcatcaaatctatctggacgttcattgcgtaatacaatgttgagatcgagaacattttcagaggggaaattaagcacatcatgtagtgagccaaacatcgcaaatgccttctggaggcgaagccagaggagaggagttgctgaggaacctcgtggtgctagttcaagtcctgagcatccattaatgagggcaaagggaagatctatacttggtggtgaccggcaatcatttcaagaatacaccgatagagttacattaagatcagatgatcagggggccactagtacacctaaccctcgaagaataagacgaagaagcattagcatcacacctgagattggagatgacattgtgagggcagttcgggctatgaatgaaacactaaagcagaatcgcctccaaagggatcatgttaatgatggttcatgttcatttattggggaggataaaaccaatgcaaatgactgcccaaataatgatgataaatctgggacgaacaatggcttgagaaaccgagctggttctactcagaaggctatgtcattgcctacttctcctcatgactatgggggtgaaatttctgaaacaaacaataattgtgattttataagcgaagagaagatggtattcgcatggaacaaggttttgcaaagctccccttttaataagcctttatcgcctttccaagagtggaacatagatttctctgagcttacaattggtacacgggttggaataggattctttggagaggttttccgtggtatatggaatggcactgatgttgccatcaaagtatttctggagcaggatctcacgactgaaaacatggaagatttttgcaatgagatatacatcctgagccggctgcggcatccaaatgtaatattgtttcttggggcatgcatggtacctccgcacctgtcaatggttactgaatatatggaaatgggatcactgtactatcttatccatatgagtggtcagaaaaagaaactcagctggcgcaggaggctgaaaattattcgtgatatatgcaggggattgatgtgcatacaccgcatgaagatagttcacagggacctgaaaagtgccaactgtctggtgaacaagtattggactgtcaagatatgtgactttggcctctctcgagcgatgacagatagtcctatgactgataactcctctgctggcacaccagaatggatggcccctgagctcataaggaacgaacccttctcagaaaaatgtgacattttcagccttggtgtgataatgtgggagctctgcacattgagacgcccatgggatgggatcgccccagttcaagtggtgtatgcagttactgaagggtcggggcttgaaattccagaagggcctcttggcaagttaattgcagattgctgggcagagccccaagatcggccgagctgccaggagatcctcactcgcttgctcgactgcgagtacgctgagagctgatga

SEQ ID NO: 315 - DNA, 1292 bp, Hordeum vulgare
aaagtcgaccttgctaagggaagggaagggaagggaagggatccggacggcgatggggcaggacgggcagatccgccgcgacagggtcatcatcgacacggatcccggcatcgatgacagcatgacgatcctaatggcttttggagaaccaagtgtggagatcattgggctgacaaccatattcggcaatgtcactacagagtatgctacacgcaatgcgctcttgctgtgtgagagagcagggcatcctgaggttccagtagcagagggcagccctgagcctcttaagggaggagagccacgcgttgctgactttgttcatggatccgatggtcttggtaatttgtctcttcctgcacctaccagtaagaaggttgaggaaagtgctgccgagttcatggttaataaggtctctcagtttcctggagagatatctgtacttgcattgggacccctgacaaatgtcgcattggccatcaaaagggactcgtcatttgcaagcaaggtcaaaaaaatagttgtgctgggtggagctttcttcgcagctggaaatgtcaaccctgctgctgaagcaaatatctatggagatccggatgcagcggatgtagtttttacatcaggagcagctattgatgtggttggcattaacataacaactcaatgctgttttacagacgaggatctcttggaactgaaaaactcaaaaggggtgcacgcacagttcttgtgtgacatgtgcaagttctacagagattggcatgcgaagtctgacagctttcatgggattttcctacatgatcctgtgagctttacagccttagttcatcccgagtacttcacattcaagaagggtgttgtgagagtcgagacccagggcatttgcaccggccatactttgatggatcatggattgaaaaagtggaattcagaaaatccatggtcgggttatgcaccaatttcagttgcatggacagtcaatgtgccaaaggtccttgcatatgtaaagaagctgctgatggcaccctgagaatagaaccagaggtctattctgaatctttgagccgaagtgtaatggttcaggtcaactctcatggccaaagtatatttttctgtttttagaagcaagcataggaggaagggaagcttcctagtgcaaagcaaccaatgggggtaaattctgcacatgacagacagcattgtgacagcattgattccaaacatttatatatacaactacatttcaaatttggaaaaaacttccccatactctgcggtcttgtcttaggcctttt

SEQ ID NO: 316 - DNA, 1261 bp, Hordeum vulgare
cgcaattaacacctcctgcggcggcagacagcctgcctccacccccgccctgtcatcgccctccggcctccgcccacgccgccggccggcgcccatgacgtcatccgcgtcgcaccaccacgacgccccctcggccacctccaccccccgcgccggggccggcagcaccggcagcagcaacggcaacggcaacggcaacggaggccaccacccgcctcctccgcgggcgcaggcgcaggcgcacggggccgcgtacgtgcgcctcatgtgcagcttcggcggccgcatcctgccgcgcccgggcgaccaccagctccgctacgtcggcggcgagacccgcatcgtctccgtcccgcgcaccacctcccacgccgtcctcttcgccgcgctcgccaagctcgcccccgcgctcttcgttcccggcgaccccactccggcgctcaggtacaagctcccgcacgacgacctcgacgcgctcatctccgtctcctccgacgacgacgtcgacaacctcatggaggagctcgaccgcgtccacagcctcgccgccaccgccgtcaagccgccccgcctgcgcctcttcctcttcgccgcctcaccagatcactcctccgcgggcgcgttcggctccgtgctctccggtgtcggcgacgcctcctccgaccagtggttcgtggaccagctcaacgccccaccgcccggttcgatcgagcgcggccgatccgaggcctcgtcggtcgtctcggaggtcccggactacctcttcggcttcgacactacctccgaggagcccagccccggcgcgggtgcgcagcccaagtctgacgcggagatggcgcaaggcgacgacgacgacgcgccggctcccgtgctgggcgctcctctggccccatacgtcgcggagagcgccccgtggccggccccgccgccaccgtacatggcgcagccggtgtactacgtgcctgtgcgccccgtccactacctcgacccggctgggcacggcggctacatgcctgggccggtttaccacattgtcggtggggggagaaaccaagccccgggagatctctacgcgtctgggggcgctggtgccgtctacggcgtcccgcggcccatgccgccattccgtcaggtgatgtacgcgccgccacccgccacggaagtctactcggtggaggggaagccgccggaaggtgagtctcactctccctaggcgcaaggggaggaagagtcatggccgtggtagattctgatgatcgca

SEQ ID NO: 317 - DNA, 1151 bp, Hordeum vulgare
ggaggatgttgagggccgttgcgaggtgctgcgggcactggccgccgggcgcggcggcggcggacggcatgctctggcagacggagctgcggccgcacgccgcgggggagttctccatggccgccgcgcaggccaacctcgtcatggaggaccaggcgcaggtgctcgcctccccggctgccacgctcgtcggcgtatacgacggacacggcggccccgacgcctcccgcttcctccgctccgccctcttcccccacgtccaacgcttcgccaaggagcaggggggcgtaaccgcggaggcgatccggagggcgttcggcgcggcggaggaggacttcctgcacgaggtccgccaggcctggcccaagcgcccgcggatggccgccgtcggctcctgctgcctgctcggggccatagcgggggacacgctctacgtcgccaacctcggcgactcccgcgccgtcctcggccgccgcgtcgtcggcggcggggtcgccgtcgccgagcgcctctccaccgaccacaacgtcgcctccgaggaggtccggatggaggtctcatcgcagaaccccgacgacgggcagatcgtggtgcacaccaggggcgcctggaggatcaaggggataattcaggtgtcaagatccattggtgatgtatacttgaagaaaccggagtatagcttggacccattatttcggcagatcggccctgttattgcattgaagaggccagctcttagcgctgaaccacaaattcatgtccgcaagctcaaaccaacagatcagttcataatatttgcctcggacggtctttgggagcatcttagtgatgacgctgctgtgcaaattgtcttcaagaacccaagaacgggtatagcaaaccgattagtgcggtccgccttgaaggaggccacgaagaagagagaggtcagcgtgcacgacctgaggacgatagagcggggcgtgcgacgccatttccacgacgacatcagtgtcgtcgtggtgtacctcgaccggcaccggggtcgtcgccagaccaaggtggtggactcgagcagcaactgcaccagcgcccccgtcgacatctactcctcctccagctccgtccagtcggcgcagccacggcaggcttaccgtgactccggttaataa

SEQ ID NO: 318 - DNA, 848 bp, Hordeum vulgare
ggattagttgagcagaaggcagtcggcggcctctggattgatttgcacgccatgaaattcggtaagtggctcaagcggcagatcgagcagagcctcccggcatggaaggacgagttcctgagctacaacgagctcaagcccgtcatcggcgccgtctcgccggccgagttcgtcgcccgcctcgacgttcaaatagagaagatcaacgccttcttcatcgagcaggaggagttcttcatcatcacccacagggagctgcagggggcgatcaggagcgcgctggagaggaaggtggcggtgccggcggctgcgcacgaggccgagatcgcggcgatccggagggagatcgtcaacttccacggcgagatggtgctgctgctcaactacagcagcgtcaactacatcggcctggccaagatcctcaagaagtacgacaagcgcacgggcgcagggatccggctcgccgtgatcgagacggtgctggtgcagcccttcttcacggtggaggcggtgtccctgatggtgagggagtgcgaggccatgatggaggcagtgttccccacggcgcccggcgaggggcaggcggcggcgcggcgggaccgcgaggccctggtcgcagcggagcagaggatcttccgcaacaccgtgtcggcgctcctggccatgcaggacgtgcgcagcagcagctccacgcgcggccgccactcgctgccgccgctcaacctgccggactcggactggctccgctccttctagccgccgccgtcgtcccccattccattccccgtccaatgacccccgccggcctcttcttggtggcctcaccagccacatccacagatatgtaa

SEQ ID NO: 319 - DNA, 1576 bp, Hordeum vulgare
aaaggatccctacgtaccgtacctgcctagctaagctagccacggggtacgagggaaatccaagaaggagaagaagaagaagaagaagaagcccaccacgtaagggcgggcttccatggcgtctagctgctgcggcaaggggcgcgcgccggtcgtcgtccccttgctagcgctgctcgccgtctcatgcgccttgtcggtgtcggcgagcggcggcgccgggggcaacggcacgcggacggcggagttccgctccggggacgaactgcgagcttaccggaccatcctggcccggatggtcaggatgaacaaggcctccgtcaagaccattcagagctccgacggcgacgtcatccactgcgtgccggcgcacctccagccggcgtttgaccaccccaagttgagaggccaaaagccagaggctgagcccgtggacaggcccaagatcgtcgtcagccacgacgctgccggagaagaagaagaaggggacgccgagttcccgcaggcgtggagcgacggcggcgagtcgtgccccggcgggacggtcccgatacggcggaccacggagagcgacctgcggcggtactccggctccctccggcggtacggcatgaagccccgcgccgccggcgtccggcgcgactccaccagcgacggccacgagcacgcggtggggtacgtgaccggcgaccagttctacggcgccaaggcgagcctcaacgtgtggccggccagggtggcctcggcggcggagttcagcctctcccagatctgggtcatctccggcaccttcggcaacgacctcaacaccatcgaagccggctggcaggtgagccctcagctgtacggcgacaacagccctcgcttcttcacctactggacgagcgacgcgtaccaggcgacggggtgctacaacctgcactgctcggggttcgtgcagacgaaccggcggatcgcgatcggggcggcaatctcgccggcgtcggcgtacaacggccggcagttcgacatcagcctgctcatatggaaggacccgcggcggggccactggtggctgcagctggggtcgggcccgctggtggggtactggccgtcgtccctcttctcccacctcggcggccacgccaacatggtgcagttcggcggcgaggtggtgaacacgcggccggcggggtcgcacacgcccacgcagatggggagcggccacttcccgcgggaagggttcaaccgcgccgcctacttccgcaacgtgcaggtggtcgactgggacaacaacctcctcccggcgagggacctccggctcgtcgccgaccacccggcgtgctacggcatccagggcggctacaaccgcgcctggggcgactacttctactacggcgggccggggaggaacgtgcactgcccctagcgcttacgttacctgccgatcgtcgccggagacggagaaggagaaggagaaggagaaggagaagaaggagatccatcgatcgatctacttatgattgatgagaacagtacgtactgctgattgatcgttgattcttactggtgctacgtacgtgatgatggtaccttt

SEQ ID NO: 320 - DNA, 1153 bp, Hordeum vulgare
aaaggatccgcagcaccagagctagtcggcgcgactcgtcggcgatggggaggacgctggacgtgctgctggggcggacaacgaagcagacggcgcggctgaggtcgctgctgcacctcgccacgaggcgggtcgccgtggtgcgcgcgcaccgggaggtgcggtgcgcgcaggcgcggggggacgtggagcagctgctccggcagggccacccggaccgggcgctgctgcgggccgagcaggtgatccgggagcgggacacgctcgacgccctcctcctgctcgacgcctactgcgcgctcctcgccgaccgctcggcgctgctcgacgcggcgcacggccgggagtgcccggccgagctgcgggaggcggcggcggggctctgctacgccgccgcgcgctgcggggacctccccgagctgcaggaggcccgcgccctcctcgccgccaagttcggccgcggcttcgcgtccggcgccgccgagctccgcggcggctgcggcgtcagcgccaagctcgtgcagaagctcgcgaccacgctgcccagcctcgagagccgccagatggtgctcctcgagatcggcgccgagaaggatatccccgtgcgccttcacaacgacgctaccgccgccgccgagcacgaggacccggccggccgctcccgccatggccatggccacaggaagatgaggcacgacgacgacgacgaacggcgagccgactccgacgagccggagggagacagggccgtctctgcccactcaaagctgacattcaaagacgtggaagaggcggcgcaggccgcgttcgaatcggctgccacggcggcggcggccgccaaggctgccatagagctctcgcgagccgggtccgggagccccgacggcagctacaggaggaaggcgcacgccgccgacgagacgcaccaccgcggcgatgatctggccgatggcaaggccttggagaggatcggacatgttcggaactacagttctgatgcagaagatctgccggagaaacgcggagaacagcaggatacgcccaggagcaggccggcttcagtcaggacgaacagaggactctagtagtttagctacagccatacccatatggcagcagcagagactgtttcttgatttagttgggtaccttt

SEQ ID NO: 321 - DNA, 1601 bp, Hordeum vulgare
ataagaagcggcagaaccctctcgctctcccgccgtttgacccgcctccctccggcatcgcggggttctctgctcgggttgcttgctgggcgctggacatgaaggacggaggggcgaggcagcactggccgtgcgactactgcggggaggcggcggcggcgctgcactgccgcgcggacgcggcgcggctctgcgtggcgtgcgaccgccacgtgcacgccgccaacgcgctctcccggaagcacgtgcgcgcgccgctctgcgccgggtgcgcggcccgcccggccgcggcgcgcgtggcggctgggggaggcgagccggcgttcctctgcgtggactgcgacggcgggtgcgaaggcgcggcgcgcgtgcccgtggaggggttcgcgggctgccccgcggcggccgagctcgccgcgtcgtggggcgtcgacctcctccctggcggcggtggcgccgccgcgttcggttgcggcctcggcactggcgccggccaggaggatgaggacgccttcttcttctcgtccttggactactccatgctggttgaccccgagatgcgcgacctctacgtgccctgcaacccgccggaggtggctgtctcggcaggcggcggtcggcccctcaagggggaagcgctgtgcgaccagctcgcggagatggcgcggcgagagacggacacgtcgcagccgcaggggtactcggatctgagccccaggactcctcgccggtcctccgccgggtctagcgggcgcttgcctgacaagcagcctcccccgccgctgcctcctgctccagaggtgccgtgtccgtacacgtccctgctgatgatgccgtcagcccactgcgccgagcttgtcggcaacgaccggctccctgatgacgacgaagaacaacttcgatgggagttcgccccaccctcatcagtgccacccacccagatatgggatttcaatttaggaagatcaaggaaccacaatgaaaaatctgcacatgaagttggatttggttcaaacaatggaggctttatgatcaagagttacagtgacatgctcaaggaaatttcttgtgggacaacgaaagatctggaagatatttacgactcaggatacggtgcagctgctgaagatatcatgtcaacaaatatctgccaggtgccatccaaaaatgttagcacagcgagcaacaagcgaatgaaggttagctcatgcacctccacaatggatggcccaacaacctctgggagcaacgtgcctgcttcagggaccttggcgagctcttcccatgacagaggagcagctcccactagggagatctcctttggtgatcaaacaatcgtcccgactggagctgagaggcctaccacaaggatcgacagtgagactctcgccctaaacagggatagcgcgatgcagcggtacaaagagaagaggaagaatcgcaggtacgagaagcacatccggtatgagtcccggaagctgagggcggatacccggaagcgcgtgaaaggccgttttgtcaagtcgaatgaagcgctcaatgccggcagcaatggcggatgagccttcttccttgctcgcagcacggagatgacatcctag

SEQ ID NO: 322 - DNA, 4630 bp, Hordeum vulgare
aaaggatcccccatcaccaaaaccctagcgcggccacacaacctctgtgtgccgccatggcgcccaccgcgaagaagccgccgctcaagtccagctcctcgcacaactccgccgcgggggatgccgccgggaagaccatcgaggagatgtaccagaagaagacgcagctggagcacatcctgctgcgcccggacacctacgtcggctccatcgagaagcacacggcggcgctctgggtctacgagaaccgcgccatggtgaaccggcaggtcacctacgtccccggcctctacaagatcttcgacgagatcctcgtcaacgccgccgacaacaagcagcgcgacccctccatggactccctcaaggtcgacatcgacgtcgcggggtgctgcatctccgtcttcaacaacggagacggcgtgcccgtcgagatccaccaggaggagggcatctacgtgccggagctcatcttcggccatctcctcaccagcagtaactacgacgacaacgagcggaagaccaccggcgggaggaacggctacggcgccaaactcgccaacatcttctccacggagttcgtcatcgagaccgctgacgggcgccgccagaagaggtacaggcaggttttctctgagaacatggggaagaagtcggagcctgagattaagaagtgcaagcaatcagagaactggaccaaagtgaccttcaagcctgaccttgcaaagttcaacatgaccgagctcgaagctgatgtcgtggcactcatgatgaagcgagtagttgacatggcgggcacccttggcaaaaccgtgaaggttgagttgaatggcgagaaggtggcagtaaaaagcttctcagattacgtgcaactgtatattgactccgcttccaaagaaggaatcgacctaccaagaatttaccaaaaggtaaatgatcgttgggaggtctgtgtgagtctaagtgaaggccagttccagcaggtcagctttgtaaatggaattgcaaccataaaaggtggaacacacgttgactacgttgcaaaccaaattgccagccatgtgatgggcgttgtgaacaagaagaacaagcaggctaacatgaagtcgcatgtagtgaagggctacctatgggtatttgttaatgcgctcattgacaaccctgcatttgattcacagaccaaagagaccttgacgactcgtcaaggaagctttgggtccaagtgcgagctccctgatgattttcttaagaaggtctctagctcgggagttgtcaacagtctcctttcttgggccgagttcaagctaagcaaggaacttaagaagactgatggaaccaagaagacgagtattgttggcatccctaaactggaggatgcaaatgatgctggtgggaagaactctgacaagtgcaccttgatcctcactgaaggagattcggcaaaggctctagctatggctgggataggtgtagtaggaagggaccactatggcgtgtttccactcaggggtaaattattaaatgtgagagaagcaagccataagcagttaatggagaatgcggagatccaaaatataaagaaaatattaggtctgcagcatgaaaaaaattatgatagcacaaaaggcttgagatatggccacctcatgataatgacagatcaggaccatgatggttcccacatcaaagggttgctgatcaatttcattcacaaagagtggccgtctctcctcaaagttccttctttcttggtcgagttcatcactccaattatcaaggcaactaagggcaaaactgttgagccattttattcgatgccagactatgaagcatggaaagagtccttaggaacaagtgcaagttcgtggactataaagtactacaaggggctgggaaccagcacagctgaagaaggtcgggattactttgaacaaattacccgtcacaagaaggattttgtctgggcggatgacaaagaagatggtgacgctattgagttagcgttcagcaagaaaaagattgctgagaggaaggattggctgaccaactatcagcctggtacttgtcttgaccaacgtgagaaacgcatcaagtacagcgattttatcaacaaagagctgatactcttctcgatggcagaccttgaacggtcaataccttcaatggttgatggctttaaaccaggacagaggaagattttgttttgctcgttcaagaagaatttgattaaagaatctaaggtggcacaatttattggctatgtgtcagaacactcagcataccaccatggtgagcagagtctagcaagcacaattgtaggaatggctcaggattttgtcggcagcaataatattaatcttttggagccccgtggccagtttggtaccagaaatgcgggtggcaaagatgctgctagtgctaggtacatcttcaccagattaaatcctatcacccgcttaatttttccgaaggatgatgatgttcttctgaactatttgaatgaagatgggcagtcaattgaacccacctggtatatgccaatcattcccatggttttggtcaatggaagtgaaggcattggcactggatggagcacctatgtcccaaactacaatccaagagatattattgctaatctgaaaaggttgcttaatggggaggctattgtaccaatggttccttggtacagggggttcaagggttctttgaaggagacaagttcaaaggcaactggtgtgacatataccatcactggtgttatagaggaagttgctgacaccaagcttaaaataactgagcttcctgtccgccgctggactacagattacaaagagtttcttgaatccatgtgtcctattcctatcaaggaaaaggaaaagagcaaggacaagaacaaggaaaagaagaaggacaaggaaaaggacaaggacaaggaaaaggaaaagagcaaggaaccaccattgttagaggaaataaggtcgcagtgtgatcacgcggatgtggaatttgagcttatactgagtgagcaaaacatgaatatagctaagcaagaaggccttgagaagaaattcaagctgactaccacaataggaacaacaaacatgcatttgtttgattcacatggtaaaatcaaaaaatatgacaacccagaggatgtacttcaagagttctttgatttgaggttcaaattctatgtcaaccggaagaaagtaatgatggaaaacatggggaatgagttgctgaagtatcagaacagagttaggtttattcttgctgttatttccgaggacatcatagtcaataacaggaagagggcagacctattcctggagctgaagcagaagaactatacacctttcccaaagaaaaaacccacgtctgggccagttgctgtaggatctacagaagcagaggaagataatgatcagagtcctgctgaagctgcagcaagtgattatgagtatcttcttgcaatgtcgattggtaccttgactttggagaaggtgaacgagctcattgcgcagcaggataagttaaaggctgatcttgaaatgctgcgtaatacagagccacaaactctttggctgagagaccttgacgctcttgagaaggaactggatgtgtgtgatgcaaaacttgaagctgagcagcagaacagatcaagcaagcgcgctaaaaattctgaaaaggcgaaggattctaagccagcacccaagagggcagtggcagctaagaaggcgaaggcgaattcggctgggagtgatgatgatgattatgaagcagcaattccgaaacgtgcagcacaaaagaagaaaccaccacccaaaaaggcaagtgcactggtgaaagatgaagaggaggaagtggctgatctgaaagaccgcctggctgcttacaatattaatgactcctctccagaacccagtgccatggaaacagaagaacagcagaaaggaaagaaaggggggaacggaccaagcaaaagaggtgcagcaaagaaggccatgtcatccttagctgagatttctgatgaagacatagcagagccccagcatgagagcgaggatgaggggtcttccatggaagttgagaagaagactaaaggaaaacagcctgctgctgcgaaaccaaagactgctgccatcaggaagagagcgccagctcagagcaaaggcatgaggcagaaagtgatggaagaaatattcaagcctactgatgacagcaacctcagtgctccttctcctgagaagaaggtgcgaaggatcagggactcccccttcaacaagaagagcggctcggttctgcacagaatggcgagcacttcaacaggggtagaagatgatgaggctcctccctccggcagctctgctgagccagttgcacctagaaggacaacaagggagaggaaggcggcggtagtctacgtcgcttccgggagtgaagatgatgagtctgaggatgaagatgtgtcggaaccaagtgacgatgatgacttctctgaagatgactagactccttggctcaaccgctcaaacattgcagtggctagtgtctagagacatttggttggctaatctgatgtattggtgctttgctcaggtgcatctcttgtgcgtcgtatgttgatatcttt

SEQ ID NO: 323 - DNA, 989 bp, Brachypodium distachyon
gagatatgtttatccagaaggcatggaggacggcggcgtttgggctctacggcttcacccagttcaccaaatcaggattcgcggaacatgccaagaaatttagagaggaggatatgcagatccggttggatgggaaaaattgcctggtaactggagcaaattctggcttaggttttgctacagctgagggattggcttcgcatggggccactgtttatatgctttgtcgtaacaaggaaaggggtgagactgctcttaaacagataagatccaaaaccggcaatatgaatgttcatctggagatatgtgacctttcatctattaatgaaataaaatcatttacgacaagattctcttcaatgaacaagccactccatgtcctggttaacaatgctggcttcctggagcacaagcgtgtgactacaccggaagggttggagctcaattttgctgtgaatgtggcagctacgtacacgttaacagagctagtgatgccattgttggaaaaggcagcacctgatgctcgtgtcattacagtttcatccggaggaatgtacactgagccattgaataacaatttggagtacagagaaagtgactttgacgggaccaaacaatatgctcgaaacaagagagttcaggttgcactcactgaatggtggtctgagaaatacagcaacaaggggatcggtttctactctatgcatccaggatgggctgatacgcctggagtctccaagagcttgccgggactttcagagaagttatcgggaaacctgagatcaaatgaggaaggggctgacacagtggtctggttagccttgcaaccgatggacaagttagtggcaggagctttctactttgaccgagctgaagcccaaaaacatttgaagttcgctgggactgcagcctcccatgcgcagataggttccattgttgatagcattcgctccatctgtggcctgcagcctcccatgcgcagatagtag

SEQ ID NO: 324 - DNA, 1369 bp, Brachypodium distachyon
ggaacccaaagagaggttgccgaaatggagatacagtcgtccgggaggcccatcgaggtgctcatggagaaggtgctgtccatgaacatcgtctcctcggactacttcaaggagctctacaagatcaagacgtaccacgaggtcatcgacgagatctacaaccaggtcgaccacgtcgagccgtggatgaccggcaactgccgcggcccatccaccgccttctgcctcctctacaagctcttcaccatgaagctcaccatgaaccagatgcacggcctgctcaagcaccctgattccccctacatcagagctattggatttctctacctgcgatacgttgcggaaccaaagacgctatggacttggtatgagccctacattcaagatgatgaggagttttcccctgggtccaatggtaaaatgacaactatgggcgtttatgtgcgtgatgtcctccttggtcagtactacttcgacagtcttcttccacgagtgcctctcctaattttgcgtcaggtcactgcccatcttgagaagatgaagctcccaacaaagcagtcagggatgactggggattctagtcgccttggttcagatgatactgcccggcggcctccttcggtgaaggcctctttgtctgtctcttttggtcagcgtgcgccacaccgtgcatccacaagggactcgtccccagttcgaaagacattgccttctatacgggaaagggaaaggagtcatgacggtgatcgtgcaaaatctccacccaggaagcgccgaagtgaaagtcgggagcgtaatcgtggtgaaactgagagggaccgttcggatcgtgatcgtggtagatataacgatagagaacaaggtcggcaaagccgtgatagcagagatcgtgactaccatcgttcgagctatgcagaaagagatgttgaaagacgaggccatgaaaggcgggacaggaactctgatcgaaatggacgttcgagcgcccacagaagcaggagtgggagcaggagtccaagccgtggcagaaccaacggcgaccaccgtcgtgctagcccatttggtaaagcacccgagtcatccaatttggctaagttgaaggatctttatggcgatgcgtcgaatgcaaaggacgatgcaggcgatggcagagctcgcagggattctggagctgaagaggtaatcagattgggaggtgccaggtggaggtgattgtcaaaaccagaaaccgcgagatttaattcttgttgtactaacactgttacatgctgtcagagataaggcaacgtatgatgggattcataccccctgagctgctattctgtctggccattgcgtgtactgaatggaacacaatctgttagctggc

SEQ ID NO: 325 - DNA, 1756 bp, Brachypodium distachyon
ggagacttggtggatgctgtagaaatggtggaggcggtcgcgtccgcgggtgggctcgccatggcgtcctcgacctccgtcacgcccggccaggcttctgctctgctgggatttctttgggttcttgcagcctgggtgtatggtgaggtgctctctcacaagaagaatgctgcttctattaaaacacattcggacatcaatttaccagagatggataatagctcaaacaaagcagaggatcaaacaaagttattagaggagggtggccaagcagcaggtgcaaagcctgtttatgcttctttcgcatcacagatgatcagacttttctttatggaccagtcacttcttctggagcatcgattgacactgagggcaatatccgagcttggaggccatctcctttacttttacatatgtgatcgtacaaatctattcggagagtctgaaaagaattacagccgagatctcttccttttcctctactttcttcttattatagtagcagctattacttccttcaaggtccaccaagataagtcaaccttcacaggcaaatctgtactgtatttgaataggcatcagactgaagaatggaagggttggatgcaggtgctgttcttgatgtaccattacttcaatgctaaagagatctacaatgcaattcgtgtgttcattgctgcatatgtttggatgactggatttggtaacttctcctattattatgtgcggaaagatttcagtctcggacgatttgctcagatgatgtggcgcctcaatttctttgtggcattctgttgcattgtcctaaataatgattatacactgtattatatttgccctatgcacactcttttcaccctcatggtgtatggtgctcttggaattctaaacaaatataatgagattagatcagtgattgctataaaatttgttgcatgcttcttggttgttatcttggtatgggaaatcccaggtgtctttgagatggtctggagcccattcacgtttcttctaggctataatgatccttctaaaccagatctccccagattgcacgagtggcatttccgatctggactggatcgctacatatggattgtggggatgatatatgcttattaccatccgactgttgagaagtggatggaaaagcttgaagaagctgaaacaagaacgaaactctacattaaggcctctatagttacagtttctttaacggttgggtatttgtggtatgagtacatttataagctggacaagatttcctacaacaaataccatccttacacatcctggatccccataactgtctacatctgtctacgcaactttactcaagaattccgtgcctgctctatgacgctattcgcctggcttggaaagatcacactagaaacatatatatctcagttccatatctggctcagatcaaaggtacccaatgggcaacccaagtggctattaacaataatcccagagtacccactgcttaacttcatgctcactactgctatatatgttgcggtttcccataggctctttgaactgaccaatactttgaagatagcatttgtacctcgtgacaacaagcgcctctcgtacaattttatggcaggaattgccatttcagtggctctgtactctgtatcgtttgttctggttggcatagcaggatactagctgttatttagtttgttccagttcccgttctagggtataagcaaagctagtttggttgctcgtgagatcaaattca

SEQ ID NO: 326 - DNA, 1806 bp, Brachypodium distachyon
cggcagattgattcgatttcgatcccgtccccagattttcttcacctcccgatcgctccagacagcctccgcaatcccctccccgaggagcccccccacaacgtgcgtgctcgcacactcgcactcggctccattattaattccccttccccgtccgtacttccaaaacctccccgtcttcctctcctccatctcgttccactcccgcacggccgcattgctcggccgcgtcgcagcggcttcatccctgcattttgttttgggtttgttggatttggtttggtttggtttggttgcgaggagggtttgttcgatcggagcgggcgaggggaggaatcgagaaatgtgggcggtggagcgggtggtgggggagcggcggatgcgggagatccagcggttcgcccggaacgccaagctcaccgtgctctgcctcctcctcaccgtcgtcgtgctccgcggcaccctcggggccggccgcttcggcacgccgcagcaggacctcatcgagctccgccaccgcttcatctcccacccgcagcgcgcgcttgccgagcaccacgacgccaggtccagggcctccaactccgccgcggggaaggtcgccgaccgggatgacgagccggacccgccgccgaggactctcagggacccgccctacaccctgggccccaagatctccgactgggacgagcagcgggccgcctggcaccgccgccacccggagtccccgcccttcctcaacgacgtcaagccgcgggtgatgctagtcacggggtcctcgcccaagccctgcgagaaccccgtcggcgaccactacctgctcaagtccatcaagaacaagatggactactgccgcatccacggcctcgaaatcttctacaacatggcgctgctcgacgccgagatggctgggttctgggccaagctcccgctcctccgggcgctgctcctcgcgcacccggaggtcgaattcctctggtggatggactccgacgccatgttcaccgacatggcattcgagctgccatgggagcggtacggcccctacaacttcgttatgcacggctgggatgagatggtctacgacgacaagaactggattggtcttaacacgggtagcttcttggtgcgcaactgccaatggtcgcttgatttccttgatacctgggcgccgatggggccgaagggtcctgtccgtattgaggctgggagagtgctcaccaagcacttgaaggaccggccagtctttgaagccgacgatcagtcggccatggtgtatatccttgctacccagcgcgagaaatggggtaataaggtgtatcttgaaaatggatactatctccatggctattgggggatcttggtggacaggtatgaagagatgcttgagaattacaagccagggcttggtgatcatcggtggccactggtcactcactttgtcgggtgcaaaccgtgttcgaaattcggggattaccccgttgagagatgcctcaagcagatggaccgtgctttcaattttggagataaccaggtcttgcaaatgtatgggtttgagcacaagtctcttgcgagcaggagggtcaagagaatcaggaacgagaccagcaacccacttgaggtgaaagatgatcttgggttgctccatccatccttcaaggccatgaagactactacgtgataattatagtaaaatccacttattttgttggttcgttctagatcctcttggatcaaaatcttataagttctttttgtagactcagggtgaaaacaaagtttgggttggtatcacgggatggatat

SEQ ID NO: 327 - DNA, 557 bp, Brachypodium distachyon
aaaggatccccagaaattgttgtcaggaaggcaaatgattgctcatgtggtcaaccgggaggatcagtagcgagaagtggagatgatcacccgagcgaagctggtggaacagctgagggagcaacagatccggtcggcgcagacctactccgcggccctcgccgtcttttcgcccaacccccacatctcctccaggcgggatctaaaggttgctctcctatatgctttcttgttctgttttctcatggtgtcgtgctatatggccctttacctgaaatggttcagactttcatccctctttgtacttttcggtatccttctgcaagtaagtctcaaaatctctaggcatagaaggctgaaaaggaaaagggaaagaaagttgttattacccttgtccatgtgaatatctttctgatatcgtgtaacatttaagtaaaatggatgaaccacaaagaggaaaaatcttgttggaccggcttacaccctcaaaaatgtatattttgcttttatgcattcacatacatatgcaccaccaccggtctcagtttggtaccttt

SEQ ID NO: 328 - DNA, 2316 bp, Brachypodium distachyon
aaaggatccaaaccttcgcttcgtctcgactccacttggccattttccctcgccaaatctccgcgcgcgtcaaaccctaggggtcctgctgactcccacgcgccccctccagatccaatgggagcggcgccgtcgacgccgaggcttggcgaggtgggcgccgcgccgccgggcgcggcggagcagatgttcgcggcgctggtcggcgacaaggcctacccgatctcctccgagttctggaagcagctgttcgagctgcccctcaccctgcagtggccgcgggagcgcgtgctgcaggcgtgccacgcgttcgcccagaacaactacaatacgaagcatctcacaaagatcttgatccatttggtttggtgtttgcaagagtgcacgtcagcttcttcagtgtcttatggcgtttatagaaaggccatcaatgctgcctatatatcatccatatttctcaagtttattattgagaacgccaaggcagataattggcaagagctatgccttcacattgacaaggatgagaaggggctggagaattttccttctgatcaaacagtggagtattttctgatgaaaggggtgctgaactacattggtagtgtagatgtaagcccagagtcgtgctacctacatcatgagcttctaaacttgatgttagttcttatgtcgactcagttatgttctggaccatctccagaaccaaaagatgtgcatccttttattgatgcagctatgcttcaggagagtaccacagtgggctctgtagttcaaaagttacttctaaatttcgtgagacgaccacagattcctttaaatggttcacaccctgttttctctgataatggtgggcctggtgttctgcaacgagttggctcagcagctgcaaatttggtactgctgccatattatactttcaactatcttgtaaatgcaagtgctgaaggggcaacaagtcaattggcagataacagtttgcttgttctgcttattctgattcactaccgaaagtgcatttcaatgaccgagtccattccaatcgacaatatctacatgagcgattcaaataccaatattaaggatgcgccatcttttcatgagaacccttattgcaaggcattaaataatgccaaggacattcaatttgatcgtgctgatgttgagggaaatgctcaaaatggacctgttgtcaggttgtcttttgcgtcgctgtttgatgctctcggcacatgcttaaaagacgagagctcagttttgttgctctattctttggtccatgggaattgcgactttcaggagtatgttctggttcgaacagacttggatactttgctgatgcctatcttggaaatgctttacaatgcatcaaggaagacttccaatcagatctacatgttgttgataattctcctgatactgagtcaagactcaaccttcaatgctagtgtgcacaaattggtgcttcctagcgttccttggtaccaggagcgcctcatgcaccaaacatctctgggatctttgatggttgtgatactaattcgaaccatcaagtacaacctctccaagctgcgagatgtctaccttcacacaaactgtctcgctattctagcaaacatgggccctcatgtgcataggctgagcgcatatgcatctcaaaggctggttagcctcttcgacatgctttctcgcaagtatgccaaattagctgagttaaaaaatgacaaggcttcaaaaattatatccgatcaaattgaaccagacaacatctcagatgatacgtcaacagagcttcacatatacactgacttcttaagaattgttctggaaatcgtcaacgcaatccttacgtatgcactgcccagaaatcctgaggttgtgtatgctattttgcaccggcaagaggtttttcagccctttaagaaccatccacgtttcaatgaattgcttgagaatatatacacagtattggatttcttcaatagccggatggacatgcaacagttagatggggaatggtctgtggacaaagttcttgagctcattaacaaaaattgccgttcatggcgtggagaaggaatgaagatgtttacgcagttacgatttacatatgagcaagaaagtcatcctgaggaattctttattccatatgcatggcggcttatcctatcacggggattttctttcaatcctggtgccataaatttgttccctgtggagattcatgttgatgatgcacaaccgggtgaacaaaaagtttagggacaatctggaaccgttggggttctgacaagtgacaccaactaggatatcttt

SEQ ID NO: 329 - DNA, 2054 bp, Brachypodium distachyon
aacatagggtttgcggctccctgcgccctgcatgttaaggtggggaggaggcgacctggggttgtctgggggaagcgggagcggggtctggggtgccacgccggcggatggacgccgatgaggccgcggggagtagcaggaggatggatctgaacctatacctcggcctaccccgcgccccgcgtccgcgccgctccgacctcggctccgacctcgccctcagcaccccgatgccctcttcgccctcctcttctgcggcctccgtcgacgcccctccaccgccggagcccccgcatgccatctactccccacctcgcgccgacctttctcctcgaacaccggaggtatattcctcgcaccatctcgacgacgctctttctgcggacgcgcacctactgtatgcgcctcctccggcgccggtcatccgtgaccgtgagctcccggacgaaatcggatttggcttccaggccccgcccccgcccccaccaccgctggtgcgagccagcgaactgctgggctgggaggaccggccgtcttcctcgacggcctcctcctccttcctccctgacattgccacaaggtacaggcggctgctcgagcaaactggaagccggtggctccgccctcgcccaagaaggtttagatcagaccttccgcctctcagcgcagaggctcaacctatagggcaggacgcagcagtacctgtgccccatcaggagatgacaaatgatgatttcggtgacaataaggtaatcgccaatggagcggaactaggtgcctccgaggagtcggaggagcggggcaagagtgctgccacattcgagtgtaacatatgctttgagatggccggagagccggtggtcacttcttgtggccacctcttctgctggccttgcttataccaatggcttaatgtttactccaaccacaaggaatgcccagtttgcaaaggcgaggtgacagaggcaaatattactcctatctatgggagagggaattcctcttcagatgtagagaaggctgtggaagaaggtaagcagccaggccctacagtaccaccaaggccacatggaaatcggcttgaaagtttcaggcagcagttccagcacttacgaccgatgtcaagaaggctcggtgacgcacatggaatactgtcatcatggaggcgccttcttgatcaacagattatgaatagtgtgagtaggtttgaaggtccacctgaaccagctgttcatgaaacaggtgatactgctcaacccgctagtcgcctaggtacattgcccataaggatgagaccaagacgacggtatcagatggaggcggatgaccttcctgatggtggttccgttgcccctgatagtggtttacctgggaatagtgcaccagatccacacagacatggtccgagcccgcttttaccagaaggaattgatttgttgcaacgacttacccttattggccttgcaaatacagaaagattggcaactgccatgagtgacctgagaaggatagctgcccctaaccaatatggagcatctgcgtcgtcatcgaacccgtcgaatcccgagccagcagttgacggagcacatgttggtgcagcaccttctacagatcaagcatcgaactcgagcaccattgcagtgatacagggggatgctggtatttctgagactgcaggagagcctagtaatgcaggatcttcaagatccctgaggaggagagggaggagcaatgccttggcttctttagatgtggatggtgggcctccccagcgcatcaagaggcggaggatgaactgaaccttctcagtttcggtgtttctttaaacttcataatgtgctttgctaattttcagttttgcatttcgtttctttcggtgctacctgttatattgtagttgtaatgttgtgtcttctcttccatttttttactagtgtcacccaaatggttctgtttagttcctttgtagcctgtacctctttaatctatcatgaagttattggtcaaagctaattgtggaggaaactaaacagttgtcgacttgtcgtgagatg

SEQ ID NO: 330 - DNA, 740 bp, Brachypodium distachyon
cggcaatggcctctcccggaccagcccccgccggcgaactcctccgcatcgaccccatcgagctccgcttcccctttgagttgaagaagcagatctcgtgctccatgcagctgtcgaatctcagcgacgactacgtcgccttcaaggtgaaaactacgagcccaaagaagtactctgtgcggcctaacaccggggttgtcttgccacgatctacttgcgatgttgttgtgacaatgcaaacacagcgagaggctccacctgacatgcagtgcaaagataagttcctagtccagagtgttgttgcaccatctggtataaatgtgaaggatgtcacgggagaaatgtttgccaaggagtccggaaataagattgaagaggtgaaattgcgagtcacctatgttgctcctccacagccaccatctccagttcctgaagaatcagaagaaggttccccatctaggggtgaatcagaaaatggagatggtcctgctgggggattcaccagagcactgcgagaacgcattgagcctcaagaaaaatctttagaggctggagctttgatctccaagttgaccgaagaaaaaaattctgcaattcaacagaaccaaaagattagacaggaacttgatatgatgagacgggaagtcagcaagaggcgcggtggagggttttcctttgtaattgtcttaattgtagctttgatcgggatcttcctgggctatatgatgaagtcataataa

SEQ ID NO: 331 - DNA, 941 bp, Brachypodium distachyon
aaaggatccctgctgcggacgtacctcgcccgtcggcgatgggtgcggagtttgaggtggcggtggctggagtcgccgcgccgccggcgaagaggaggcgccggatggtagcggcggcgggaggagcgaggcggcgcgccacgaggcgtgcgccggcgccgccgaccagggccgtgcagcggctcttccaggctagccgcgccgtcttcaggggccccggcaccgtgccggcgcccgccgaggtcgccctgctccgcgccatgctcgacagaatgagaccggaggacgtcggcctaagcgcgaatctcagattcttcaaagccagagaagccaccgaggggaagacccccacgattacacataccaccatatacaaatctgagaatttctcgatggtcatcttgttcttgccaccgaatgcagtcatccccctccacaaccatcccgggatgacggtgttcagcaagctgctccttggatcgatgcatataaagtcctatgattgggctggtcctggtcctgatcctgccacgagcggcgctaatttgttgcctgacgatcgattgagactggcagagctggttgtggacgatgttttcacggcgccatgcgacacatcggtcctgtacccaacagctggaggcaacatgcaccggttcaaggccattgcgccatgcgcagtccttgacattcttggccctccttactccatagaagaagaccgggattgcacgtactacacagagattccatactcccaccaaccgagcagtgaccttgtcgataacgaacaagaacgccggcgtctcgcatggctgaaagagatcgacatgccgaaggagctgaagatgtgcagcgtagcttacggtggcccgccgatctccgacaggtgaacccccaagtcagccagctgatgtcagaactgccaacctggtaccttt

SEQ ID NO: 332 - DNA, 836 bp, Brachypodium distachyon
ctagccctaaacctcgctgaccgatcgccgccccaccgccgcggcgctcccggcgccgtctggttcgccccgcccccggccacaaggaggcgaggagcccccctcctcccaggacagccgccgccatgaacatggactccttcgagcgcctccaggccgacagcaagctccgcgatgcgctgaggcgaatccagtacgacgaggaggggaccgacgaggaggaggatgaggaggacgagaggggcgcggaggaggagctggcctgcccgttctgcgacgacgagtatgacagcgtcggccttgtcttgcacatcgacgacgaccacccgctggagagcaaggccgggagatgccctatatgctcagagagggttgggcttgacttggttgggcacatgactgtgcagcatcccactttcttcaagggcaggtcgagaaaccgacaagcttcatctggatcacattcttcttcaagatattctgaattgaaaaagaatgcggcgtacatacagtaccgttatggtggatcctctcgtgcttgctcgctcaacacagtgcctgatcctctactctcctccttcgtcagtagcttcattgatgatgatttgccaaaagaggtccaagaagtgttcttggatgatgttattgagaaaagtgattccttggagcctaaagcagcagaaagtgctgaggagcctttgctccctgaggtcaaggaggagagaactaggaggagccaatttgtgcagggactggtgctgtccctgatgtttgatgacatcttatgagcaatgtcttgttctgaaaattggttgaggaaggtagctcttgcttag

SEQ ID NO: 333 - DNA, 866 bp, Brachypodium distachyon
aaaggatcccttcctcaagctcaagcagaacctcccctctctcttctcctctcccagactcccccacaaacccttcttccccgagcccaagcaagccgcgcgcaaccatgttcctcacaaggacggagtacgaccgcggcgtgaacaccttctccccggagggccggcttttccaggtggagtacgccatcgaggccatcaagttgggctctactgcaatagggctgaagacgaaggatggggttgttcttgctgtggagaaacgtgtgacctcgccattgctggagcctagcagtgttgagaaaatcatggaaattgatgagcatgtaggctgtgccatgagtggccttattgccgatgcgagaacattggttgagcatgctcgtgtggagacccaaaatcatagattctcatatggggagccaatgacagttgagtccacgacccaagctatttgtgatctagctcttcgttttggagaaggtgaagaagagtcaatgtcacggccttttggagtttctctcctcattgctggtcatgatgaaaatggtcccagcctgtactacactgacccatctggaaccttttggcagtgcaatgccaaggcaattggctcaggttctgaaggtgccgatagctccttacaggagcagtttaacaaggagttgactcttcaggaggctgaaaccatagctctatctatcttgaagcaggttatggaagaaaaggtgactccaaataatgtcgacatcgccaaggtcgcaccaaactaccacctctacacccctgcagaggtcgaggcagtcatcggacgattgtgaaacacagaaatctttatcttatgtcagcccggatagggtaccttt

SEQ ID NO: 334 - DNA, 1613 bp, Brachypodium distachyon
tccggatggcgctggagctgagcttagccttggcggcgccgccggggggtggactcttggccccaccccctcccgctccgccggggaaggagcagcaggtggcaggggtggggatcctgctgcagatctccatgctcgtgctctccttcgtgctcggccacgtcctacgccgccaccgcttctactacctccccgaggccagtgcatcgctcctcatcggactagttgttggtgggcttgctaatatttcaaatacagagaccaatactaggacatggttcaacttccatgaagaattcttcttcttgttcttactacctcctataatattccaatcaggattcagcttatccccaaaaccattctttgccaactttggggctattgtaacttttgccattcttgggacattcattgcttccattgtaacagggatgcttgtctatcttggtggtctgacatttctaatgtacaaacttccactggttgaatgccttatgtttggtgctcttatatccgcgactgatcctgtcacagtattatcaatattccaggaactgggcagcgatgttaacttatatgctctggtgtttggtgaatctgttttaaatgatgcgatggcaatttctctttacaggacaatgtcatcagtcagaagtaatgcagcaggcagtgaaagcatttttatgatggttctccagtttcttgagatctttgttggttccatgtcatcaggtgttggagttggatttatttctgctcttctatttaaatatgcgggattggatattgacaatcttcagaacttggagtgctgcctttttgttctcttcccatacttctcgtatatgttagctgaaggacttggcttgtcaggaattgtttctatattattcacgggaatggttatgaagcactatacgtactccaatctgtcagataactcacagcgttttgtttccgcattttttcacttgctgtcatctttggctgaaacatttgtcttcatttatatgggctttgatatagccatggaagagcatagctggtcacatgttggcttcatcttgttctcaattatatttataatcgttgcaagggcagcaaatgtcttctcttgtgcatacttggttaatatatcacggccagaacatcggcgtatacctctgaagcatcagaaagcactttgttttagtgggcttagaggggccatggcttttgcacttgctctccaatctgttcatgaacttcctgaaggacatggaaaggcgatattaacaactaccacagccattgttgttttgacggtacttcttattggagggtcaacaggcaccatgcttgaagctttggatgtagttggtgatgaaaatacatcaatagaaaattatgaggataacagtggttacattcccccaacttatgaggaaggtacatcgtctggaggaggattgagaatgaagctcaaggagttccacaaaagcacaacatcgttcaccgccctggacaagaattatctgactccattctttaccagtcagactgatgatgatactgatgattttggtgatcaaccccaaaacctaagacgaggattctatgatcaatagtaa

SEQ ID NO: 335 - DNA, 870 bp, Brachypodium distachyon
caagtaagtaagcacactcgaacgagaagatggtgaagcttgtgcaggacgaggagaaccagaggcagctcctggacggccacaaggagaagcacttcacgtccggcgaggtggtccgggacatcatcatcggcgtctccgacgggctcaccgtgcccttcgccctcgccgccggcctgtccggtgccaacgcgtcgtccgcgctcgtgctcaccgcagggctcgccgaggtcgccgccggcgccatctccatggggctcggagggtacctcgccgcgaagagcgacgccgaccactaccagcgggagttgcagcgcgaacaggaggagatcgacaccgtccccgacacagaggccgcggagatcggggacatcctttccgagtacgggctgggccccgaggagtacgggcccgtggtcacctccctccgcaacaacccaaaggcctggctcgagttcatgatgaagttcgagcttgggctggagaagccggacccgcggcgggcgctgacgagcgcggcgacgatcgcgctggcgtacgtcgtcggcgggctggtgccgctgctgccttacatgttcgtcccgtcggcggaccgcgccatggccacctccgtggtcgtcaccctcgccgcgctgctcttcttcggctacgtcaagggccgcttcaccgggaaccgccctttcctcagcgccctgcagaccgccgtcatcggcgcgctcgcctcctccgccgcctacggcatggccaaggcagtgcaggccatctgatctttctgatccagataccttaatttgcgccgtgccgtcaaaccaaacccaccgggcttgctaatgtaccgagaaaaataagtgcagctagggatctctctgt

SEQ ID NO: 336 - DNA, 1237 bp, Brachypodium distachyon
aaaggatcccaaggctggaagtaccaaattccgtcctggaggatttgctgggcatgcagatggcagatgatcctaaccaaaacttcagggcattttcgcagccgttctgcacccaggatgtggtttcatttcagacaagcgcgacaagcagcgggtcaggaggcatgccggtgtacctggactgttccagcggcatggacagcactatggcgatgatgagcagcaccacgccgtctgtggctgtttccaccagctcatcaagcatggctgctgattccgcaccgagcctgaaatacggaggacccttggccgcggattggtcgtaccttgagctcgaagtgctgaaagattgcctggacaagtatgtgaatgaacaaggcatcatgaagtatataaagatagcagctgcaataccaaccaagacagtgagagatgtcgcgatgagatgccaatggatagggaccaaacaaaatacaagacggcggaagcctgcagaacatcatattggcagaaaagtgaaagatagaaaggagaaaatggtagagccttcatcatggggtacaagtcatcctgttcagagggacacaagagtctcttcctttgtgtctagtgacattcaaaatagtctatttccatctgaagcctctgagatagatcgtgcagtgcaccatatactggaagaaaacaatcggcttctgagtcagattgaaacaaatattgtaacattccaggctcaaaacaacatcgacctcttccatcgcatcagaagtaacatcgatggtcttttacaaaccatgagccaaatgcctggaataatgagtaagatgcctcaattgccaatttcagtgaatgaaaatctggctagctacatgctccctggtcttacaatggcacaagttcttggaaacaggcatttcaaggaggagccaagaggatggtgaaccacagccaaacaggtcacagatgaggcagacactgaaacttcattggtagtctgacgaatcaatgaagaaaaagagaaaaaaaaactatttcagtataagcgccagattgggatgaataggatcaccaaggaaccttctttctctatcttgaagcaaaaggggaggtgactgagaaaccactctgctccaatgacaggtgcctgaactcatccattgcaccgcaacaagcctaaatatatattggtggctgaagagttgtggagcagtgatggtttcaggaaactggtaccttt

SEQ ID NO: 337 - DNA, 1924 bp, Setaria italica
atcggagaccacgtacactacccgcccgtccttccccgggcaagacgaagccgagagcagaggaagcacggaggatttttctgcgtcggcgaggaagcgaagcggaccggatcgcggcgccatgtcgctcgacgagctcgccgacaaggagcagtcatcgcccgaggaaattcagctggattccaagttcaggagcttcaacccagggccgattccgatcccagctgctccgaccatcagatcattggccgactcggtttctgatgagagagtggatgtcatggcctcacatcaaagtgaaaatggatccggatccatctctacggctagttctactgttagttcaatagaatcagagaaagcagcctatgaataccttgctcaaactcctatcaagtcgactgatgcacaccttgttgagttttcagaggctatgagaactgttgcaaaggccttacggcgagtagctgaaggcaaggctgctgctcaagcagaggcggcagagtggaaacgcaagtatgaattagagatggcgcacaagcaacagagtaaaatcaaaggctgtggcagttgtatcagtaatgacttagacaaactggccagtcaactaaccctggagacatcagcatctgatcaattaggatgctgtggaaagcatggtatatgttcacatgaggttctccaggacgaagttcctggacctatcccaagatctaatcacaagatggtagggagaaaggcatcatttaaactttcatggggatgtaatggagataaaaatggccagcataagcatgattttgtgtcctttgaaaaaggtgatataacaacagcagaacggagtaataagcagatcttactgaaatgggaatcaacaccacaaacagtgcttttcataaccaaacctaattccaactctgtgcatgttctttgtgcagaaatggtcagatggcttaaggaacataaaaatataaatgtctttgttgagccacgcgttagcaaggagcttctaactgaggattccaactataacttcatccaaacatgggataatgatgaggagatgaagctgctgcacacaaaggttgatctcattgtaactcttggcggtgatggaactgtactgtgggctgcatcattgttcaaaggaccagttcctccagttgttgcattctcccttggatcactcggcttcatgacacctttcccaagcgagcaataccgcgattgcttggacaatgttctgaatggaccatttagcatcacattgagaaaccgtctacagtgtcatgtaatccgagatgcagcaaaggatgaactcgtgaccgaggatccaatattagtgttaaacgaagttacaatcgaccgaggaatatcatcttaccttacctacttggaatgctactgtgacagttcttttgttacttgcgtacaaggagatggactaatcatatcaactacatctggaagcacagcatattcactagcagctggaggatccatggttcatccgcaggtcccagggatccttttcactccaatctgtccgcattccttgtcattcagacctttgatactgcctgaatacgtgactctgcgcgttcaagtgccttacaatagcaggggccatgcctgggcatcttttgacggcaaagatcgaaggcagttatcacccggcgacgctctgatatgcagcatttctccttggcctgtgccaacagcctgcgtgatggattcaacgaccgatttcctgcgcagcatccacgagggtctccactggaacctgaggaaatcccagtcgtccgacggcccgcgtgattgatgcaacgatttttcagttatatcagtccagtgccagaattctaagttggctaaggcactgatgggtttgttctcccagaacagaagcatttcctccatctag

SEQ ID NO: 338 - DNA, 1918 bp, Setaria italica
tgagttcctggcggaatggaggtcttcggccccgtcacgccaggccaggtgtcattcttgctcggtgtgttccctgttctcattgcatggatttattcagaaatcttggaataccgaaaatcgtcatccattaaagttcatgctgattctaatttggaaaaggaaactgtcagagaagatgataaggcagttttgcttgaaggaggcctatcaaaatccccatctacaatgcttcggaacatgtctacgaaaacaaaaattatacgatttataacgatggaggagtcctttcttcttgaaaaccgtgccgtaatgagagcaatggctgaatttggcattgtgctggtttacttttatgtttgtgaccggacaaacacatttcctgaaagcaagaagagttacaaccgtgatctgtttctatttctgtacatccttctcatcatagcgtcagcattgacttcacttaagaaacacaatgaaaaatcagcattttcagggaaatccatactctaccttaaccgccatcaaactgaggaatggaaaggttggatgcaggtcttgtttttaatgtaccactatttcgctgccacagaaatctacaatgcaatccgcattttcattgctgcttatgtctggatgactgggtttggaaacttctcgtactattacattaaaaaagacttcagcctggcacgatttgctcagatgatgtggaggctcaattttttcgtggccttttgttgcatagtccttgataatgattacatgctgtattacatatgcccaatgcacacactttttacacttatggtatatggttgccttggtctgttcaacaaatacaacgagataccatctgtgatggctatgaagattgtgggttgcttcttagtggtgatcttgatatgggagattcctggtgtatttgagcttttgtggaggccttttacatttctgctgggatacaaagacccagaaccttcaaaagcgaacttaccccttttgcatgagtggcatttccgatccggtcttgatcgttatatttggattatcgggatgatctatgcttacttccatccaaatgttgaaaggtggatggaaaagcttgaagaatctgaaactaaggttaggttgtcaatcaagggaaccattgttaccacttctgtggtggctggttatttgtggtatgaatatatttacaagctagacaaacttacgtacaacaagtaccatccttacacatcgtggattcctataactgtttatattgctttacgtaattgcacccagcagctgaggagtgcctcattgactctttttgcctggctcggcaagattacactagagacctatatctctcagatccacatttggctcaggtctagcatgccaaatgggcaaccaaaatggcttttatctttcattccgggttatccgatgctcaactttatgcttgtcacagcaatataccttcttatatcttacagagtgtttgagctaacaaccatcttgaagtcagcttttattcccagtagagacaacaatcgtctatatcaaaattttgtagctgggatcatcatctccttatgtctatatttctgctcagttatacttctcaagattacagttgtataggaacatgatcttgatacaaggccatttctgtgaaatgttgtcttacctaggatgatcagtcgctgcctcatttccacgttgcagttggagagaaagaaagaggcttattaaggtatgtcgaatgcttatacgcctgagtgcagatgctccagattttttttttctgtttaccagttattgtacacaattaggcagtcggtgcattcctttgggagttgtaacagctggttggacttgcattcctacgtgtttacaaatgcacgagagatttatgttgcatcga

SEQ ID NO: 339 - DNA, 433 bp, Setaria italica
aaaggatccaggggttgattcagagatgcgtttctctaaagaagatctggttgggtcagcgtttatggcttttggcgttactttgtttgtgggtttcttctacgctgctgttctgtccaagctgcttccaccgtatgaaaataggcttctagctgccgtccaaaatgattggtattactgcctacttgtgccgttgacacttcctgtcataatcgtggctgtctatctgcattggcttagcatgaagatgttcaaacatgcatgaagcaatatttctgtggattttatggaacaagtatgcagctttgttccaatttcagaaactctggagcacgatgaggatcaaggtagtttatctgaaagtgtcatgtcaagttgtaaactgtagtgttacacagtcccgagtttgtgtttgtcagctccaggtaccttt

SEQ ID NO: 340 - DNA, 1729 bp, Setaria italica
gaactgatgcaggaggaagaagcacatccagaggccaaggctatcgagtggttcgtggacgagaagagcacggggttctctacttctcttatcattttggtgtgcctttcacctgagacacatggcaggcaaggcatggcggcagttggtcgccgttgcttcgctcctgtcagtcctgtggcttctcccatgggcttcggcgatccaccggagcgacttcccggtgtctttcctcttcggcaccgccacttcctcgtaccagatcgaaggcgcgtaccttgagggcaacaaaagtttaagcaactgggatgtgttcactcatgcaccagtttcaggaagaatcaaagatggaagcgccggggatatcgcggatgatcactaccaccgttacgatgaagatgttgagctcatgaattctttgggcgtaaacgcctacaggttctcgatatcatgggccagagttcttccagaagggaggttcggcagggtcaacccattaggcatcgagttctacaacaagctcatcgattcactcctgctcaaaggaatagagccgttcgtcacgctgaaccactacgacatcccgcaagagctcgaggacaggtacggcgcgtggctcagcgcggagatccagcgcgacttcggccacttcgccgatgtgtgcttcgcggcgttcggcgaccgcgtcaagtactggaccaccttcaacgagcccaacgtcgccgtgctgacggggtacatgctcggcacctacccgccggcgcggtgctcgccgccgttcggctcctgcgccggcggcgactccgacgccgagccctacgtcaccacccacaacgtcgtcctgtcccacgccaccgccgtcgagatttacaagaggaagtaccagagcaagcagaagggcttgatcggcatcgtgatgtacaccacctggtacgagccgctgacggacacgccggaggaccggctggcggctgaacgggcactggccttctcggttccatggtttgttgatccaatagtctacggcgactacccgccggagatgcggcaggtcctgggctcccggctgccgactttctcgccggaggagagaaggaagctgggttacaagctggacttcatcgggataaaccactacacgaccctgtacgccagggactgcatgttctcgtcaggctgtccgttggggcaggggacccagcatgcgctagcggccgtcaccggagaaaggaacggagtccccatcggaccaccgacagggaggccaatgttctacgtcgtgcctgacggcatcgagaagatggtcacctacatcatgaggagatacaacaatctgccaatgttcgtcaccgaaaatggctatccagatggtggagaagctggtcataaccatgccaaagatttgcttcacgaccagggtaggatacagtaccttgatggctacctcaccaaagttgccaaagctataagggacggagctgatgttcgtggctacttcgtctggtctctcatggacaatttcgaatggctctatggatacaccctccggtacggactgtactacgttgactaccaaacactggaaagaaagcccaagtcatccgcgctgtggtacaaacggttcctccaaagttttcaacatgaagctcaatagagggagggagccttgtttaaatcttgagaaagtgtgcgacggctggacatgctggctcttcgatttatgaaatag

SEQ ID NO: 341 - DNA, 1445 bp, Setaria italica
aaagtcgactgtctcagtgacgtgaactcatcgtcgttcctctgttccagatgatctggccaagatcggcagcggcgagcagggttcatcggttcgtctccgaattcctaggcttggagaagagcatcatgcgagaggggcagggagagaccatcaagtacagggtgtttgctggtacgtggaacgtcggcggcgaggcgccaccggatgatcttgatctggagggttggctggacactaaggccgactcgtacgacatctatgtcctcgggttccaagagatcgtgcagctgaacgcgaggaacgtgcttgggccgaaacagagatcggcagccatgaagtggcagctgctcatcgaggacgcattgaacaacaggaggagcgcacaagacggaggaggagaagaagcaatggatcaagaacgggacgtgttcaggtgcgtcatgagcaagcagatggtcggcatcttcgtctcggtctggacgaggagcggcctccgccggcacgtccgccacgccggcgcctccaccgtcggcgccggcgtcctcggccggctcggcaacaagggcgcggtgtctgtccggttcttgctgcacgacacgagcttctgcttcgtctgctgccacctggcctccggcggcgaggtcggcgacgcgcttcgccggaacgccgacgcggcggacatcctatcgaggacgagcttcctcaacagctccggcggcgtgccggcgccggtggacctgcccaagaagattcttgaccatgaccgcgtggtgttgctcggcgacctcaactaccggatcgccatggacgacggcgaggcgcggcagctggtgcgggccaggaagtggagcatgctgctggagaacgacgagctgctgctcgagctctccgaaggccggcagttctacggctggcgcgagggcgtcgtcaccttcgccccgacctacaagtaccaccgcaactccgacaagttgtactggtgcgccgacaccggccatcgtcgtcagaggcagcaccgcgcgccggcatggtgcgatcggatcctttggcgcgggaaggggattaggcagattcggtatgagcgttgcggcggttaccgcctctccgatcatcggccggtgagggcaatgttccacgccgtgtgcgaggtggtggaaagcaagcatggttgagctgcaggcttctgtggtctgaaacaattaacaaacgaggacgctgtaaatgttagagagtgttcagtgttcacaacacagaaatttcacttgaaacagctcgattcctgcatccagctttaaagttgggccatcgaagaaactcctaaggcttcagcctgggacaaaggtcacgcaagtaggaaagatccatgtatattttctgttcttttcctgctgaacgagtggaatgctaggatcactgcccaactgattctctttaggcctttt

SEQ ID NO: 342 - DNA, 1579 bp, Setaria italica
acttcccaccaacaaaccacgtcgccgccgcccgccgcccatggcgaccccatcgcccggcgtcctccccctccgcgcgctcctcgtcgcgctccccctcctctccctcctcatcatcttccagctcctccaccgcccggctcccctgcccccgccgctccggacccacgcccacacccagcgccgcgccgaggcggaggaggaggtgtcggttaattccctatcatccacaacgtccccggcgtcgcggcatcgatcggagccggagccgacgtccctgcgccacgtggtgttcggcatcgcctcctcccgccgcacgctgccgctccggctccggctcctccgcctctggctccgccccccggcgcgcgccttcctcttcctcgacgccgcgctccccgcgccgccggacctcccgagcggcgtcgcgctccgcgtctccgccgacgcgtcccgcttcccctacacgcacccgcggggcctcccctcggccgtccgcgtcgcgcgcatcgcgggggagctcgtctccgcgctcgaccgcgaagaggagggcctcagccgccgccgcccgccgccgcagtggctcgtgctcgccgacgacgacaccgccttcgtgctcccgaacctgctccgcgccctccgcaggtacgaccaccgcgagccctggtacctcggcgcgcgctccgagtccgcggcgcagaacgcctggcacggcttcgccatggcatacggcggcgccggcatcgccgtcagctggcccctcgcgcgccgcctcgcccgctccctcgactcctgcgtcctcaggtacccgcacctctacggcagcgacgccaggatctacgcctgcctcgccgagctcggcgtcgagctcacccacgagccaggcttccaccagatcgaccttcatggggatatttctggcctgctaagagcacatccactttctcctttagtttcactgcaccatcttgataatgtgtaccctctttaccctggtatggaccggacaagagcaatgaaacatttcttcagggctgctaatgctgatccagcgaggatcctgcaacaaacagtgtgttatgacagcaaaagatcccttacagtatcaatcgcatggggctattcagttcaggtgttcaaaggcaatattctgctccctgacctccttgctgtgcagaaaacatttgtgccatggaaaaggggtcgcaatgttacagatgtctatatgtttaacaccaaacatgttcccagagatgagtgcaaaagaggagctcttttctttctgaaaagcatttcttcgggggaaggcaagacacaaaccacttacaatagacagccaccgagaaaatgcttgcctgacttgataccattgaagaatctaagtctgataaaagtgacggctgaacaactgcaactgattcctgggaaggccttaaaacggcattgttgtgacattgtaccttcttcatctgataccaccatggatgttaacatcagaaaatgcaaagatgatgagttgatcgcgatgcattcatagtcattcttctgtcagatggacgctcatctattgcagaggtag

SEQ ID NO: 343 - DNA, 1729 bp, Setaria italica
caccattgctgagcttcttctccagtaaaacattggatttttcacgccgccccaacctgtacttgatgatcaaaagatgtcatcaaactccagtctaaccgagtctctacatgagaaaacaattgtctttggcctcaaactttgggtcgtgattgggattgctgttggagcgtccctcttgggtattcttctcattcttctcatatgcctcaccattcagagttgtatcaagaggtcacgcaagccactcaatgaccgtccaacgatccagatacctcctgcatacaaagatatcaaggaagtggggacggtggatcagttttcagctaatgattttgttgtacatgatgggcttctactcactattcaaaatgagcctgagcctgttgagtccgtcaatagagatgcagttcagttggctcaggaggaaaagttgaaacaaagagaagagaacaatctttctggttcgttccgcattacagatggctgtgatgtaattcagattgtttcttctgaggaacagtcttcaacacatgctactgtcgactcagcgccattggcgggcttacctgaattttcttatcttggttggggccattggttcaccctcagagatctagagcttgcaaccaaccgttttgcaaaggataatgtgattggtgagggtggatacggtgttgtgtatcgtggcagattatcaaatggcaccccagttgctgtcaagaaaatccttaacaatttagggcaggctgagagagaattcagggtggaagttgaagcaattggccatgtccgtcacaagaatttggtccgccttttgggttactgcgttgagggtactcaaaggatgcttgtgtatgagtatgttaacaatgggaatcttgaaagttggctccatggggaattgtcccagtacagctctctcacatggttggctcgcatgaaaattcttttgggcactgcaaaggcccttgcttacttacatgaggcaatcgaaccaaaagttgtgcaccgtgacatcaaatccagcaatatcttgatcgacgatgagtttaatgctaaaatatcagactttggtttggccaagatgcttggtgctggtaaaagtcatattgctacacgagtcatgggtacctttggctatgttgcacctgagtatgctaacagtggacttctgaatgaaaagagtgatgtctatagctttggggttgttctgttggaagctattacaggtagagatccaattgactatgagcgtcctccaaatgaggtaaacctagttgactggcttaaaatgatggttgccaacagacgttctgaagaagtagtggatccaaacctagagagaagaccttcaacaaaggagctaaagcgtgcccttttgacagctctgagatgtattgatttgaatgctgagaagagacctagcatggaccaggtggtccggatgctggattctaacgaacccatacctcaagaggaaagaagacaccgacagaaccgaacccctgagacttcggaaactgagccattgaggggcaagaacaacagtggcaggagtgatgcccctgagcacgaagcaaggccacctcgacctaagagtcgaacattttcttccaaatgagacaaacaagaaaataaaacagaaggcatactaggagatacgatataggcaactggagtgcggcacacgaaacacacattgtgggaagcaggaaatttcgataca

SEQ ID NO: 344 - DNA, 991 bp, Setaria italica
cggagctggtctttgctcgggccagccacggcggcggcggcggcatggcggggcggatggtgcggagctgcgtgcagacgacgctcaagacggtgaactccgtcgtggggctcgccggcatggccgtcatcctctacgcgctctggatgctccgcgcgtggtacagggaggtcgcccaactcgaccaacgcctccccgccccctggttcatctacacatttcttggcatggggatctttctttgccttctgacttgctctgggcatattgctgcggaaactgcaaatggtcactgcctctcttgttacatgatcatcgtattcgtgcttattatactggaaggtgcgatcactgtggatgtatgtctgaataacaactgggaagaggatttcccccctgatccatcaggcaagtttgatgaattcaaggtatttgtgagatcaaattttgagatatgtgaatgggtaggcctctcagtggtggctgctcaggtgttatcaatcattcttgggatggtactcaggacccttgggcctgaccgagagactgactatgacagtgatgatgacaccactgtgcctgcaaggctgcctctcctaagaaaccagtcccaacatggtccagcagactatgctgaacccaacacatctcgtaggagtgattcatggaaactacggattttagacaaggtcaacaactaagattttactgatgtcatatggcgaacccttcaggaaagagttttgctccgagggtttcggaaggatgataagagtatacctttttttttcttatggagagatgattctcatggtggagtagcagcagcagtggttagaatagttttgaatggctacttttgaatgcctttcaatatgcacagatatttgagtagcgactgacccttataaccccagccatgatggggaagaatgctgtaccgaatgtttcagaaaaagatgaaggcatgactggtgtcttcactgaccaa

SEQ ID NO: 345 - DNA, 1195 bp, Setaria italica
acccagtccaaccaaatcggccgccaggatgaagggcggcgacgtcagcagcattagcccgctggtctccttcgtcctcggcgctgccatggcaaccgtctgcgtcctcttcttcatgtccgcaagccccaccaggcgcctcgccgacatctccgccttctccaccggcaactccaccgcaagcacggacgacctccgcctcgcctcctccgccgacagcggggtggccgacggcgacggcgacggcgacgtcgtcagcgccacccccgcgccggcgccggctccggtcgaggcggcgtcgccgtggggcgacctggaggaagtgctgcggcgtgcggcgaccaaggaccggacggtgatcatgacgcagatcaacgcggcgtggacgcgcccgggctccctgctcgacctcttcttcgagagcttccgcaccggggagggcggcgtggcgcgcctgctggaccacctggtcatcgtcaccatggacccggccgcataccagggctgccaggcagtgcaccgccactgctacttcctccgcacctccaacggcgtcgactaccgatcagagaagatgttcatgagcaaggactatctcgagatgatgtggggaaggaaccggttccagcagaccgtgctcgagctcggatacaacttcctcttcacggacgtggacgtgatgtggttccgggaccctttccggcacatctcgatggcggcggacatcgccatctccagcgacgtgtacatgggcgacccctacagcctgcgcaacttccccaacggcggcttcctcttcgtgcggtcgtcggccaagaccctcgacttctaccgggcgtggcagcaggggcggtggcgcttcttcgggaagcacgagcaggacgtgttcaacctgatcaagcacgagcagtccgccaagctcgacctcgccatccagttcctcgacaccacctacatcagcggattctgccagctcagcaaggacctcaacaagatctgcacgctccacgccaactgctgcgtcgggctcggggccaagctccacgacctccggggcgtcctcgacgtctggaggaactacaccgctgggacaccagaggagcgccgcgccggaaagttccagtggaagctcccaggcatctgcatccactgatcatcagacgtcggtggcgaacttctggtggtagctttgtag

SEQ ID NO: 346 - DNA, 1645 bp, Zea mays
aaataaagagagagtaccaagcaagccgccggcagctcgggcagccatggggcacggcgtcagctgcgctcgcacgggcgacgagcacaactacttccgcgcggcgcaggtcggggacctcgacgccctggacgcgctcctcgccgccgacccctccctcgcccgccgcgccacgctctacgaccgcctctccgcgctgcacatcaccgccgcgaatggccacctcgaggtgatgtccatgatcttggatcacggggtgccgccggacgccgtgaaccggcacaagcagacgccgctgatgctcgcggcgatgcacggcaagatcgactgcgcgcggaagctcctggaggccggcgccaatatcctgatgttcgactccctgcacgggcggacctgcctgcaccacgcgtcctacttcggccacgtcgactgcctgcgggccatcctcgcggcggcgcggaccacgccggtggccgactcatggggtttcgcccggttcgtcaacgtcagggacgaccgcggcgccacgccgctgcacctcgccgccaggcagggccgctccgcctgcgtgcaggtgctgctggagaacggcgccattgtctccgccctcaccggctcctacgggttccccggcagcacgtcgctgcatctggccgctcgaagcgggaacctggactgcatccggaaactgctcgcctggggcgcggatcgtctccagagggactcagcagggaggattccttacgccgtggcgctgaagcgcaaccacgcggcgtgcgcggcgctgctgaacccgtcggcggcggagcccatggtgtggccttccccgctcaagttcatcagcgagctggacccggaggcgaaggctctcctggaagcggcactgatggacgccaatagggagagggaggagaagatcctcaagggcatcaccaagtattcgcagccatcgcctacttcgccttgcgagcacgatgccattgacgaagcgtccttggaggccagcgacggggagctgtgctgcatctgcttcgagcaggcgtgcagcatcgaggtgcaggactgcgggcaccagatgtgcgcggcgtgcacactggcgctgtgctgccacagcaagccgaacccggcgacgctgacgccgccgtcgccggcctgcccgttctgccgcggcagcatctcgaggctgctggtggcccgggcgagccccgacgccgatgacgacgacaaggccgccgccgcctcgtccccgcagctcgtccggcggcggtcgcacaacctcagatgggcggcggcgacggcgtggacaagcccgagcacgacctgtgatcggcatttgatgctgtgcgtggctgagcagacagcagagcacgaccattttaaaagctgaagcaggcattgccactggctttccaagatgagagacatcacatccaagcgtgattatctactggagtacttgtaatgcatcctcttcttctcccccatgtctggtctatttttgggcgtgctaggatggacctggccggcgcgatatggttgagctgagcttgagccaccgacatgtgtgtaaaactgtcggtcgagagaacacgcagagtggaaccggcgatgtgcactggacttgtgatctggactctgaaggagg

SEQ ID NO: 347 - DNA, 896 bp, Zea mays
atttctcttaggctcacccgtccgctcggctcgcttccttccccactctctctgatcccgtcgcacttccctcctcgctgcagcccctctactattgcgattaccgtttcctcgctgccctttcctttttcggtcggcagcaatcaccggggcaagcgaaccctcgatttgcgtccccgctctctgctagcgcccctaaaagaggagcgaagcgatgtctatgtcgaagacgggtcaggccgcggagaaggatgagcagcagcagtcccgagggatagcactgatgcagggcatctgcgccgtggtgtaccgcaaggccgataacacgccctgccccatcaagcagggtctctacttgggatctgttggagcagcattcaataaggacgctctcaagagtttgaacatcacccatatcttgatcgttgcaaagtcactggatccagtatttccagctgaatttaattacaagaagatcgaagtacttgatatcccagacactgatctgttaaagcattctgatgaatgctttggtttcatagatgaagctataagctctggaggcaatgttttggtccattgctttgctgggcggtcaaggagtgtgacaatcgttgttgcatatctcatgaagaagcatcaaatgagcctcgaaagtgccttgtcactagttagaagtaaacgacctcaagtggctcctaatggggggtttatttcccagctggagaagtttcagaaatccttgcaagtggagcaggaatggagaatgcaacctgtgcagcactgataattatactagtgttataataggtgcagaaggcctcatatgtagtgaaggcgtatgcgttgtaagagcgtcttgaccgcgtattatgacatctggataacaagcgagg

SEQ ID NO: 348 - DNA, 431 bp, Zea mays
taataatggcggcgtcgacggtggcgagcctctctgtcccggtgacgacgacgaccttcgcggcggcgggcggcggcgacgtgctgatcgtcgtcccgaggagggcgggcgccaagcgcgtcgtctggttccccgcggcggcgcgccgcggcggcgggcggttggtcgccgtgcggtccagcgggccggccacgccgccggagatctccgacaaggtgtcggagagcatcaagcaggcggaggagacgtgcgcggacgaccagaagggcgacgccgagtgcgcggcggcgtgggacgaggtggaggagctcagcgccacggccagccacgcccgcgacagcctcaaggagaccaacgccaacgacccgctcgagaagtactgcaaggacaacccggactccgaggagtgccgcatctacgacaactagtag

SEQ ID NO: 349 - DNA, 638 bp, Zea mays
ctgagtgctgagttgttgaccaacgggaagtccagtacccaagcggagccaccaaggaaaggaggaatggaagccaccggcgcagcctcgcagccctcggcgccgcagacaactcacccggcggtggcgccgctggccttcctactggggaagtggcgcggggaaggcgagggcagcttccccaccatatcctccttccggtacggcgaggagctcctcttctcgcatcatccctccaagccagtgatctcgtacacgcagaagacgtggaagacggcgtctggcgagccgatgcacgccgagagcgggtactggcggccccgccctgacggctccgtcgacgtggtcatcgctcagagcactggcctcgccgaggtccagaagggttcatttgatgctgaaaagaaaacagtgacactccaaagcgaactcgtagggaatgcatcaaaggtgaagcagatcacgagaacttttcaggtggcagatggggagctctcgtacgtcgttcagatggcaacgatcacaactagcctacagccacatctcaaggcccttcttaggaggatttgaagttgaccggcaaaatctcctacaacgacgtcgctgcggctaaccacaaccgagggacacctgtaata

SEQ ID NO: 350 - DNA, 2330 bp, Zea mays
cattgctcaccttttccgtccagcgcaaggaaaccgcgcgccagagagggcgagggattgccgtcaccaattcggaagccgcttcaggcgcgcgtggaatcgccccgtggccggcggggatgtccggattcgtcggggtcgtcgtgtccgacccctcgctgcaggggcagttcacgcaggtcgagctccgatcgctcaaggccaagttcgtgtctctgaagagagattccggccatgtcaccactaagaacctgccggggctgatgaagaagctgagggggctcaatgaggtggtctccgaggaggagatcgcggccttcctgtcggagtcgtaccctgatagcgatcacgagattgaattcgaatccttcctccgggagtatcttaatctgcaggctcaggtgagtgccaaggaaggtggtgccggcggtggcaggggtggcaagccgtcgtttctcaagtccagcatcactacgctgctgcacaatctcaatcaggcagagaaatcttcgtatgtcgcacacatcaatacttacctccgtgaagacccattcctgaagaagtacttgcccatcgacccgtctggaaatcagctgttcgatctcatccgagatggtgttctgctctgcaaactgatcaatgtagctgtacctgggaccattgatgagagagcgataaataagaaaagagttcttaacccatgggagagaaacgaaaatcacacactctgcctcaattctgccaaggccattggatgtactgttgtcaacattggcacacaggatttggtggagggaaggcctcatttagttcttggattgatatcacaaatcataaagattcaacttctagctgatctgaacctcaagaagacaccgcagctggtggagctatttgatgacagcaaggatatagatgaggttttgagcttgtcaccagaaaagatgctacttcggtggatgaatcatcatctgaaaaaagctggctacaagaaaactgttaacaatttctcttcagatgtcaaggatggtgaagcctatgcttaccttttgaaagctcttgctccagagcattcccctgaaactacattggacaccaaggatccgaacgagagggcaaaactagtacttgaacaagcagagaagttggactgtaagagatacttgaccccaaaggatatcactgagggatctgccaatctaaatcttgcatttgttgcacaaatattccagcataggaatggtctgaccagtgacaccaaacaagttaccctcacacagacagcaacgcatgatgatgttctattatctagagaagaaagagcctttcgaatgtggatcaacagccttggggttgaatcatatgtgaacaatgtcttcgaagatgttcgcaatggatgggtacttcttgaagtgcttgacaaggtgtctcatggatctgtcaattggaagttggcatcaaaacctccaattaaattgccatttagaaaactggagaattgcaatcaagttgtaaaaattgggaagcagttaaagttttctttagtaaatctagctggaaacgatattgttcagggaaacaagaaattgattgttgcacttctgtggcaattgatgagattcaatatcctccagctgttaaacaaactgagattccactcccaagggtccgaaggaaaagaaatttctgatgccgatattctaaactgggccaactgcaaagtgaaggcatccggaagaacatctcgtatggaaagtttcaaggacaagagcttatcgaatggaatgttcttccttgatcttcttagcacagtacagccaagggttgtgaactggaaagttgttactaaaggggaaactgatgaggacaagaagctgaatgctacctacatcattagtgttgcaaggaagattggatgctctgtgtttctgttgccagaggacatcattgaggtgaatcagaagatgatcctaacacttactgctagcattatgtattggagcctacagaaacagccccagtcacaatctgaattgacagaacaatcagaaccatctagcatgacttctgacgcagcctctgaagttgcctcggaggatggtgcttcaacgacagcaccgtccgagtcagaagaggtgaactcgctgtctgatagcatatcgaatttgacaacggatgatgctacttcaaacgccccatctgctgaaaacggaaatggtgtggcagggtcctgatggttatgattatgcagaccctgttcttttttccccatacagtgctgttacaggaaatagtgctttcatggtgcccaaagttgtcgctaccagaag

SEQ ID NO: 351 - DNA, 524 bp, Zea mays
aaaggatccgacgagcatcaccaggtttcctgttgatcatggcacagcttgcgatgtgcttgcttcggcgctccatagggtttacagcgccaccagcacagagagccctgagtaccactgccacaccagcacagagagccctgagtaccaatgcggagggtgcagcggtggccgaggcgacggcgaaggaggcaaagaagaggaagaagaaaaacctgttcgacgtggtgcagttcctgccggggtggggcgttggatacaaggtcgccaagacgacctggcgcgatgtctcctaccagatcaccaagatcaacctgtacaaggatggtcggcatggaaaggcatgggggtttcggtacaaggcaggtgtgcaagctgcagatgccccaaccaggatcagcggggttaacaagcgtgggtggaagtacataaaagaatcacagaagaaactacacgatgcccccaaagtagacgtagcgattgctggctagttgcatgttgtaagatgattcttgggtaccttt

SEQ ID NO: 352 - DNA, 2740 bp, Zea mays
aaagtcgacaatcccaccacttgtgtctacctcttcgagtcaggctgatgggaggtgcctgtcagcaactctccgtggacggagatgcgaggacgcctgcgaatgaccgcgatccggccggcctgctccagcatgatgatacggaaaaccagcagcagcagcaggcctgctgggagcgcttcctcctcaaggagactctcaacgtcttgcttgtggagagtgatgattcaaccaggcaggtcgtcagtgccctgcttcgttgctgcatgtaccaagttatctctgccgaaaatggccagcaagcatgggcttatcttgaagataagagaaacaacatagatcttgttttgactgaggtttttatgcccggtgtatctggtatttctctgctgagtagaatcatgagccacaatatttgcaagaacattccagtgattatgatgtcttcgagtgatgctatgagtacagtctttaaatgtttgtcaaaaggtgctgttgactttttagtcaagcctatacgtaagaatgaacttaagaacctttggcagcatgtgtggagacaacggtgtcacagttccagtggtagtggaagtgaaagtggcattcagacgcagaagtgtaccaagtcaaaaggtgccaatgaatccggtaacaacagtggtagcaacgacgatgaagctggcatgggacttaatgcaagggatgacagtgataatggcagtggcactcaagcacagaactcatggactaagcttgctgtggagatcgacagtccacaagctatgtctctggaccagttagccgatccagccaatagcacctgtgcacaagtaatccactcaaagtcagagatatgtagccacagatggctaccaggtagcagcaacagaaactgcaagaagcaaaaatacactaatgatgactttaagggaaaagacttggagatagatggtcctggaaatctatatatggatcaccaatcttccccaaatgagagacccatcaaagcagcagatcatgaaaacaattccaaggagtcaatgatgggaaatttaggggatgcaactgttcgagctgctgacctaattggttcaatggccaaaaacatggatgcccaacaggcagcaagagctgcagatacccctaatttctcttctgaagtgccagaagggaaaggtaagaatgatgactttaagggaaaggacttggagataggtggccctagaaatttatatatggatcaccaatcttccccaaatgagagacccatcaaagcagcagatcatgaaaacaactccaaggagtcaatgatagaaaatttagaggagccaactgttcgagctgctgacctaattggttcaatggccaaaaacatggatacccaacaggcagcaagagctgcagaagatacccctaatttctcttccaaagtgccagaagggaaaggtaagaatgaccagcatgataattatgttttgccatcacttgagctgagtttgaagaggtcgagatcatgtggagatggtgccaacgatacagtcaatgacgatgaacagcggaatagtgcattaaggcgatcgaatctctcggcttttacaaggtaccatacatctgcggcttccaatcaaggtgggacaggattggtaggtagctgttcgccgcatgataacagctcggaggctgtgaaaacggattctacttacaacatgaagtcaaattcagatgctgccgcaataaaacaaggctccaacggcagtagcaataacaatgacatgggttccactacaaaggatgttgtgacaaaacccagcacaaataacgagagggtgatgttgccctctgctattaaggctaatggatacacgtcaacattccatcctgtgcagcagtggatggttccagataatgcgacagcagggaaagcgaaggctgatgaagtggccaacaatgcaggcagaaatagtcatcctggtgacgtgcagagcaacctgacgcaacaacatcgtccaacccttcattacgtccattttgagaatagtggatcaggtgccctgcaatgtggttcctccaatgtatttgatcccccacttgaaggccaggctaccaataactatggtgtgaaagccgggagcaactcaggcagcaacaaggggcagaataatgggagtacagctggtgcgagcacggctgctgcaaatgctggacggacagatacagagatacgggctatcgataaaagtggacctggaggtggcagtgggagtggcaatgacacatatgtcagacggcttgctgcgagcatgacaccacgacaagaacagctaaagaaatatagagagaaaaagaaagatcggaactttgggaaaaaggtgcggtaccagagcagaaagaggctagccgaccagcggccaagggttcgtggacagttcgtgaagcaagctgtgcaaaatcaagagggagatggagagagatgaccccccccccctctggcttcagctcatggttgttagacgtggcggttgatgattcttccttctctggtgtgatctgatatgatcgacaacacaccatccttccttttcttcattggtttcttcacatctagaatttactgcctgaccgggaaaaaataagctaggaacttctatacatgtgtatgcatttctaatcatgtagaagaataagtgtgtcttgactctagataattttaggtagagtcatgctcgctctcggatccttt

SEQ ID NO: 353 - DNA, 453 bp, Zea mays
acgctaatcccttcctttcctctgctggccgcccttaaacagcactcggtcctcgctctccctgcggcggcctttttcacactctgcacctcctcccctccggccagtcgaaaccgtcgccaccgccgccgccgggaggagaagagctccatggactacaggcagtcctactgcatgaccctgaggatgaacatcgactgcaacgggtgctaccagaggatcaggagggcgctcctccagatgcgagagctggagaaacacctgatcgacaagaagcacggccgggtcgtagtgtggggcgccttcagcccgcaggacgtggccatcaagatcaggaaacggaccaaccgccgcgtcgagatcctcgacctcagcgaggcctcgccggcagccccggaaggcggccccgacggccacatgtcctgaaggaaccacgtcaccaatacgtactag

SEQ ID NO: 354 - DNA, 1579 bp, Zea mays
gcggattcactctctctctccccccggccccctcctccgcccatccaaccaccatataacaacctagtagccgccaacgccacaccaccagtagtcctactggtccttgacgtccgtggccactcaggttgtgttctctgagttctttcgccgggtggggaggcggagtgcgcggtcgaggaaggcccccttagcggtcggatcgatcggcgccgtgcttgactgcctgtacatgaggagcggctgcggcggcggcggcggagggagacaacctggggaaggaggcgggggaggcgctggggctgctgggctgcgtcaatgaggtggtggcggcggtggcggccacgtgggggcccatgaccgacggcgcgcgcgtcgagacggcgcccaggctcgcccaatggcgcgtcgacccgctcccctgctacacctaccgcaagtcactccccttcctcatcggcctctggaactggtgcatatctgtggagagaaataacaagcaaacctgtgttaagctctttgcagagaatacaagttctctcaagaacggttcctcagccccaatagcttcctttatcgccaaacttattgtatctcttccacctaatcagcagaccatagtccacccaggaatttttgacaaacagctgaaatacgacggttttgtgtggacaatcgatagcaccgtcactgggaggtttgtgattgagatagagtttcttgacctgaaggtcgctgatccgtctggcggggagccggcctcgatttgggcctcccgccaggtcaagcagtgctcggacagcacggccctgtcgtccctggctcggatgctgcacgaggacgtcctcaccgacatcaccatcaacgcggcggacggcagcgtgggcgcgcaccgcgcggtcctggcgacgcggtcgccggtgttccggagcatgttctcgcacgacctgagggagaaggagctctccaccgtggacatcaccgacatgtccctggacgcgtgccgcgccttcctcagctacatctacggcgacgtgcgcggcggcgaggagttcctggcgaaccggctggcgctcctccgcgccgccgacaagtacgacatcggcgacctcagggaggcctgccacgagagcctgctggaagacatcgacgcgcgcaacgtgctggagcggctgcagacggcgcacctgtaccggctgccgaggctcaagggcggctgcctgaggttccttgtggacttcaggaaggtgtacgagatgcacgacgacgacctcaacgcgttcctgcagacggccgacagggaactcgtggccgaggtgttccatggcgttcttgccgcgtggagcgggcggtaagccgggcgcatgccatggcactgccgctctgctgcaggtgttgcacatctggttggttcagttcgtcacaactcagaagcgttgtttgcaactggaggattcttgctgggaaagcgtgtaaatatttgcaaactgtacatgcgtgccagtggttggtctaaaatttactgtgcatgccttgattggattttgttcctatgatgtggaaatcagctcatatgctg

SEQ ID NO: 355 - DNA, 1811 bp, Zea mays
aaagtcgaccctcctctgtcctcgtataaagcgccgcagtccacgacggcgacgccgcccatgggagctggagcaccagcacacgccgctgccccggctctgcgccgcgaaccctagccgaccgcctcatggccgccgagtcctgcggcagccgcggcgcctcgcccccgccgcctccctccgctggcggcgcggccgggaggcgccgcaaggcggaggcctacgccgaggtgctccgccgcatccgcgctggcgccggcggctacggtgctgcccgccccgggttggaggacgagctctgggcccacttccaaggcctacccgccagatatgctttggatgtcaatgtagaacgggttgaagatgtcttactgcacaagaaattgctggagcaagcccataaacccatgaatggtctggtctttgatgttcgtcctgcacagggttttactctggaggaaagcactggatttgagtccacaacttcctttaatcaagaagaacaagatccccagtcctcagtattcacatcaagagatcaaaggcctttgcatgaagttatatttgcatgtgacgataagccaaagcttcttagtcagttaacctctctcctcggggagcttggtcttaatatccaagaagcacatgcatattcgacgagtgatggctattccttggacatctttgttgttgatggctgggagtatgaggctgacattctccaaagtgcattgagggaaggcgttgataaaataaagtacagagcatggccgttggtaccgtcgatgtctgctaggatggatcaccaaccattggaggtttctccttcatctgactttgtccagataccagctgatgcagctgatgtttgggaagtcgatctcaggcttctcaaatttgaacaaaaattagcgtctggatcatttggtgatctataccatgggacgtactgtagtcaagatgtagctatcaaagtactcaagcctgagcgggttagcgttgatatgctacgtgagtttgcacaggaagtttatataatgaaaaaggttcgtcacaaaaatgttgtgcaatttattggtgcatgcacgagacctcctgttttgtgtattattacagaattcatgcatggaggcagtatttttgacttcctttacaatagacgaggaaattttcaactcccggatgtgattagaattgcatctgatgtgtccaagggaatgaattacttgcatcagattaatattgttcatagggatttgaagactgcaaaccttcttatggatgatcaggttgtcaaggttgcagactttggggttgcaagggttaaagaccagtcaggagttatgactgcagaaacaggaacctacagatggatggcccctgaggtcattgagcatttgccgtatgatcatagagcagatgttttcagttttgggatagttctttgggagctgctgaccggaaagcttccatatgaagacatgacacctcttcaggcagcagttgctgttgttcaaaaggatctgaggcctactattgctgttgatactcatcctatgctcgctgagctactccagagatgctggcagaaagatcctgctctaagaccaacatttgcagagattgtggatatattgaactctataaaggaggcggttcggagttctatgcatcacaagaggcattcaggtcgatctcactctgggagaagacgaggctgttgatgtgccagttttatgtggtgccacacgccctttttattttatttttgtagtcgagcgataacttcagaatacggctagggatccttt

SEQ ID NO: 356 - DNA, 221 bp, Zea mays
gagtcatgtcaaaggcacgtaatgctgtagttgccactggattgctgctcttcgctggtgctggcttatcatttccgttccttttcgtgaaatcaaagaacaagcctattattgattcgacaaaacctctgccaccacaggctacttttcgaggaccatacgtgaatacgggttcacgtgatatcggacctgatcctaccaactatcccaagaagtgatga

SEQ ID NO: 357 - DNA, 927 bp, Zea mays
cgagaacccgagtctatttctgcacgcgcttccaggttttagctgcagcggcatcagggcagggggagagcaatagttctgttctactggaggaagagcagggagcaagatggggtccggatctttcctcaaggtgctggccaataacttcgatgtccttgccgggccactcatatcacttgcttatcctctatatgcttctgttagagctatagagacaaaaaatcctgtagatgatcagcagtggctcacttactgggtgttgtactcatttatcactttgtttgagctaacttttgctccaattatcgagtggcttccattttggtcgtatgcaaagctgttctttaactgctggttggtcttgccttggttcaatggtgctgcctatgtttacgaccattttgtgcggccaatgtttgtgaaccgccaaatagtgaacatatggtatattccaagaaatgagaagctaggtaaatctgatgatgttctgtcagctgcagagagatatattgaacaaaacggaccagaagcatttgagaagctcatcagcaagtctacgaagtcttcgaagtcaaggaacacaaagcggttgaacttggaggatggagaggctgaaaatcgagctaaagccgagagagaatcgtggggcgaaaatcccttctacgacaaaaactacagatactaaaccagttcaaaatccactcagcagtttgaagatgaccttgctcacgagcctcatgcaagctttagttgcgtcggaccgaagacgacattcccatatttctgactctgaatattgtaccttgttacatccactgctactacataatgatgagttctagagcaattgtggactgtgtaaatggaggtagatgctagcgttaatcgtttatgtgctttttggatggtgtccttatcacccgt

SEQ ID NO: 358 - DNA, 1477 bp, Zea mays
aaaggatccagcttcgtctggttgaattctcttctttggaagtgctggtgggcggcgtggtttggtgctcttggggccggcgtgtttctgcgttctccgggctatctgcctgtcttgctgcggcctgcggcggcggggtggagatggggatggccggggagaagttccagctggggacggtgggggcgctcagcctctcggtggtgtcctccgtctccatcgtcatctgcaacaaggctctcatgagctccctccgcttcaactttgccaccactttgacaagctggcatcttctggtcaccttctgttctctccatgtagcattatgtatgaagctctttgagcacaaacctttcgatgcaaggaccgtcatgggattcggagtgctcaatggcatatcgattggacttcttaacttgagtttgggtttcaattctgttggtttctatcagatgacaaagctggctattattccctgtactgttatactggagacccttttcttcaggaagaaatttagtcggaacatcaagctttcccttagtgtgctccttcttggtgttggtgttgcaactataactgatctgcaactcaaccttgtgggatctgtattgtccctactggcaatcatcacaacctgcattgctcagatcatgacgaatacaatacagaagaagttcaaggtatcttcgacacagctcctgtaccaatcgtgcccataccaagcattgactttgttcctcgtcggcccattccttgatgggtttttgactaaccaaaacgtctttgctttcgactacacaactcaagtcctgttcttcatcgtgctgtcgtgcctgatctcggtctcggtaaacttcagcactttccttgtgatcgggaagacgtcgcctgtaacctaccaagttctcggccacctgaaaacgtgcttggtcctcgccttcggctacgtcctgctccacgacccgtttagctggaggaacatacttggaatcctgatcgcggtgatcgggatggtcctgtactcgtacttctgcactagagagactcagcagaagccggcagaggcctccccgcaagccatccaggcaaaggagggtgaatcgagccctctgatcttggattccctgagcgccgctgaaaacgggggcagtgccaccgacgacgagcctctgaaggtgccaatgtggagctcgaagtactccaaggcgtgaaaggctgttctgttactggtgtactacggcgctatacagaatccagcttggtaggcagataccatactactactagggttggaaggcaatcctgttcctgttcatgttccatttttggccttctatttttttcttttcttgttttcttcctttctggcatatactacaaatatatgtgctgctggtgctgttagtaaatggatctcactcttgggaggatgatacctcagctcgagacgagtgatctgtctgaaggtaccttt

SEQ ID NO: 359 - DNA, 760 bp, Zea mays
catcctctctcgcacacagacactcgttcgccgtcgcagccacagccagagcaccgacactcaggccaggccgatcgatcaatgggcaagaagagcggccgcagcggcgccgacgcgcccaaggcgacggcgttcgtgctgaaggtggcgatgcactgccgctgcgacggctgcgtccccaagatccgcgccgcggtcaacaaactgacgctccggtgcgagggcatccagtcgctggaccagtcggcgctggacaccaagggcgaactggcgctggtggccacggcggacccggagaggctgcgccgccgcctgcgcgaggccacggggaagagcgtcgacatcgtcttccccaagcccgcagcggccaacggcggcagcggcagtggcagggaggaggcgaacgccgccgtccaggctcaggctcaggcccaggcccaggcgctgctgctcgccgccggtctgcaacagcagcagcagcacggccgtccctggtacgcgctccagcagggtgggtacggcccgccgccagagccgtacgtggcttcctaccccgccaccgcgtggggcgcgtacccacacaacggcctcgatgacgcctacggcggcggatggttcgggtactgagcgaccggcggagagtagagcagcggatggagcttttgaggttcgggtactgagcgaccggcggagagcagagcagcggatggagcttttgcgttgtgtagtgtgtcagtggtgatgtccgcacgtgtagtac

SEQ ID NO: 360 - DNA, 1088 bp, Zea mays
aaagtcgactctctcttctattccattcccaacttggctgcccaacccttgcgtcggtagacggcggccgcggcgaggatagagggttccctgaggaggcagtgatggagaccatggctaagtacaaccgaagcaacccggcagtgaagcggatcctgcaggaggttaaggagatgcagtccaacccctcacccgacttcatggccctccccctcgaggaagacatcttcgagtggcaatttgctatccttggcccgagagacagcgagtttgagggtggaatctatcatggcaggatccagcttccctcggattatccattcaagccgccgtccttcatgctactcacgccaagtggacgctttgagattcagaagaagatttgtttgagcatatccaattatcaccctgagcactggcagccatcatggagtgtgcgcacagcgttggtggccttgattgcattcatgccaaccaaccctggtggggcattgggctcattggattacaaaaaggaagatagacgggcacttggtataaaatcacgtgaagcaccgccaaaatttgggtccccagaacgacaaaaactaattgatgagatccatgagcaaatgctcagtaaggctcctcctgtcccccaaacgctaccaaatgtgccaaacgaggagtctaacgaattacccgcatctgacccttctggcgagcatgcagacaaggtagatgaaggtgacaacacatctggttctgtatcagactcgtctagtggccttcctgtgcctgaatctgaatcgggggttacagaaaacactggtgaaacctcagcagttgaggttgccaaccatcatgtgcctgaagcaagccacagagagaacattccaagagttagttcgtctcaccagaatcctgctgttgcgatccagaagccaaagcatgacaggctgttaaccttggccgcatttgggctgactcttgctattatggcacttgtgatcaagaaattcttaaaaatcaatggcttgggcggtttcattgagggcaagttctgagtagggattgtgcataagttggatgtaagataggaattcttt

SEQ ID NO: 361 - DNA, 853 bp, Zea mays
aaaggatccatcctcaaggaatgaacacagccagccagcaagcaagcagagaacaaggataacacagcaactgaaaaccttagaacaaacaaccacaagaggctttgcaagttcacagaggcagctgttcactgcgaatgaacaaccagaggaagcctggagactggaactgcaagaactgccagcatctcaacttcagccgccgtgactactgccagcgttgccgtgatccacgccctgacttgcagttcggcgacggctatagcacagttggtgtgctgacctccctggatatccgcccaggtgactggtactgcagttgcggctaccacaacttcgccagccgcagcagctgcttcaagtgcggcaccatcgtcagagacttcccagcggggcaaggcgcagccggtgctgagggtgactttgctggcggacgcgacagcgccgcagtccgtgctgggtggaaagctggcgactggatctgcacgaggcctggttgcaacgtacacaactttgcgagcaggatggagtgctatagatgcaatgcaccaagggaggcaggcaccgggaggtaagaggcgactggggtgataccaggagcgtgagatgtgacgagctggccgagcagtggaaccaactgccgtcacacactcaccatcaggcatccaggaaggatgagtctactacgtacacgactatattgctgattgccgagcgtagtgccgctgctgtggtttgcgtgggtggagaagtacccaagcgcaacacctgttacgtgtgttgtttgctcctttttgaggttgtgctgattcagtgacagctgagttgtacggcctgatgatgtggtaccttt

SEQ ID NO: 362 - DNA, 2864 bp, Zea mays
cgtggtatgtgccatgaggaagctcttcttctccgagtcggcctgcaaggagaccaagctccactgcgcgccccactcatggctgcccctcgagagggggaagctctccaagttctccggccatgccgccgccggctcctccatagaggcattgatgaagatgccggagccggcagtgcttccgtacttcaagcccgcgaactatgtcgacatactggctcagatacacgaggagctggagtcctgccctcctgacgagaagtcctgcctgtacctgctccagttccaggtcttccgcggccttggggaggccaagctgtcacggaggagcctccagtctgcgtgggagaaggcgagcaccatacacgagaagctcatctttggggcgtggctcaagtacgagaagaaaggggaggaggcaatctccgacctgctcagctcgtgctgcaagtgctcacaggagttcaggctgctggattttgtgtcgcaagtctccactgggtcacacatgatgaactatgatgatgatgatgatgagtctgatgagtttcggggttctgcggtggttcatttccggataagagatgatatgattgcatgcgatcgacggaaacttgcagctctgtcaactccactgtatgcaatgcttaacggtggatttagggaatcctatctggaggtcattgacatgtctagaaatggtatctcccctattggcatgagggcaatcagtaaattcagcctatcaggaagactaccttatttgtcagcagatgctatcttggagatgcttgattttgccaataagttttgctgcaagggcctcaaggatgcctgtgagcgaaagcttgcttctttcatctcttcaaggcaagatgctatagatttcatggagtgtgctcttgagctgggctgttccattcttgctgcttcatgcttacaagtgctcttgaatgagcttccagagtgcttgaatgatgaacaagtggttaggatattctcctctgcaaataaggcacagagattgacaatggttggcaatgcatctttctccctatattgccttctcagtgaagtctccgtgagtaccaacccaacatcggatgtcactgtgagtttcttggaaaaactggtagagtcggcatcagattctaggcagaagcagctggccttacatcagctggcatgcaccagatttttaaggaaagattaccctgaatctgagtgcttgttcaatgctgccttttctgctggccatctttattcgttagtgggtttggctagattggcctctctgaggggtaataagcattttgctctcaagttgctagactctgtgatgtcatctcggtggcctcttggatggatgtatcaagagagagcactctatttggatggtgataacaagttagaaaatcttaacaaggctactgagttggaccctacccttacatatccctatatgtttcgagctgcatctttgatgaaaaggcaaagtgttgaagctgcattgatggagataaaccggatccttggatttaaactggtgctggagtgcttagaactaaggttctgttgctaccttgcccttgaggattatagggctgccttatgtgacgtgcaggcaatcctcactcttgccccagattatcgtatgattggtggccgggttgctgccaagcagctgcgaatgctagtgctagagaatgtagagcagtggacacctgctgactgttggatgcaactttatgatcgctggtcgtctgtggatgatatagggtccctctctgttatatatcaaatgctggagtcagagactgccaaaggagttttgtactttagacaatctttgcttcttctcagattaaactgtcctgaggcggcaatgaggagtttgcagcttgctcgtgagcatgctgcaagtgatcatgaaaggcttgtctatgaaggatggatattgtatgatactggccactgcgaggaaggactgcagaaagcggaagcatcaattgcaatacaacggtcatttgaggcattttttctgaaagcttatgctttggctgattcgagtcttgatccttcgaccacagcaacagttgtatcacttctagaagatgcattgcggtgtccctcagatagacttcggaagggtcaagctctaaacaaccttggaagtgtttatgtggattgtgggaagcttgacctggcagctgaatgctacattaacgccctaaagatcggccacaccagagcgcaccaaggccttgcgagggttcatttccttcggaacaacagagtcggtgcgtatgatgaaatgaccaagctgatagagaaggccaggaacaacgcgtcggcatacgagaagagatctgagtactgcgagcgggagctgacgaaaacggacttgcagatggtcaccaaactcgaccctctgcgagtctacccctacagataccgtgctgctgtgctgatggacaaccacaaggagaaagaggccgtcgcggagctgaccagggcgatcgccttcaaggcggacctgaacctgctccacctgcgcgcggccttccacgagcacatcggcgacatctcgagcgccctccgggactgccgcgcggccctcctggtggaccccaaccaccaggagatgctggagctgcaccaccgggtgaacagccaggaaccatgagcggagcgccgccatggtgtacatacaggacgtgataggaagcccctcatagccaacccccccgccataccagtgtatgttttgtaccatacacagcatgtcaatgtaaggatagtagaaaagccactttaggtccctccctggctccctccccttgcaaaccaaacacctacattcc

SEQ ID NO: 363 - DNA, 1297 bp, Zea mays
aaaggatccgcagagctaaccaatggacgtgctgaagcgcgagctgcagcgcaagcgccagctcctcaacgccgatttcggcggccgcaagatcatccgccgcgccgaaatcgaggcacgcgagctccagcgcatccgcgaggtcgagcgccagctcctcctccaaaagcagcacaggcattcccgcccgctgtcctccccctccagttcctcctcaagctcctcgcccacctccgcagccgctgacgccgacgccgacgcgtcgcgggcagagagcggctccaaggagtcgctcccgagggaggaggtcatccggcgcctgcgcgtgctgcggcagccggccacgctcttcggcgaggacgacatcgcgcgcctccgccgcctccaggtcctgatcgaggaccccggcgcgctcgccgacatcgacgcggcggagatcggggagggccagaccaacgacttcctccgcgatatccaggcgatgcgtgctaaggctgcgactgtcacgaagcccaaggcggccggcgcggagaccgagcgcggggagggcgacagcgtatcgatagatgtgccgttcgaggagctctgtgacgaggacaagatcaccgcgttcttcaggaggctgttgaacgagtggacccaggaggtggacggtatgcctgaggcggaacggaggacggcaaaagggaaggccgcgatagccacctgcaagcagtgcacgcgatacctcgaccctctgttcaagcagtgcaagaagaaggctctcccttctgatgtccgacaagcattgctggaggtggtcaagtgctgtaggagacgagactacttggctgcagtggacaactatatcaagctagcgataggtaactcgccctggccaattggtgtgaccatggttggtattcatgagcgatcggctcgcgaaaagatctacacgaacagcgtggctcacatcatgaatgatgagacgaccagaaagtacctgcagtctgtgaagaggctcataacattctgccagagaaagtaccccactgatccatcaaggtcggtagagttcaacagcctggcaaatggtagcgatctgcagtctctcctggcgcagcaaaacgcgaagaattcagaagaaacgcttcggttagtggcagcgtcatgaaaggttggattatatctgtcatcggaattctaggcaagttcgattcttgtgtgatttatttgtgatacgaattagtacttgtaagaacctgaattgtatgctcggtcgttactcgttactgccttactgaaccgtggtaccttt

SEQ ID NO: 364 - DNA, 1409 bp, Zea mays
aagcctgtatccgtctgtcgagccatggcgaagggaagggcacacccgtcgaagcgacccacccaccaacttatcctcgcggctgtcctatccgtttccgttctcctcccgctgctcgtgccggcggcggcaactgtggctgtggcggtggcggaggggggcgggaagcagttggcggtcgggaaggacgagggaaaactggtcgcggagggggatgctggtggaggcgggttagtggaggagaatgagttcgcgggtggcttcggctccctcgacagcatgctgcagtgggcgatcggaaattctgatccggagaagctgaaagagggggcggttgatgtgcagaagttatctgcagatgaactgctcgagcggcgtcaggagattaaggagttgatggagaagttaaagatgccatcagacgctgacttaatgaaaatcgcaattgatgacttaaataattcttccatttcactggaggatcgccaacgcgcactgcaggaacttttagttcttgttgagcccattgacaatgctaatgatcttgaaaaacttggagggctccttcctgtgattcaagagcttaataatgcaaatgaagaaatacggaccacctctgcatgggtccttggtacagccagtcagaataatgaacttgtacaaaaccagatccttggttatggagctttggcgaggttggtgaagatgggttattccacatctacagaagaagctgcaaaagcattgtatgctatatcatctttgatcagaaataatgtaaatggtcaagaagcattccattcagaaaatgggagtgcaatgttgcagcacatattggtcagcaacaatattgatgttaggctacagaagaaggcagtgtttttagtaacagatttggcagactttcagctaaattccggaatcgcgcaacttcctttcttgagtgaccgtctttttctgaagtcaatagtcgatatgttatcaaggtttgacctagaccttcatgaaaaagtattattggccatcaagagtctgctgaaactttcctcaactgatgtggaggattttgagttctatgatctcgatagtgtactgctcagactaggggtacagttggaggacttgacaccagaggatcaaaaggagttcgctgtggaggttgatgccctccggagagaagttcaaacactcttccaacagaagctcaagcagggtaaagcgacctcgacatgatgttcggatgaccaccagaagatttgcccgtctagatggaagtagaatggatcagcttttgcgggatgctacagctagatggcggacttgggttttcttcttgcagtattcgagaaccatcagtcggaggggtcgggtggatgcacttcggcaaggtacatgagggcatgataggt

SEQ ID NO: 365 - DNA, 1493 bp, Zea mays
agtctagcatcaggcatccatcggcgagagcgagagcgagagcgttcgcagcaagcctacctcaccttgcctgcctgtctgcctgtctgtctgtctccagagctgcgcttgtccggagacggagccgactgaacatggccggagatccgggggacgcgccggaggtgggaggcggcggcatacgctccgtgctcaccacggcctcgctcgtcgctccctccggggacgaggttcagtttcgggagatcgacggcaagatcatcggcctctacttcgcggcaaactggtatccgaaatgcgaggctttcaccccggtgctggccgcggcctacgagcagctcaaggagcgcggcgccggcttcgaggtcgtgctggtgtcgtgcgacgaggaccggccgtcgttcgagcggttccacggaaccatgccgtggccagcggtgcctttcggcgacctcagctgcaagaagcgcctcagcgagaggttccaggtggagggcatcccgcgcctggtggtgctcgctccggacggcggcgcggtggtacacccggacgccgccgacctcgtgcaccgctacggcgagagggcgttcccgttcacggccgcgagggtggcggagctggaggcggatgaccagcgcaagtacgcgtcccagacgctggagaagctcttctccgtcagcgggaaagagtacgtgatgaacagtggtaataatgaaaaggttccggtctcgagcctggtggggaagacggtggggctctacttctcggctaaccattgcgcgccgtgtatcaagttcacgacgaagctggcggccatctacagcagcctcaggggcaaggcggaggacttcgaggtcgtgtacgtccccatggacagggaggaggacgggtacctgcgctcctgcggcgacatgccgtggctggcgctcccctacgacggcgcgccgtcgcgcgcgctggcgaggtacttcgacgtgcgggagatcccgacgctggtggtggtcgggcccgacggcaggacggtgacgcgggacggccggaacctggtgaacctctacttcgacatggccttcccgttcacggacgcgcagatcaggctgctgcaggaggcggaggacgaggcggccaaggagtacccgcggtcgctgcgccaccggggacaccgccacgagctcagcatcgtgtcggagaagtccgggggagggccctacatctgctgcgagtgcgaggagcagggactcggctgggcgtaccagtgcatcgcctgcggctacgagatacacctcaggtgcggccagaatgcggagggcggcagcgcaggaactgcttagctagctaggcgacgtacggcagtcggcagcatgccagcataacagcatcactggagtggtgtctacctattagactgctgcatgcgtattggacttggacatggtctgtgtttgatcccaacaaacgtcagcttgctctacgtcaagcaagtctgatgctaa

SEQ ID NO: 366 - DNA, 1153 bp, Zea mays
actcctcagctccgaccttcacggggcccacggggcccgacgcccggcggctttactcagggcaccatggccttctcttcgtcactggcgccgttcttcccaccttctggaaccttccgagcccatcccgctaggaggctgcgggccgatgcacccgggagattcgtggcgtcctgcttgccccctcccgacgtcgtggtgacgcgcgagcagggaaagaacgccaggctcatctccgcgctggaaaagcataatgtacaccctctggaacttcctcttattaagcatgttgaaggccctgatacagataggcttttagatgtcctacgtaatgacaagttcgactggattattgtaacctctcctgaggcagctgcagtgttccttcagggatggaaggctgctggaagtcctaaggtgcgagtagctgttgttggagaaggaactgcaagggtttttcatgaagtgtcagaatctgatgatcaatctctagagcttgcattttcaccttccaaagctttgggtaaagtcttggcttcagagcttccaagaagcaacaggaactcatgtaaagtattgtaccctgcatctgcaaaggctggccatgaaattgaggatgtgctatcagaacgaggatttgacgtgacccgactgaatacatatacaactgttcctgtagaagatgtcgacccactgacattaaaccttgctatatcagctccagttgttgcggtagcttctccttctgcactgagggcatggctaaatcttatctcaaaatctgataactggaacaactccgtcgcctgcatcggtgagaccactgcatctgcagcgaagaaactgggcgtcaagagcatatattacccaacgacccctggacttgaggggtgggtcgagagcattctcgaggcgctcagagtccacatgacagcatcgaaagaggccccaaaacgttgaagacgggcggatggcggagcttcttcttggcgttggtagccgtccgcagtgtcgaagaaattctttgcttcttcgacgacaattgccccccgttgaggcaggtggtggtgtcaagtcatggctttccactggcccagtttgtaatggattcttgggccgaaaggcccatctctacatgtcttgactcgcaagg

SEQ ID NO: 367 - DNA, 1421 bp, Zea mays
aaagtcgactttgctgcagagagctcaagaaagatgtacgtggtgaaggatattggcggcgccatcgggctgatggcggtggcgctggtgctcctgggcacctggccggttgtcctggcggtgctggagcggcggggccggctgccgcagcacacgttccttgacttctccgccaccaacttcatggcggccgtgctgatcgccctcaccttcggccagatcggccccgccagcagcacgcccaacttcctgacgcagctcactcagttcaagaacaactgggcttcggtcttgtttgccatggcgggcggcgtcaccctgagcctgggcacattggccacgcagtacggctgggcgttcgtcgggctctccgtcactgaagtcatggcctctagcctcaaggtcgtcatagggacaacggtcaactatttcctggacggccggatgaacaaggcggagatcctctttcctggcgtcggctgcttcctgattgcggccatccttgggtcacttgtccacgcttccaatgccgccgacaaccaggagaagctggctaataataacgcttccaatgcagctgcagctgcagatgaggagaaggatctcaccaaacacctcctagagctagagataccatcccaagaagcagagccggatgcaggaacggcagggttcctggttggtctggaggagaagaggtcgattaaagtgctgggatcccacacgctgctgggccttggcatcgtggtgttcgcgggcatcttctacgcgctcttcgcgccagcgttcaacctggccactaacgaccagtggcacacgctccccgccggcgtgccgcacctggcggtgtacacggcctacttctacttctccctcgcatgcctcgccgtcagcgccgccctcaacgtgtggctcctctaccggcccatggtcggcgtgccaagctccaccctggcggcctacgtcctcgacggcgacggcaggggcctcgcgatgctggccgggatgctgtgcgggctcgggaacgctctcacgttcatggcagggcaggccgccggttacgccgccgccgactccgtgcaggcgctgccgctggtcagcacgttctgggccgtcgccctcttcggcgagtaccgccggtcgtcgcggcgcacgtacacgctgctggcgagcatgctactcatgttcacagtcgccatggtcctcctcatggcttcctcaggaagccgctccatcattcactgagctggccacgtggatggatatgcgatgcgatgcgatgcgatgcgatgaggagaatggacaccgggatagctcttgtgttgtgctggaatggaatggaaccaacccactagctgtgcctgtacagagcgatcatgctacgtccacccactcgtccatgaattgatttggaattcttt

SEQ ID NO: 368 - DNA, 2262 bp, Zea mays
aaactcgagctgtgctgacttcattggagagagagacagtgaagagtagaggagagagagagagagagagagacagaaagagaaaatgggcgtggcgacggtgacagagctgaagcagagcatctccgggaagaggacattccggccgagcctcatcagccgccacgccaatgagtggcctccgaccgacgtctccagcgacctcaccgtcgaggtcggcacctccagcttcgcactccacaagttcccgctggtctcccggagcggcaagatccggcgcctcgtcgcggaggccaaggacgccaagctggcgcggctcagcctgcacggcaccccggggggcgcgccggcgttcgagctcgccgccaagttctgctacggcgtccacgtggacgtcacggtcgccaacgtcgccatgctgcgctgcgccgcgcactacctgcagatcaccgacgacttctccgacaagagcctggagctccgcgccgaggccttcctccgcgacgcggtgctccccagcatcgccagctccgtcgccgtgctccgcagctgcgaggcgctgctcccggccgccgaggacgtcggcctcgtgccccgcctcatcgccgccgtcgccaccaacgtgtgcaaggagcagctcacctcggggctgtccaagctggaccagtgcgcgcagctcaagcccgcggcggcgttcgccgacctcgacccgccggccgactggtggggcaagtccgtggccgcgctcggcctcgacttcttccagcggctgctctccgcggtcaaggccaaggggctcaagcaggagacggtcaccaggatcctcatcaactacgcgcagaacgcgctgcacgggctcatggccagggacgtgcacagatgcggcggcgcggacgccgacgccgtcaagaagcagcgcgccgtcgtggaggccatcgtgggccttctcccggcgcagtccaggaagagccccgtgcccatggccttcctctcggggctcctcaagacgtcgatggcggtgtccgcgtccagcatctgcagggccgacctggagaagcggatcggcatgcagatggaccaggccatcctggaggacatcctcatcgccgcgggcgccgccgttggcgcgccggccggtcagcagcacgcgctgtacgacacggacgtggtggcgcgcatcttctcggtgttcctcaacctcgacgacgaccataacgaggaggacgacgggttcgactacgacagcccgcgctcgccgaagcagagcctcctggtgaaggccgccaagctgctggacagctacctcgcggaggtggcgctcgactctaacatcctcccgtccaagttcatctccctcgccgagctgctcccggaccacgctcgcgtcgtcaccgatggcctctaccgcgccgtcgacatcttcctcaaggtgcaccccaacatcaaggaggcggagcggtaccggctgtgcaaggcgatcgactgccagcggctgacgccggacgcgtgcagccacgcggcgcagaacgagcggctcccggtgcagatggcggtgcaggtgctctacttcgagcagctgcggctgcggagcgcgatccaggccgggggcggcagcagcatgggcgggcacgacggggcggtcttcttcgggtgcgccgcggccgccgcgtcggtgcagggcagcgtgaacatgcgctccggcagcggcgtgggcagcggcgccatgtcgccgcgggacaactacgcgtcggtgcggcgggagaaccgggagctgaagctggaggtggcgcggatgcggatgcggctcacggacctggagaaggaccacgtgagcatgaagcgggagctggtgcgcgtcggccccgccaaccgcctgctccggggcttggcgcgcagcctcggcaggctcttccgcatgcgccccgccgccgagccggggctgcagcagctcggggccaaggctaccgccgacgccaaggtgctcttccagcgccgccgccgccactccatctcatgatctcggttcctcgactcggagaggcgactggcgggcacgctgccgatcgagcgtgctcgcgaggatgagcggccacgctactgtacgtgcgtacagcaaagtttcgcgtgtgcaattgtgcatagcatacaagaaagaaagacatggtttgagtgagtgcacactgcaggtttatttcaatcccggatttcgtgcggtgcgggcatcgcgtggtcttctgctcatgaaagtcatgggaattcttt

SEQ ID NO: 369 - DNA, 685 bp, Zea mays
aaagctaagctcagccagagtcgatcatcacacggcgatggagccggccgccgacggcgacgacgtgcacgggcagcgacgggacggaggacaccacgcgccggtggtgtcgctccgggcgctgggcctggcggacgcggacgccttcatggcgtgggcgtcggacgaccgcgtgatgcggcacctgaagcggccgctctgcgccacccgagagcaggccgtggcgcagatcagggacaccgtgctgggccacccgtggttccgcgccgtctgcttcggcgacgtgcccgtggggcaggtgtccgtgtggccgtacgccgacgagggcggtcgcagggccaacctcggctacgccctcgcgcacgaccagtggggccggggcatcgccgccgccgccgtcaggatggtggtgggcacggtgttcgacgacctgccggggctggaacggctggaggcggtgacggacgtggcgaacgtgcggtcgcagagagtgctggagaaggccggcttccacagggagggggtgctgcgccgctacatcgctggacgccgcggcagcggggccagagatgcggtgatctatagcttcttgtcgtccgatgatcgtgcgtgacccggtgaccggtgtcgctatgctacctgcatatggttgtgtgtcctgtaatatgcgttccataaattgtgc

SEQ ID NO: 370 - DNA, 354 bp, Zea mays
aaaggatcctgtgtgatggcggagagggtgtcgagactatcgacggagaaggcggtggtgatcttcacgacgagccagtgcccgatgtgccacacggtgtcgagcctcttctccgagctgggcgtgtgcgcggcggtgcacgagctggacaaggacccgcgcggccgcgacatggagcgcgacctcgcccgccgcctcggacgcgcgccgcccgtccccgccgtcttcatcggcggcaggctcgtcggctccaccgacaagatcatgtccctgcacctcgccggcaagctcgtgcccatgctcaagggcgccggcgccatatggctctgaattcgcgattattaaggtacctaa

SEQ ID NO: 371 - DNA, 2436 bp, Zea mays
aacaggaagcagcagggtgcaacaatggtgaagttctccaagcggttcgagggccagctggtgcccgaatggaaggacgccttcgtggactactggcagctcaagaaggacgtcaagaagctgcaggccgcggcaggagaggctgccgtggcggcgccggcgagggctccggctcactgggcgatgaggctgcccttcttccacccccttgggcagccgcctgccgccattcaggtgcacaggaagctggccacagacaggagcgtcgacggcgcggtggccggggaggtgtacgatacggcggtggcggatggcgccgggttcgcggacgccgaggcggccaaggccttcttccagaggctggaccagcagctcaacaaggtgaaccggttctacgagagggaggagcgggagttcctggagcgcggcgagtcgctccggcggcagctgcagatcctcctcgagctcaaggctgccgtcacccagcagcagcaggcacggcgcggggggagcgctgccgacacggatgacccctccgtttcttggtccattcagctcggaggccaatctctcagggtaattgcagagaaagaagaagagtgtgaagaaaagctcaacggcggcgatgctaccgccaagataagcagtggtgaaggacccgtgtctcaaggtctcagtgaatctgggagactttgcaagccgaatgaagaaatgacgaggacactctccggccagggcaggagtgtgaggatcaacatcccggtcaccacgccttccaggactgtcaccgccatacgcgaactgctgttcggggacatgccgagccagtccaagaagactggcgcgcatggtaccgacggcagtgagaagctgagcatcaacaagaggaaggtgcaccaggcggagaagatgatcagaggtgctctggttgagctgtacaaaggactgggctacctcaagacgtaccggagcttgaacatgatggcctttgtgaagatcctcaagaaatttgacaaggttacaggaaaggaagtgcagcaaatttacctcaaagcagtggagagctcctactacaacagctctgacaaggcagtcaggctaatggacgatgtggaggagctgttcttgagacatttcacagaaggtgacagacggaaagcaatggtgtatctgaagccaaatcagcgggaagagtcacactgtactacgtttttcattggagtatccactggcggcttcatagcattgttcataggttactgtatcatggcacgcgttgctggaatgtacactcagcagtcaaacaaggtgtacatgtcaacttcttatcctgttcttagcatgttcagcctcttcttcctgcatctcttcatctatgggtgtaacatcttcatgtggagaaagacacgcataaaccacacattcatatttgaattcacgcctactaaagagctcaagtaccgagacgtgttcttgatatgcactgcttccatgacaattgttgttggtgcaatgtttgcgcacctggcaataattgttaaaggaaattcatcaggcgttgtccaagcgataccagggtccttacttctggtgttcttgttcatattagtctgccccttcaacatcgtctaccaatcaagccgttaccaattccttagagttatcagaaacatcattctgacacccttttataaggttgtcatggttgatttctttatggctgatcagctctgcagccaggtaccactgctcaggagcctggagtatttggcatgttactacataacaggcagctacatgacacaagactatggatactgcacaagagttaaaaactttagagaccttgcttatgcagtatccttcctgccttattactggagagccatgcagtgcgcacggagatggtttgatgaaggggatataaaccatattgtcaaccttgggaagtatgtgtcagccatgcttgctgcaggaacaaaggtggcatatgagaataacaatagtactgggtggatgtcacttgttatcattgtatcaagtattgcaactatctatcaactgtactgggactttgtcaaggactggggtcttctacagttcaactccaagaatgcctggcttcgtaatgatttgatacttaaacaaaaatacatttatttcgtatccatgggcctgaaccttgtcttgaggcttgcttggcttcagactgtcatccaccctaatattggaagcctggattctagagtaactctgttctttttagcagcacttgaagtgatacgacgaggtcactggaacttctacaggctggagaatgaacacctaaacaatgcaggcaagttcagagcggtgaaggttgttccacttccttttcaagaagtggaagaggaataacaaaacagggccaccactggagcatgttgtaggttttag

SEQ ID NO: 372 - DNA, 1028 bp, Zea mays
aaactcgaggattccttacacgctaagccacgcaacgcaacgcaactagccatgacgatgaagtccagcagcggcggcggccatgtcatcggggtcccggtcacctccaaggcgcacgggatagaggaggtgtccagggatccgtccttcggcaagggcgccggcgatcacctcgccgtctcgttgacgcaccccagcccttacgcgtctttcggctacaagcacacaggcagcaaaggccaggtgacccactgggtgagcaagctgagcagaagggcgcagggcttcagagagcatgtgaccttggggccgaagctgtcggagacggtgaaggggaagctgagcctgggcgcgcggatcctgcaggccggcggggtggagcgcgtgttccgccaggccttctccgccgccgacaagggcgagcggctgctcaaggcgctgcagtgctacatctacaccacgggcgggcccatcgccggcatgctcttcgtctccaccaggaaggtcgccttccgcagcgaccgccccatcaccgtcacctcccccggcggcggcggcgacacggcgcgggtcacctacaaggtggccatcccgctgcggaggatccgcagggtgcggcccagcgagaacgtccacaggcccgaggagaagtacatccacgtctccaccgtcgacggcttcgagttctggttcatgggcttcgtcagctaccagaggtcgtgcaagtacatgcagcaggccgtctcggagatgcgatgaccggtgtctgtatcgctgccccctgtcggaacgatgtgaagtgactaggatgttatgggtctcgcttcgccatcttttgtcgccaagcagccgtagctaaaaagattgccctgtctttaattttggatcggtgcaattgtgttccttccgcgtacgaatttggaccagcatctctgttgttcccaaagtggttgctctcgatctactagtacacatggaccgaaaaaattaaccatttgtgcatctttgttgaatgcaacgaattcttt

SEQ ID NO: 373 - DNA, 511 bp, Zea mays
ggaaacgagagatccttggagtcagcaatggagtctaccgcgctaatgaccgcgagactaccactgctgacctctggctcccgttccaaacccctcccctttgcttccttcaccacggcggcttgccgtctcgcctccgccccctgctccggcagcggcagcgtcgtcctgctgtcgcgccggagccgcgattatgctggcgttggttccttggtctccgccgcggcggctcctggggatacggcggacgccggatccgagtccatcctgctcagcgtccaggggatgatgtgcgacgggtgcgccgcgagcgtgaagcggatcctggagagccaacccgaggttacttctgctaccgttgattttaaggaagcaagcgcagtcgtgtggacaacagatgaggccaaggggacacaaggttggcagaagcagtatggagagaagcttgctaaacaccttggcacttgcggatttgagtctcgcctacaagagtaaggtgaagccgaaccga

SEQ ID NO: 374 - DNA, 583 bp, Zea mays
gtcctccagcccattatacatcatacttgctccagataagaccaagagcatcatggccaacgccttgcctctcatcgtcgcgctggtcgccgccgccgggtgcgcggcgctggcttcggccacgtcgtacaccgtcggcgactcgcagggctggacgaccaccggcgtcgactacagcagctgggccagccgcaacactttcgtcgtcggagacacactagtgttcaactacgtgagcaaggcgcacacggtgacggaggtgagcaaggccggctacgacgcctgctccggcgccaacgcgctcagcgacgacgacaccggctccaccaccatcacgctccagaccccgggcacgcactatttcatctgcaacgtccccggccactgcgccagcggcatgaagctagcggtcgccgtctccgcctcgccctcgggcacggccccttccgccggagccctgcaggttccggcgatggcctccgtcgtcgccgcggccgcgggcgctgccatcaagctcgcgctcttctgacggagcacggccgggtcgtctcaggggagagacagtgcatgcagactacgttag

SEQ ID NO: 375 - DNA, 2284 bp, Medicago truncatula
tgcttccttacttgcttcatcccgtgacttagaagaagtactgctgcttcggttcaacctgggtgagtgagtgagtttgagtttgaagttgtgaagtgaagatgtttgggttctctcgtagacgcaccaaattcggaagattgaaggttcagcagctttctgatggtactaggagtccagttactgttcggcatcccaaacgaattccaaattccattctcaatggagaaggagaagaagatggggatgcagttactggctcaagtggtcattctcatgaaattgataatgaaattgttagcagcaccgatatcagtactacttgtagctcaggcggatccgagaattgggtattattgtcaatttctggagataagcccgctcctagattcaatcatgccgctgctgttattgggaataagatcatagtggttggcggtgagtctgctactgggttgctagatgatgtgcaggtgctgaattttgacacattttcatggacaacggcatcgtcaaagctttacttgtctcctagcagtctgcccctaaagattcctgcatgcaagggtcatagtttggtatcttatgggaaaaaggcacttctcatcggagggaaaacggatcccggaagtgacagaatttcagtatgggcatttgatacagaaagtgagtgctggtcactcatggaggcaaagggagacataccggttgctcgcaatggtcacagtgttgtcagggcaagctcttatttgatattgtttgggggtgaagatgcaaaaaggaggaaactgaatgatctacatatgtttgatctcaagtcgttgacttggcttccacttcactacacgggaacagcaccttctccaagattgaaccatgtagcagctctctatgatgataaagttctttatatatttggaggatcctcaaaatccaagaccttaaatgatttatattcacttgactttgaaacgatggcttggtcaagagtaaaggttcgaggtttccatccatcacctagagctggttgttgtggcgttttgtgtggtactaaatggtatattacagggggtggaagcaagaaaaaacgacatggagagactctgatttttgatattgtaaaaaatgaatggtctgtggcaattacatcacctccatcttctatcactaccaacaagggtttcagcatggtacttgtgcaatacaaggaaaaagactatcttgttgcatttgggggatccaaaaaagagccgtctaatcaggtggaagtgttggaattggataagaatgaatcagcacttagaagacgttcaactcccagtaaaggtcctgcgtctatactgcttgaaaaacattcatcatccactagattagcctctcagcttaatcactgttcccaacgcttagttgactctgttgctagacaaaatttagcatctgcagttgaacatggttctggaaggaaatctctttcagaatctgtagatcccaattaccccccaagcaatgtctcccttcgtaagcaatttgatcgcgacgaagaatacaatgcagatgtcaagatggacaagaactcagatggaagttctttacctcaggcggcatatcacagaacaaatgaaaatgaccgtggtaaactgatgaacattggtggagccaaggctaatattgaaggacaagtattattgtctgggatgtcaaatcaacaaaaccaagtatttgaaaatgatgcactagaaagtgatggtgtgtcttttcctgagaatgataaatcaggatcactttcttctacaaatatctatcaatattatgaaagtaaagtagcgtccctgataaggaaaaatggaatgttggagggtcaactggcagcttccatggcaagcagagaagctgcagagaaaggcttagcatccgttcataaaagcagacaggaaatggagaaaaaattggccgatgcattgagggaaatggaattactgcgagagaagctagccggtctagagttggcccaagaagaggccaacaacttatcaaacattgtccactctgacaacgttcggctcgagcatgatgtggccttcctcaaggctgttttagatgatacacagaaggagttgcactcgacacgaggagttattgcaggagaaagagctagggcattccaactacagtatgaagtttttcatctcaaacagagattgcaatctatggaaaatcggacatctactacacccaggaaaccgtttcacgtgcagtgaagtagataattggagcagctcaccac

SEQ ID NO: 376 - DNA, 743 bp, Oryza sativa
aaaggatccacctcatgtcctcatcatcatcaatggagtgcaccggaaacatgtcggcggcgccattgctcgtcttgacggtggcggtgctcgccgtgctagcctccacctgcgccgccgacccagagccgatacaagacttctgcgtggccgtgccccgtgccggcggcgaggcgtcgccggcatacccgggcttcccgtgcaagccggcgtccgcggtcgtctccgacgacttcttcttcgccgggctcgccgccgccggcagcacggacaacccgttcggggccagcctgaagccgggcaacgtggaggcgttcccggcgctgaacacgctcggcgtcgccatcaaccgcgtcgacctcgcccccggcggcgtcaacccgctgcacagccacccgcgcgccgccgagctggtgcacgtcatcaccggccggatgctcgtcgggttcgtgagcacggcggggaagtactactccaaggtggtcggcgagggggagactttcgccatcccgcgcgggctgatgcacttccagtacaaccctgggaacgcctccgcccgcgccatgacggtgttcaacagccagctccccggcgtcgtgcccgccgcgacggcgctgttcggcgccgacccggagatccccgacgccgtcctcgccaagagcttccaggtggacgccgagatcatcaaactgctcaagtccaagttcaagaagtgacactgacgtctcatccgcggtaccttt

SEQ ID NO: 377 - DNA, 683 bp, Oryza sativa
gggggatggcggcggcggcggcggcggcggggtacagggcggaggaggagtacgactacctgttcaaggtggtgctgatcggggacagcggcgtggggaagtcgaacctgctgtcgcggttcgcgcgggacgagttcagcctggagaccaggtccaccatcggcgtcgagttcgccaccaagaccgtccgcgtcgacgacaggctcgtcaaggcccagatctgggacaccgccggccaagagaggtaccgcgccatcacgagcgcctactaccgcggcgcggtgggcgcgctggtggtgtacgacgtgacgcgccgcatcacgttcgagaacgcggagcggtggctcaaggagctccgcgaccacacggacgccaacatcgtcgtcatgctcgtgggcaacaaggccgacctgcgccacctccgcgccgtccccgcggaggacgccagggcgttcgccgaggcgcacgggaccttctccatggagacgtcggcgctggaggccaccaacgtggagggcgccttcaccgaggtgctcgcgcagatctaccgcgtcgtcagccggaacgcgctcgacatcggcgacgaccccgccgcgccgccccgggggcggaccatcgacgtcagcgccaaggatgacgccgtcacccccgtgaacagctcagggtgctgctcgtcttgatga

SEQ ID NO: 378 - DNA, 320 bp, Oryza sativa
tgaagatgagctcgtcgtcgttgagcaagaaggcgtcgtcgttcgtggtgacggcgagcatgagcgcggtggaggcgctcaaggaccaggcggggctgtgccggtgggactacgcgctccggtcgctgtaccagcgcgccgccgccgccaagcaggtcaccggccgcgccgtcccggtgtcgctgtcgtcgcagaccggcggcgcggcggcgtcctcctctcccgccgccgcgtgcggcagggccgccaggtcgaagaggtcggaggaggagaagatgcagaaggcgtatcacctcgtctgctggggacctaattaataa

SEQ ID NO: 379 - DNA, 992 bp, Oryza sativa
cgtcgatggacgcggcgtggcgcggcggcgttggctgctcgccggtctgcctcgacctctgcgtcgggctgtcgccggtgcgggagccgtcggcggcgaggcacgagctgcttgaccggccggccggctgccgcggcggtggggattccaagtcgatgaccaatgacgaggcgaagatcgtcgaggcgaaggtcactcagatgagcgaggagaatcggcggctgaccgaggtgatcgcccgcctgtacggcggccaaatcccgcggctcggcctcgacggctcggcctcgccgccgcggccggtgtcgccgttatcgggcaagaagaggagcagggagagcatggagacggcgaattcctgcgacgccaacagcaacaggcatcagggcggcgacgccgaccacgccgagagcttcgccgccgacgatggcacctgccggaggatcaaggtcagccgggtgtgcaggcggatcgacccgtcggacacctccctggtggtcaaggacgggtaccaatggcggaagtacgggcagaaggtgacgcgcgacaacccgtcgccgagggcctacttccggtgcgccttcgcgccatcgtgcccggtgaagaagaaggtgcagcggagcgcggaggacagctcgctgctggtggcgacgtacgagggcgagcacaaccacccgcacccgtctccgcgcgccggcgagctcccggcggcggcggggggggccggtggctcgctgccgtgctccatctccatcaactcctccggcccgaccatcacgctcgacctcaccaagaacgggggagccgtgcaggtggtcgaggcggcgcatccgccgccgccgccggacctcaaggaggtgtgccgggaggtcgcgtcgccggagttccggaccgcgctggtggagcagatggccagcgcgctcaccagcgaccccaagttcaccggcgcgctcgccgcggcgatcctccagaagctgcccgaattctagtag

SEQ ID NO: 380 - DNA, 1103 bp, Oryza sativa
caacaatgggagccaagaagcataccttgcaagtgcttccatggctactgctctttgcgcagcacactgcagccagtgcctgcgactgtgctaacaccacagacggggcagacagacagggtgcaatgaagctaaagctcattgccattgcatccatccttgcagctggggcggctggtgtcttggtgccagtgattggccgctccatggctgcgctgcgccctgatggtgacatcttctttgctgtcaaggcatttgcagccggcgtcatccttgccactggcatggtgcacattcttccagcggcgtttgatgcgctcacatctccatgcctcaaaaggggtggtggggataggaatcccttcccctttgcgggccttgtttcaatgtctgctgcagtgtccacaatggtggtggactcattggctgctggatactatcaccggtctcaattcaggaaggcacgcccagttgacaacatcaacgtacacaagcatgctggagacgagagggctgaacatgcacaacacataaatgcgcacacacatggaggacatacacattcacatggtgatatagtggtctgtggctcaccagaggagggttcagtagctgaatcaattcgacataaggtagtatctcaggttcttgagctgggaatcttggtgcattcagttatcattggagtatccttaggtgcatctgtgaggccatctactatcaggccactagttggtgccctcagcttccaccagttctttgaaggtgtaggtttgggtggttgcattgttcaggctaattttaaggtaagggcaaccgtcattatggcaatatttttctccctgactgcacctgtgggcatcgtgctaggaattgcaatttcatcgagctacaatgtgcatagctcaactgccttcgtcgttgaaggagtcttcaactcagcctcagcaggaattttgatctacatgtccctagttgaccttctagcaacagatttcaataacccgaagctacagattaatacaaagcttcagctcatggcataccttgcacttttcctaggtgctggactgatgtcaatgcttgccatatgggcatagtag

SEQ ID NO: 381 - DNA, 1350 bp, Oryza sativa
aaagaattcctgagacgcgacacgcgagcaatggaggctgcggtcgacggcaggtggacacgcgtccgcacgctcggccgcggcgcgtccggcgccgtggtgtccctcgccgcagacgaccgctcgggcgcgctcttcgcggtcaagtcggcggcggcggcggcggcggccgagcagctcgtgcgcgaggggcgcatcctttccgggctgcgctcgccgcacgtcctcccctgccttggcttccgcgccgaagccggcggcgagtgccagctattcctcgagttcgcgcccggcggctcgctcgccgacgtggtggcgaggagtggcgggcggctcgacgagtgcgccatccgcgcgtacgcggcggacgtggcgaggggcctggcgtacctccacgggatgtcgctcgtgcacggcgacgtcaaggggaggaacgtggtggtcggcgccgacggccgggccaagatcgcggatttcgggtgcgccaggacggtgggctccgacaggccaatcggcggcacgccggcgttcatggcgccagaggtggcgcgcggggaagagcaggagccggccgccgatgtctgggccctgggctgcaccgtcatcgagatggccaccggccgcgctccgtggagcgacatggaagacatcctctcggcggtgcgccggattggctacacggacgccgtgccggaggtgcccgagtggctgtccgcagaggcgaaggacttcttggcccgctgcttcgcgagaaacccacgcgagcggtggacatcgtcgcagctcctggagcacccgttcctggcatcggcaggctgcagcgtgaaaacaggggaggcggcgccccaatgggtgtcccccaagagcacgctggatgtggcgttctgggagtcggacacggacgacgaggaggacgacatgccagcgagccccgccgagaggatcaaagcattggcttgcccctgctcggccttgccggattgggactccgacgagggctggatccaagtgctcaacgagtccagcgaagcttgcgacacggcagtggccaaggtggaggccgaagggaaggggcgcgttctgatcgaagcgttggaaacgatcaacgaatcttccggtggcgatgcagagtgtgttgatcccgagggcactgtacgattgattactgttgcttccattgggcagcaggaagtgttctgcttgggtctcattaatgacccacttgtattttctgttaataaaagtgaattaacaaagtctttgtttccccaaattgtctcattttaattcttgcttctactcattttcttccactagtatatgcaatttgcaccatctgacaggcctttt

SEQ ID NO: 382 - DNA, 2378 bp, Oryza sativa
ttagctcgctttgcttgtagtggcgacttgtgaggcggaggaggaaggagatcgaggctagggagatggcgtcgttgaagtcgccggtggcggcggaggagcaggcggcgacggcggcggcggcggcggcgaagggggaaggggagaggtgcccggtggaggaggtggcgctggtggtgccggagaccgacgacccgacgacgccggtgatgacattccgggcgtggacgctggggctcgcgtcctgcgtcgtgctcatcttcctcaacaccttcttcacctaccgcacgcagccgctcaccatctcggggatcctggcccagatcctggtgctccccgcggggcagttcatggccgccgtgctgcccagccgcgaggtgcgcctcctcggcggccgcctcggcagcttcaacctcaacccggggcccttcaacatcaaggagcacgtcatcatcaccatcttcgccaactgcggcgtctcctatggcggcggcgacgcctactccatcggcgccatcaccgtcatgaaggcctactacaagcagtccctcagcttcctctgcgccctcctcatcgtcctcaccacacagatactgggctatggttgggccgggatgctgaggaggtacctggttgacccggctgacatgtggtggccatcgaatttagcccaggtctcactcttcagggcgttgcacgagaaggagggcggcgatggcgggaaggggtcgtcgtcgagggggcctacacggatgcgcttcttcctcatcttcttcttcgcgagcttcgcctactacgcgctgccgggctacctgctccccatcctgaccttcttctcgtgggcgtgctgggcgtggccgcacagcatcacggcgcagcaggtgggctccggctaccacggcctcggcgtcggcgccttcacactggactgggccggcatctcggcgtaccacgggagcccgctggtggcgccgtggtcgtccatcgccaacaccgccgcgggcttcgtcatgttcatctacctcatcgtgccgctctgctactggaagttcgacacgttcgacgcgaggaagttcccaatcttctccaaccagctgttcacggcgtccgggcagaagtacgacaccaccaaggtgctcacgagggagttcgacctcaacgtggcggcgtacgagagctacgggaagctgtacctgagcccgctgttcgccatctccatcgggtccgggttcctgaggttcacggcgacgatcgtgcacgtggcgctgttccacggcggggacatctggaggcagagcaggtcggcgatgagctccgcggcggcgaagatggacgtgcacgcgaagctgatgcggcggtacaagcaggtgccgcagtggtggttcctcgtgctgctcgtcggcagcgtcgccgtgtcgctggtcatgtcgttcgtgtacagggaggaggtgcagctgccgtggtgggggatgctcttcgccttcgccctcgccttcgtcgtcaccctccccatcggcgtcatccaggccaccaccaaccagcaaccggggtacgacatcatcgcgcagttcatgatcgggtacgcgctgccggggaagccgatcgcgaacctgctgttcaagatctacgggaggatcagcacggtgcacgcgctgtcgttcctcgcggacctcaagctggggcactacatgaagatcccgccgcggtgcatgtacacggcgcagctggtgggcacggtggtcgccggcgtggtgaacctggcggtggcgtggtggatgctgggcagcatcgacaacatctgcgacgtggaggcgctgcacccggacagcccgtggacgtgccccaagtaccgggtcacgttcgacgcgtcggtgatctgggggctcatcggccccgcccggctgttcggccgccacggcctgtaccgcaacctggtgtggctgttcctcgccggcgccgtgctgcccgtgccggtgtggctgctcagcagggcgttcccggagaagaagtggatcgcgctcatcaacgtccccgtcatctcctacgggttcgccgggatgccgccggcgacgccgaccaacatcgcgagctggctcgtcacgggcaccatcttcaactacttcgtgttcaagtaccgcaaggggtggtggcagaagtacaactacgtgctgtcggcggcgctcgacgccggcacggccttcatgggggtgctcatcttcttcgccctgcagaacgcccaccatgagctcaagtggtggggcacggcggtcgaccactgcccgctcgcctcctgccccaccgcgccggggatcgccgtcaagggatgcccggtgttctgagctcgccggccggagctgcacacggtggtgtatgtatag

SEQ ID NO: 383 - DNA, 1756 bp, Sorghum bicolor
tgttgcggaagataggtgtgattttccttctggcgggcggcagctccggaggtgaagatgatccgtcttcagacgtacgcggcgttcagcctgctggcgacggcgtcggcggtgtactacgccttcagcagccgggagcagttctacccggccatggtctacctctccacctccaagatctgcttcgttctgctcctcaacacgggcctcgtcgccatgtgcgtcgcctggcagctcgtcaagcgcctcttcctgggctcgctccgggaggccgaggtcgagcgcctcaacgagcaggcctggcgggaggtcgttgagatcctcttcgcagtcaccatcttccggcaggatttctcggtctctttcctcgccatggtcgccgcgctgctccttattaaggcactgcactggctggcccagaagagggtcgagtacatcgagacaacaccttcagtgcccttgctctcacacatcagaatcgtctccttcatggcgtttctcctcattgtcgactgcctcttcctgtcaaactcgctcaggtcactcatacagaagtgggaggcatcggttgccatcttcttctccttcgagtatatgatactagcaacatcgacagtatcaacatttgtgaagtatgtattctatgtcagtgacatgctaatggaaggtcaatgggagaggaaggcagtgtatacattttacttggagctgatcagtgaccttgtgcacttgtcactatacatgctcttcttcatagctatcttcctgaactatggtgtcccacttcacttgattcgtgagctatatgagaccttccgcaacttcagaattcgcattgcagattatgtacgctacagaaagatcacttccaacatgaatgaacgctttccagatgctacagcagaagaactcaatgcgagtgatgctacatgtattatttgccgtgaggagatgactacagcaaagaagctgctttgtgggcatctgttccatgtgcattgcttaaggtcttggctagagcgccaacacacttgccctacgtgcagagctccaattattcccccagacagtggacgttctgcatcagcacgacaacatggaggtcaacctggtgttcagcctggtactgacactccagcctcagaagctgcgcaaggtgacaatatgagcaggcgccaagcaaaactcgaagctgctgctgcagctgcttctttatatggaagatctcttgtttatcctccagcaaacaccctaaataggtcaggtcctcagtctacatcaagtacaccacaatctgaagctagtaactccaatcaatcacagaaagaccaagaactccagatccaaaactcaagtgatggtttagcaccttcgccttttagcgcacatggtgccattggttcaggaccaagcaccagcaatcttgaaaattcactgcagaaggcacaggaaaactttataaagagccagatagagatgttacaaatccaacttcaaatgattcggcgcggtgctgctgtgtcggtgactaacagtgggaatgacgagcacaaaaggaatgactgaagctgtaaataggcaggcggaaatgaggacagaattaaacgacaagaattggtaaatacctagggggcaactgttacatgatgcctcgttgcccagattttgtactttcatgtttctgcactcttactgataatgtttcttttctctttgtaataccgctgatagatagaggctgtcgtgttgtaacaat

SEQ ID NO: 384 - DNA, 822 bp, Sorghum bicolor
caatcgcagagaagaggcagagagagagagagggtccatccatggcttccgccgtcgcttcccaggtggccttgccgaagcccgtcttcctcatggacatcctcgcctcaccgtccgcctccgcccgccccctcttcagcaccggagacgcgccgccacgctcctcctccgacggcgtcaaggacaccgacggcgtcaaggactccacaggcgaggacgccgccgccgccgaccgccgcccggagcgcgtccccaagctcttcaccggagacgtgctggacctgttccccgaggctgcgatccgggacctgctactggcgctggcggaggatggcggcggcgcggcgtccatgaccggcttctccccgcgcgggtcgtcgtgggtctccaaggatgatgccgacgcggtgcagctgaaggtggcgatgccggggctggggaaggagcacgtgaagatgcgagtggagaaggacaccctggtgatcaagggggagggcgacaaggactccgagggcgacgacaagaaggacccggcagggtacatctgccgcatcgacctcccctcccacgctttcaaggtggaccagatcaaggcggagatgaagaacggcgtgctcatggtgaccgtgcccaagatcaaggacggggagcgcaaggacgtgttcgagatcaaggtcgagtaggtctcctggttgcagtccatatcgtagttgcagtatactagagtagtagtcgtttctgatgcagagcagcagaacgggagggctttggctttttggcgtctcgttcctgatgtgaggcagccgtgtttacctttctgtt

SEQ ID NO: 385 - DNA, 2538 bp, Sorghum bicolor
tctgttaaacacgcgcagcgaagcaacgcagcagcaacaaaagagacgagccttttcgctcgccgctgccaccaccctcgtcgtctcgcctccgcctcggcctccgcacgcgcgcgcgcgcgggatctcgcgcgggctcgctagactccccgcgggaccagcccgcgcgcgcacgcgcaccgaggagggcgcacccaccacccgcagggtttgggggcgggggcgatccggcggcgatggcgagccgggtcaaggaggacgagcggcacgagaagatcatccgcggcctgctcaagctgcccgccaacaagcgctgcatcaactgcaacaatttgggaccacaatatgtctgcacaaatttctggacctttgtttgtaccaattgcagtggagcacatcgagagttcacgcatcgagtaaaatcagtttccatggccaaatttaccgcacaagaagttactgcccttcaagaagggggaaatgagcgtgctagagaagtatttttcaaggaatgggatcctcaacgaaatggataccctgacagcagtaatgctgacaaattgagaaatttcatcaagcatgtgtatgtggaacggagatacacaggagaaagaagtactgataggccaccaagggcaaaggatgacaaggatgagtatagtgaaaataggagatctgatgggaattggggtggttcaagaagtccgccaaatggaagttactctgatcgtcggagttatagtggacggagtgatgacagaaattccagatattcctatggggaccgtagtcctggctatgaccaaaatgactataagaaaagtcctcgctactttgaggttgtcgatgatagatctggaaaaataactccagttcaaaggtttgaagaccggaggttttcggagcccagaaagccagatagtgggtctccagacttccagaaagaagctgatggttctagtcctgttgtacggccagtgagggatatattgggtgacaacgctcctcagcttcgggttggtgagccttcaaagccagctgctgaacctccaaagccaagtgtagtcagaccacttgatcctccaaagtcaagtgtagtcagaccaattgatcctccaaagccaaacggaaccagggcaattgatcctccgccactgacaaagacaatatctagtgccagcagcattggttcttcagaagggacatcggaacagacaaaggtggcaactgcagtgagtttaattgattttagtgcagatcctgaacctgcatccacagcaccaccacagccgacccctatgccacaacagcctccagttaatgcagcagcaccacagcctgttcttgaacaagggaagagtgctccttctgtcagcggtggtgactgggcatcttttgatgcttttggccaacaacaaacaccacaaacaagcaccagtgtaaatcctcttgagtctgcacttgcacagctgtcattctccgaagcaccctctgcaccgaatgcgtcagcttatcctgcttctcttgatcccactgtgaaagcaaatgatggaggacattcatctgtgctagaccattcacattccttgtttgatgcgccctttggaatctcaggcaaccaggcctcaacagtaatgtctggccaaggatcatcggttcaacaatctcctctagctgcccctacggctggatttccatctcaagctactgcaaatccgcaaggaatcagtggtattcaaggagcagcctcttctactgacagtaaattcagtggcaggaaagaacttccagcggatatcttcactgcactatatccaccatcaactccaatgatgcctggttggcagagagctccccaatttggaatgggatacgccatgcaatatccagctggagtgttccagggaatgcaagcatatcctcatggagcatttcctcagcctacatatcagcaacctatgtattcgcaacatgcatattcccacccccagcctgtgaaagcttcgaacccttttgatcttgggaatgagtcagctccaattcaagctcacatgcccccatctgggccaccaggagcatcagcaggcctagcttctcaaaccttaattggcaactctagttttggtgttcctccacagcagcctcaccagctctatcagtcagctgcacagccaagccatttcatgatgcagcaagttccgaacagcatgcccatgccggagcaacaacctaatagcatgcttgcaacgcaacaaggtttgggttccttcaacatgggttttgatcagcaagctcctcccagatacccgcagccaaacaccccaccttcctacggctccgttgggggtagtaatccgtttggctaaagcaagtgtggaaatacctgctctttcatctctagactaagggtctgcagcactcagcgggacagacatgcatcgaagcccacgagagaatgtgtttcatacaaccaggtggtgtattttgtcggccgtaatctgttgtacaacttgtttccaaaggcttaatgatcgaatg

SEQ ID NO: 386 - DNA, 1782 bp, Sorghum bicolor
aaagtcgactactctgagcgggtaccgtaggagcaagtcgccgagggtacagaaaagagagagaagatgtcgtccaagaagaattactacaaggagaagatgatgcggcggaaagaggagaaaaaggtagaaccggagacacccaggtatcgcgatcgtgctaaggagcgccgtgaagatcaaaacccagactatgaacccacagagcttggttcatttcatgctgtggcaccccctggaacagatttgaggctggcagatgcacacaagatttcaattgagaaaagcaaatatcttggaggtgatttggagcatacacatctggtcaagggcttggactatgctctacttcacaaagtgcggagtgaaattgaaaagaaacctgatgcagaggatgggaaggattctaaatcaagggcaacaaaagaggatcaggcagtctctttccgcactgcaactgcaaagtctgtctatcaatggatcataaagcctcaaagcataataaaagagaatgaattgtttcttcctggtcggatgtcattcatttacaatatggaggagggaataactaatgatattccaacaactcttcataggagcaaagctgattgccctgtaccagaggagatggtaactgtcagcgtggatggttctgtacttgacaggattgctaaaattatgacataccttcgacttggatcttcagggaaggtcttaaagaaaaagaaaaaagagagagatataaaagggaagaacaatttggcaagcggtgactatgacgaagcagtaaaaccttcacaaactaatggttctgctctgaaacatcaatcagatatgccaccaccatcagctccaccccctcggaacaataatttcaatggaaaggagaaacaatcggcccctattgctagagcagacgatgatgacatttttgtcggagatggagttgattattcagttcctaacaaggaaatgagccaaagccctggttctgaggatatggaggaatcaccacataaccatcagaagcagtcctatttcactgaacccatgtatggcccagtaccaccatctgaatctgctcaggcttggcaacagccgaatgagtatgatgctgctcaagcccagatgatagctgctggatatcaaggcgattggtcaggctatgtgtatgcagaacagccattgggttatcaagaacagtatgcgcaacaaagcactcaggaatatgatgtactggctgaccctagtatatcccaggatccaaggttcatgactcaagcagacaaggatcggggtctaggttctgttttcaaacgtgatgatcaaaggcttaatcagctgagggaaaaagatgcacgggagagagatccaaattttatttcggatagttactcagagtgttatcctggttaccaggagtataataatgagattgcagggagtgatgatgaagatgatttatccaagatggatatgggtggacgggctaagggccgtcttcacaggtgggattttgagacagaagaggagtgggcgaagtacaacgaccagaaggaagccatgccaaaggccgccttccagtttggggtgaagatgcaggacggcaggaagacaaggaaacagaacaaggaccagaagctcacaaatgacctccacaagataaacaagatcttggctcgaaagaagggtgagaaagatgggggcgatgatggcggtcattacgatgatgatttgcctagcgcaaagaaacaacgtggctgaagttagtcggaattcttt

SEQ ID NO: 387 - DNA, 296 bp, Sorghum bicolor
aaaggatcccttagcttgcttccctctcactttggtagcttgcaatttgctcgatcgcacacactgcgatggcaccagtgtcggaggcggctagctacctcgagctcgtccaaggcggcagcattgcctcctcgtcgggcgccgtttacgccgcgccatgggatgggcgctgcagcgcgcggggaaggatggcagagaccgacagcgacgacgatgacgacgactacgactgcgctcctgctgcctgatcgagaatcaatcgatcgttcgggtgaaactgatctgtgggtaccttt

SEQ ID NO: 388 - DNA, 2520 bp, Sorghum bicolor
tcgtccttgtttacatcagcagcggcggcggcggcggcggcgcagctgaactggacccaccggacgatgctttgcccgagatccggatgctcatccagacattcatcccccatcgccatgcggatgcgctggctcctcctctgggcgctcgccgctttcgcccccgcccccgcccccgccctcgccgccggcgagatggggtacacgcattgcggctgcgacggcggaggaggcgccggcgggttctggagcctggacaacatcttcaagtggcagaaggtgagcgacctgctcatcgcggcggcctacttctccatcccgctcgagatcctctacttcgtcgcggggctccgccacctgctcccgttccggtgggtgctggtccagttcggcgccttcatcgtgctctgcggcctcacccacctgctggcggccttcacctacgagccccacccgttcatggtcgtgctgctcctcaccgccgccaagttcctcaccgcgctcgtctccttcctcaccgccatcacgctgctcacgctcatcccgcagctgctgcgcgtcaaggtccgcgagagcctgctctggatcaaggcccgcgagctcgaccgcgaggtggtgctcatgaagcgccaggaggaggccagctggcacgtccgcatgctcacccaggagatccgccgctcgctcgatcgccacaccgtgctctacaccacgctcatcgagctctccagggtgctcgcgctcaacaactgcgccgtctggatgccctccgaggacaagtccggaatgtgcctcacccacgagctccgccgggacagcgacgatgatggcgaggccgtcgtcgccgcagacgacgcggacgtcctcgaggtcaaggccaccgacggggtcaagctgctgccgccggactcggtccttgggtccgccagcgggggtggcaaggaggggaccggcaccgtggccgcgattcggatgccgatgctcaaggtcgccgacttcaagggtggaacgcccgaggtgatcaagacgagctacgccgttctggttctggtgccgcccagtgacaggaactgggcgccgcacgagctggagattgtcgaggtggttgccgatcaggtggctgtcgcgctctcgcacgcctcgctgctcgaggagtcacaggcgatgcgcgacaggctggccgagcagaaccgcgagctgctgcaggcgaggcgggacgcgctcatggcgaacgaggccagggacgcattccagcgcgtcatgagccagggaatgcggaggcccatccactccatccagggactggtgtccgtggtgcaggaggagggcctgacgtctgagcagaagctcgtcgtcgatactatggcacggaccgcaaccgtcgtctcaacgctcatcaacgatgtcatggagatgtccgccgccaaccaggagcgctttccgttggagacgaggccattccacctgcactccatgatcagggatgccgcctgcgttgcacggtgtctctgtgacttcagggggtttggattcgcggtgcatgtcgagaatgtgctgccggaccttgtcattggcgacgagcggaggattttccatgtcttgttgcacatggttggcaatctgatcggtcgaatcgatgtgggaaatgtcacgttccgggttcgtgctgatgatgaggcgatggaggaccagaggtggaatccgtggaggccaagctactccggtgggcactcatcggtcaagtttgtgattggggtgaagaggcagcagaatgctgactcgccaagctcgcttgcacagttcttgcggaggccaaggaccgaggggtttgatctcaggctcagcttcagcatgtgcaggaagcttgtgcagatgatgcaagggaacatctgggcaattctcgacggccaaggactccctgagagcatgaccctggtcctgagattccagcttcaaccatcattggcgagctccagcctcggagggtcatttgatctgcaatacccatcaccaactaaccaaatagccgggctgaaggttctgctcatcgacgacgatgaaatcaacctagtcgtggctcggaagctcctggagaggctaggctgtaccgtttcctcgctcccctcaggctcaggattcatgaactccgtcggcccttcctctacctcgtcccagctcgtcatggttaacctggagatgtcaacgattaatcccctggatgctgcctcgaggatcaggcagtacaggagctcgcactggcccctggtgatggccatgacatcggagcagaacgtgtgggagaagtgcgcacagtcggggatcaacggcgtcctgaagaagccgcttgttctgcaggaagtgaaagaagagctcacacggattcttcagaacacatgatacttacaaattattggtgggttcctttgctgcctgccaagagctctgaactctgaagtagccaaacatggcgccaccctgactgacgatgaatacgaccccactgtctagcatagcagaaga

SEQ ID NO: 389 - DNA, 2212 bp, Sorghum bicolor
aaaggatcctgaagtgagttgtggcactaaagagcgaaaatcagaaaaatcttgtggatacaatctccaaggaatgataatggacccccgtcctcgtgataatctcaactttggtgctcgattgcccaccccaaatccacccacacctcacatgattagcttctccctccaacagccacagcctcagttcttcccgtcatatggattccacagccacaaccacaacaaccctgctatcagctcacatccatctccaccctcagtcatgcctggctgcaccacgccaagcccagcatcaacaaccacaaccgaggcagacaatgccgaggatctctccgaggctgttgctgatgatgcagtccttgcttacatcaaccagttccttcttgaagatgaggatgaggagtcctatcctgttaccagtgtgcctgtggaggattcagtactcctcgccgctgtcgagaaaccattcgtcgacatcctcaagtctgctaaccatatcacagcaaaggcctatgaagtaaaatcctggatcactgatgattgccattccacgggaagtggaagatttcatgatgtggtcacaagtactctggactccacccaattggcccctgaaatggttcaaggggatgtagttgatgctgttcataagggtcagaagaacccacgtgacaatgacttggaggtggagaggaggaagagcaaacagtccgcattgtgtgatgaggagactgtccgagagatgtttgacaaagtgctgttgtgtaccgataagaattgtgcgttccactcaccaatgccagccgatgcacaaaacagcgggggatatgtgaaaggatctggaaatagaagagggcgaaggaagggaagatccggtgctggtgcagagcaggagccagtcgatctcacaaccctacttattcattgtgctcaggccgcggctattgatgaccacagaaactcaagtgagcatctgaaacagattaggaagcattcttctgctactggagatgctggccagagattggcacactactttgctgacgggctcgaggctcgcctagctggcactggtagcagcatctaccgttcacttgctgcaaagagaacttctactggtgatatgctgaaagcgttcaatttatatgttaaagcatgtccatttaggataatatcacactatgttgcaaatacgaccatcttaaatgctacgaagagcgtgacaaggttgcacattatagactacgggataatgtatggtttccagtggccaatcctcatgcagcggctctcaaagagatctggtgggcccccaacccttcgaatcactggtatagactttcccctgtcaggattccgccctgcagagcgtgttgaggcgacagggcgacggttacatgagtatgcccgtatgttcaatgttccgtttgaatatcaggccattgctgccaagtgggatactatccaagttaaagatctcaatataaagagcgatgagttcattgtcgttaactgcctttaccgaatgaggaacatgatggacgagacggcaacagatgacagcccgagaacaagagttttgaacacaatcagaaagttgaatccccatttgttcgttcatgggattgtcaacggtacttacaatgcacccttctttgtgacacggtttaaagaggctatgttttttttctcttcaatctttgatatgcttgaagcaaatgcctcacggatggatgaacataggctgctgatagaaagagaattctttggacgggaagctattaatgtgattgcttgcgagggtacagagaggattgaaaggccagagacctacaaacaatggcagatgagaaacctcagggcaggcttcaggcagctacctctggacagagagataatggcgagagcaaggtacaaggttagcaagacctatccgagggatttcctcgtggacgaagataacaagtggatgctacaaggttggaagggtcgtgtcatatatgctctttcagcatggagtacctagacttgtaaatcctagttagcttagctgacatcttcccttaatatcttgatttttcactatttcattttgttgtattatgattacgttaatgaatctgtccctcgtctaggaaccaaaattttgtaagtttgaattgactgccataaagatttttgtctgtgtgcctgacatatttgcggtacc

SEQ ID NO: 390 - DNA, 2474 bp, Sorghum bicolor
agagcacaagcgagcaagtccaaaccggaagaggcgatcgctagccgcgagtgcggggcggccatcatcatggcggcgagcgcgagggggagcgtgtgggagatccagccgcgcgacgtggaggcggcggggctcgccgcagccgacgcggccgcgttcgtcgccgcgctccgctccgccgcggccgccgcgggctcgggagccacgcgggacgccgtgtgggcggcggttgcggcggcgggggtgctgcggccggagcacccgcacgcgctccaccagctcgtctactactccacctacgctgggtgggaccgcgacgcccggggcccgccgccgtactggttcccgtctccaattgactgtaagcaaacaaacctggggagattgatggaagcaaatggaccaaagctgttaggatcatcatacaaggaccctatatcaagtcttagccacttttacaggttttccgtagagaaccaagaggtctactggtcaatggtgctaaagcaactagcagtcaattttaaacaagaaccaaggtcaattctgagtacatcagatagatcaaagaaaggggggacatggcttcaaggtgcagtgctcaatatagctgaatgttgtctgctgccttgtccttccctgaagaggacagatgacagtacagctatcatttggagggatgaaggccttgatgattatccagtgaaccgtatgtcactgaaggagcttcgcggtcaagtgataactgttgcacatgccttagatgccatgtttgagaagggggaccggattgcaatagacatgcctatgacatgcaatgcagtcataatatatttggcgatcatccttggtggctttgttgttgtatctatagcggatagttttgcacctcaggagattggtagtcgtatgggtgtctcaaaagcaaaagcaatttttacccaggatttcattgttagaggagggaagaaagttccactttacagtcgtgtcgtacaagggacttcgtctaaagctgttgtgattcctgcaattggagactctattggaattacgctaaggaatggtgatatgtcatggaaagattttctttctcgtgctgctggaaggtcatcttcttattctccagtttatcaatctgtggatgcactaactaatatactattttcttcaggaacaactggggagccaaaagcaataccgtggacacaactttctcccataagatgtgcatctgatacctgggcgcatttggatgttcgtccatgtgaaataggttgctggccaactaatctgggctgggttatgggaccaataatcatatactcatgctttctaaatggggcggctttggctttatatcatggatctccacttggacgcgatttctgcaagtttgtacaggatgctggtgtgactgtattaggaagtgtgcctagcttggtgaagtcatggaaagctgggaactgtgctgaagggcttgactggaccaaaatcagagtactaggcacaacaggggaggcttctgatattgatgacaatctgtggctaacttcgcgtgcctcatacaagcccattgttgagtgctgtgggggcacagagttggcatcctcatacattcaagggagtcttttgcgaccacaggtctttggagcttttagtggtgcatcaatgtccactgggtttgtcatacttgatgaacagggaactccgtatcctgatgatgtaccttgcactggagaagtgggtctcttccctttgtattttggtgctagtgatcgacttctcaatgctaatcatgacaaggtttactttgatggaatgcccatttataaaggaaggcaactcagacgacatggagatataatccagaggacagtaggtgggtactatattgtacagggaagggcggatgacaccatgaaccttggaggaattaagaccagttcagttgagatagagcgggtatgcaacagagctgacgagtgtctgctagaaacagcagcagttagcatcaagccttctggcgggggaccagaacatctagctatcttagcagtgctaaaagatagatcggcccagtatgacgtgaatcttctcaagaggaagtttcagacagccattcagaagaaccttaaccctctcttcaaggtgagctatgtcaaagtcgttcctgagttcccaagaacagcttcgaacaagctgctgagaagggttctgagggatcaactagcgcaggaactctcaaatcggagcaagctatgacctttgggattgttcggccttctttcaaataaaggaggcatcgtttaccgcgtgtccattgttgatgtgttgtgttgtattatactattgtcaatgcatgtcaagatgatactacaaaattttcccctcttttgtaaaacttcaagccttatacgtttgttgcccttttgaaaagggaaccatattccagagaacgtttgtaaatggca

SEQ ID NO: 391 - DNA, 925 bp, Sorghum bicolor
aaaggatccgggagcgtatacgaggtagaggagagcgagggcgacgcgcggatcgcatcgcagctttgggcggggggaccttgccgcggagatgctggcggtgttcgatcggtcggtggcgccgagcccggaggggctgcggcagccgggcgccgcgggtggcgacagcgcggcgtgcctcgctgatcggttcagagaggcgcgccccgacgcggtcaccgtcaaccttggcgggtccggcgccatggcctactcctccagcaaacagagccccctcctccccaggttatttggggcggtggataacatattctgcatgttccaaggcacaattgcgaactttgcggtcctcaagcagcaatatggattaagtaaaggtactaatgaggtcaacatcatcattgaagcttacaggaccttgagggacaggggtccttatcctgcagatcaagttgtgagagacattagtggaaaatttgcatttgttctgtacgattgcacgactaagtcggtcttcatggctactgatcccgatggaaacgttccattctactggggcgctgataccgatggccgtcttgtggtctctgacgacatcgatctcgtgaagaaggcctgtggaaaatcctctgccccgtttcccaaaggcttcttcttcacgacgtccggggggctgaagagctacgagcacccgatgaacgaggttaagccggtgccgtgggtggacagcaagggcgaggtgtgcggcacgacgtacacggtcgatgcaagcgccaagaaggagaccaagaccagcattccaagggtcggcagcgccgccgattggtcttcacaatactaacaatctgtttatgttggatcggagcaatagggtacctaggactggcttccgtatgaacacaagcgtttcgatgggggatccttt

SEQ ID NO: 392 - DNA, 580 bp, Sorghum bicolor
aaaggatccgttggtggtggggatgagccgggggagcaagctccggtggctatggcgtgcgccggcgcgggcgctggggcgggcgcgggacatgtacgtgcgggggctgacggggtgcgcgcgctacgtccccgccgacgccgggttcggctaccccgtgttcgtgccggcgccgctgtcgcggagccacagcgccgactggcggggtggcgccgggtccggcgccgacgaggacctgcgggagctggtccgcgccgcgtcgcagcgccgcgtggagcagcggcgcgccgagctgcaggccgtggccaggagccagagcatggccgcctcgctgtccatggcgcggatcgacgaggacgcgccgtgcgagttcggggccgacgccggcgacggccccggcgcgctgtacccgaggagccagagctgcgttggtgacgccgcggggaggagggcacatgcccaccgccggcacgggaaggtggtggccttggtctgacggagctgctgctgcttctggtctggctgctgcccggccgccgtcagtgacacagtgtgtgcgatcgtgtcatagggtaccttt

SEQ ID NO: 393 - DNA, 2233 bp, Sorghum bicolor
gaacttcagaagacgccatttccttggtcttggatcgtccggactccggagctctcactcgtgctcggcttcttcctccctgctactgagttccgggcgctggccactaggcaacagcaactgatctctttcttgattggttcttaagctctgccacggcatggaggtggaggctctggagaagaaggggcacacagcttttgccaaggcgatgaaatctttcagttcttcagaaaggtacaagcgatccaagagctattttgaggatatgtatgctacagatgctttgcgttcttcagacaaaacaattgttctacctatgccgcaagttgtaaaagctaaggtgaaaagtgatatcagtaaggaagctcaacctgggaggggagcacaaagcaccttgagaaaggagattcttcagcttgagaagcacctaaaggatcaacaggttgtgcgtggtgcactggaaaaagctttagggcctaacgctgctcaagtcaacttgtcaccagagaatccaatgccaaaggcagctaatgaattgatacgggagattgccacattggagctagaggtgaagaatatggagcagtatctcctgacactgtaccggaaagcatttgagcagcaagcgcctgcattttctccccctgatgctgctcctgcattttctccacctgatcgacgggaagcttcgaagatgtcagtgagctcacgttccgggcagctccgggaaacgcccgtggcaatgaagtcttgcaagagcagaggtgatgcagcgctccggtcaagttacccgccggtgcataagaaattgaatgatccattggcagattgctgcacatccgctcgctctgatagagcgattgattcagatgtcctccgctgccagtctgcgttgtcataccgtggagttttttcgtctaggatattgccttcagaggatgatagtcttgcaagggctcttcgctcgtgccattcacagcctttctcattcgtagaggaaggagagactggtgcatcaggaatgataagcttagcagagtatctaggaactaatgtagctgaccacatccctgaaactcccaacaacctgtcagaggagatggtgagatgcatggcggggatatactgcagacttgcagatcctcccttggttcaccatggctcgtcgtcttcgccatcgtcgtcgttctcctcaactagtgcaatctctccacagtatgtgggggacatgtggagtccccattacaggagagaaacaactctggactcccgtttgataaacccattccatgtggagggtttgaaggagttcagtggaccttacaacacaatggttgaagttcctatgattagccatgacagtcggaggctgaaagaagctgaggacctgctccagacttacaagttgattttgtatcggttggaagccgttgatctgaggagaatgacaaatgaagaaaagatagcattctgggtcaacatacacaatgctttgctgatgcatgcttatctgaagaatggcgtcccacagaacaatctaaagaaaacatccctacttgttaaggctgcctgcaaaatagctggacgtaacatcaacgctgccgttatccagagcattgttcttggatgtaacacacattgccccggacagtggctacggacgctgctttacccaaggatcaaaagcaaagtgagcaaagcagggcatgagtggcgagcctttgccgttgcacaatcagagcctcttttacgctttgcgctttgttccggcagccattctgatcctgcggtgagggtgtacactccgaagcggctgttccaccagctggaggcggccaaggaggagttcatccgggcgacggccggcgtgtggaaggagcagaagctgctgctccccaagctcgtggaggcatacgccaaggacgtgaagctctcgccgcagggcctcgtggacatggtccagcgctacctcccggagagcatgaggatggccgtgcagcggtgccagcagggcggcaggtcgtcgggcaaggtcgtggagtgggtgccctacaacccggccttccgctacctgctcgctagggacctcgcgttccctcacctcagctgaccctgactgtaggtcgcgctaagcatccctgggctgctgggcatggagtagtagctagtaggtgttagtagtatatgcgtgtcatagggctagaagtagagaagggatcatgtgcagttt

SEQ ID NO: 394 - DNA, 1695 bp, Sorghum bicolor
ctttcacaaagctgtctccgtccacgagtgctctagctgacacctatcgccggcgtcaatggcgagctccggcgatgaagggcgcgtggtggtggacctccgctccgcggcggagtcggcggctgccgacgaggaggcgcacgccacgcctctccacgagatcgagtccctatgcatgcgctgcggcgagaacggcatcacgaggcttctgctgacgctgatcccgcacttccgagaggtggttctgatggccttcgaatgcccacattgtggtgagaggaacaatgagattcagtttgctggacagctccaacctaagggatgttgctatagcttgaaggttccgttggggcagagtgacatactgaatcgtcaggttgtgaagtctgattcagcgactatcaagattccagagctggactttgagattcctcccgaagctcaacgtggaacactttctactgtggaagggattattatgcgggctgtggatgagctgcaggcacttcaagatgaacgaaagaaagtggatcctcagaaggctgaagctatcgatcaatttttactgaagttgagatctcttgggtcaggagaggctgcattcacctttattcttgatgaccctgcaggaaatagctttatcgagaacccgcatgctccatcatcagatcctttactatctgtgagattctacgaaaggactcgtgaacaacaagcagcacttggttttctggctgaaccaccaacagaacaacctggagaggctgttttgcctgcttcagctgtggaatccaattctgatgggttgcaaagcgtgccccatggctcagttggagctgttgcaggtcgtcgcgctatagctcagggaaaccctgacgaagttgctgcagcattgtgtagatactcagcaccagaagaggttgatactttaccatcaacatgtggggcctgtggaacagaatgtgtcacgcgattctttgctacaaaaatcccatatttccgggaggttattgttatggcaacaacatgtgacatgtgtggttatcgcaattcagagctgaagcctgggggtgaaatcccagctaagggaaagaaaattacactgcgtgttcaaaacgcacgagaccttactcgcgatgtcataaagtcagattcagctagcgtgaaagtacctgaacttgagttggagctttcaagtggaacgttgggtggtatggtcacaactgttgaaggtttaattgtgaaaatatgtgaggctctggagagaatacatggattccaattgggcgatagcacactggaatggaaaaagaagaaatgggaggattttaaggagagattatccaagcttctgagtttacaagagccctggactctaataattgatgatggattggcggcttcgtttgtagccccggctactgattctttagaagatgacagccagctaaccatggaggagtatcagaggagttgggagcagaatgaggaacttggcctgaatgacatggatacgtcctctgcagacgcggcttacaacacgaccagcacatgattttttttttaagttttgttgtgctgaatgtatttgttatgctagcttgtatcattatctatttactttggtaaactcccagtgtgtatactaatatcaaccacttatatttcttctgacgataaacatcgagcggcaat

SEQ ID NO: 395 - DNA, 819 bp, Sorghum bicolor
agcgaggaatctagtccagtcccggcggcaatggagtgcgttttgggcgtggttggccgcgacttcgcggtggtggcggccgacacctccgccgtgcagagcatcctcgtccacaagaccgacgaggacaaggtgatggtcctcgactcgcacaagctgatgggcgcttcaggggagcctggtgaccgggtgcaatttacggagttcatacagaagaacctccacctgtaccagttccgcaacaccatcccgctctcaaccgccgccgccgccaacttcactcgcggcgagctcgccacagcccttcgcaagaatccatatatggtcaatattattcttggtggttatgataaggatgttggtgcttccctgtactacattgactacattgcaaccttgcacaagattgacaagggcgcttttgggtacggatcatatttctgcttgtctctgatggacaagttgtaccgcccggacatgactgttgaggaagcagtagatcttgttgacaagtgcattaaggagattcggctgcgactggttgtcgcgccccagaacttcgtgatcaaaattgtcgacaaggacggggcgagggagtacgcaaggcgtgaactcgtcggcgacaatgcacctgttgatgctgcaatcacagttgctgcctgaggcatgaacttgttggaagttagactgtgttaattgtgttttctcagcgaggctacttatgtaatcacaggatactggtgggggtcccacaactgttttatcaatttgagcccagacgtgtgtatttctgtttctgcactattcatgtctttgctg

SEQ ID NO: 396 - DNA, 2011 bp, Sorghum bicolor
aaactcgagggtggacatggtgttcgtcggcggcgaccgtgccatggggggcgcccctggcgccgacgccgcgagcacgatgcggttcgcgctgcacgtcatgcgcggtcggtggttcatgttcttcgcgtccatcctgatcatggcggcggccggcggcacgtacatcttcggcatctactccaaggcgatcaagacgtcgctcgggtacgaccagcagacgctcaacacgctgagcttcttcaaggacgtgggcgccaacgtgggcatcctcccggggctcatcaacgaggtcaccccgccgtgggtggtgctcctctgcggcgccggcatgaacctggtgggctacctcatgatctacctggccatcaccggccgcacggcgcagccgcccgtgtggctcatgtgcgtctacatcgccgtcggcgccaactcgcagtcgttcgccaacaccggctcgctcgtcaccgccgtcaagaacttccccgaggaccgcggcgtggtgctcggcctgctcaagggcttcgtcggcctcagcggcgccatcttcacccagctgtaccgcgccatctacggcaccgacaacgacggcgccgacctcgtgctgctcatggcgtggctccccgccgccatctcgctcgtcttcatccccaccatccgcatcatgccgcggcagcgggacgccgccgccgccgccgcgcgcggggagcgccgccagcgcgagcgcaaggccttcttcctcttcctctacgcctccatcgtgctggcagcctacctgctcgtcatgaacgtcgtcgagctggaggtgatccacttccccaagacggcctactacgtcacggccgtcgtgctcctcctgctcatcttcttcccaatcgtcatcgtcgtcaagcaagagctcaagacctaccttgcggcggcgccggcgacggcgacaacctcgtccgccaccatcgtgacgatcaccgtcgacgacgagaagacgcgggcgtcgaacaataacgtggcaccggagtcgtcgtcgcccgatcaccgtcgtggccatcatcaggcggccgtcgccgccgaggccgaggacatcagccgccgctcgccgtcgtgcttccaggacgtgttccggccgccggcgcggggccaggactacaccatcctgcaggcactgttcagcgtggacatgctggtgcttttcgtggccaccatctgcggcgtcggcggcacgctgacggcggtggacaacctggggcagatcgggcagtcgctgggctacccgcagcggaccatcagcacgttcgtgtccctggtgagcatctggaactacgcggggcgcgtcgtgtccgggttcgcctccgagtacgtgctggccaggtacaaggtgccccggccgctggcgctcacggtggtgctcctcctggcgtgcgtggggcacgcgctcatcgccttcggcgtcggcaacgggctgtacgcggcgtccgtgatcctgggcttctgcttcggcgcgcagtggccgctgctgttcgccatcatctccgaggtgttcgggctcaagtactactccacgctctacaacttcggctccgtggccagcccagtgggatcctacatcctcaacgtccgcgtcgccggacgaatgtacgaccaggaggcgctccggcaggcgggcgggcggcggggcagcaaggacctcacctgcatcggcgtgcgctgcttcagggagtcgttcctcatcatcaccggcgtcacgctgctgggcgcgctcgtgtcgctggtgctggcctggaggaccaggaacttctaccgcggagacctgtacggccagttcagggaggtcggcatggccgccggagcagcagcagcagaggacggaaaggtgcacgaggccgaggcgagtagcagcagtggtggtggtgccagtgactctgacaccaaggacactgaggccgttaatggcagcaaggtctgaattgttgacgtgtagtcgtgtactgtagtgtctctgtcaggggaattcttt

SEQ ID NO: 397 - DNA, 3929 bp, Sorghum bicolor
aattgttcaggggacggagcaggccgctgctgtggtggtgggtgtcgcctgccgccgccgccgcgaggatggacgccggggagatggaggacgtgcgggccgccgcggccgccgaggaggtcatcagcagcaggggcggctccgtgctcgggaagaagaccatcctcaagagcgaccacttcccgggctgccagaacaagcgcctcaccccgcaaatcgacggcgcgccaaattaccgccaggctgggtcgctgcgtgttcatggtgttgcaatgcccacaatggaagggattgctaatgtgctaaatcatatcggagcacacaagaaaggaaagcaaacccggattctatggcatagtcttcgggaggaaccagttatctacatcaatggtcgaccctttgttttgcgagatgttgaaaggcccttctcaaatcttgaatacacgggaattaaccgggagagagtggaacaaatggagtttcgccttaaggaagatattcttcaggaagcttcaaggtatgggaataagatactagtcactgatgagctgccaagtggtcagatggtggatcagtgggaatcagttgagtatgatacagttaagactccacttgaggtctatgaggagttgcaacaacaagggtacctagttgactacgaacgtgttccaattactgatgaaaaagcaccaaaggaaggagattttgacaacctggtacgtcgaatctctcaagttgatatagaaacagaaattgtgtttaactgccaaatggggagggggcggacaactactggtatggttatagctacattggtttacctaaatcgaataggagcttcaggtatcccaaggacaggctccatagggaaggtcttctatgctggaaatgatgtagatgattatatgcctagctcagaagaagcaatactcagaggagaatatgctgtcattaggagcttagtccgagttcttgaaggtggtgttgaaggcaaaaggcaagttgacaaagttattgacaaatgcgactccatgcagaacctaagagaagctattgctacttaccgcaataacattcttcggcaacctgatgagatgaaacgggaggcatcactttccttctttgtggagtacttggaacgttattacttccttatatgctttgctgtctatgtgcattcggtgagctctgctcaccaaacaacattatcagtagaagttagtttttctgattggatgagagcgaggcctgaactgtacagcattcttcgaaggctattgagaagagatccaatgggtgctcttggttattcaagttcaaaaccccctcttaccaaaattgttgagtctgctaatgggcgtccacaagatatggatgttgttgctgccatgaggaatggcgaagttcttgggcgtttaactgttttaaaaagcgatcactgcccaggcaaccacagccttaatttacctgagagggtggagggtgcaccaaattttcgggaaatacctgggtttccagtctacggtgttgcaaatcctactgttgatggtattcgagctgttatccagtgcatcagtacaagcaagggagggcgacctgtactgtggcataatatgagagaagaaccagttatctacataaatggaaaaccatttgtgctacgtgaagtggaaagaccttgcaagaatatgctcgagtacacggggattgatcgtgctagggtggaacgcatggaggctcggctgaaggaggacattttacgcgaggcagaacgatatggtggagcaataatggttattcatgaaactgacgatggagagatcttcgacacatgggaaaatgtagataatgaagctgttctgactccgttggaggtatacaaaaatttggagagtgaaggccttccaatcaaatatgcacgagtgcccattactgatggtaaagctcccaaaagttcagactttgacacaatagccttcaatgttacttctgctagcaagagcactgcttttgtattcaattgccagatgggcaggggcagaacaactacaggaactgtgattgcttgcttgctgaaactccgaatcgatcatggcaggcctattagaatcccagtttgtcaatatggccatgaagatactatttactcaactggaggagatacagcagatcacaacggtcacttgaattcagaatcatggaaacctcgcactttgacaaagctaaattctggatttggaattaatgacatcctattgctgcgaaaaattacaagattatttgataacggaattgagtgtaggcaaactttggatactgttattgacagatgttcagctttgcagaatattcgacaagctgttttgaagtacacaagagtaattaatcaacaacatgttgagcctagagttaggagggttgcattaaatcgtggcgctgaatatttggagagatacctcaaattaattgcattttcagcataccttggtagtgaagcatttgatggtttctgtggacaaggagaaacaaagatctcatttaaaggatggctgcaacagcggccggagatccaaaccatgaaatggagcataagactgcgacctggccgttttttcactgtgccgcacgagcagaaaacaacatatccacctccacaaggtgatgtaacaatggaaaccattgtcaaagctcgtagtggttctgttctgggaaagggatcaatactcaaaatgtacttctttcctggacagaagaggtcaagcagtgtgaatttccggggtgcaccacatgtttttaaggtggatggataccctgtgtatagcatggcaacacccactattgatggagcaagtgatgttctgtcatatctgggctctaaagacacaaccggaagaagcattgcacagaaggtggttgtcacagatcttagagaggaagtggttgtttacatcaagggatcgccatttgttttgagagaactagatcaacctgttgatactttgaagcatgttggcattagtggtccaatggtagagaacatagagacaaggctaaaggaggatatactctctgaaattaaacaactaggtggccggttactgcttcataaagaagaatttaatgcagccacaaatcaatgtagtgtggtaggttactgggaacacatagatctggaggacgtgatgacaccagctgaagtctacagcacattgagagacaagggctattgtatcgactacaaaagaatacctttaaccagggaaagagaagcattggctgctgatgtagatgctatacaatcattaatcgaagaatctgctaggtactatctctttatttcacacaccggatatggtggtgttgcttatgcaatggccattacctgcctgggactgggtgcagatgcaaagtttgtaatggaagaaacagcagaaacacactttgtatcaacatctcttgcaaaaaatgtgtccatcaaaactaaaacagacatagcacttaggcagggtgattaccgtgacatattaaaccttactagagtgttggtacatgggcccaagagcaaagaagaggttgacaccgttattgacaggtgttctggtgctggtcatttgcgggaagatattatgcattacaggaaagtactgcaagattgttcacatgacgacgacgacgacgatgatgaggaacactcttatctcactgatatgggtacaaaagctttgaggcgttacttctttctgatcacctttaggtcctacctatacagcaaaagatcatgtgaagcaacatttacatcatggatgaaggcaaggcctgagcttggccacctttgtgacaatctaaagctggacaaataggttatcttcatgtggtgtgattatgtagttttgtctcttccttggacaaattcacccagagcttcatag

SEQ ID NO: 398 - DNA, 2728 bp, Sorghum bicolor
atgccacgctacgaggttcagtcatgagtgggcttctcatgagcttccctaagtgatgcttcatatgttttctaacaagtaacatctccccgatgttatccatgcactggatatatccttagaagtcagagatgcagaagtctgatcatcatgagcagaagctaacttcgccaagagggttaatccataagatacttcgtcgtacaaatagcaggcgttctcccactgcagctgatcaacaaccttctcctgtatctccagaaacaagcaactcatcaatattctcaaagcaaaaggatgctgatgatgccatcaaagattcagaaaagccgagcacacatactatcagaattgaagatgagaaatctgatttgctagggtatgaagtttattctgggaagcttacattagataacaaagcaaaaaattcatccagtgaacagtctggatctgggtctagtagcaattgctttgatgctaggctcagcactgaagcccttatatggggttctaacatccttaagcttgaggatattgtatctgtatcatataattctggtctccggtatttcaccgtgcatgcgtgtcctcttgaaaaaagatccagtggactctcctgctttatgaatcctagaagaacccaaaaggacttgaagttcgtatccacttctccgcacgaggcctttcggtgggttaatagttttgcggaccagcaatgctacataaacctgttgcctcaccccatggcatctagcaagaagcattcttctgaactcattcagtttgataccatgtttgatccttatcttaaaaaatgtcggtctccaccaaagatacttgtcatcttgaatcctcgatctggacatggtagatctagcaaagtttttcatggaaaagtggaacccatatttaagcttgcaggtttcaagatggaagtggtaaaaactacacatgctggtcatgcaaaatctcttgtatcaactattgattttagtacctgtcctgatggtattgtatgtgtgggtggtgatggaattgtaaacgaggttctcaatggtcttctatgcagagatgatcaaaatatggccgcctctgttccaataggtataatacctgcggggtctgataactcacttatttggacagtcttgggtgtcaaggatccaatttctgcagcattgtcaattgtcaggggaggtcttacaccaattgatgttttttctgttgaatggattcaaagtgggactatgcattatggcacaactgtatcatattttggtttcgttagtgatgttcttgagctctcagagaaatttcagaagcattttggtcctttacgatactttgtagctggttttctcaaattcctgtgtttgccaaagtacagttttgaattggaatatcttccagtgtcagatgtcaatgacgctgagcatacaattttggtaggacaagaaaaggtcgatgcatctgatctatatgatgatgttgttcggagatcaagagcagaatgtttaccacgcgcctcaagtttatctagcattgattcaataatgtctacaggcatgtctggggcagagctggaggtttgtagtcctcgtgcaaataatgaaccttctgaggttgttcgtgcacttgacccgaaatcaaagcgcttatcattagggagagcgagtacatttaaagaaccagaagaagtgcttcatccccactcccatggtacatctactcccaactggcgtagatctaagtcaaaatcaaggactgaaaaggcaaggccaggcttgtctgctacaaatgatgcaaaatcctctaaggttaacacagacaaagaggacacgtcgtccacaatttctgatcctggacctgtggctgtatgggattcaggaccaaagtgggacgatgaacctaaatgggacaatcaacctaactgggaacctgagacttcaattgagctccatagtcctcgtgaggacattgagcttggtctgactaaggagctggtacctagcttagatgaaagatggacagttaggaaagggcgctatcttggtgtactggtgtgcaaccattcatgcaagactgtgcagagtctgagctctcaggttgttgctcccaaggctgaatatgatgacaattgtttggacctgctgttagttggtggaagtggaagactgagattactgagatttttggtgcttttgcagtttggaaagcacatatctcttccaaatttagaatatgtaaaggtgaagtctgtgaggctcaaggcaggcccaaatacacatgatggatgtggtattgatggcgaactactccatgtcaaggggcaagttcgctgtagtttgttgcctcaacaatgccaattgatgggcaggccagtgaaaaaccttgtacaatagctgtaaatacactactctgcggactgtctgcagctctgaggtcagcccataatcttgcacctgtacaagcggcgaaccatggaattttgtccgcatccacatataagtaaatatattcagaagtcagaacagcttagctgacactcaaactccagagatgtacatttgtggttaatgagcagaaggtgctgggtgggtgctatttatccagatgtaaagccaaagcctatcacagactgcagcttgttgcgcacctcttgcttttgcctttttctcgtctgatagtatacgtctactatacaaccatccagagtgtacttgctcca

SEQ ID NO: 399 - DNA, 2013 bp, Sorghum bicolor
gagactacgctaggtcgagcaccacctggggctcagcgttctcgcaaccagttccggcgcagcgtccgccctctgcagccactcgccacctttggccggcgacgagcaccaccaggacagcaggttgcttcagagactaagctgatgaagcatcctaattgggtccacgttggcaaagaatcggtaactgacttaagagagcaaattctccgactcattgagcatgattctcacgatcaagaggaaaaatcacgggcagagctactggagaagctcaagagctgtaaaagagatacgctaattgaactgtgtcattcatttgatgtcattggctcaagcgctaataggaaggaggatctggtatgttttctgatggaatttattaaggatcagtgttctggtgatggcataaactctgataagaaattcaagaaaagaaggcgtgtaaaagaagacgaaaatttgtctactggtaaaccttcgaagaaaaagaaacgagaaggtgaagaggaagcagatgagaggaagggtgtggaggatataggaaaacattctgactgtgatttgatggacaacaaatatacatgtgctgatagtaagaagggattcccaaatgaacagaccaactttgatccttctgagaggataaatgactctatgtcacagaaagatggagcatcactcagcgaagcgccaattcttacagatgaacagttaataataaccacaccacctacaaagtttgttacagctgctacgggtgacagtattgacgtgaaggctttaaaagggaaaatgtcttctattaccaagaaaaaagcaactcctaaggaagattgcaaagtcaaattctgtggtaaacaggagtctaaaggagacgcaaaacctcgaaaacaggcaatcaaaccaagtaaggatgagctgagggaagctgtctttcttatcttggataccgcggactttgccacgatgacctttggagatgttgtaaaagaagtcgacaaatactttggcaaggatctgtttgagagaaagccactaataaggtgtcttatagaagaggagctctttaagctagcagacgaggctgagaagaaggaattggaagagttggaagcagcagaggcgaaggctagagctgagcaagctgccaaggagatggcacaagttcaaacagttgaatcgggtatcaacaagcaacatgtacttcaagctggtcgagatagcaacactaaagacagtctaaagaatgcaaatgacagtactaacaaaataagtatcgatggtggggcatctgtggagtctgctttcaagagaaacagctgttatgctgccgaaggttcaggcggccacaaagctgacactgatgcaaagaataaagtcataactaaggatggcaatggtgaaaaggttgccctcgcacccattgcaaacagtgattgtaccatacaactacaaggttcaagcaatgtcgtagctgagctgatgaataacaacaatgttgaaatcctagaagggtcaaaagatggcaaagtgaaaggcgctagcagtggagaaaacaatgacactgaagatggtagcaatgaaaaaaacaggagtgagaatgtcggtagcaatgcagaagctgccaatggttgtgaagctgaagagtctaacaatcatggaaataatgaacgtgtagaacacacagaaggtgacaaagctcaggaagctaaccataatgagaacagtgcaaatgtagaaatccatgctgatggagacggcgaagcaaaagaaggcgatatagatgcagaacagagtcaagcagacggtggcagcaataatacggctgaagatgctgagcacaatgagaacaccaaagttgatgatgccaattcaagcaagaatggtactgccgagaatggaaagactgatgttgatgtgaaaggcaacagcgatggcacagctgaaggaagcccgctagcgtgatgagatgggcgtagattgtaagagagttcgaataagatcccgctt

SEQ ID NO: 400 - DNA, 995 bp, Sorghum bicolor
ttgtgggtagaggactagggactgtgcaccagatcggtggtctggccgtggcagttgggcgattacgacggagagggatgggcctcctcgacaagctgtgggacgacaccgtcgcgggcccgcgcccggacaccggcctcggccgcctccgcaagcagcccgcgcgccccgccgccgtcaagatcaatgatccagccggggacgcttcggcgttcgtgccgccctcgccggcttcgggcagcagcgaggagacgccggtgaaggtgacgcgcagcatcatgatcaagcgccccgcggggtacccgtcgtcgccgaggagcgcggcaagcacgccgccggcctcgccactagggactaccccgcccatctcgccgtttgccgccgccggtggtcgcttcagaaggaaatcatcatccgatgcatatgagagggcaaccccaccagggactaccagccaacctcctcccttcgaagtgtgaactgactgcaccctcgcacttgttttgctccttgatgacaatcatctacttcacctaaggtagacagggaggagagaagatatcaagacgggaaaagggatgagttgcgggtttacctctactgtgatatattgtagatgccgctatgtgtattgttttctatctgctatgtggcatatgttgtataataataatgttgaaagctcatggtgccgtgctgtgtcaataaggtgctatgtgcgtagagtggctcatggtcagggctgtgtgtgggctttgccgcagctttctgtgctgctcgctgtgtcgtgtgtgtttcctctgctgctatgtcataacggatggtgtgtggaggatggggtcatgcatgtaatgttagctgggtttgaggtggactacatgtagttttgttcaatgtctggtatgtagtagctgaagatgtttgcttgaactctctgaactgtgcgggataatgctaagatgcgggttgtcttgtcgattgtgaattgtacgcac

SEQ ID NO: 401 - DNA, 837 bp, Sorghum bicolor
ctcttcttcaaccttccgctgctggttccagaggaaggagtgcgagcagacggcagccggatggcggcagcggcgcggccatcgaatgccactctcctcgcgcgcctccgggacggcacggccatgttcgagctcctcgacgactcttcgcttgcgcatgcgcccccgtcctggccccgacttcactgcttcgccagggttgcctcctcgctgaggggtgggtggtcggcggcgctgaccaaggtggagcattacggggttcagagggtcaccggcgatggccgttgcatgtttcgagcgttggctaaaggaatggcgaaaaataaggggattcctttggccccaagggaggaggtacaggatgcagatgatttacggatggcagtgaaagaaattatatgcgacagcgagaccgagcggcaggagtatgaagaagcagttatagcaattactgtggagcaatcattgaaacgctactgccaaaggataaggcggcctgatttctggggtggagagtcagaattcctggttttgtctagactgtgtcggcagccaataattatttatattccagagcgtgagtaccatggtcggggtaatggcttcattcctatagctgaatatggtttggaattcaccaaaaatacaaagcagtggaagaaaaagacaccagtaagattattatacagcgggaggaaccattatgatttgctagtgtgacataactgcagaactatctactttttattgtccgtcatcataccatggttgtattatcattctttttatacctgtgtttgtgccctgcttttagctaccagtggaattggttcatag

SEQ ID NO: 402 - DNA, 1662 bp, Sorghum bicolor
ggctgagagcaaagattgtagcagaagctgccgagcatggccgaggcggagaagcgccgtgccgggtagggctatctgatctcgtaggccttgcacgcggaccggcctgagcgcttcccgttcgttccgccccggctagccgaccgaccgagtggttttggtttcttgggttgggactccgacatcgcaatggcgtcgtgggacaacctcggggagctctccaacatcgcgcagctcacgggtctggacgccgtgaagctcatctccctcatcgtcagggcggcgtccacggcgcgcctgcacaagcgcaactgccgccgcttcgcgcagcacctcaagctcatcggcggcctgctggagcagctccgggtgtcggagctcaggaagtacccggagacgcgggagccgctggagcagctcgaggacgcgctccgccggggatacctcctcgtcaactcctgccaggaccgatcctacctctacctcctcgccatgggctggaacatcgtctaccagttccgcaaggcgcagagcgagatcgacaattacctacgcctcgtcccgctcatcacgctcgtcgacaatgcccgcattcgggatcggcttgagtatattgagagggaccaatgtgaatattcttttgacgaggaagacaagaaagtgcaagatgctctgttaaatcctgacccttgcacgaatcctacaatagtgctcaagaagactctgtcatgttcctatccaaacttgcctttcaatgaggccctccgaaaggaaagtgagaagcttcaggttgagcttcaaagatcacaaagcaacatggatctgggttcgtgtgaggttattcagcacctgattggagtaaccaaaactgtggaatctacaattccagaggaagaaacaaatgctaaagcttcagaaaagaagggttcaaactacagtgaatccaaaggagataatgcaaaatcgtttgatgatgacgacgactatcctaagaagcaaaaggatacctgcagcacgcaacgattttcttcacaagttccatatggccatgatcttgtctcaagtagaggatcgtacagcgatgagtggcatgcagatttacttggctgctgttcagaaccagctttgtgtttcaagaccttgttcttcccctgtggaaccttctcgagaattgcttcagtcgccaaggacaggccaatgtcttctggagaagcttgcaatgatattatggcatactccctaatattgtcctgctgctgttatacatgctgtgtaaggagaaagcttcgccaaaagttggacattgcgggaggctgctgtgacgactttctttcacatctgctgtgttgttgctgtgcacttgttcaagaatggcgggaagttgagattcgtggggcatataccgaaaagacgaaggttaccccaccgccatgtcaatatatggagcattgaacagctatatgcccgtatgggtagacctgaacttctgtaaagatattaacagaatatctgatgtcgtactgccagagtagtcatactacactatttctgtgtagtatttatgcttactgtctattgttcgtcctggtacttccatgtatatgttgggacatagcagcatagtatgtactttgtaaacacatcagttacaggccggtagag

SEQ ID NO: 403 - DNA, 2879 bp, Sorghum bicolor
cgattctcatagcagctgtttccgggtggtggattttgaaggaataaagaatgatcaacctctttgaattgagcgttggagccagcgccaaggtctcctcaagagatggctctccagtgagaggaactcaatctgaacggaaggaatacgttggatcaaaggcattgactggcagcacaaggaggagctcgtccgatagatcgggtggtacgcccatgaagatgctgatagctcaggaaatggcgaaggagggggacgcaaatcagaagaccactaatgttgtagcaaggctgatggggcttgacgataacgtggatcttcctaagcatgtagtgccttcaaacaggaggagtttcccggatggccatttatctgctacaatggcaagagttaacaaccaaatttcatttgagaagcacacaagttccgccgaagatgtggagtacaaggatgtctacgaagttgggtaccaaccaccaagaggtgatgaatatccaagaaggaggccgaatgaagatcatgacaagagaaggatggatcttgtccgccagaagtttgttgaagcaaagaggcttgcatcacatgataatatcctccagtcgaaggaattccacgatgctcttgaggttctgaattcaaacaaagacttgtttctcaaatttcttgaagaacctaactctctctttacaaagcaatctggaggacacaattctgcaccaacgtcacctcagagaaagcgcattactgtgttgaagccctcaaaatcagtggagttgaagggtgacaaagcaattaaaaggatgaaaaaccatgcagtcgatggaaacagaatagaaaggagcaacgtacacaagtctgatgctgctcatgtgaaagaagataggcttcccaaacacaccaggatagtggtcttgaaacctacctcagtaattacttccacggagcaatctgagcaaaattatcatgctgatctggatgattctgaagcacctggtctatcaaggcatttgagtgatgagatagattggtcagtgcatggaatttgtcgacaccacacagaatctttgcagggttgcatacagtcaaatttgttcagcgcagatagaccataccatcggtatgctgaagaagagagtgactcggatattggaaccccaacatcacatcattcttgggagtacatctaccagtttagcaatccttactttggctctttgagccatgcttcttgctcccctgagtcacatgtaactagggaggctaagaaacatgcttctgacagatgggcaattgttccatccagtgagatatcccagcaaaaggtaccagtgcgaagaagtttgagcacacttggtgaaatgcttgccatgcctgatatgaagaaagaagaggttgctgatcaagcatctcctgacgctaatacccaccagttgtgtgaaccaacaggcggtgtatcatctaattctgctgttgatgaaggtgagggagaacgctccctcaggaaaatctcgaggtcaagatctgttccggtctcttcaacagcttttgatagcctgcggttagatggtggacgtttggatgctcaacataaagaacctacagtgccaaaggaggtcaaacctaagaacgggaaatcatctttgaagggaaaaatcacgagtttcttctcaaaacgaaagaaagcagaaaaagagaaggctaacccatctcccttgggaaccctgaacagtcgagcttcgtcagcaagtactgtagcagttggtaaatcagatgttccacaacatgtttgtactagtttacaagatgatgttgcttctgaaaatttagaagaacagtttaatcatggaccaattggagttccggttgatgaacccgaagcaccctctgtgtctaagtctccagcttcccatgagaaggcactatcgtttgagattcgaacttcccacttcgatcagcccagccctacatcagttcttgatttacagtttgaggacatcagtgagaaatcccccatttcatcagaaagtgcaattactgctaagcaagaacctctatctaggtctcttccaattggatcaattgcaaggaccttatcgtgggatgatgcttcccaagaggctccattgtgttctaccaaaggagataaccttgagcaagagcagtatgagttcgttgagaagactctaacatctgcaggcttctgtaatgagaaggtccaggacatctttgtccgttggcattcacttgactgccctttgaacccagccgtgcttgaccagctgctggaacgcaaagtggaggatgccaagtgcagagagagacggtcaaaccaaaggcttctcattgattctgtaaatgctgccctactagacattggccaaagtaaactttggggtgcatacccttgcactgcacgccattctaatgcaccgggagttgctacatgtgatgtgctagtaaccgacgaagcatggaggttagtaaagagttggctcttcgatgatgagaatgatattgctggtttgggagactatccaggccttgcagcagattgggttgtcggtaaggagattaatggcaaagggtggcctgaaatgctgcgcttggaggtggatgaaatcagcaaggagatatgcgaggaagtcctgggcgagttggtcggggaggcattttcacagcttgcggatcattgaagctgctttattttccctgcttgtggcgtccacctgttgcttttatttccaatccggtggagtccggccatggggctgatcttcaccctccagagctgttcttgtgtgtatattaccctcataactgttctgcacgctgctcaaaatgttccccactggctctatctgttcatctcttccgcatag

SEQ ID NO: 404 - DNA, 1912 bp, Sorghum bicolor
ctagtcagagcaggagagcaccaccagctgacaaccaccgccgcgtctccgcagcgcgcacgcacacaggccggagaggcggcgcacccggcgaggcaagccaagcgatccttcccactctcaggctccgacccaggagatcccggcgatcgcgatggcggaccggccggaggtggcggtggactcgcgcagcggctactgcgccgcgacgcgcaccttccgcagcaagcgcgcggacgtcccgctccccgccgacgcggacctggacgtggtccggttcctcgcgtcccgccgccacgcgggcgtcgtcgcgctcatcgacgccgccacgggccgccgggtcacgttccgggacctctggcgcgccgtggagggggcggccaccgcgctcgccgcgccgccgctgtcgctccgcaagggccaggtcgcgctcatcctctccccgaactccatccacttccccgtcgccgcgctcgccgccatgtcccttggcgccgtcctcaccaccgccaacccgctcaacacgcccgccgagatcgctaagcaggtcgccgacgcgcgccccgtcgtcgccttcaccacccgcgacctactccccaagctccctctcggcgccggcctccgcgtcgtgctcctcgagcccgaccgcctcgcctccgaccctagctccgtcgtcgccactatcggggagatctccgccacgccgcccgaccctgcgcgccgcggggaccgccgcgtcacgcaggacgatccggccacgctgctctactcctcgggcaccacgggccccagcaagggcgtcgtcgccacgcaccggagcctcatctccatggtgcagatcatcatgacgcgcttccgcctcgagggctctgacaagaccgagaccttcctctgcacggtgcccatgttccacgtctacggccttgtcgccttcgccacggggctgctcggctgcggcgccaccatcgtcgtgctctccaagtacgagctccccgagatgctgcgctccatcaatgaatacggggtcacctacctcccgctcgtgccgcccatcctcgtcgccatgctggcgcaccccaagccgctgccgctcgggaacctgcgcaaggtgctctccggcggagcgccgctgagcaaggagctcatcgaggggttcaaggagaagtacccgcaggtggagatcctgcaggggtacgggcttacggagagcacggctatcggcgcgtccacggactctgccgaggagagccgtcggtacggcacggctgggctgctgtcacccaacaccgaggctaagatcgtcgacccggagaccggcgaggcactgccggtgaaccgcaccggcgagctctggatccgggggccatacgtcatgaaagggtatttcaagaacacggaggcaacacagtcaacattgacacctgatggatggctcaagactggggatctctgctacatagacgaagatgggtatctctttgtggtggatcgtctgaaggagttgatcaaatacaaagggtatcaggtgcctccggcagagttggaagctcttttgctaacacactcagaaatccaagatgtcgccgttataccgtttcctgatcgggaggtcggccagttcccaatggcctacgtagtgaggaagaaggggagcaatttgtcagagcgcgaggtgatggagtttgtggccaaacaggtagcgccttataagaaggttagaaaggtggcgtttgtgacagaaattcccaagaacgcgtccggcaagatactgaggaaggatctcatcaagctcgccacatccaaatccaaactatgaaaatgtccgagtttactgttgtcatccacgagcagggagccattctctacgctgccccaatattgtagaatgctcgtaatttgaggatcctatcgg

SEQ ID NO: 405 - DNA, 1433 bp, Sorghum bicolor
ccgtcatggctcccccaccaacctcgcgccgtctcaccctcggcctcatcctcatcggcgccctctgctccgcctccgtcgcagcgcggttcgccccggcggacaaccacctcctcgcgtgcggcgcggcggcgcccgccgtcctccccgacggccgccgcttcgtgccggactccggctgcgcgtccacccgcctccggtcctcctccccgtccctctcctccgcggcgccgcccggctccccgccgccgccgtccccgctccacgcctccgcgcgggtcttctcctgccgcgcgtcctacgacctctccgtccgccgccgcgggcaccacatcctccgcctccacttctaccccttcgcccccgccctcgccgcgtcccgcttccacgtcggcgccgcggggctgctcctcctccacaacttcacggcctcgtcccccgtcgtcaaggagttcatcctccccgtggactccgacgttctcgtcctcaccttcgtccccgactccggctccaccgccttcgtcaacgccatcgagctcgtctctgcgcctgaggagctagtcggcgacatcggcaccttcgtcacgtccggcggcgccgcgcagatccacgggctgtcgtctcaggtgtttgagacgctttacaggatcaacgtcgccgggcgcaaggtcacgccatttaatggcacactgtggcggacatgggttaacgatgagaaattcctcgtcgacaccgactcggccaactacagggtgtggtcattcagcggccggattgcttatcccaagggtagcaggcagatgaccagggaggtggctcccgacaatgtctacaacactgcgagatcggtgaagccaggggccaatgtgacttggggtttccctgtgcctgctggcagccggtaccttgtgcgtatgcacttctgtgacattgccagtaaggcgctgtatgagctctacttcaatatctacgtcaatggtgatcttgcagtcaaggattttgatctctccagtgtcaccggattcttggcctatccttattacattgactttgttgtcgatgtgaaggatgaagggatactgaaattggcgattggtggcttgaagaagagtctatctgatgaagtaagtggcatccttaatgcactggagataatgaggatgaacaagaccagtggaggtatggatggagacttcccaattgatctagacatggagtatgtggtgggtaaggggattggagaatttgcccgctccttgctctgtggtttcatctttgctgggttgtttgtggctttggtcatgcgggtgctgagattgaggactgagctgaggaataacggtgcagcttggtcctggagaccgatggactccagtgaagggaaactggccagagcatatcaacttgtgcctagtaagacagactattgatga

SEQ ID NO: 406 - DNA, 1616 bp, Sorghum bicolor
cggcgatggcgctcgccttcgacgagttcgggcgccccttcatcatcctgcgggagcaggagaagaagacgcgactgcgggggctcgacgcgcagaaggccaacatcgccgcgggcaaggccgtcgcgcggatcctccgcacctcgctcggccccaagggcatggacaagatgctccagtcccccgacggcgacgtcatcatcacaaatgatggggcaaccatcttggagcagatggatgttgacaaccagattgcgaagctgatggtggagctgtcccgtagtcaagactatgaaatcggggatggtactaccggcgtggtagtcatggcaggggcgctcctcgagcaggctgagaagcttctggaacgtggtattcaccccattagggtggctgaaggctatgagatggcatcaagggttgcttttgatcacctagaacgtatatcccaaaagtttgagttcactgctgacaacattgagcccctggttcagacatgcatgacaactctatcctcaaagattgtcaaccgttgcaagcgggcattggcagagattgctgtcaaagcagttcttgcggttgcagatttggagaggaaggatgttaacttggatttaattaaagtagaaggcaaggttggtgggaagctggaggacactgagcttgtatatggaattattgttgacaaagatatgagccatccacaaatgccaaagagaattgaggatgctaagattgccatcctgacttgcccatttgagcctccgaagcctaagacaaagcataaggttgacattgatactgtcgagaaattccagacactgcgtgagcaagagcagaaatacttcgatgaaatggttcagaagtgcaaggatgctggtgcaaccctggttatttgtcagtggggttttgatgatgaagccaatcatttgttgatgcacagaaatctgccagctgtcagatgggttggtggtgttgaattggaattgattgccattgctacaggaggaaggattgttcctagattccaagagttgagccctgaaaagcttgggaaggctggattagtcagagaaaaagcatttggaacaacaaaggaccggatgctttacattgagcagtgtgccaattccagagctgtaactattttcattcgtggtggaaacaaaatgatgattgaggagaccaagcgtagtcttcatgatgctctttgtgtggcaaggaatcttatccggaataactcaattgtgtacggcggtggctcagcagagatatcttgttcaattgctgttgaaactgctgcagatcgtcaccctggagttgagcagtatgctatcaggtcatttgctgatgcattagatgctgttccactagccttggctgaaaacagtggtttgtcaccaattgataccttaaccgcagtaaaagcccaacaagttaaggagagcaacccccactgcggtatagactgcaatgatgttggcaccaacgacatgaaagaacagaacgtcttcgagacccttattggcaagcagcaacagatcttgcttgccactcaggtggtgaagatgatcttgaagatcgacgatgtcatctcaccgtccgagtactgatga

SEQ ID NO: 407 - DNA, 2331 bp, Sorghum bicolor
aaagatatcctctgatgatgaagcacccaattgcaattgcaaggcttctctccatccgtcgtcttcttcttcttgtcctgcagcagctctgcctcctcccgctcgtctccgtcgttctatccgccgccgcagccgtcccgccgccggcgcaccggcggccgccagaaagctgcccatcgaggtgcggcgacgtcgacatcccctacccgttcggcatcatcggcggcgatgatcaacaacactgcgccatccacaccggcttcaacgtcaactgtactcgccttgtcgacggcaccgagaggcctttcatggggccgttcgaggtgaccagcatctccgtacccgacgccaaggcttggatgaagatgaacatctcatggcggtgctacgattctcgcaccaacccgacgacgtggtccacgaggagagagaacttcacacacacgcccttcaggttctcgcaccaggataacaaaatctttgtcgtcggatgcaacacgctcggctatatcaccagtgaatattatagcataggttgcttgtccgaatgctacaataaaccgaggaacatgagttggtgctctgctggcagtggctgctgtgaggcggatgtcccaatcgacatggggtatagtcgatcttacttcaattcagagtataactacactggctgcggctatattgcagtgatggaagagaagatgttcagctatagcacgacgtataggaactcatcaacatcgttttttgatgcatacaacggcacagttccagttgtaatggactggaggattagacggtacacatgcgaggaggctaaattgaacagcagctcatacgcatgtgttagcaacaatagccaatgtgtcaacaccaccaacgggccaggctaccgctgcaaatgccaggacgggtatcaaggcaatccatacgtcagcgatggatgcacagatatcgatgaatgcgttcaggataatatgaatgactattgcacggctagaggggcgacctgtcaaaatacacaggggaactttacatgtttatgtccacctggaaaaagtatgacgaatggcatctgtatggcacatcacaagtcctcttcttggctgatacctgtcgtaggagcaagtgttggcctagttgtccttgtcgttaccttaacctgtgcatacttgatacaacaaagaaaggtacatcacaccaaacagagatacatccaacagtacggagatatgcggatttttgagaagatgaaatcacaacaaggtttcaaaatattcacagaagcacaactccaagaagccaccaacaagttcaatgaaaaacgagtgctgggtcatggaggacaaggaactgtgtacaagggacttgtcgaaggcaacgtcgaagtagctgtaaagaggtgtatgtccattgatgagcagcacaagagagaattcggcaaggaaatgctaatcctttctcaaatcaaccacaagaacatcgttaagctactcggttgctgcctcgaagtgcaggtcccgatgctggtgtacgagttcatccccaacggcacattgttccagctcatccatggaaaccatggcaggcagatttccttggcaattcgcatacagatcgcccatcagtctaccgaggcgcttgcctacctgcactcatgggcatccccaccaatcttccatggagacgtcaagtcatcgaacatcctcatagatcgtgactacactgcgaaagtctcagacttcggtgcttctatcctggcaccaacagatgagtcgcaattcgtcacatttgttcaaggaacttgtgggtacctagacccagagtacatgcagacatgccaattgacggacaagagtgatgtgtacagcttcggggttgttcttctagagctgctcacacgcaaaaagccattcaagtttgatgggcctgaagatgagaagagcctagcggtaaggttcatttcagttgcaaagcagggaaagcttgaggagatcttggacgatcacatcaagaacgacgagagcatggaggttctccaagaggttgcagagctagcaatgcaatgcttggagatgtccggtgcaaataggccgaccatgaaggaagtctccgagaggcttgatagtttgagaaaggtgatgcaacatgcacagcagcagcacaacaaccctgaggagatggagcccttgcttggagagtcatccttggcaagctctgatgaggtggttgtcagcactggaaatctaagcattgagatggaagctgccaggagtctagaacggggacgttgaccacaaattcaccgtctagtaaagtagtctcgagttt

SEQ ID NO: 408 - DNA, 1009 bp, Sorghum bicolor
aaactcgagacgaagcagcaacaaagatcacacgagctccgcttactcgacgacccactgcactcgcctccgatcgatcgatccggcgatcacactagtcgagtcgactcgactcgagcgagcgcgcgcccccgatcaatcaatggcggccaaggtggcgtcgccgctcgcgttccgccgcgacgtgcgtggcccgctcggccggcctcatccgagcggcggctgccggagcgggaccgggatgccgggggtgctgtactggagcagcggcgccggcggcagcagggtgctcgcggcgcgggcgcgcgggcggaacaggttcggcggcggatcagggcggactgccaaggacgaggcggcggacgaggacgaggaggaggtcgcggacgtggtgatcgtcgacgctggggacgaggaggagttcgcctccgacgagctgtccgggttcaggggcctggttcttgatctctcctacaggcctgtcaatgtcgtgtgctggaagcgcgccatctgcctggagttcattgggaaggccgatgtgttggagtactatgatcagaccgtctcttcgcctagcggatccttctatatccctgcagttttaagggttccacagttgctgcaagtagtaaagagaagaagagtcaagcagagcctaagccgtaaaaacattctttacagggatgatttcacctgtcaatattgctcttcaggggacaacttgacaattgaccatgttattccgatttcgcgtggtggtaaatgggaatgggagaatttggtgactgcctgtgccagatgcaactccaggaagggtcagaagacaccggagcaggcaaacatgaagctgcttaagatccccagggcgcccaaggagtacgatattatggctgtgcccttgacaaaatctgcattcagaacgctcaagaggaaccatgggcttcctgaagtgtggctgcagtacctttccagaccatctccatgaccaaaactccaagaggaattcttt

SEQ ID NO: 409 - DNA, 401 bp, Sorghum bicolor
cccaaagctacaacttgagcacacacataagcaaagccatggcaaaggcacaggcaatggccgcgctgatgctgaccgtcttggtggtcctggcggcgtctgccgagatggcgcacggcgtctgcaacctgtcgagcgccggcatccgggcgtgccagccggcggcagccatccgcaacccgacggagcagccgtcggccgagtgctgcgccgcgctggcgggggccgacctggcgtgcctgtgccggtacaagaacgccgccggcgtgtgggtgaggttctaccggatcgacatcaaccgcgccatggggctgccgggcaagtgcggcctcgccatgccagccaactgctgaggcatggtcaccgtgcgtcactggctcatccacaataatgcaatgtag

SEQ ID NO: 410 - DNA, 585 bp, Sorghum bicolor
gcctggtccaatgcaactccaatccagcatggcgtctctggccctccaccccatcatcccggccaccgccgcttcatccacgaccctcgcggtcgtcgtcggctcccgccacgccgccacactccaccgctgctttcgcccgcggcggcgcctcatcaccacctgcaaggcggagccgagcgggggcaacagcaccgtggagctagccgcaggggccgccgggctggcatcgagcgcggtcgtggcgtggtccctctacacgctgaagacgacggggtgcggcctccctccaggccccggtggcgccctcggcgcggcggagggcgtcagctacctcgtcgtggcgggcctagtcgggtggtcggccaccaccaaggtgcgcactgggtcgggcctcccggctggcccctacgggctcctcggcgccgctgagggcgttgcctacctcaccgtcgcggccattgccgttgtcttcggcctgcagttcttccagcagggatccatcccgggtccgttgccatcagagcagtgttttggctgactctgtaactcattcggttgatgtttgttaccgagtgtacgctg

SEQ ID NO: 411 - DNA, 581 bp, Sorghum bicolor
cagtgcagcccatcatactttagatcatcatggccaacgccttgctgctcctcgtggcgctgctcgtcgccgggtgcgcggctctggcttcggccacgtcgtacaccgtcggcgacgggcagggctggacgaccaacgtcgactacagcacctgggccagcggcaagagcttcgccgtcggagacaaactagtgttcaactacatgagcaaggcgcactcggtgacggaggtgagcaagagcggctacgacacctgctccggcgccaacccgctgagcgacgacgagagcggctccaccgtcgtcccgctccagaccccgggaacgcactacttcatctgcaacgtccccggccactgcgcggaaggcatgaagctggccgtcgccgtctccgccacgccgtcttccgcggggggcgccctgctgcaggtcccggcgatggcctccgtcgtcgccgcggcggccgcaggcgctgcgatcaagctcgcgctcttctgacggagcacggcggcgcggctatcgatcgtcagagtcgtctcagggtagagacagtgcatgcagttggctatgttcttggacgtt

SEQ ID NO: 412 - DNA, 1541 bp, Sorghum bicolor
tagcaatggttgaccttcgtctccaggtcgtcgccaccgtcctgggcatggtggccctggcggccgctgccggcggcagcagctccagcggcaagcagtccgagttccaggaggtcaccgtggacgccatccatcagggcttcaagaacggcagtctcacctcgacggcgctcgtccggttctacctggaccagatcgcccgcctcaacccgctactccacgccgtcatcgaggtgaacccggacgcgctggcgcaggcggcgcgcgccgacgcggagcgctcggcctcccgcggccgctgcgccgtcggcctgcacggaatccccgtcctgctcaaggacaacatcgccacgcgcgacaggctcaacaccacggccggctccctcgctctgctcggctccgtcgtcaggcgcgacgccggcgtggtggcacgcctccgccgcgccggcgccgtcatcctcggcaaggctaacccttccgagtggtccaacttccgccccgtcgagtccggctggagcgcccgcggcggccagacgctgaatccatacgttctgtccgcgacgccatgcgggtcgagcgccgggcctggcgttgccgcggcagccaacatggcagcggtgacactgggatccgagaccgacggctccatcctctgcccatcgtcgttcaactctgtggttggcatcaaaccaactgttgggttgacaagccggtccggtgtcatccccatcactcctcttcaagacactattggaccaatgtgtcgcacagtatccgatgccgtccatgtgttggacgtcattgtcggctatgacgagcttgatgctgaagccaccggagcagcatccaaatacatcccgcacgggggatacacgcagttcctgaggatccatggattgaagggcaagaggatcggtgtcctcgacgtgttctttcaaggatacgatgacatgcaattggcggtttacgagaagcatctcgatacaatgaggcaacaaggcgctgtcgtgatcaagaatcttgacattacaacaaatttcactgatctgggtgagcaagagattctgctcatggctgcagagttcaagttaagcatcaatgcgtatttgtcggacctactgtactccccagtccgctcccttgcacagatcatagccttcaacaaagcacatcctgtagaggagagactcaaagattttgggcagccagacctgattgccgcggagaaaaccaacggcattggcaccagggagagagctgccatccagcggctcaaggagatatccaccaacgggttggagaagctgatgaaggaacaccagctggatgcgatcgtggcggccaacagcgacgcctcctctgttctcgccgtcgggggctatccgggcatcgccgtgccggcagggtacgacaagcagggagtcccatttgcaatatgctttggtgggctcaggggctacgaaccaaggttgattgagatcggttatgcgttcgagcaggctaccaaagtcagaaggccaccaacttacaagagctagtag

SEQ ID NO: 413 - DNA, 404 bp, Sorghum bicolor
aaaggatccacagtggttgttggattggagagtgcgcgatccagctagcgggccgagggagccagcagccaggaggagcgagcgggcgagcgatggtgttcttctgcttcctggtggaccagcggcggaaggtgcggagcagcaagccggcggcggggatctgctcgcgctgcggcgggtgcgctagcgtggcggacatggagaccgccaccagggtctgctacctgctcaccgtgcaccgccgcacctggcgcgccatcatctgcaccttctgcggcgccatgctcaagtcctaccgccactacaggctctactgatcagtcccgatcgatcgtgcatcgagatcgagcgctggtaattgtgctattaccggtagatcgagtcggtcagtgtagggtaccttt

SEQ ID NO: 414 - DNA, 586 bp, Sorghum bicolor
ggactgccatagcttcctagctagcactgagtagctagtactagctagagcacagtagctcaaaagccagcagccatggccacggcagccctgacggctccgaaggcggcgctgccgccgaggggcccggggaaggagcaccggacggcgatcacggtgccggagttcaagcgctgggtgaagcagttcgacaccgaccacgacggccgcatcagccggaaggagctccgggaggccatccgccgccggggcccgtggttcgccggcctgcgcgcactgttcgctgtccggcgcgccgacaggaaccgcaacgggttcgtggacgactccgagatcgagggcctcatcgacttcgccgagagggagctgggcttcaggatcacaacggaatgaacggcggcgcgatgagctagtctgtcgtctcgtctgctccgatcctctctacagctacaggtcgccgacgacgtacatgccggcgtatattgtactgtgtactgtattgacgtaattacgtgacacgtacttgattaattatgtacggtctgtgtagttttttttctctcgctgtgtagtgctagcgcactgt

SEQ ID NO: 415 - DNA, 571 bp, Sorghum bicolor
cgaagactcctccgaatccgagggctcaagcgaccgacggcgagcatggcggcagacggcggccccgcgacggcggcgctggacgaggccctcaagcccttccaggaaagagcctccgaggctgagatacgcatagcaaagctggaagccttgctgtacaacaaagatgatctgagccgtggatctgaggcaacttcctctgccgtgaaggatcttcggtcaaagctggatgcggctactgcagaatgcttgactgaaaaagagaagaacaagaagctaatcatggagaacgagaagctccagtaccgcatgacccatcttatccgtgcaataaaagaggcagaatcaagataggagcagcctgacgaggcctatgttgaagtgtccccatcttgttgatccttcacgttattcctgaatttacaatttagcttaagctattgttgtgatcctgatatagatcttggttgaaactgtgtcaaactgtcgattggaacgatgatatgcacactattgtctgttttgacctgaccccaacttgaagggcaggtgactccagcattgaacattg

SEQ ID NO: 416 - DNA, 2504 bp, Sorghum bicolor
gaaaggagacctcagaggcagccgtagcgttctccgatcgttgacagctcccgttctcttctccggatgtcctgggggcctaccggcccatggaaaattcagacgccagagcggttcgccgcgtgagatgccccaggtgcccctgcgttcttgaggagccccgcgctccggtgtaccaatgcggtggatgcggcgctacccttcgagcaaagaaccgcaccggcaccggcagcgcgggagacgcggccacggcgtcgccgtcgcggagcggtctgcctcctcggagcaggcacctggacgccagcgacgtcgcgagcaccagcaggtccagcaccccgactcctcctcatgtcgcgagcaccagcaggtccggcaccccgccccctcctcatgtcgggaccagctggcaccgagccaccaccgacgcgacaagcagccggcacggttccggtgatctcgctctcgtgtcggccgggacgcgtgcgtccggtgacgtcgcgagcaccagcagtactcctgacgccaccgcgagcagcaggcgccaaggcaccgacgcgacgagccggcgcgggtcgggtggtcctgtgtccgccgcgaggagccgtgcctccggcgatgtttccagcaccagcagcacccctgacgctagtgccgccatgagtatcgggcgtccgggcgcggacaccacgagccggggcgagtccggtggcccggcgaggaatcgtgtccctgagcaagtggcactgatcgagaagagaagccgcgaacagatcgcggtcggtcaggaagtccgtgacgactctgaaggctgcggaccaagtgatgccggtggtgcagagtcgggcgtcggtggtgccggcttctccggaggaaacagagaggccactcctgaatcgcaggatgacacagagaaggggatgaaacgccaggccgaatcgaccgatgctgcgagaaagaaacattctggtgaagctgctgtgcagccgcagaacccccatgaccgtcgccaagaacttgcgccgaagtcatcagctcaacccgcagctgctcaacctgcacgggatgatgccggcgagaaggcgcggagtccatctcgccatgagattcaagaagaacatctggggcccttgcggaagaagattctgaagacggtggatgagctgaaaggcgacctctctgaacttttcaccaagtccccagagctcaaccagccacgcgcgcgccctgctcgtcttccaaagcaagaaggctacgtgtctcgtgcggcggcggcggcggcctcgggcttccctgccagagctcgtcacgccgctgctgctaccgacggtcaccgtggtcaccatgtcagcgcagctcgtgcggtgaagccccgtcaagccgctgctcctccccgtggccttccgtcacggcgctaccgtcagtgcagagcacacccgtgctgccatgacgtggagccgaggccgtgccatcacgggcacggctgctgccgccaccacggcaaaccggagtgcagcagctgccgaggatactgctgcaggcccagagcgcaggagccgtccgcgccgcggaagccaccggcaggcaaggagcccaagcggcgcctgccgccccgcaaccactgccggccggtgctgaagggcgcgccgttcatcgtctgctccagctgcttcaagctggtgcaggtgcccgccgacttcgccgtctcgaccaggacagtgcgcaagctgcggtgcggctcctgctccaccgtcctctcctactcctacagggacccggccaggaagaaggcctaccaggactccgtcgaccagtgcagcatagacggctccgagctgcacgtcggcaaaggcgacgaacgatccgacccgttcgcgccgttcatcgatgccttcgggctcagcagttactcgacggaggacgaacagcggctgcccgtctcgaggaacacgtcgttcgacaccctcgacgggacgaaaggcgtggggcggctgcatcgactgatggggtacgggtcagctagcgagctgctgcggcactcccctgacctgtacgagagcttcagcgagcggacgacgcctgacgtgagacagcacgacaggaaagggaaaggcgtttgcatcgacgacggagacggcgacgacgactacgacgtcgatgactcggatgaggaagacattggtgcgctgaagagatcagcgaggaaagggtccggttgggcgctcccatggatgcccggcaaggggactccagcagcgggagccatcaggatcaagtaaatagcagcaaaggcttgtgtatattgcaggaataggttcaggttttggaattcgaatgggaattcttcttattataggtatatatagtttgactattcattttaggtgcggtattggatttataggctgtttgtttgccattttttgaagcgtgacaatgctgtataatgaaatgtgtaaatatccagcattgagagtctgagaaagaataagcatcatggccttgtt

SEQ ID NO: 417 - DNA, 1503 bp, Sorghum bicolor
aaaggatccaccacctaccatggcgacgctcccgagcgccagccggtggtcgtcgtccaccgcgtggccacggagggccgctggagcggcgtcgacggcgctggccgccgccgtcttcgcggtcctggacgtcgccgacgcggtcctgtgcttcgtgtacgccctcctggatggcatcctcgaggacagccccgtgcgctgctactgccacaggagctacgacgacggagtggatggcggcgaccacgagcacgaggaggtctccgacacgctgtacgcgcgcggccggaggagcgccgtcagggacgcgatcctgtacctcctgcgacacgtcgtcgggaggaggggacgggcgccgccagatgagacggtggcgccgtgcaagtggcgcagccccaggtggtcagactgcgcgtgcaagtcgtgcgtcgcatggcggggcggcgaaggcgaaggcgaaggcggcggcggccggcttcacgtcgtcgtcaaagagccgcagccgtatcggaaagatgcaggaagaaaacagagtgagacgacgaccactcgtgaccccgagaacgccatcttcgtgcacggcttcacgtcgtcgtcgtccttctgggcggagacggtgttccgggagtcctcctccgtcctccacgactacaggttgttcgcggtggatctcctcggctttggccgcagccccaagcctgcgaattgcaagtacagagtgagagaccacgtcgaggcgatcgagaggagcctcggcgagccgccgcagagcctgatgagcggcagcggctccttccacctggtcgcgcactccatgggctgcatcatcgccctcgccttggctgccaagcacccgacccgagtcaaatccatcacgctcgttgcaccgccgtacttcctggcgtgcgagcagaagcaggcgagccaggtggcgctcaacaggctggccgagaagaagctgtggccgccgctgctgttcggctccgcggtgatgtcgtggtacgagcacgtcggcaggaccgtctgcttggtcgtctgcaagaaccacctgctctgggagtggctcttcagcctcttcacgggaaacaacacgggcgtggatttcagggtgagggatctgacgaagcacacccaccactcggcgtggcacaccatgcacaacgtcatctgcggcggggcggcgctgcaggacacgaacctggaggccgtcgcggcggccggcatcccggtgcaggcggtccacggcgccgacgaccaggtggttccggtcgagtgcagccgccatctcaaggcgaagctcccgcgcgccaagctccgtgtcaatgtcatggacaggcgcgaccacgcgacggtggttctgggcagggagagggacttcgccgaggagctcaaggcgttctgggtctgggggtcagcaactccttcaacgaagcggaggttcagaggatgctgattgttagcagggccacgggccaagtagtagcaggccagagtggtaccttt

SEQ ID NO: 418 - DNA, 2134 bp, Sorghum bicolor
ctttccatcataaacagcccacacctggtcgcctcgcgtctcccgagccaacctactctcctctttctactactggtgcggcagcggcggttgcagcgttgcgatggggaagcacgagttcctcacgccgaaggcgatcgcgaaccggatcaaggcgaaggggctgcagaagctgcggtggtattgccagatgtgccagaagcagtgccgcgacgagaacgggttcaagtgccactgcatgtcggagtcgcaccagcggcagatgcaggtgtttggcatggcgcccgaccgcgtcgtcgagggcttctccgaggagttcttcgagtccttcctctccctgatccgccgcgcgcaccgccactcccgcgtcgccgccaccgtcgtctacaacgagtacatcgccgaccggcaccacgtgcacatgaactccacgcggtgggccacgctcaccgagttcgtcaagttcctggggcgtgagggatactgcaaggtcgaggacacgcccaagggatggttcatgacctacatcgaccgtgactcggagcaggccgtcaaggaccgcctcaagcgcaagaggatcaagtcagacatggctgaggacgagcgccaggagcgcatgatcgcccgccagattgagcgtgcgcagaagtctttatccaaacccaatgatggtgatgttgccgagggtgagtctgagtccggcagtgaagaagagtattcaggctcggatgatgatggggaggagcgggaggatgacgcgaaagaggcaaacaaggcaacggggaagattgcaattgcactgcagaaggctatgccagggcccaaggttaatccttttgaggataagccgaagatgaaattcggttttgacgaagaggatgactcgggtacccaagagaaggtgaaggatgaggtgcccaagaagaagggaaaggatgtgaaggcggcagaggctaggaggtcagcattggacgagctgatgaaggaagaggagaaggccaaggagaggagcaatagaaaggactactggctgtgccctgggattgtggtcaaggtaatgagcaagtcattggcagagaaggggtactacaagcagaaaggggtggtgaagaaagttattgataaatatgttggggagattgagatgttggagagcaagcatgttctcagggtcgaccaagatgaacttgagactgtgatccctcagattggtgggctggttcggattgtaaatggggcttatcgggggtcaaatgccaggttgctctctgtggacacagagaaattctgtgcaaaagtgcaggttgagaaaggcctctatgatgggaaggttcttagggctgtcgaatatgaggacatttgcaagatatcctcttgattatattatacaacatgatttattccattttcctggatcatcactgttgcaaagaataggaatacgatccagtgcactagctctgtctcatagatgcctaacagtgtctttgcttgctattgcttgtgctagaatatcttctgttaaagcaatgttcaatatgagcaaatgtttctagttcactgtatctgctgaaaggctatgtgtgagaatatggtggcatgtatgtttgcttgttactagaccagaataaccgtattgacaattttgtaatatttggttagcctctatgtttctgtttagttaatattttactaaatgttttcttggtagtttgagtgttacttgccaatcaaatgtcgtcatgattttcgattgtattatgaaggtaaaggattcatctacatgaataccaccaaaagataattgtgaactagtaaaatgcaacaaaggttgttgtttatgatctacttttattatcattgtgaaagaaccaactcagtttagtcaactatatagatgacacgagaggtacgcgggtgaatcatcacctggtcattcagaagatcagaaaggagagaatgctggtagatcaagtagttctggaagctctagcagtgactcaggctcgtcgtctagtggtaaatgttctcttattttgaagatattgtaacaagaaaatcttttggattatgtatttttcttctttatatgaacatatgtatttaccttaaggagcatgtgcagatagggata

SEQ ID NO: 419 - DNA, 2196 bp, Sorghum bicolor
aaaggatccctctttccagagcagagcagacagagcaccacgacccgccagaccgccacttgccaaccaatacccttttacttctccttctccttcgcctccgggagggacagcgggtatggacgccgccgagctgcccctcgtctaccacatcggcctggtgctggccgcgctctgggccgccgccgccatcggcttccgcggctccctcctctacctcctcgccttcctctacctctacatggtaaatgctcgctgtgcagtgagactgcggaagaggatacaacatgaggagatgaaatctgcctatcaacgaaggctcctctctgatgcagaatcagtacgctggttaaactatgcaatcaacaagatgtggcctgtctgtatggagaagatcgtttcacagcttctacggcccatcataccatggttcttggataagttcaaaccttggacagtcagcaaagcaggtattcaggagctttacatgggcaggaatccaccaatctttacctccatgagagttctacctgagacatcagatgatgaccatttggttcttgagctgggaatgaatttcctttctggtgaagatatgagtgctgtacttgctatgcagctgcacaagagtgtgggacttggaatgactgcaaagatgcatttaactagcatgcatgtcgagggaaagattttagttggtgtgaagtttgttcggagttggccatttcttggccgtgtaagactatgttttgtggagccgccttattttcagatgactgtgaaaccacttattaatcatgggcttgatgtcactgagtttccaggaatttcaggatggctggataagttgatggatactgcatttgggcagacattagttgagcccaatatgatagtcataaatgtggaaaaatttgcatctactccttcagaaagtaactggttcagcattgaggagaggcctcctattgcatatgtgaaacttgagattttagaaggaattgacatgaagccatctgatataaacggactagcggacccttatgtgaaaggtcgtctgggtcctttcaaattccaaacacagatacagaggaaaacattgtcccctaagtggtttgaagaatttaaaataccaatcacatcgtgggaggcaacaaatgaacttgtcatggaagttcgtgataaggaccccatgtttgatgactcgcttggacaatgtaccattaatgtacatgagctgagaggtggacaaaggcacgacaaatggatgtcactgaataatgtcaagaaaggaaggattcacttggcagtaacagttgaagatatatctgaggaccaaaatagatcaagtatggacgaatcattgaaacaagcggatactgaagtaccagtatcaacatctgtttatagcaaagtggattctggtgaacttcctgaagaaaataaagtcttaatggatgaagtggagcacataaacattgatggacaagaacaacctggaggtttatatgtacatcgccctggcacgggggttccaaggacatgggaatcccggaaaggacgagcacgaaacccagacacacagattcaccaagaggttgacaagtcaaaggaaatcccgacaccaaaaggcagtggacaagggggtctatttaatgtaggctcctttttccggagaaactcaaggaaggggagctccaaaaatcttgatcccagccttcctgcaactccgggtcctcagagtgtgacagagcctgatccaaagctccctcaaactccacgtcccaacctgaaggagctgggcgagaagcggacatcgataaagattgtagtgaatgaagaagcaaacccagcagacaaggtgggatatgcagaaaactcaggagaagatgtggcaaaggtgatagagaaaaatgcaggtgaaccaggcagatcactgacaagcacattgagcaggaagttttccagaaagagagcagatgacagactatcagatatcccagagcagattgaagctcatggatctgagtcggtgagtgaagggcctattcttgttagaggcgagccaatgatagcagaaggccatccaacagcggaacatggcaatggagatggcaccgagcaagatgtggcgggagcaaaggttgctacccaggcctcataaaggattgggacttaagatcagcaggtaccttt

SEQ ID NO: 420 - DNA, 1273 bp, Sorghum bicolor
cctcaaagcagagaccctactgatagccatgtcggagactgaatcggcggcagtggccgcggcgctggacccggcggctacagcggagccgaagcctcggcggctgcgggggcacaagaagggcgccgtcacctgctgcgtcgcctcctccgcccgcccgggcgtcgtcgcgtcctccggcgaggatggatgtctttgctggtttgatctgcgcaccaaagatgtacttttgaccatggaagcagcaaataaaccaatttcttcaatttgctttaaaccaggaaatgaagattgtgtgtatatctctgctggaaatgaaatattgtcctttgatgttcgtatgggagctcaatcaaagccattagagacgtataactacaatagagatgaaatcaatcagattgctgtcagctctaaaggttttctcgctgctgcagatgatagtggggatgttaagattgtcaataccattcagaagtgcttgtataaaagattaagggaagcccacacaagtatttgcagcagcgtgcaattcattccttggagaccttggacagcaattactggtggccttgactcaaagctcgttgcatgggatttctccaaaggacgaacactgttttctattgattatggatcacctgaattgcaaaatggcaattcttccggtagtgcagggcaatgtttcaaccctgcttttgttcattcaatagcagtttctgaagagggtattttgggagggctctacaaggtttgtgctgttgcaaggggggatggtgctgttgatgtgattgatcttgagtatgaactggctcctgcgaaatcgaagggacctcctcgggcagctatttcaaaaaagagttcaaaaggagctgaacttggagatgggagctgtaatcaaagtcaagcgaaaagaatccatcttgactacacgatgggtggccataccgcagctgtgtcttgtgtagcattttcagtatttggtgagaaggggaagttcctcgtttctggcggcaatgatgcatcagtgaagctgtgggattggtcgaaaggattttcctctgaaacaaacagcaaagttgaattggttttgaatattgatgtaaagaaaaaggtaaattggctgtgtactgctccaactgattcagataacttgattgtgtgtgacacatccaaggtggtcaaagtatataatttccggtagatggatcaaggtgtagcctcagtttgtcagacagctatccgagggagtgaagattgtctgaccgcttag

SEQ ID NO: 421 - DNA, 1506 bp, Sorghum bicolor
aaaggatccgtcttccttcgccgcttccccgcgaatctcgccgcccggcttccggtctccgcttccccagtggtcatggacccgtctctctcctcctcgcctctccgcctctccggaacccccgccggcccgggcgcgacccttaccaccccgaagcccaccctcgtggcggccgcgggccccggccgccagcccaccaccaccacctgcctccgcgccatctcgccgtccccgtccccgtccccgcccacccccgtggagtcgttcggcttcgacgcgctcaaggagaccttctccgtggacgtggcggcggccgacgcgcgcccgctcgacgtcccgctcgccgcgcccttcaccatcgcgtcctcccgcctcgtcgcggtgagcaacgtcgccgtgcgcgtcgagctccgcagcggcgccgtcgggtggggggaggcgcccgtgctgccttccgtcaccgccgaggaccagcccgcggcgctcgacgccgccggacgggcgtgcgccgcgctcgaggacgcctccgcggcgccactcggcgcgctgctccaggacgtcgccagtgtgctccccggacacgccttcgcctcggccagagcaggagtggagatggcgctgattgacgcggttgctaatagcattcgcataccgctatggagattattcggaggagcatcagatagtgtgacaactgacatcacaattccaattgtgaccccaaatgaagctgctcagttggctgcaaaatatcgtggacaagggtttcaaactctgaagctcaaggttgggaagaacttgaattcagatatagaagttctgaaagctattcgacttgtccatccagattgctcatttattttggatgcaaatgagggatacacagcaaatcaagcaattgaagttcttgatagactaaatgaaatgggagtgacccctgtgctctttgagcaaccagttcacagggatgattgggacggtctccgagatgttagctctgtggccatggagaaatacaaagttgctgttgctgctgatgaaagctgtcggagtttacttgatgctcagaaaataatacaagggaatcttgcccatgttattaacatcaagctggcaaagttggggattcttggagccctagaaataattgatgctgcaagaaaagccaatatttctctgatgatcggtggcatggtcgagactaggattgctatgggctttgctggtcatttagctgctgggcttggatgctttagtttcgttgacctggacacacctcttttactctctgaagatcctgtgtatggtggctatgaagcttttggacctctgtacaagtttacaaacgcccgtggccatggcggtttccttcacttggataatgatgcctcgaaatgaagatggttaacaattttttctgtccttctggagcttcatcgaagcattgcagtgcataggtatagcctgctgttgcaagtccagtacaccagtcagtagggtaccttt

SEQ ID NO: 422 - DNA, 1000 bp, Sorghum bicolor
gtggagatcaaactagccaagggcagcccaaatttggggatttttcaagtgaatccccctgtatagagatagttcgaagatgatgaaccagcacagagaggaggatgccttgagaggtcaagcagtcaaaaaccagaaggcgatatgggacaagaccctggaaatgagattcttgctgcagaagggattttccacttccaacaagttgccccaggaacccatcagaacaaggttttgcaatcatgataagcagatagagcaagcctatgatgatctgttgaattcatcaaagcagactttgagcagcatgatggagctgcaggaggctttgctcgagagtaatcaggctacaaagggtgccaatgaaattccttctgccgcaaatggagacaatgacgagtggtcagaagtacagagattgcagacaaggataacaacattcagaaatactgagatagataaatggcagaggaaaatacaggtgacaacaggtgctgctgcacttaaaggaaagctacatgcatttaatcagaacattagtgaccaagttgctggttacatgagagatccaagccggatgattaacaggatgtacttgtccaactctgctgttagtgtatttggaaaggatgtgggagaacccagaacagctgaggaggggcacattatggaaggtgatcctgaacttattgacgattctgagttttatcaacaacttctcaaggagtttcttgagtcatgtgatagaggggcctcagagtcggcactttatgccctaaaaaagcagcaggttaaaaagagaaagcttgttgatcgtcgtgcttcaaagagcagaaagatacggtatcatgtccatgagaagattactaatttcatggccccagagcccatggttgttcctccaatggccccgaagttgtttgagaatttatttggcaatggcaactagaatcaacttaagcttggattcaaatgtcacattacttggtgcagcttttag

SEQ ID NO: 423 - DNA, 1532 bp, Sorghum bicolor
aggccatggggccaccgcagccagccagggtcggcgccatcaacatcgaggcgtgcgcgcggccgatcgccgtcgaccaccgcatcaggctcccctactacttccgcatcgcgggcagcctcctccgacaggctaatatatatcggaacgagagtaacttcctcgacctgtatgtcatccttctgagatactcgagcttgctgtgtgagacgattccgaagcatcgtgattaccatgccttcaagttaaaagaaaaggcattttttgataaacttaatgatgttatgaaagagcttgagacattgaagccagttgtgcagcggcaggttgccgagcataacagaggaggtactgtggaatcgaatactaatagtctaaatggaaactatggtataactcgtaggatagagcagcgcactccaacctcttatactccacagccatttgtaggcagcactaatggagcattgcaaaaaaccttccatgctgggagacaagtggcattattaccaagcgtccagaaacaatttatgaatctaccatatccaaaagaagaaacactagctagacactccatattaggacctaatggtcttaatggccgatggaatgggcctgttactgaaattaaggttcagtatccaagcaattttgaattaacacaaaatgatataacaagtttagtgccatccatcttgaaccaagatgattcgcatggtcccagtactgcacctgcacctccacctccagatagctcctcaaatgacaatgacgatatgaaatctgttctctctcttgatgatggtcgatggtctgtgccagcagaacgcactccacttccttctgctagcttggaagaagagttgtttcaattggatatcaaacaaccttctcctccaccagttctggcagaggtgcaaagaccaatttctccatctagagttgctgatccaacacccggacttccgacctcaggaactgcccgttttcagaacttgcatgttccgatcaagttgatggagtgttttctaagggttgctgagtcaaacaccaaaagaagcttagaaacctgtggggttcttgctggtaccttgaaaaagagaactttttgcgtgacaaccttaattattccaaagcagaaatcgacatctaatacgtgtgaagctataaatgaagaagagctatttgaagttcaggacacaggctcactgttcactcttggttggattcatacacatccaacacagtcctgcttcctttcttccattgacctccacaatcattattcttatcaggtcatgctacctgaagcaattgcgatagttatggcacctactgacacaacaagaaaacatggtatatttcatctcacggatccaggtggtatgggcgtgatccatgattgtcaagagagaggtttccatcctcataaggcacctcttgatggttcgccaatctatgagcagtgctcccatgtgtacatggacaacgatataaagtttgatatgattgatctccgagaacgatgatga

SEQ ID NO: 424 - DNA, 2053 bp, Sorghum bicolor
taacaactagcacgggagcaggggaggaagtagagaggacggcgcgaggcttggccgtgccggcgagttggggcgtttttcctgcggtcggagatgcgaccgttgggacccgggagacagcgcagttcggcttcgggttcgggggcggctcccgcgacggcggccgccacctgagcaggatgtttagctggaacgacgagcagcagcaggtaggggatgcaatatggactgagttcaatgagagtgaggaccatattatgccttatcctaaaggtgcagaagatagtacgactcgcaagaacaatgaaaaagaggtggctagtattgatggcatcactgaacattctgaaggtgttcaaactggacttcaacggatggaaaagcaaactgcaaatcagacaagtgcacatttttcagccacacgaattgacatggaatcctggcctgaccttccttccctgaatcctacacttgatagaaactatagtgatgacaacataacatccacatatctggatttcagtgctgaacccagtttacagaaagtgacaggaaaagctacagggcaactagatggtgaatcagaagtgttcagtaatgatcaagaagaaaagagtaacagtttccttgattgcgactggggcaatattggagattttgatgattttgaccgtctatttagcaatagtgactccatatttggtaatgagatagttgccaacgacagtgattttctttctgcatcttcgaatttgatggataatgctgtgcaatcaatcccaattctgcaactaccattgaataaacaaccatcatgtgatcgtgggccttctttgcttctgactaacgaaatttccagtggtgttaccaaacaagaaaataaggtcgaagtgcagaagaggccagtgaggtcacgcagaaaaccagaggagagaggtaaaagtaaaatatccagcagtacaagtggcttctcccagagcaaagtagagaatgcatcaaccaatttgcaagctcctatgcaacctgtacagactcctcaatatgcactgttccaggatagcaagaagataggacaagttcagcatgttaatcagtttatgtttcctggatatgggtatcctgcatatccatttcctacaattccgttagtgtcaaacattcaagctgaaggctatctgacaaaaccaactggcacaagctaccgaactttggaagattccccaaaacagtcaagttccatagaaatgtcacaagacattccatcaagagcactgataatgacaccacaagaaaagatagaaaagcttaggcgccggcagcaaatgcaagcactgctagctattcagcaacagcagcaacagtttggtcaagagggttctggcagtgacacaatggtgtctcaggcatactcccctaggaacaaaaatccggattccttggggagttcaattgtcatagatgaaaacgcaaataaggttttttcgcctgaggtgattccaactaaccatgacctggttcacaagagttctgcaatttctgttgatccttttatagaggaaaaaatatattatcagctacaagatgctcttggcaagttggataccaaaactcgactatgcattcgagatagtttgcttcgtttggcctatagtgcagcagagagacaaattgatggtgataggagcagcactaacaagactaataaagatgatgatgaagcttccgaaaatgatgcatctactaggagaacaaggtctccaactagggaagcagaaacgatcacaaatccaattgatcgtatagtggcccatttgctgtttcatagacattgctccaaggttgcaacagcaacaaaggaggaaatcatatcctcaacccccttgatactagaacctgaaccgaaggtacccttgggaactcctaggttgccatcacaagatcaacgagatgagcaagaaattgtattgcctctgtcacaataacatgctgattttatcaactgttcagaatcaaaatgatagcaaatccaatgattatggcaatctgctgatca

SEQ ID NO: 425 - DNA, 1076 bp, Sorghum bicolor
cctttcgtcctcaccagagacgaacccctcctcctgctgctgctgttgtcggctccggagccatcctctgctccgaccacgcaaatccccgaccccgaggcagacaccggccaggccccgcgatggcaaagaccaacgacaacgacgccttcagtccccctgtttcccaagaaagggttgtggtaacaaacaaacatggtgagaggcttgtggggctgctgcatcacaccggatcaaacaagattgtggtcttgtgccatggttttatatcttccaagaatgacagcctcattcttgacctagcggcagcattgacaaaggaagggatcagtgtcttccgcttcgatttcagtggaaatggagaaagcgaaggtcagtttgagtatggcaactacaggaaggaggctgacgatttgcattctgtcgtattgtatctctatcaaaaaagttacgatatagcagctgttgttggtcatagcaaaggaggagatgtagtgattctatatgcttctatttacaatgatgtcagcaaaattgttaatttatcaggccgatttgatttaaaacaaggcattgaagaacgaataggggaagggtctatcgatagaataaataaagaaggctaccttgatgtcaaggacaaatctgaacatgtcaactacagggtaaccaaagaaagtttgacggaacggcttaatactgatatgcatgctgcaagtgtttccataagtaaggaatgcaggttcttaactgtccatggttcagctgacaagaccatacctgtagaagatgcccatgagtttgcgaagcatatacccaaccataaactgcatatcatagaaggagcaaaccataactacaccgcacatcgcaaagaagttgctgatgcagtagtagatttcatcacgtccgatggggtttaaggctgaggagcccacgtctccaaggtgaatgttcattccagactgtttaacacttggtcatacacctattcccattggtggacatgagcggtacagctccaaattggacccttcaatactagggcaataatcgacacagacttgcatggtact

SEQ ID NO: 426 - DNA, 2598 bp, Sorghum bicolor
aaaggatccagctccgtctcaaggataacgccagtgcttgccgatccggtggggaaaagtgggagcacggagcggcctcgcctcggcggggacgcggcgcccaccatggggagcgatctcaaggagatgaagtacaggcggaggattggggtggaggagcggccgcaatgcagcgacccgaggggcggcggcgcggactggcccgcgctgcagcaggaccccgtcgagctgctgcgcaagctggacgagctcagggaccagatcacgcgctcctgcaacgtcgtcggccagccgcgggagcaccgcagggtcagccgacgtgcggtctccatgctccccgagcaacttgagccaccgcctctgccggcgtaccaccgctcccgctatggcgggcggtatgggcacggcttgccaccaccgagcccatacgcaccgccacgccctgaacatggggaaaggtatgtgcggcagtctagtgggcactaccgccagtaccctgcgactgggaggcagtgggagaacggtgggatggggcctgggggctaccatcactatgggtgtgcctgtccacactgtcttcatgggcagaggcctttgcagcaagaggagaacatcccaatggcgagatactttgccgggcagcatgaatcataccggttccagaggtcgccatcagtgtcatccgattatgataggaggtctgtggcgtcatcactttactctcatcggtctgtatcaaagaggagggcagagtacttcaggaaaaaggcagaacatatctgccgtccagtggatggtgctgctcctttctctgtatgcagttcatgttataaactactgcagatgcctatgggaaaatgcatagggaggaagcagaatcggtttcaatgtggatcttgttgtcagataattagtttgaagcatgaagaagaaaatggtattccctttgtgccatcatcatccttatatgctcctgaaatggagcaatgctcaagtgaccagatgaggagagattctgcccatcaacgccatgaggatttcaattctatgttctacaattcaattgatcatagcaacatgcaaaacaacatggatttcaccgatgataattcactttcttcgaccatgagtaatgacaggattgaaaaagagtgtggttcaactagaagcattcagtcaaaagctgagggtctctctttctctccaagtaggtctgtagacattggtagcccaaaggatatattgtgtgagagggaggcagactgcaaggtggagccttctgtagatggtccacttggcccacgatctccagctttagaggacaaacttgttgacccattgtgtgcccaagaaaatggtaacgatgaggatgatcaaggcatgccttacagatcagacctaacttgcaaaggagagtatgatgttaatgatgagtatgatgtgggcattagtacaagaagcaaacaggagagcaatgaagatgacaaagatgccactgaagatgaaaggtcatacagaagttatgaacagaagagcaagagcaaggaagatgactgttgcaatgttgaggatagtagcaaaacatacaggcagaatagtggagaagatgacgctagtagtctagtagatggaagtgaaaagtatgagtgtatgaatattaaagatgacgatagcagccccggaggtgaggacacatggaataaatatgagccaaaggtcaaaggagatgaaaattgtgttcttggagctgagagtattcacaacaattgtgatgaaaataataaagatttcataggaactggaagcataagtttgagacatgaagagctgaaaatcgaagaagataacgggaaattgcagcagccatttattgaggatgccaattcccaagcagggagtggttcatcaattaatgagcggacaaattctgggttttctcgtggttcctcagagactgggttagatgaagaccagtcctcaaccggtaagagtggggattcatcattttttgctggtttcttgaagaagggtttcaaggacctttctttattaaataagtccatggacagtgttaaggtttcaattaatggtcatccaatctctgaaagagcccttaagaaggcagagaagaaagctggtcctgttgatccaggttcatattggtacgactaccgtgctggtttttggggtgtcatgggacgagagtgtatcggcattgtccctccatttattagagaatttaattatccgatggccagagattgtgccggtggggatactggtgtttttgtcaatggcagagaactgcaccagagagatttagatttacttgtaggaagaggattaccgcggatatctggaaagtcatattctattgagatgtcaggaaatgtaattgatgaagcaactgggaaaaaactacgcagtcttggaaaacttgctcccacgattgagaagttgaagcgtggttttggcatgcacgtccctgaagagtttagataactggttctagtacaggtcttggctttgctaatagtacactcttcaaagattaccatggggtgcaaacctatgatttctgcggattagggtaccttt

SEQ ID NO: 427 - DNA, 852 bp, Sorghum bicolor
agaaacatgcgagacatggaggacagatcggtcgtcagccgccgccatgaacccaccaccgtcgccaggacggcggacgacgacgacgacgtggcttccggcgacgaggactccgactcggacgccgagttcgagttccccttcgtgagccgggagtccgaggcggcggccgacgagctcttcgcgggcggccgcatccgggccttctacccggtgttcggccgagtcctggacgacgaggcgccagccccagcgccgaggtcgccgctagggcggctgttccagctggagcaggcgcggacctcgtccgtcgcgtccacgtcctcctcctcctcctcctcgacggcgggcgcaggcgcggcgggcctcgacggcgcgtccccggacagctactgcctctggacgcccgggtcggcgtcggcggcgtcctcgccctcgcggtcgccgcggaagagcgggtccacgggctccatcccgcggtggcgccgcatcggggagctcgtcgtcgggcgcagccacagcgacgggaaagagaagttcctcttcctctccgcgccgccgtccccggccagggacagggagagggagcactcctcccccgcctccaagtccaagtccaagccaaagcagcctcagccgaaaggaagtaaaaccgccgccgccgccgccgccaccgagctcgacacggtcgccgcggggcgccgggtgtcctacggtggcgccaacgccaaggcctccaccggaggtgcgcggcgcacgttcctgccgtaccggcaggacctcgtggggctgttcgccaacgtgcgcgggctcagccggagccaccacccgttctgaagcggatccggttaa

SEQ ID NO: 428 - DNA, 2504 bp, Sorghum bicolor
aaagtcgacagctaccaacctctccctcttcttcctccgttgccaagctctctgaggagaagaatggctgcgctgctctatctcgcccttcttctactgctgacctttccggtttgctctggcgcttcgccatggcaaaccatgaccaccggctcgcacatacgaggagaggaccatgacaaggtcatcctcctctcgcctgatgctaccttctcctgcggcttccatgaggttggcacgaatgctctcaccttttccatctggtacaccacccatgccgccgagagaaccgtcgtctggacggcgaatccctattccgcagagagaggaggatactctccagtgaacaaatatggctccagggtatcgctaaaccgcgacggcaacctgatcctcacagataccaacggttccatggtgtgggagagcaagacatcgtcaggcaagcacacgacagtcaccctcctcaacagcggcaaccttgtgatcagtgactccagtaacaagatcatgtggcagagcttcgattcgccaactgacaccttgcttccggggcagaacctgacaaaggacacaaggttagtctctggttaccatcacttatacttcgacaacgataatgtcctgcggatgttgtatgacggcccagagatcacaagcatctactggccaagtccggattacgacgctcaaaaaaatggccgcaataggtttaacagcaccaggatagcagttctagatgacatgggtaatttcacatcaagtgacgggtttaagatagaggcttcagattcaggtccaggaatcaagagaaggatcacaattgattatgatggcaatttcagaatgtacagcttgaatgcatcaacagggaaatgggacatcacagggcaagctgtaatacagatgtgctatgtgcatggactatgtggaaagaatgggctctgtgactacttgggtggcctcagatgtagatgtcccccagattatgagatggttgatccaacaaattggaacaaaggatgcaaaccaatgttcttgactgatggaaaccaagcacgtgaggaatttacatttattgagcaacctcatgctgattactatggctttgatctatcctccaataagtccatcccatttgaagcatgccggaacatctgctggaacagcagcacctgcttatcattcacatacaagggtggggatggttggtgttacactaaagatttactctacaatggtcaggtgttcccatatttccctggggacaattatatgaaagtaccaatgagttttaacacttcgacgtactcaatctccaagcaaaaaaccctcacctgtggacccgcaggttctgagaatatgctaggaccagcaagtatgtacggaacaaagaaggacaacataaattggacatacttctatgtctttgctgcaatactgggagctctagagttgcttgttattgttacaggctggtaccttttcttcaagaagcataacatacccaaatcaatggaggatgggtacaagctagttacaaaccagttcaggcggtttacataccgagaattgagggaagcaactgggaagttcaaagaagagcttgggagaggaggtgctggaatcgtctacaggggagtgcttgaagataagaaaatagtggcagtaaagaagcttacagatgttcgacaaggagaagaagaattctgggcagaagtgacccttattggaagaatcaatcacataaacttagtcagaatgtggggattttgctcagaagggacaaagaggttattagtatatgagtatgtggagaatgagtcactggataagtacctctttggtgagagaagtactgaaagcttgcttggttggagccaaagatacaagattgcactgggcacagcaagaggtcttgcttacctacatcatgaatgccttgagtgggttgttcactgtgatgtgaaaccagaaaacatacttctaactcgagatttcgaagccaagatagcagactttggattggccaagctcgcaaagcaaggtagcactagtttcaatttcacccatatgagaggtacgatgggctacatggcaccagaatgggcattgaatatgccaatcaatgcaaaggttgatgtgtacagctatggggtagtgcttctggagattgtgactggaatcagggcttcaagtggcataatgttagatgaaagacaaatagattttctggagtttgtccaggaggctaaacagattctatctaccgggaatgtcagtgatattgttgatgatagattgcacggacactttcatacagagcaagcaattgcaatggtgaaaatagccttttcatgcctcgaagaaagacgcaagaggccgacgatggatgaaattgtcaaggtgctcatgtcatgtgatgatgaagacgactaccatcctgcttattcatattgacttgcaacagatgcaaagtggcaggcataacaagtggatccttt

SEQ ID NO: 429 - DNA, 2102 bp, Sorghum bicolor
gatcccaacagaggaatcacactcgggttggggggggcttgcagagaagggaatgtcggcaaccatcgaccggctcgcgacgccgtgtcatgagggtcatgcacacagtgacggaaagagagagtgcaattctgatgaagagaactcggaaggagaaagaaagcccaaaaagggctctctcaagaagagagcagctactgcagggtataagtttaggcattccttaaggagaaagagtaaaaccaaggatgataaccatgtagcctcaatagaagacatcagagatgttcaagagctggagactgttgaaaggttccgccagtgtttacttgacgagggcctgttgccagaacatcacgatgattatcacacgatgttgaggttcctgaaagcaaggaaatttaatattgacaaagcaaagcatatgtggtcagagatgcttagatggaggaaggaatttggtgctgacaatatagaggaatttgactacaccgaattagatgaagttgtgaagtactatccgcagttttatcatggtgtggacaaagagggaaggcctgtttacatagaactaattgggaaagttgataccaacaaactagtgcaaatcacaactattgaccgctatgtaaaatatcatgtcaaggagtttgagagatgtctccagatgaggtttccagcttgttctattgctgcgaaaaggcacatagactcatctactacgatattggatgtgaaaggcgtgggcctaaagaacttctcgaaagatgcaagagagctaattatgcggttgcagaagatcaacaatgacaactatccagaaaccttataccgactttacatcataaatgctggccaaggcttcaagatgttatggggtacaataaaatcatttcttgatccagaaactgcttcaaaaattcatgtcctcggaaacaagtaccaaactaaattacttgaaataattgatggcagtgaactcccagaatttcttggtggcaagtgcaggtgtgaagaatatggaggttgtccgaaatcagataaaggcccttggaaggaccctgaaattgtcaagagagttatcaatggtgaggcaaactatggtcggcatgttcttgctgtatcaagcataaatcagaaggaagttggttgtactgaacactcaactgagcaggaaaaaggcaatgatgcctctgccgaatctatttctgaggtggaagatgtttcttctccaacagctttagtggatcctataagccctaatttgacccatgtggatgagtcaaaatttccaggacgtgcttcctcatctgatgcccctcccattacaggggatagcatccctgctgttgacaaggtcgtggatgcatgctccaatccaagaaacagctcgacgccttccagctcaggttctttctccttgagaaatataccggcaacattgggaggacttaaaactcgaattgtcgcatggtcaacaatcttagtcctgagcttgttggcattcctccgttctgtcctgagcatagtgaccaaaaggctctcaaaccaggccatcacatgtgaccactatagtgctgacttccgtcaaggatatacgggaaatggcacccttacatctgtattgacacggcttggtgaattggaggagaagatacagacacttgaagcaaagccaccccaagtgccatttgaaaaggaggaattgttacgtacttctgtttaccgcgtggatgtgttggaagctgaactaatttctatgaagaaggtcttgtatgagacattgattcggcaggatgagctgcttgcatatattgaccaacaacagacagcaaaattttgtcggcggaagttctgcttctaagggcctgtttggaagagctccggcagctagcactgtattgtggcggagccgtcggagcctcaaaacgctgggtcctccggctcctgcactttgcagttgtattttgccaaagccagagccggccagctccgcgttacagtgcagcacagtactgtaaagtgcacctgcgcagggagccagagccggcgagagcgggtgccaaacagcctcgaagtactggagtacctgccacctattt

SEQ ID NO: 430 - DNA, 495 bp, Sorghum bicolor
aaaggatccttattggcatctctctccgtccctgcactcctccactgggggagtcgcgccggccaccacagcgcagaagaacacagcacccgcctgcctcgccgccgcaatggccgccgccgcctcagctgcgagatccttcctccggtccagcggctcatcatcactccgcagcgcggcagccagagccgcctcgcgtgccggaccggctccgctgccgaggcggatgcccacctctgccccccgcgcactcctaaggtcgccggtggagatgagcagcgtgtgcctggagtccctgatgcccatgcacagcgccacggcttcggcgctcatgacgtcgctactcgctgccccggcttgcaagggattcggttggctatcagaagctggtaatgatgacgtgtgacagtctctagatggaacgtagcagactattatcccgtcacctcagatctacagatggatgatttgtcgttattggagtagggtaccttt

SEQ ID NO: 431 - DNA, 3745 bp, Sorghum bicolor
tgtcctaaatacgctcctctccgctgcgatcgctgcagcgatccgatctttcgccggtcaccggcgccggagacgccgggctccataatcatggctgtgtcgggcgcccccgagcagccacagcgggagcagccacagcaggaccacgatgaggagatgctggtcccgcatcaggatgccattgaggggccgcagcaggatgttgttgagggtccgcagccgatggaagaatctgcatccgctgttgagaaccaacttgtgccagatacctccacatccagatttacatggtgtattgaaaatttttctaggcgcaatgttagaaagcactactctgacgattttattgttgggggatacaaatggcgagtgcttgtcttccccaggggaaataatggtgaccacctttcaatgtatctggatgttgctgattcaaacttgctgcctcctggttggagtaggaatgcacaattcagccttgctgtggtaaaccaattagacagcaaagcatcattaagaaaagaagcgatacaccaattcaattcccgtgaaagtgattggggttttacatcttttatgcctttgttggatctgtatgattcaagtaaaggatatgttgtgaatgataaatgtatcatagaagctgaggttgctgtgcgtaaaacttttgatttctggaactatgactccaaaaggatgactggttatgttggcctgaagaatcaaggggctacctgttacatgaactctcttcttcagactttataccacattccctactttcgaaaggctgtatatcatatgcctactacagagaatgatacaccttcagggaacattccattggctttgcaaagtcttttttataaacttcagcattgtgataacagcgttgctacaaaagagctcaccaaatcttttggatgggatagctatgattcgttcatgcagcatgatgtccaagagttgaatagggtcctatgcgaaaagctggaaaacaagatgaagggaacccccgtggaaggagcaatacaaaaattgttcgagggtcaccatatgaattatatcgagtgcattaatgttgactcaaaatcgaccaggaaagagtcattctatgatctcgcacttgatgtcaaaggatgttctgatgtctatgcatcatttgataagtatgttgcacaggagaggttagaaggcgataataagtatcaatctgaggaacatggtctacaggatgccaagaaaggaatgctttttattgacttccctccagttttgcaacttcagttgaaacggtttgaatatgattttgtgcgggatacaatgctcaagataaatgaccgttatgagttcccacttcaattggatcttgatagagatgatggaaaatatctttctccagatgcggatagaagtgtgcgtaacctatatactcttcacagcgtgctggttcatagcggcggagttcatggaggacattactatgccttcattcgcccgaagctgtctgatcaatggtacaagtttgaggatgaacgagtgacgaaagaagacatgaagcgggcattggaggaacaatatggtggtgaagaagagcttcctcataccaatgggcttaaaaatgctcctatcagatttacgaagcattcaaatgcttacatgcttgtttacatccgagaaagtgacaaagagaaaatcatctgcgatttagatgatgaagatataccagaccaccttaaggttaggttaagaaaggaacaggaagagaaggaatgcaagaaaaaagagaaggctgaggctcatatgttcactgcattgaaggtggcccgagactctgatttcaaagagcaaattggaagacacatgcattttgatctcgtggactttgacaaagttaatagcttccgtgcacctaagaacatgtcaatcaacgatgtcaaggaggagctttcgaaagaatttggcatcccagtagaatcccaacgattttgggtgtgggcaaaacgacagaactttacctacagacccagtcggccattgaccttcctggaggaaacatctgctattgggtatctcaaagacgcaatagtggcaaagttaccaaattctgaagtacggttgttcttggaggttcatttgggacaggagaatcaaggaattgcttctgggaagaccaaagaagatatattaattttcttcaagctctatgatcctgaaaaggaagacctaagatatgtaggaaatttttttgtgaaagcatcaggaaaaccatctgatatagtagaaaggctgaatgagatcgccggatttccgtctgatgaagatattgagctctatgaggaagtaaaatttgaaccagcggtgatgtgtgtaccaattgagagcaatatttcgttccgttcaagtcagattgacaatggtgatataatatgctaccaaaaacgctgtttgccagattcaatggatcgataccgatatccaagtgtcccttctttctttgaatatattcataatagacaggttgtctacttcagattgcttgataaaccaaaagaagaaggcttctctctggagctttcaaaacgctccacatatgatgatgttgttgagaaggttgctcggcaactacgtctggacgatccttctaaaatccggcttactcaacacaacctatcgtctcagcaacccaaacctcaccacatcaaatacaggagtcttaattatctttcagacatgctacataatcataatcagatgtgtaacattttatattatgacgtcctggatattccgttgcctgaactagaatctacgagatcactgaagatcacttttgaaaacgccacaaaccatgagatgtcgtttcacactatgcggttaccaaaaagtaacactcttcttgatttgattgaagacttaaagtcaaaggttgaactttcttgtaatgatgctgaatttcggttttttggagtccaccttcacaagatatgcaaggtgtatcaacctggagataagatagattcagttaacgaacccttgtatattgaagaggttcctgaggaagaaaaaaatgctgggcctcatgaccgtttggttcatgtctatcacttcgaagataatcgtcatgttcagtattttggagaacctttcttctttctaattcgtgatggtgaagctttgtcggatatcaaagtacggattcagaagagacttcaagttcctgatgagcagtttataaagtggaaatttgctcatgttacattcagtaggccagaatacctccaagattcagatattgtattgaaccgattccataaacagaaacctgtttatggagcttgggaacaacaccttggattggagcatacagccactaccccaagaaggtcgtactttggcagtcagaaccgccattcttttgagaggcctgtgaagatttacaactaaaactggcaatattttttgcatgtgatgaatgatgaacaggatatgatggcagtcttgttccaaaaggagtctcttatgtttttggtgatgtacatggtggaggttttgcatagagtagtttatgtggcaatttatcagaagaattttcatttggtggatgtacagggttcgtatagcaacatttccttgtagcaagttgaagctgtatatcgagggtcgataacctgtgtttttgtcgtttcgtccccaagcctctggggagctgtgaaccatagcctcatacaatttgcgttgcagt

SEQ ID NO: 432 - DNA, 1456 bp, Sorghum bicolor
tgagttctctagcaccttacctgctactgatctgcagctgatcgatcgccaaagcttgcaatcaagcctgctatattaccctagctagtgactataccaccatcatcgccatgggctgctacggtgatttcttcgagaaggccaagccttacatcgccatgacctccctgcagtttggctacgccggcatgaacgttatcaccaaggtgtccctcaaccacggcatgagccactacgtgctcgtcgtctaccgccacgccttcgccaccatctctattgcaccatttgctctcatccttgagaggaaggtgaggcccaagatgacgtggtcggtcttcctccagatcttcgtactcgcactgctcgggcctgtgatagaccagaacttctactacgccggtctcaagttcaccgggccgactttcgcgtgcgccatgagcaacatccttccagccatgaccttcgtgatggccgtgatttttaggatggagaaggtggacctgaagaaggtgaggtgccaggcgaaggtggccgggacgctggtgaccgtggccggcgcgatgatgatgacgctgtacaagggcccgctgatgaagatggcgtggaccagcggccacggccacgcgcaaggccacggcgccgaggcgcccgctgccgtcgccgccgccatcgaccccagcggccgggagtggttcctgggctcgctcttcgtcatcatcgccaccctcgcctgggcctccctcttcatcctccaggcgcacaccctgaagcagtacgcggcgccgctctccctcaccaccctcatctgcttcgtcggcaccctgcaggccatcgtcgtcaccttcgccatggagcaccgcccctccgtctggaccatcggcttcgacatgaacctcctcgccgccgcgtacgccggcattgtgacgtcgagcatagcgtactacgtgcaaggcctggtgatccagaagacggggccggtgttcgcgtcggcgttcagcccgctgatgatgatcatcgtggcagtcatgggctccttcatcctcgccgagaagatattcctcggcggcgtcctcggcgccgtcctgatcgtcatcgggctctactcggtgctctggggcaagcacaaggagacacaggagaaggaagaggaagaggccatggagctgcccgtggcgtccaaagccaacggatcgggaataatctacgacgacgccgtcttcatcaaggagatcgccgccgtccccgccgctggtgttggagatgagtgcaggaaggccaatggggtggtgtacaagtcatcctcctcccatggacacggagctgctggtgcagtttgatgcagcatgcatggctagctagtgctaagctgagcgcatagctactactacctggatggaacatggaagaggcggtgtccatatgctgactgtctttgtcatgtgtgtcccattgaaac

SEQ ID NO: 433 - DNA, 1961 bp, Sorghum bicolor
ggctcatctctgattatggaggtaacagtcgtctagcacaccgcaccgccgggcgtccctctctgttgtcgttcccagtttagaggagagtttttgtttcggttccttcgttccacccagcgccgcggcattctgtgggtcgtgtggatttgatttggccgggggaaggaggctggtcaaagatttgtggtggaattgatggtggggttcatggaatgggtgcatgactggttgctgtgggacgccttcttggagtgcggagggatcatgaggccaccgattagatagcggctggggagcgagggaccaccggaggcggaggccgccgttagcacccacaccaccccgcggcgcgtgtccgcagccatgggggaagacctcgtcaccaccctgtccatggagaacggcggcggcggcggcggccaccacggcccctgcacgctcctctccatggacccgtcgggccacctctccgcgccggacgaccgcgccgtcggcgtcatggtgcaggccctcatcggaggggccgtcggcgtcggcgcccgcgcccacgccgtgtcgccctccggcgcgcctccgcccgacatcaaccagccctggcagacggacctctgcgacatgctggacgtcggcctcggcccgcaggtctacagcgccgaggcagtactcagctgcgctcccaaggccgggaaccggaaggccgccaagcgcggggacaccatctggggcgcctggttcttcttcaccttctatttcaagcccctgctgtccgacaagtgcaaggacaaggtcgtccgggacaacagcggcgtctccgggttcgacaagtcggacctccgccttgacatgttcctggtgcagcacgacatggagaacatgtacatgtgggtgttcaaggagcgcccggagaatgctctggggaagatgcagctcaggagctacatgaacgggcactccaggcctggggagccgcagtttccattcagtgtcgacaggggatttgtgcggtcgcacaggatgcagcgtaagcactaccgggggctgtcaaacccgcaatgtattcatgggatcgaggtggtcaggtcaccaaatcttgcggggctcactgaggcagaccttaggaggtgggcagagcttacagggagggagctcaatttcatcatcccgcaggaagccagtgattttgggacatggaggaccattacaaactcagagcttgagcttgagaagccacaccctgtcatgaagagcaatggtacccagaacccaaagaaagcaggcttgaatttgtcatcaccgtccaatcattcaggcgaagatggtatggatctctccccagttagcagcaagcgtaggaaggaattatccccacaagccatggatgaggaagtattcttcccactgaattcttgccctcagaagacacaacaagatgtggagatgcattcaccagcgcaacctgcatggctccatgagtttgctggggtgatgaaaaatgcttgtgggccagtgactgctgccaagtctatctatgaggatgaccagggctacttaataatggtcagcttgccgtttgttgatcagcagagggtgaaggtttcgtggaggaacactctgactcatggcattgtgaagatcgtttgtgttagtactgctaggatgcaacatataaggagacatggtaggatgttcatgcttgccgatccttcccccgagcactgccctcctggggatttcattcgtgaaatacctctagctactcgtatccctgaagatgctaagctggaggcatgttttgatgaggctgcctccgtgcttgagatcatggtcccaaaacgaggaaatgaacctgaagagcatgaagttagggtctctctgcgaccccctcactttggagctaatgatctacttttgacctaagctgagtaaggtctctgcaccatgttccgtcttgtttgtaa

SEQ ID NO: 434 - DNA, 4552 bp, Sorghum bicolor
aaacccgggtagatccaccacaggagaggagaggagaggagaggagaggagatctccccgtccccgatccaattccgcagagatggactcctcctcccccttctcccctgacgaccagaccgacgccgacttcttcgacaagctcgtcgacgacgacgacgaccccgccccgccgcccgccaccgacttgcctcggcccgtctccgccaccagcctcaacgctgcagacgacccacccgccccggagccgcagcctccggtgccggcgcctcccgaggggtcaggcaagggcggagccggcgtccacaccgcggtcaagcaggtgcagtgggcctccttcggaggtggcgcggacgacggtcctgatccgttcgctgatctctcgggaggcgccggcgacgacgacggcttcctcgggagcacggccgggacccagacggcctcgggtcaggacttcttcgctgggaccaactcctcctccgatcagcagaatgtcaatggtcagcacgatcagggaggtggcaccagcactgcagtggacccagcagatcccaagtcttgggaggccatgtaccctgggtggaagtacgacgaggcatcgcagcagtggtaccagcttgatggcagtgtaaattcaaccgggaatgcagctcaggtgctggagaatagcaatcagaatgcgcagcagcagctcaacacgtcttacctgcacaattcgtcgcatgcggggctcgagacaattgctgaggagggcactgccgcagccggtgctgtctcaagttggggccaaggggccgcctcagagtacccacccaacatgctcttctacgcagaataccctggttggtactttgacaccaacactcagcagtggcactcgcttgagtcgtaccagcaggctgctatgcaggctggaacagctagcacgggtcagactgttgttgcaaacgatgttgttgctgcgaattcctcctcgctgacaggctataatgctgcacaaactgaagatgttgctgcccacaatcaggtgacccatcacaattcattctcaaatagtttcactctgcagaaccaatggcagactacggatgcatttggtaacaatgtacgatctgaaagtgctacagataacagcctggctagtagtttctatggttttgaacaaaacaggaatgctgagactaccacttcctctacgagccaacaggctggttttaacacagttgaaactgttacagatcactatggtgcacgcaagggctttgaatcatcaagtcttcagagtggttatagctcatctgacagtcaacaatccagttacaaggcattcgaaccttccacgcgttataaggctggttacaaagcgtttgaacctgccatggataaccagagtggctacaaggcattcaaaccttctacgggtcaccatagtgcttcccagggattcatgccctccacgggtcaccggactgatttcaagggttccagagcttccacagttcaccaggctggttacaaagagtttgaaacttctacaggttacagtacaagtttcaaggcatttgaaccctcttcatctcaacatgctggttacaagggttcccaacctaactacacgggatttgacagttctgcaaaccaccatggttatggtgatgccaatggtgttgtgagtactcaaggctttgtcccaatgcaaaccacgtaccaaggccagaaacaagtaaatgcaacctcgcaagggcacctgtcaaatagttattttggtactgaaaactccatgaactttaatcagcaacaatttctgggtgcaaatgcgtcaaacttgcaattcgatcactccccacatgaaggcaggtcatcggctggtcgaccaccgcatgcccttgttacttttgggtttggagggaagctcatagttttgaaagaaactagctccatgcccgcaagctttaacactggaaatcagttcaagggtaactctagtagcacagtttcagttcttaatctgtcggaggtggtcattgatagagttgatccttcaagcatcactaatggtagtgcacttagttatttccatgctctgtgccatcaacctgttcctggccctctggttggtggaagtgctgcatcaaaggatgtaaataagtggcttgatgaaatgattgcatggtacgagtcttcctctagtgaattccagaaaggtgatactcgcaagttgcttatttcattgttgaagatactatctcagcactatggaaaactccgttcaccttttgcgtctgacccattgcaagaggagacaaatggtccagaaatggcagtaactaagctattttcatcgtgtaagagaagcactgctcatatgggagattatggatccattgttccgtgcatgaaaaatattgcttcagaaagtcagatgcaggctgttgcacaagaggtgcaaagtcttctagtttctgggagaagaaaagaggcccttcagtgtgcccagagaggtcaactttggggacctgcaatcatactggcattgcagcttggtgatcagttttatgtggatacagtgaagaaaatggctcacttccattttgtatctgggtcccctctgcgaacgctatgccttctcattgctggacaacctgcagatgtttttaatgtagagaacaatgtcaacagtgactatggtacatcccgtcaacctatggagcctggtcctaatggtatgttggatgattgggaggagaatttggctataattactgcaaacagaacgaaaggtgacgatctagtaatcacccatcttggtgattgcctctggaaagaaaaatatgaggttgcagctgcccattcatgctatttagttgctgaactaaatattgattcatactcggaaagtgcaaggttatgcctcattggtgcagaccacttgaagtgtcctcgaacatttgccagccctgaagccattcagaggacagaggtttatgaatacgcgaaggtgcttggtaattctcagtatattctactaccctttcagccatataagctgatatatgcatacatgcttgtggatgtggggaaggtttctgattctttgaggtattgccaagcatctatgaaggtgctgaaagcctctggtggtgcccctgaattggaggtgtggaaacaattattttcttcactggaggagaggatacgcactcaccagcagggtggatatggaacaaatcttgccccagcaaaactagttgggaagatttttacctcgcttgataaatctatatcccacatgatgggtacaccatctgcaccacttccaccattaccacatggatctgttagtgatagagagagccactctatgcctgcagcagcaaaatttggaaatagccaatcggcaatggccatgtcatcgttaatggcatctgcttcaatgcagtcaatgactgagatagcagagaatagtggtggcactggcaggacaattgcacagaacagaagtgtttctgagccggagttcggtagaacatcaaaacagggtgctggatcagatggcacacagagtagtgcatcaggatctggtagttctcgatttggttggctagtgcagaagactatggatttagtgtcgaaatcccaccgccaggcaaaattaggggatcagaacaaattttactatgatgaaaagttgaagcggtgggtggaagaaggtgctgctgttcctgccgaggagcctcctcttcctccacctccaacaaaaccatctttccagaatggtatgccagaccataagttgaatggccccgtgagtgtaaaccatgctcccaatggagtcacagaatggaaatcctcaaattcttcggatcaaggaggtctgggtatgcctccaattccacctagccaaaaccagttttctgctcgtggacggatgggtgtccggtccagatatgttgacacattcaataaatcgggtgcgtctggagcagtgccatcatataacaaaccagctgctccatctgtgacaccaccagctggtgccaagttcttcatgccgactgcagcacctgctgctgcagatcagatggtgccacaccaagcggcagagatacacagtgaaaccatccatcaggatgagcggtcagcctcaccaccagcagaaacatcaatttcttcaaccccaccacccacacaattttcatcacccccaccgcacttgcaattttcatcaccaatgcaatcaacaattcatcggcaatctagtatggagaatatctccaccccttacctgggttctggggtatcatcattaagcagcagcagctcattctcaaaatcacgagccgcatcctggagtgggacatactctgagcagtatagtgcttttgcgggcactcaatcacctgacagacagacgatgccttcaccactcatgcctggcaaaccatcacacagtcgttccaacagcaactcatcactgcagctcaatggattggcagaggatcttcatgaggttgagctctaactgatcactgctcagcattaacccgggttt

SEQ ID NO: 435 - DNA, 2241 bp, Sorghum bicolor
gacgagatcttgcactagatgggacttatttgatgttttcgccattctctacttcggtgcgagctaatggatctctacatgaaacttctcctggcctccctcagctgtattctcctgatgcaagcagcatcatgtgatggcaccacaggcgaaactgaaacggcaaactggacatgtgtatgcgcagctcatccactagatgaaccaaactctaacagcagcctgttgtccaattgctcttcatcctgccattgccaacaagatgataatggtggcacagggtcatggaactgcacatgtgccgctgataagggccttcagaaagaagaacatgctgtgctacgtgccaggagttgcttcacttcctgtaactgcacatctggtattggaagttcagaggaagggaaaaggcatgtctccagcaaaacagtcataattacgctcctagtttgtgtgattctcaccactactgctttccttgtcaccaccgtatactacttccgccgcaaggatgctctctctccacgatcgcagatatactccttcgataaatacactagctggagcagcagatcgaaccttgtcagcaatcgatcgtctccacttccccaattgaaatcaaaaccaaggcttggtgttttaaaagagtttctgtgtagctgcaacctcatctgcgggggcgaaagcggcacgttccctggtgtcattatccggttttcatacgcggagttggagcaagcaaccgggaaattctcagacgagcatcttatcggagttggtgggtcgagcaaggtgtaccgaggccagctcggcgatggcaaagttgttgccgtgaagaagcttaggcccctaggaggtgcagatgaagacttcgaattcctatcagagatcgagctgctgtcgaggctgaaccactgccacgtagtgccattgctggggtactgctcggagagccagggccggcagctggagaggctgctggtgttcgagtgcatgtccaacggcaacctgagggactgcctggacctgaagcaagggaggaggcccatggactggcagacccgggtgagcatcgctctcggcgccgctaggggggtggagtacctccatgaggcagccgccccgcgtatcctccaccgtgacatcaagtccaccaacatcctgctggatgacaagttcagagccaagatcactgaccttggcatggccaagtgcctgatgaacgacggcgtgacgagctgctcgagctccccggcgcggatgctgggcacgttcgggtacttcgcgccggagtacgccatcgtgggcaaggcgtcgctcaagtcggacgtgttcagcttcggcgtcgtcgtgctggagctcatcaccgggcggccgcccatccacaagtcgtcgtcgacgagggccgacgagagcctcgtcatctgggcgacgtcgcggctgcgggacagcaggctggtggtgacggagctgccggacccgacgctgcagggcaagttcccggcggaggagatgcagatcatggcgcacctggcgcgggagtgcctgcaatgggaccccgaggcgaggcccaccatgacggaggtcgtccagatcctcgccaccatcgcgccactccagcagggcgccaagcgccggaacctccccatcgccgccgccttcaacctcacggcgtcgccgcacgttgggaggtgcgacccggagcctaaggacgacgacgacgacatcgagaggcaacagctgcagcagcaggagtgctcgccgacgacgcccgtccagtggaaacagcaagcgcggcgcgcgccgtcgccgccaccgggccgcgcgtcgtggcccggcgacagggggaacgttgtgagcagaggcgcggtggtgtcgggcgagctggtgaacgggacgctgctgatgagcccccacgggcggggaagctggcggcggccgccaccgccgcctggcgacgacgaggaggcggtggacgtggacctgacggagcctcggatggaggcgttcacgcagccggcggcattcagatgacgaaaggattagcaggatcgggaggagatggtgatggttttgattgctgcatcagcggcgggtgctgtacatcttcttgttcatggctccacgatccacagcagcatctgcttctgcttctgcatctgcgtccatgaatgtacagtacaggcaaacgcatctagatcgacaaggggaaaagaaatggtattgagatcgttgtgggat

SEQ ID NO: 436 - DNA, 1318 bp, Sorghum bicolor
tcgacaatgctactgaagcaagatagggcgtgcatataatcccaagctcctcatagaaatgaatacagattttcatatgactgaaggggaaggagaatggagctactccaaaaattctaggcgtcaagaaattttttttcttgagacgaggccaatgattgagaatgccataaaagaagtgtacacaactcttctccccaaaactatgatcattgctgacctaggatgctcttcagggccaaacacaatgctcttcatatctagtgtcataaacatcattgttgaaaaatgtaaatctactggagatgattgcatggaacttcaattcttcttgaatgaccttcccggtaatgactttaatgaactatttcggtcaattgagaagttcaaaaggccaaatacaacaggtgaaagggaacatctaccacctttatattatattatggggttaccagaatcctattacaaaaggctttttcctcgtgaaagtgtccatctattccactcttcatactgccttcactggcgctcccaggaacctgagggactagaggcatggagaaaaacttatctaaataaaaacaacatttacattacgaagaccacaacaccttttgtggtcaaacaattccaaaagttgttctacaaggacttctccctcttcctacagctgcgtcatgaagaacttgtgcatggagggcaaatggtccttatatttcttgggaggaagaatgaggatgtatataatggtgatctcaatcaactttttgcattggttgcaagatcgttacagtctcttgttttgaagggcattgtggagaaggaaaagctagaatctttcaatctaccaatctatgggccgtcggttggagaagtgaaggaactagtcatgcaaagtcatttattcaacatggatctaattaaacaatttgagatgaactgggacccttttgatgatttagaaggtgatgatgttgaggataatacccgcagtagcatgaatattgctaagttcatcatgtccgtactaaaatatttaattgttcaccattttggagaaaccatactcgatgcatggtttgccgagttcaagtgcctcgttggtgagcaccttgaaaaggagaagaccaagttcaccgtcatcgccatgtccttgaagaaagaataatatagatctatatgtgtgttgtttctcaattcttttactcaaatgccaaagaatattatgtatgtttgtatttgtgcatgtgtctctctgtgtctgtacatgcatgcatacatgtctactcctactttgtgtagtcactccaatgtgtag

SEQ ID NO: 437 - DNA, 1303 bp, Sorghum bicolor
gtgtccgtccggtgagatagctgggggacgcgccggctcgtgctgtgacctggaagctctggaggcgctgaaagcggcctggcaggcgggcgatggggtgggggtggtcttcctgctgcaagcggtcggacggggctgagcctggtaggaggaagaagaagaaggacacgacgtggcggatcttctcgctgaaggagcttcagtcagcaacaaacaatttcaattatgataacaagctcggcgagggtggttttggcagtgtctattggggccagctctgggatgggtcacagattgccgtgaagaggctcaagagttggagcaacaaagctgaaagagaatttgctgtcgaagtggagattttggcacgagtgaggcacaagagccttttaagcttgcgcggatattgtgctgaaggccaggaacgcttgatagtctatgattatatgccaaacctgagcatacactctcaacttcatggacagcacgcagcagagtgcaatctcagttgggaaagaagaatgaagattgctgttgattctgcagaagggatcgcttatctgcatcactatgcgacaccgcatatcattcatagagacgtcaaggcgagcaatgttctcctggattcaaatttccaagctcgggttgccgactttgggtttgccaagctaattccagatggtgcaacgcatgtcaccacaaaggtgaaaggcacacttggttatctcgcaccagagtatgcaatgcttgggaaggcctctgaaagttgcgatgtcttcagttttggaattatgctcctagagcttgccagcgggaagaagccagttgagaagcttaaccccaccacgaagaaaaccataactgagtgggctcttcctctagtccgtgacaaaaagttcaaggaaattgctgatccaaagctcaaggatagcttcgtcgaggatgagctgaagcgaatggtgcttgttgggatcgcctgttctcaagacaagcctgaacagagacccataatgtctgaagtcgttgagctgctcaaaggagaatctactgagaagctttccaacctggagaacgatgatctgttcaagcctgatagctcattccagagctcatccggacctgatagctcagactgcgtcaccgaggagaggagtcccaaagctgatgcgatagaggaggcagttgattcaagtgagacagttccctcagcaaggtagcgtgatgcatagtggtgttgtctgtaggtgccctgagctccttgcctgggagaaatgtgtttatcagtgtgcttaatttgggagct

SEQ ID NO: 438 - DNA, 1668 bp, Sorghum bicolor
agcaggcatatagatcggtcctcgtcaagccgccccgaaggtgattcacgggtgcaccgcggcactttgccggccagctcgatcagggggaggcccgacgaagacgtggcagcagaggtccgagtccgatccatgggcgaggaagcagcggccgcgcccaccgtggcagcagcggcagcgacaggaaccggcggcgccccgccgcacctgctcctgatctgcttccctggccaaggccacgtgaacccgatgctccgcctggcgaagcgcatcgcggcgaaaggtctcctggtgaccttctcctcggtctccaccgtcggcgcgaagctggccgcgtcggcgggcgtgtcggccggcggcgacggcgtggccgtgggccgtggccgcgtccggttcgagttcctcgacgacgaggaccccggccctgacctggacgacctcatgcggcacctcgccagggaaggaccgccggcgttcgcgaagctgctggcgcggcaggcggcggagcgcaggcccgtggcgtgcgtggtggtgaacccgttcatgccgtgggcggccgacgtggccgccgacgccgggatcccgtcggcggtgctgtgggtgcagtcgtgcgcggtgttctccctctactaccaccacgtgcacggccttgtcgagttcccgcgcgaggacgaccccgacgcgcggttcacgctgccgggtctccccgagatgtccgtcgccgacgtgccgtcgttcctgctgccgtccaacccgtacaagctgctggtggacgcgatcatcgcgcagttccgcgccatcggacgcgcgtcgtgggtgctcgtcaactccttcacggagctcgagcgcgacgtcgccgcggcgctcccgggggtgactccccgcccgccggagctcatccccgtcggcccgctcatcgagctcgccggcgacggcgacggcgcggtgcgcggcgacctgataaaggccgcggacgactgcgtggagtggctggacgcgcagcccccgcggtccgtggtgtacgcgtcggtgggcagcgtggtgctgctcaacgcggaggaggtcggggagatggcgcacgggctcgccgccacggggcgaccgttcctgtgggtggtccggccggacacccgggagcacctcccggaagggttcctggacgccgtggccgggcggggcacggtggtgccgtggagcccgcaggacagggtgctggcgcacccgtccacggcctgcttcctcacgcactgcggctggaactcgacgctggagaccatcgcggcgggcgtgcccgtcgtggcgttcccgcagtggggcgaccagtgcacggacgccaagttcctggtggaggagctcaggatgggggtccgcctccgcgggtcgccgctgcggcgggacgccgtgcgggaggcggtggaagcggccgtggccggggccgaggcagacgccatgctcgccagcgccaggaggtggagcgccgcggcgagggaggccgtggcgcccggcgggtcctcggacaagcacgtccaggcgttcgtggacgaggtggcacggcgagcgtgtggcgtgcaagcggctaaggtcgtgccgccgccgccgccgtcgtcagagactccagactcgtagagcaatcagcagtcaccagttaagagagtccgaagctgatag

SEQ ID NO: 439 - DNA, 1997 bp, Sorghum bicolor
gagctatgccactccgcttgcccgcctgccgcgtcttcctgctcctcgccacggccgccgccgtctcagcgtcggccgagtccaacagctccgccaactgcaccttccgtgacggagacatcatccgcgcggcgttcagccaggtcgccaacttccccttgccgctgcctgctcctgctggccgccgccgccgcgcgtcgtgccgccccgtcaggcggctccacttcccgtcgcggaacctcacgggcgccgtgaactgggccgagctcgccaacctcaccagcctcctcaccgtcgacctctccgacaactccctccacggccgcatcgacgacgacgcctcgttctggcgcgcgccgctgctccgcgccgtggatgtctcccgtaaccacctccaaggcgtcctccgcttcgacgacgacccgggcacgcgcctcgcgtcgctcaacgtgtccggcaaccggttcacctccgtccacggcgtggccgggctctcccgcgtggtccacctcgacgtgtcgaggaacgccatcggaacggtgccggagggactgcggagcctgacgctggtccgcgtgcttaacctgtccgggaacaacatgaccggggtgttccccgacgacctgccgcctctcgccggcatccaggtcttggacatctcgcacaacaacttctccggcgcggttgacgccgccaccgtccttaagttcggcaactcctccttcttccaagccggcaacgcgttgcgagtgatcgacgacgtcgcaccggcttcttcgccggcgctggcgccgtcgtctaatggcggagacatgaacaggcgtgcggtcaccatagcgctaatctcagtcggcgcaacggtgaccctggcgtgcttggccgcgtgcgccttgacgcgtcgtcgccggaacaagaagaagaagaagaaggacaaggacgggaaaacagcggtgtgggaggacgaggaggtggtggtgggggcggtgaaggtggccgcggcggcgccggtggtggtgctggagcggccgctgatggagctgacgctggcggacctggccgcggccacgtccgggttcgggcgcgagtcgcagctcgcggacacgggcggccgcagcggggccgcgtaccgcgccgtgctccccggggacctgcacgtcgttgtccgcgtcgtcgagggcgccgtggctggagttgcggaggacgccgacgccgccgccatcgaggccgggttccgggagcttgcacggctcaggcatcccaacattctcccgctccttggttactgtattgcagggaaccaaaaacttgtgctttacgagtacatggagaaaggcgacctccaccggtggctccacgagctgccagtggggagcatggacaccgaggacatctgcatggacaccatggaagccatcgaggacagaaaacccgccggcgactggccgactcggtaccgcatcatcctcggcgtcgctcgaggtctcgcgttcctgcaccaggggtggacgggggcggccgccgggtccggccggcggcggcggcccatcgtgcacggccgtctggtgccgaccaacatcctgctcggcgacgacatggagccccggatctccgacttcctgcaccgccccggcggcggcggcggcggcgacgagacggcgacgccggcgagcgacgtgtaccgcttcgggacggtggtgttcgaggtggtgacggggcaggcgaggtggggcgacgcggcgaccacgagctgggcgcgcggcgtgatccggaaccgcaagggcctcaacctcgtggacgaccggctccgggacgagacggcgggcacggacgccgagaaggagatggccgagtgcctgcaggtcgggttcctctgtaccgccggcgcgccggagaagaggcccaccatgcagcaggtggtcgggctgctcaaggacgtcaggccgccggcgacgaccgccggagccggaggagtgccgccgctcggggtctcatgatga

SEQ ID NO: 440 - DNA, 533 bp, Sorghum bicolor
cggagatgaacgttgcggaggaggaggaggtgagcatggcgggggaggagaagggcggcgctagcggcggtgttcgcgatggcgaggtgaggacggcggcggcgggtgcgggggcggtgagcctggagacgctgcggaagcggatggcggacttcgcgacggagcgggactgggagcagttccactccccgaggaacctccttctcgcgctggtaggggaggtgggggagctgtctgagatattccaatggaaaggggaggtgcccaaggggctgccaggctgggacgataacgagaaggagcacttgggcgaggaactcgccgatgtgctcctctatctggtgcggctgtcagacatgtgcggcgtcgacctcggcaaggctgccctgcgcaagatggagatcaatgcccgcaaatacccagttgggcagtgcaagggttcatccaagaagcacactcactacggctccactaacaatgttagcgacaatgctaacaccgtgaacaaggagaacagcaatggcgtctaataa

SEQ ID NO: 441 - DNA, 1370 bp, Sorghum bicolor
tggtactgttgcggtattctccggaacactctctccatccccatccccatccaccaaagcagcagccagcagcaggtgttctcaaaatgcagtcatctgtgatggcgttcttccctagtgttgccacagcaaaactggagctgaattctctgtacaggaaatatgtggacatgtttggtatatcgttaaacaactctaccgttggctgccatctcacccgcaaaatggcgcaccttcctgttctgttgatcgatcgtacatttttcagtactggttctgctattcagagtattgccaccagctacggagctcttattcgtaggtggttactgaacagaacttctgttgtacagcacacgctgatttccagtgctatgaactcactgtcttggtgtggctccttgccattctttgtcagcattggtgttctaatcaccaagctctgtgactgcactatgaccccgaaccgtttttgtggtcggcaatgcatccttagtcatagtgctaacctccgtggagaatcagttttggtcatggacaataatgaactgggcaatgatcagagcttcttatcaagtttccttgggcgcaagcgagattatgtcgtcctagcgcttcagtgcatctgttaccctgcttgtctgaaggttgttgatgtcccccacaagaagctcagcttcagcaggcagtggatacggactggccatgacacaagtgcaatttggaggatcatggcaaggaatgaacaatacttggcatgcatgatagtcctggcagccttgcaagttttcctgcggctaaccagagtgaatgttaccattctgttcttgccaatgctgtcccgagccataagttccaggagcagcccagcagtgatcggtaacatcgtgctggttttggtgaactcctgtggagttcttggatctgcactttcagtgaaacagcttggcagggaggtgacgttcgccatcagtgccatcgtgatggtaatttgccaggtcgcaattccattgatcctagaagttcagatcggagttggtggtggaactcgcatgccgatgggttacacaacagcgatgttcgtcctgacttgtgttgtctcctgcggcctcagctggtcatggggttcattcttctggaccttccctggtaggaaggttcactcggctggacaggttctggccatggctgtgaacctgggcgtctgcttcgcccagatgcagtacttcctgctggtgctatgcaggctgaagaacgccactcttgcctactatgcactgtggatctggtcatgattgggattcagctgaggaaaatgcgtagctagatgagtgtgtgttaactctggttacttgagtgggttagtttgg

SEQ ID NO: 442 - DNA, 1187 bp, Sorghum bicolor
cgaaaatgagtgataacctgatggacaaggttagcgcctttggcgagcgcctgaagatcaccgggacggaggtcagcaaaaagatgacggctggaatgagctccatgagtttcaagatgaaggagttgttccaggggcagaccccggctgacaagattgttgaggacgccacctcggagaatctggacgggcctgactggaactcaaacctggagatttgcgacttgatcaacacggagaaggttaacagtgtggagcttatacgtgggatcaagaagaggatcatgctgaaggatgcgagggtccagtacctctccttggtcctgcttgagactattgtgaagaactgtgagaaagccttctcagaggttgcggccgagcgtgttcttgatgagatggtcaggttgattgatgaccctcagactgtggtgaataacaggaacaagacccttatgctgattgaagcatggggggagtctggcgatgaactccgctatctaccagtctatgaggaaacatacaagagcttgaaatcaagaggagtgcggtttcctggacgtgacaatgagagcttggctcccatatttactccaccacggtcagttgctgaagctgatgttgactcaagcttgccccagcaagcattcgaagacatccatgttcatacatatactgctgaagaaacaaaagaagcatttgatgtagctcgtaacagcatagaacttctttcaactgttctttcgtcttcccctgaacaggatgctttgcaggatgacttgacagccactcttgtgcaacaatgctaccaatctcagcacactatccagaggattattgagaccgttggagacaacgaagctgtgctctttgaggccttgagcgtgaacgatgagatccagaaagtgttatcgaagtacgaggagatgaagcagcccagggcctcagagcatgcagaacagagaccagttgtcataccgattgccacagaacatgaagattcgactgctatcggcaatgaagacgcccttgtcagaaaaccagctgccgcgagagcaaggtcaggtggagatgatgatatccttgatgatctcgacgagatgatatttggcaagaagggaggtagcagctcccaggatgggccgaaaaagccagatccgaagaaggatgacctgatcagcttttaataa

SEQ ID NO: 443 - DNA, 740 bp, Sorghum bicolor
aaaggatccgtttggacttcattcgggaagaagatcaaatcatggaggcatacttcttgttccacagcggtcgggcctccgcgtgcgcggagcaggaggaggacatcggcgcgccgtcggactccgagtccccgtccacgtccatgtccagggagtccgcgggctcctcctcctcgtcggagctcgacgacgacgccaccagcacctcctcgggctcggacccggaccgcttcgagatgtccgcgctcatgacgcagctccccttgaagcggggcctgtccaggttcttcgacggcaagtcgcagtccttcgcctcgctcgccgccgtgggctccctggaggacttgcccaagccggcggcccggaagcgcatcaagccgtcgcggagctgcggcggcgccctcgacgcgcacaaccgcggccgcttcctctcgccgcgcaggcattgcaccaagcccaagcccgccgccgccaggaagcaggcggccgcgaggagcggcgcgctgtcggttttcgcggtcgccgccgtcgcgcccaggatgccgccgtcggtgacgaggcctgagggcgtggccgccaaggttctcatcgttaattgagacacggatcggcggacgctgcctgagctcaacgttgacgcacacgacacgcgcgccttgatggggttcgctgtcgcaggcacagctacgcaccgccgcatcacacccctgcctgaactaacagccaaatagggtaccttt

SEQ ID NO: 444 - DNA, 985 bp, Sorghum bicolor
aaaggatccagcggctccaagattgacgccacgatgggcttccccgtggggtactcggagatgctgctcccgcgcgtgctgctgcaggtgctcctcctcctcggccacctccaccgcttcctcctctgggccttccacgccgtggggctcggcgacctcatcgacctcggctgcaactactaccccccgccgccccccacgcccacggcgcaggagcaccaggacgcggccgcggccgcgccgctgcagcaccggcggccggagttcaggcccgtcccgtcggtgctcatcgaggaggcgctccccgtggtgcggttcgacgagctgggcgggaccgcgtgcggtgacggcgactgcgactgcgcggtgtgcctcagcggcatcggcgcgcgcgacgaggtgcggcggctcagcaactgccgccacgccttccaccgcgcctgcctcgaccgctggatgttggcgcacgaccagcgcacctgcccgctctgccgcgcgccgctcatccccggggccggggccgcggccgcggacccctgggccgccgcgggcggcgtcgcgccgtggcccgacgcgggcgactacgacatgtcctacccgtcttcgctgccgtccacgccgctgctgacggcgttgcccaccccgacgctgctgcggcctcacgagctgctgctcaccggcctgggcggcttccagtgagctgctgcgtctgcgtcgtgtgcgtggctggcgctggcagttgggcgaatccgatccgtggcaaggcaaaccgcgtcctcgatgtcatgtgcatgtgcggcccaccccgcccggtcggtcagacgggtgaccgccgccaaacctgctcgatcttcggtcgtgtctccgttggtgaaaggcgaaaccaacggcagaggagagcgctctggtttttacagctagcggctcccaagtgaaaaaaaaaaaaaaaacagacaggcactaggaaactagccaaggtaccttt

SEQ ID NO: 445 - DNA, 1965 bp, Sorghum bicolor
gagacgcacgtaggagtagagcggagcgttcctctgtttcggctatgtcgtcttgcgccggcgccacggtggcgctccgggatgccgccgaggaggccctcaacgcctctctgctctccaaagcggacgtccggctaccggtggaggacgtgccgccggtgctcacgagcaagccgccaggccggttcgccagggcggtgaaggaagcctggtccgtctcgctgtccgtcacattccccatgatgccgtccatgtcggccggcgccgcgggcgcggaggcgcggtccatcctgggcctcgcgctgccgatgatcctcacgggcctgctcctctacctccgctccatgatctcgatgctcttcctcggtcgcctcggcgggctggcgctcgccggcggctccctcgccatcggcttcgccaacatcacgggatactctgtgctgtccgggctcgccatgggcatggaaccaatctgcgggcaggccttcggcgcgggccattacgagctcctcggcgtcaccacgcagcgcgccgtgctgatgctgctcgcggccgccgtgcccatcggcggcctgtgggtgcacatccggcctctgctcctgctctgcggccaggacgccggcatcgccgcggtcgccgagacatacattcttgcctccctaccggacctactcctccaggcgttcctccaccccgtccgcatctacctccggacgcagtccatcaacctgccgctcacgctgtgcgccgcgctcgccattgcgctccacctccccatcaactacgtgctcgtctccgtcctcggcctcggcatcagcggggtggcattggcctccgtgctcgccaacctcaacctcctcctctttctcttggcttacatcctcttcaagggcgtccacaagcgcaccggcggcctcgcgctctcggccgagagcttccgcggctggggcgagctcgtcagcctcgcgctgccgagctgcgtcagcgtctgcctcgagtggtggtggtacgagatcatgatcctcctgtgcggcctgctcgcgaacccgcaggcaacggtggccagcatgggcatcctcatccagacaacgtcactcatctacatcttcccgtcctcgctcggcttcggcgtctcgacgcgcgtcagcaacgagctcggcgcgaaccggcccgaccacgccggccgcgcggccacggtcggcctcatgctcgggttcgcgttcggtggcgtggcgtccgcgttcgcgtacctcgtgcgcggcgcgtgggcgaccatgttcacggccgacccggcgatcgtcgcgctcaccgcgtccgtgctgccgatcctgggcgcttgcgagctcggcaactgcccgcagacgaccggctgcggcgtgctgcggggcagcgcgcggcccaaggacgccgccagcatcaacctccggtccttctacctggtgggcacgcccgtggcgctcgtcctcgccttctggtaccactacgacttccagggcctgtggctgggcctcctcgcggcgcaggcgacctgcgtggtgcgcatgctgctggtgatcgggaggacggattgggccgccgaggccaagcgcgcgcagcagctcaccggagcaggcacggtggaggagaccaaagacaaagagagcagcggcaagggcagtcatgccagtaaagtcacagcagccggcggagacgaggagctgggcttgcctatcgacgttgtgatcgagagaccaaaggatcagtgctgacatccaacggcaaccatctgcgtgccgttcgacaattcgagcgattttttgtcatataatttttggcgggagggagaggaaccagaggctgacagagtgactagtttatttcgaattggttatttgtaaatgatttatttctgatggttattataggaaatgagaatattgacaagaaatacgagaaacctatacctgttaagggctcgttctgttg

SEQ ID NO: 446 - DNA, 1111 bp, Sorghum bicolor
gcccttctacagaaccgaccccccgccggaaccccgccgtcggatgcgacggagaaggcgtcaatggcgtcctcctctgccgccgagcccagctcccgcctctctgatcgagcgaagaggtcgtcgctgggactcagattcatggtgctcctgatgcacttgctgttcgttggcgctgtcttcatcctcgatccgaccctcgactggcgaatccacgaggagccgtggtatatagggttgtatggagtgcttgtcctgctcacgttagtgcaatacttctacacagctggctcatctccagggtatgttgttgatgtaatgagagctggttccatgatgcatgcaaccttcgtcaacactactgctctttcaaagcagtcaaattcaagaaatggaaacacaagttccccgacgagtcgtgctcaactacagaaacttagcacgatgactcctacatcttcgtgggcacagatggttatggatctttatcctccagggtcaagcagcagggattggacctgcacttactgcagggttgttcagccacctcgtacccggcactgccatgactgtgataaatgtgtccttcaatttgatcatcactgcatatggcttggaacatgcattggcaaaaagaaccattgtcgtttttggtggtacatatttgaagaaacaatcttgtgtatctggactgctgctctctacatcgagtcattgcgtttagatatggacaaggcctggtggaaggactttgttggtgtaatcctgttggcagtgcttatttttatcctaatattcctactactattgtggttgtttcattcgtacattgctctaacaaatcaaacaacctacgaagttgccagaagaaagcgaatattctacctaaggggagtacctgaaagagttcatccattcagtagaggcatatgcagaaatctctacgacttctgctgttctagccagaagggatatattctggaagctgtgcccccaagtgaggagctggaagctagagctgctcgttacacgtgccgagatgtcatttgctgccgttgctgctgataggctgtacaatagcattctgcccatatagccagttccgctgttc

SEQ ID NO: 447 - DNA, 2732 bp, Sorghum bicolor
gattgctccgagggttagttccgccctggtcttccgttcctacgcttgccagcaatcgagtttcaagtcgtcgatggactgcgatttgctcgctgcgtggtggagcagcagcaccagattaatctccaggatttttcgggggtcagcagctgatgcgccggggccgtcgccaatgaggccagccataccgcttcaccagaagcaggcggggctcgctgctagcaagctaggggtggggacctcgaagaagcacagggcctttgtcgcgagcgatgagcagtggtacaacaagatatttgacccatcgagcgacttcatcttgacatggaaccgcatcttcctcttctcctgcttcgtcgcgctatttatagaccccctctacttctatgtgcccaagatcagctacggcagccccaaattctgcgttggaacagacacccgtttcgccgtcggtgttacattcttcagatcgattgctgatttattgtatgtcctgcacatcataataaagttcagaacagcatatatcaacccgagctcgactctgagggtgtttggaagaggggatcttgtcacaaatcccaagcaaattgcgtgcaaatatatcagatctgacttagctgttgatgtggccgctgcattgcctttgccacagattattgtttggtttgtgataccagccataaagtatacctctgctgagcacaacaataacattctggtgctcatagttcttgctcagtatcttccaagattgtatctcatattccccttaacttatgaaattgtcaaagctactggagttgtcgcaaagactgcttgggaaggggctgcatataacatgctgctctatctgatagctagtcatgtgctaggtgcactatggtatcttctatctgtcgatcgccagacattctgctggaagacgaggtgcttgaatgaaactggttgtgatcttaagtacctagattgtgattcgacactgaatgctacttgggcgagtacaacttctgtcttcagtaaatgtaatgctagtgatgacactattagttttgattttggtatgttcgggcctgcattgtctaatcaagcccctgctcaaagttttgcaatgaagtatttctattccctctggtgggggttgcagaatttaagctgctacggtcagactcttgttgtgagtacctatcttggtgagacactgtactgtatattcttggcggtacttggtcttgtcttgtttgcgcatttgattggaaatgtgcagacctacctgcaatctattactgtgagggttgaggaatggagattaaagcaaagagatactgaggaatggatgagacatcgtcaacttccttgtgaactgcgggaaagggtgagacggtttatccagtacaagtggcttgcaactaggggtgtgaacgaagagtcaatattgcaagctctgcctgcggaccttcgacgtgacattaagcgtcacctttgcttgggtcttgttcgacgggttccatttttctcccagatggatgatcaacttctcgatgccatctgtgagcgtcttgtatcatcactgtgcacaaaaggcacatacattgtccgtgaaggcgatccagtgactgagatgctcttcatcatccgtggaaaactggaaagctccacaacaaatggtggtcgcactggtttcttcaattcaatcaccctgaaacctggtgatttctgtggtgaggaacttcttggatgggctcttgtccccaggcctactacgaacttgccatcatccactcggacagtgaaggcactgatagaagtggaggcctttgcactccaggccgaggatctcaagtttgttgccagccagttcaggcggctgcacagcaagaagttgcaacacactttccggtactactcacaccactggagaacgtgggcctcatgcttcatccaagctgcttggagacggtacaagcggaggaagatggcaaaggacctgagtatgagggagtcattcaattccgttagattagatgaagtggataacgaagatgatgattctccgcccaagaatagtcttgctctaaaattcatagctaggactagaaaagtgcctcagaacatgaaagagttgcctaagctaacgaagccagatgagccagatttctcagctgaacctgaagactagagatgtttgcttatgctacgtacagtggtcatagctgactattgtgaattagtcctatttggttcgtgaaggaggttacaggccaactagttacggtgaattgaacttgggttgacggtgccatctgtggatgtgaggcaggtaactcgaaactcaatcaaagctcatctgtggatgtgaggaagttaactcaaatctcaatcaaagcgtgatgaagcttctgactggtatagatcgaatggttgtaactactagctatgttcatgttgtatattcagatatctccgtgcctatagatttcttgaaaaaagaagagaaaaagaagaatgcatcgttacatagactgataacttaaacatctaacaagggtgtggctacattgtttgtgaccgtggaggactctgtaaattatgaggctttggcttctggcaaaatgttagcacagactgctgtcatgtacaaatgcacctgtgcctgcttttgagcatggtcgaggtgctgtaatgtttttttttggttaactgtacaaatgtgctgttcctgcgatatgtta

SEQ ID NO: 448 - DNA, 2136 bp, Sorghum bicolor
actcccaaaccctagcaaccctcacccccgatcgaacccaaatccgcccgaggaattatgcgaaattccccgagatcctagcccagcccaaccttaccctaccctaccagatcgatcgatagagactacgatgagcctatcaccgctcgactcctcctccccgccggcggcggccgaggtgcccctcgccccgggcttccgcttccaccccaccgacgaggagctcgtctcctactacctccgccgccgcgtcctcggccgccgcctccgcgtcgacgccatcgccgaggtcgatctctaccgcctcgagccctgggacctgccctccctctcccgcatccgcagccgcgacgcccagtggtacttcttcgcccgcctcgaccgcaaggtcgccggcgccggcgccgggggccggggcggccccggcaacaggaccaaccgcgccacgccgagggggtactggaagaccacgggcaaggaccgcgaggtgcaccaccgcggcaagcccgttgggatgaagaagacgctcgtcttccacgccgggagggcgcctaagggcgagaggaccaactgggtcatgcacgagtaccgcctcctcgacgcagacgggcctcaggatctgcatgtggtgtgtagaatcttccagaagcatggatctggaccacagaacggtgcgcagtatggtgcaccatacatggaagaggaatgggaagaggatgatgatgctattgagaatggtcctaccagtggcgcatctgctcaaatggctgcaatcacatgtgctgtagatgaggagtcaaatgaggacgatgagaatgcatattgtgaaacaaacagacctgctcgagtagaaccatctcatctgcctttggtccatgaaatgctcaatccaccagagatggctcctcaacaaggtcaggattctaaagagacaagtgatggaagctgtgctgatggtgctatttctctggaagaggttttgcaggaacctttgtcgaatattagtgtggagaatataggtagacttgaagggcagaatgcaactgatgatagcatcaatgttgatgacttgttatcagcataccccaggaaagataatggctatgtaggccaggataacactatgaatgggagtggtccagcagatggtgatcacacaagctggcctttgagagcatatagtaatcagaactatgtcaatggccctcttgctgatgagttctttgacacagggaatgataccaatggggttgcatattctgggcagcagcaagctgatggctttccagcacctcgccaagtggataacagtatggtattttatgatgctccatctgattataacttggtggatggaaatgatgacttcgtatatctgaatgacctcctcaatgagccacttggaaatgaatcactctttgatggagatgatgtgatggcttactttgacgccacagagaatgatttcaagtatgacattttgggctctgctcagggttcgaattatcaacttgcagacatgccgttgaactttgcccaaaagagtgataacaaagacaagtttacattcgatgggatctcagaggttccggaagcaaatgctcagtacggtgcatcctcatctggttcccatgaggatctgtatgcagatactgaatttccaggtgtgccaacagatgacactgctgataaaacttatggaaagcgccttgccagcatgttgggctctatcccagctccacctgcaatggcctcagaattcccgccatcgacagggaaatctgttgggatgctctcggctgtcagctcaagctcaattcgtgttactgctggcatcatccaacttgatggcctcactttcagcagtggctccgatcggtggcccttgcagaagaatggagacttgagtttgcttgtgtctttcgccgtggagagcgacgtgtcatccaagcttcctgttggtcttgaggatgctactcggattagcactgttcccatggtgatgcgaagtggcttttaccttttctttatgtcggccatgattctcctgttgagctacaaagtagggtcgtgtatctacagcaggtgagttgaaggtgatggcgcctctggtccggtctgactctgagggctgtt

SEQ ID NO: 449 - DNA, 1355 bp, Sorghum bicolor
aaagaatgaagacagaggccactcacaaggcgatagcagcaggtggcaagatgacggtgctccactctccggttggagtgaggagcatcgtcacctccatggtggctttcttcatcttagccagctccatcgtcttcctccttgacagaggccaggaagagcaagtgcaaatggcaatcgagcatggacgccaagaagtgcaggtgaagctggaagctgggctccaagaaccagcgatcagagggacaactgacgagggggacgccagcaatgaggagtgcaactggtcgagggggcggtgggtgtacgacaacgtctcccggccattgtacaacgggctcaagtgcaccttcatcttccccgaggtggcctgtgacaagtatggaaggaaggatgtcatgtatcagcactggagatggcagcctcacggatgcgacctcccaagatttgatgccatcaagctgcttgaaaagctgaggaataagagattggtgtttgtgggtgactcagtcaacaggaatcaatgggtctctcttgtgtgcatggtggaggcctcaatacccgatgacaggctcaagacacgcatcttcaatggctcactcatctcctttaaggcattggaatacaatgcaacaatagatttctactggtcaccactactggtggagtctaacagcgacaaccccattatccaccgggtggagtaccggatcataagggcagatagaattgagaagcatgccagtgtctggagggacgctgacatcattgtcttcaattcttacctgtggtggaggaagcagaaggatgacatgaggatgaaggtcatgtatggttcatttgaagatggtgatgcaaagttagacgaaatggaaatggttgatggtttcgagatagctctcaagaaactaaccgaatggcttggggaaaatattgacaagaacaagactaggatcttttttgcaggatcatcaccagcacattcctgggctagcgactggggcggagaagacaagaacaaatgcctgaatgaaacagagccgatctacaaaaccggatacaaagctgcaactacggactacagcttgatggccacggccaagtcctatttccgaacactggagccgaaaggcatacatgttcagatactgaacatcacagagctgtccgactaccggaaggacgggcatccgaccgtgttcaggaaacagtttgctcctctaacgaaagagcaaatcgcggacccagccagctatgcggattgcacgcattggtgcctccctggagttcctgatgtctggaacgagtttttatatggctacctcgtgcaccaaatgatgagtaaattgtaataa

SEQ ID NO: 450 - DNA, 1974 bp, Sorghum bicolor
aaaggatccctgcacagctctgactctaaggactgtgatccttgtgtgcactgcctagccgccatggctgcttcctccatggacaggatcacccagtgggtgtcctcccaggtccagcaggtctccgccgacctcaccgtcaggatcgccgactccgtcttccctctccacaaggcggtgatggtgcccaagtgcggctacatccgccgggccgtggcagcggcggcgacgagccagacgcagggcccggggcccgcctccgtcgagctggacctctcggcgctgccgggcggcgccgacgccttcgagaaggcggcgcgctactgctacgggggcagcctggagatcacggcgcgcgacgcggcggcggtccgctgcgccgcggcgttcctcgacgccccggacctggcgcgccgcgccgaggactacctcgcgcagaccgcgctccggtcgctgccaggcgccgccgccgtgctgcggtcctgcgagtgcgaggcgctgctccgggccgccgaggagaccggcgtcgcgcgccgcgccgcggacgccgtcgcgctcggggtctgcaacgaggcgctgttcccgacggcgcgggcggcacctgggtggtgggtggccgagctcgccgcgctgtcgcccgcgtcgttccggaaggtggtcaccgcgctgcggtgccgccgcgcgggtccggaggtggtggccgccgcggccgtcgcgtacgcggagcgcgtcctggccggggtcctcgcacccgctgcgcccggccgccgggacgccgtcgccgtcgtcgcgaggaacgcggacgcggacgcggaccggcgggcgctgcttgaggccgtcgtggacgcgctgcctcccgcggccgacgcgccgctcccggccgcgttcctctgccgcctcctgcacgccgtggtcaccgccgaggcgtccgccaagacgtgccgcgacatggagctccgcgtggcgggcgtgctgcaccaggccaccgcgggggacctgctgggcgtcgcgctcgacggcgccggggagcgcgtccggaacgcggacaccgtgcgccgcgtcgtggccgcgttcgtcgagcggccgcagacgcaggagggccggcgggcgtcgctggccggaggaccagcagcaggcgagctcggcgcgctggagaaggtggcgaagacggtggacgaggtggcggcggagatggcgacggaggagtcgctgggcatctccaagttcgtgggcgtggcgggcgcggtgcccaaggacgcgcgggcgtcgcacgactgcctgtaccgcgccgtggacatctacctgaagacgcacccggggctggacgagatcgagagggagaaggtgtgcagcgtcatggacccgctcaggctctcgtaccaggcgcgcctgcacgcgtcgcagaacaagcgcctgccgctgcaggccgtgctcagcgcgctctactacgaccagctcaagctccgcagcgccgacggcggcggcggcgatggtgcggagggaggagcagggtgggagccgcagtcggccgccgggaaggctcgagcgcaggcgcgggcggacgcgtcgctggcgagggagaacgaggcgctgaggtcggagctggcgaggatgcgggcgtacgtgtcggggatgcagcagcacagcaaggggagcgggtcgaggtcgtcgtcggcgtcgctggtgccggcgtcggcggcggggaagaaggcgagcttcttggggtcggtgtcacggacgttgagccggctgaacccgttcaagggcgggtgggccaaggacacggccagcatcgccgacggacgtgacaggagcgccatgcatgtggtcaagcccaagaggagaaggttctccataggctaatttagtttgtgatatatgaatatggaatgtgatattgtttgtgattatgtttttttattactgtaattagaaaaaggttgtgggtgctttgtagtttcaatgggtaccttt

SEQ ID NO: 451 - DNA, 1282 bp, Sorghum bicolor
agcacgcccttctttgttcctccgactctcactcggcggcggcgacgacgacgacgacgacgggaggagcggtggatcgagcgaatcgatctgtgcgtgcgtggctgtcgcgcgcgtcgatctctgccgggcagggcagggcggggcgggcggcatggggaggtccccgtgctgcgagcaggcgcacaccaacaagggcgcgtggaccaaggaggaggaccagcgcctcatcgcctacatcaaggcccacggcgagggctgctggagatcgctcccaaaagccgcagggctgctgcggtgcgggaagagctgccggctgcggtggatcaactacctccgcccggacctcaagcgcggcaacttcaccgaggaggaagacgagctcatcatcaagttccacgagctcttcggcaacaagtggtcgctcatcgccgggagactgccgggcaggacggacaacgagatcaagaactactggaacacgcacatcaagcggaagctcctggctcggggcacggacccgcagacccaccgccctctcgccgccgcctctggcgcgcccgcggggcagcagcattaccagctggagcaacagatgcaggcagccgcggccggcgttggcacggtgggccatccgcaccaccaccgccaccaccagcagcagcaccaggctccgcagcagcaggacgtcatctccaactcgccggaggccgcctgcacgagccgtagcagcgacgacgagccgcggtcctccacgccgacaccgccgccgccgccaaggcgccacctggacatcgacctcaacctgtccatcagtctgtctgcttaccagccgccggaggaggaaagcggcagcatcaagtcgccactgatgatgatgatgatgaagcaggaggaggagacagcggcggcatcggcggcgggcggcaccaatgcggcggcggcggtgtgcctgtgcctcaacagcctcgggtaccggccgggcgtcgagtgcgcctgcggcggcaacggcggcgtcgggtcctcctcccagtcccagcaatgggctcggagttttttacaggcagcggcggcggcgacgccatgctacagaggccaatagtgttaagacaggaagagtgatcagtgagtgagacagtgacataagtgggagggttatttacgcagggcagatacttttagttaactactggagtactagtagtaaaaagccacacatgcttaggctttagcagctctctttgtaaaacatgcatcatgggttatgaggaggagatgtgct

SEQ ID NO: 452 - DNA, 1160 bp, Sorghum bicolor
gaaagatgatgcggagcccaaggggcgtcggcggcggctgctaccgcggcgccggcggccaagaccagcacgtcgacctgatcccgggtatccccgacgacgtggccgtggactgcctggcgcgcgtcccgcacgcctcccaccgcgccatgcgcggggtctgccgtggctggcggagcgccgcttccaccccggccttcgcctccgcccgcgcgcaggcggacgccaacgaggacctcgtctacctcatgcagttcggcaacccgtccgccgccgctgacgacgccgaacccaagggcgacgacggtcccgccaacaccccggcctacggcgtcgcggtctacaacgtgacgaccggcgagtggcgccgtgaccgcggcgccccgcctgtggtgcccgtcttcgcgcagtgcgccgcggtggggacgcgcctggccgtgctcggcggctgggacccgcgcaccttcgagcccgtggccgacgtccacgtcctggacgccgcgacggggcggtggcgtcgaggcgcgccgatgcggtcggcgcggtccttcttcgcgtgcgccgaggccggcggcaagatctacgtggccggcgggcacgacaagcacaagaacgcgctcaagacggcggaggcctacgacccccgcgccgacgcgtgggacccgctcccggacatgtcggaggagcgcgacgagtgcgacggcatggccacggtcgcgggggaccggttcctggccgtcagcgggtaccgcacggcgcggcagggcgggttcgagcgcgacgccgagtggttcgacccggccgcgcgcgcctggcggaggctggagcgcgtccgggcgccgccctccgccgcgcacgtggtcgtcaaaggacgcgtctggtgcatcgagggcaacgccgtcatggagtggatggggacccgccgcgggtggcgcgaggtcgggccgtacccgccggggctcaaggctggcacggcgcgcgcggtgtgcgtcggcggcggggagaaggtggttgtgacgggcgcgcttgatggcgagggcggtggtgggcggcacgcactgtgggtgttcgacgtcaagaccaagagctggactgttgtgcgcccgccgtccgagttcgccggcttcgtcttctccgtcgcctccgtccggatctgatga

SEQ ID NO: 453 - DNA, 1003 bp, Sorghum bicolor
cgctcagctccgaccgaccgaccgaccaccgccgcgatgaggcagtggaagtccctggtcccggccgcgctgcacctgcacggctcggccgcgtcctgcttcccgcacccgccgtcgtcgcccagggccgccgcggaggagacgacgacggacgacctgcagctaccgtctcagggcgcggcggcggcgaaaggcgcggcggtgcggctggtggggtgcgacgggcgggtgcgcgcgtacgcgccgcccgtgacggcgcgggagctgatgcaggagcacccgcggcacctggtgtgccgcgccgacgcgctgctgatcggggagaagatccccgccgtggcgcccggcgaggagctgcagcccggggaggcctacttcctgctgcccgcgcacctgttccgctccgtcctctccttcgtctccctcgcctcctcgctgctgctcctgctgtcgtcgtcgtcgtcgtccaccaccaccgccgccggcgcgggtgccggtgccggtgccgggaagaaggccggcgccggcaggccgttcgagctccaccgcacggcgtccggcacgctgcagatcaagttctccgacgacttcctcctcgcggacaacggcaatggggaggacgaggaggaggaggacgaggcgcccgcgcagaaggagcagcagcagcgcgccgtgctgctgcgcggcgacgaccgcctcgccaaggactacgaggagctggtcgggtacagcaagtcccgccgctgggcgcccaagctggagacgatcgaggaggcggttccgcccgccgccgccgcggcccccgagtccgccggcgccgcgtcaccgaaggcccagcgcggcggcaggaagagccgcgcgcttccgttcctcggccgcctgggcagccgccgccgcagccgcgaccgcgacgcctgcagcgccgtcgtggcctgctccggctagggacggagggagggtgagagtctctctcgatctgtcccgtccggtagggtagtttagg

SEQ ID NO: 454 - DNA, 635 bp, Sorghum bicolor
agtccatgtccagcccagcgatggcaatggccgtgatccgcctcgcgcgccccgccgccatccgcccgccgtcggccccgtcgctacggccgaccgcgcggctgctgcgccgcctccgcgtcgtgaggtgccgcgccggcggcggcggcaacggggagggagggaaggggaaggaggagggggaggccgcggaggcgcccgagtcgctcttcgccagggagctccggcggcgcgggatggcgccgggggccgccgccgcgggcgctaataaggaggcggaggagggggcgccgccggaggccggggccaagcgccgggtggcggccgccgagttcgagcgcgccgccgccgccgacggccagcgccagcggtccatggcgctcaacagcgagggcctcgagggtcttgttcctcgggcaaagttactactatcacttggcggtaccttctttctggcatttgggcccctgattcttgtgaccgtttctctttttgctggtttatatgtgtactttggaccgagttttgtacatgatgcaagcaagacaccggtgtcggtgccaccatacattgatccatacgagctgcttgaggacgagaggctcagccgaccctccccagatgtgttctgatga

SEQ ID NO: 455 - DNA, 449 bp, Sorghum bicolor
aaaggatccagcctctagaaccttccggtccggccggacaagcaaaaacaaggagcagagcgaggatggcaatggagcacgtggcgaggctggcgtcggagcgcgcggtggtggtgttcacggcgagcaactgcagcatgggcgacgtcgtgacgtcgctgctgagcagcctgggcgtgaacgcggcggtgcacgacctggacagggacccccggggcctggagatgcagcgggagctggccaggaggctcggcgccggcggcacccccaccgtgccggcggtgttcgtgggcggcgacctcgtcggcgggaccagcagggtcatggcgctgcacctctccggcgagctcgtgcccatgctcaggaacgccggcgcgctctggttgtaggaattcagagcccgcgtccatgcaatgcaagcatggctggtgaccttttagggtaccttt

SEQ ID NO: 456 - DNA, 621 bp, Sorghum bicolor
aaaggatccgtccgagtctccgaggaaagcacctcaccccaaaatgaagcacatattcaagattgctgcaatactgatagcaatctcagctatctggattgctctacttgaaacctcaactgttcctcgaagttatacttggctgcttcccatctacttggtagtggctcttggatgctacggcctttttatggttggatttggacttatgctcttcccaagttgtcctcaagaagctgtactactgcaacaggatattgtggaggcaaaggaattcttagcaaagaagggtgttgatgtgggctcaattttaagtggttgacagtcatgaccgtcttgaaggatcaccattctgttcctaggaatatattgcttttttggatacttactgtagataggaaacatatcatttcactatgttcagctattattaacacagtttcctaactcagtgagttggcatgtttacaattgtgcttttgtcaatgatggggctcactaagttcgaaaagtgaacttttctaggaatatttggtttctatctcgattccccgtcagtggaccctttaccaattctgctgttcagtacatccatcaccttatgccttaatgggtaccttt

SEQ ID NO: 457 - DNA, 447 bp, Sorghum bicolor
accaccataagcaccaacggaaaagcagagccttctgtccccggccggtacggtccgccatggctctggatgcgaggtccctgcttccggtagtgtccgtcgtcgtcgtccccgccctcgaactcgaagtctgctccgggatgatgccgagaaccaggaacggcggcggcgtcccgtccgcgacgacgacgggcgcggcggaggtgtccgtcgtggacgtgccggcgctgtggagtgacgaggggaggatgaagcgggagctggtcgcgtgggccaaggccgtggcgtccatggccatcagggaaaccatgaagtgctgaaacttcgttccttaattcgtgcatatatagagccctgatgatgcacatctctttgtttgttttttcctctcgtgctgctgagtcctttctttgttgtacatgttcggttgatcatttcggcttgtac

SEQ ID NO: 458 - DNA, 1062 bp, Sorghum bicolor
aaaggatccagtccgggacatcacagctacagctagcgggagccgcagcggcgatggcggagatcccggtgatcgacctgcgcctcgccggctcgtcgcgcgaggagtccgcgcggctgcgtgccgcgtgcgagcgcctgggctgcttccgggtgaccggccacggcgtgcccgcggggctgctggccgagatgaaggccgccgtgcgcgcgctcttcgacctccccgacgacgccaagcgccgcaacgccgacgtcatccccggcagcggctacgtgccgcccagcgccgccaacccgctctacgaggccttcgggctcctcgacgccgccgcgcccgccgacgtcgacgccttctgcgcgcgcctcgacgcgccgccccacgtcagggagaccgtcaaggcctacgcggagaagatgcacgacgtgatcgttggcgtcgccggcgagctggcctccagcctggggctggagaagcactcgttccaggactggccgtgccagttccgcatcaaccggtacaactacacgcaggagacggtgggctcctccggcgtgcagacccacacggactcgggcttcctcaccgtgctccaggaggacgagtgcgtgggcggcctcgaggtgctggaccccgccaccggcgagttcgtgcccgtggaccccgtcgcgggctccttcgtcgtcaacatcggcgacgtcggcacggcgtggagcaacgggaggctgcacaacgtgaagcaccgggtgcggtgcgtcgcgcccgtgccccgcatctccgtcgccatgttcctgctcgcgcccaaggacgacggcgtgagcgcgccggaggcgttcgtcgacgaggaccacccgcgccggtacaaggcgttcaactacgacgactaccgcaggctccggctgtccaccggcgagcgcgcaggcgaggcgctcgcgcggatggcggcgtgacgtggtgcagctgcaaattggaagccggcagcgacaagccgttaatttataggcttaccgtgggaccgccatacgcctacacgagcagagtattccatatcggggtaccttt

SEQ ID NO: 459 - DNA, 1331 bp, Sorghum bicolor
atctactaccgacgcacctctcacaacgctcaatccaatcgcgagccgcccgcaaccctaaccctagcaaccgcgagtgatggcgcgcccgaggggtaagaagcgcacggcgtcccaggcggccgccactgattcggtcgagctggaggccgccgccggtgcttcgagcaagccggaggcggcggcggcggagccggcaacacgggggcgggggaagcgcgtcaaggcgccgcccaagcccaagcccgagacggactacttccctgagaagagaaatctggaggatctctggttatctgctttcccagttggtactgagtgggaaaacattgataagataaaggagttcaattggagcttcgaaaatttagagaaagccttagaagaagggggagagcttcatgggaagacagtttatatgtttggaagcaccgagccccagctactggatgttaatggagaatcaaagatagtgcttattccaattgtagttgttgtagactgccctttccctccatcagacaaaattggtataaactcagtccaaagggaaaatgaggaaatcgtgccaatgaaggcgatgaaaatggcatgggtgccttatgttccacttgaggaccggcttagcaggattgacagtttaaaaacaaaaatattcactctcggatgcacacagcgaaggtctgcgctgaagcatctcaaaattgagagagtcaagaagtttgattactgcatgccttactatatgcctctacaacctcttgaagatgaggatgacacagttatcaatttcttatatcctctagaacccccgatagtagatgagttcgactgggaaatggatgattatgaggatttttcagatcagaaagtgcaagaaggtagcctgccagagggcgagaaagaaaaattcaaggagttcctcaaggagaaggttagagaaaggaagagagagctgaaacaggctaaagaagccaggaagaaagctatcgacgacatggatcctaaaatgaaagaagcattcgagaatatcaaattttacaaattttatcctgtaaaaaccccagacacacctgatgtaaacaatgtaaaggctaggtacatcaacagatactacaggaatgcccattatctgatgtaatggctttcctgatgacctgatctcatgtgcttggccagcatgtcatttgaggagttgatagaagaagatttttgaaacccgggaggagaacaatttggtgacatcttcgaatgtggtcttactgttgtattgtactagagttgccctcaggtctcaggttttcattcccttgggcatcttctttcactgt

SEQ ID NO: 460 - DNA, 2370 bp, Sorghum bicolor
aaaggatcccggaggaggaagaggaatggtattggggggaggccctctaggcgccattattggccgctatccctccgccgccgccggtgatgatgaacaaggggaccccgggcccggaggaagcgtcattcgccatgaccgcaagtgccgggactggcccttcctcttcctcttcgccgccttctgggtcgccatgattgtcaactccagcttcggattcaaccagggcaacccactcaggctgacatacggactggactacaaagggaacatatgtggcagcaggcacggtgatcctgatttgcgtgagttggatgttcgctattggttgaaccccaaccaggtctaccaaagtgggctcaaaaccagtcacatcgagctacctgacgctaaagccatctgcctgatggaatgcccacttcctgccgaagatggcttgaattttgtttgcgattatccagaaggtgacatacgcctctctgtcgatgattggattgacagggactacgattacttcgagtacctcacaccagacatgaggaatagttctcttcagctgcagggtccttgttaccctgtcatatttccaagtgtaaatgtctactggagttgccagtttattgcacgggcatccaatgcctctttgaagcattggaaggacatgggtggtgtcagcatcgatgaaaacatgctaatagatgaaacaattcatgatgcaatcaacagcaaatctgccgtcatgaagagatatgttgcagatattgggaagtcctggcctgtgttaatcctttgtgggggattactccctctgttcctgtctgtgatctggttactcatgattcgtttttttgttgctgggatgtcttggataacagtggtggtcttcaatgctcttgtgatatctgttacaatgttcttctatataaaagctggttggataggccatgatcctttgactgttgtaattggtgaaagtgatccttatgttagcataggtggacgggagataaatcaccttcatgctgcttctgtcttgatgacagtgataatgatacttgctttcctgacttcaatagctattgctcggcgcattatgatagcaacatctgtcttgaaggttgctgcaaaggtcattggcgaagtccaggcacttatcatttttccagttgtgccatacttcatcctcgctatcttttacatgttctggttttcagcgacacttcatcttttcagcgccggtcaagttatacgaaatgattgtaataatgattgttgttcatatgatctcaaacttggcaaagtaaattgtgacagctgttgtggctacagtatccattacaccccacatattggcatcgccattcttttccatttctttggctgttactgggcaacacaatttttcatcgggtgttcttcgactataattgctggatcagttgcttcatattactgggcacgtggtgaaatatcgcgtgatatccctttccatactgtggtatcttccctgaagcgcttattgcgctatagcctgggatctgtggctctgggctcgctgattgtgtccatcatagagtgggtgcgattcatactcgagtcactacgccgcaggctgaaatttgttgattctgcccgtgaaagcaggttggggaaggcagtatcatcctcatctcagtgctgcttaggctgcattgattggaccctgaaatcagtgaatcgaaatgcttatgtcatgattgccattacagggaaaggattcttcaaggcttccgtgctagcaactgaattaatcatgaacaacatattgcgcattgggaaagtgaatgtcattggggatgtgattcttttgttgggcaagctttgtgttagcctgttgtgtgcactgtttgccttccttatgttggatgagcacaagtacagatctggccataacaagatatcatcgccactagtccccgtgctgttgtcgtgggtgctgggttatatagttgcaaagcttttctttgcagtggtggagatgtcaatcgacactatggtcctgtcattctgccaggactcggaagaacatcaggggagcgctcagtatgcgcccccgctactgatggagacactggatgaagagagcgagttgcgaagactgacacagggacaggggccatgaagcatgatcttctaaatacgtgtagggatagagctagaggtgaaactgaatggtgtgttatctgtactttatttatatatgaatcactggggtggatggaggtgcaagtaattaaggtggttatggttatggttatggactggttatcagctaaatacgaggaatagggctagagctagaattgaaactgaatggtgggaggtaccttt

SEQ ID NO: 461 - DNA, 833 bp, Sorghum bicolor
ggcccatggcgtgccggggcttcttcgagtgcgtcctcaagctgctcaacctcgtcgtcatggcggtcgggctcgctatggtgggctacggcgcctacctgctcgtgatgtggctgcaggtcgcgccgccgctcccgccgcccgcgccgtcgccggcgcccagcggcggcgacctcgtgcggctcgggaggccgctgctgctccttgtcgatgcgtccctgtcggactcggatgggaccgcggagaggctctccagtgcctggtttatttttgctttcattggtgtcggtgctatactcttcatcacatcgatctttggttgtgctggagctagaaatggatgctgcctgtctatttactcattcctcattattttgttcatactggtcgagcttggtgcaggaggcttcattttcttcaaccatagttggaaagaggtcatcccagttgacaaaactggaaactttgacatgatgtacagctttttgaaagagaattggagaattgcaaaatgggttgcacttggagctgttgtatttgaggcattgttgttcactgtggctatcatagtacagtcggggaatcaagctgattatgacagtgacgatgagtacatcggcgcaaggtctggaatacggcagccgttggtgaatcagcaagctgctgccactgatcctagggtgcccaatctcgactaccgcccaatccggaatgacgcatggagccaaagaatgagagaaaagtacggggtggacagctttgatccgaacaggtttcaacaggccacgatatctccaggagaacaaagaaaccgatgcaccattctctgatga

SEQ ID NO: 462 - DNA, 2574 bp, Sorghum bicolor
cagcactcatcaaccaagtagctagaagacagagagtgtgtagtagcacccacagacgaagcaaaccaaccaaaattgtcatgctcccacacctacaccagtgattgtgtgaagtgataacacaggggagaagagcgagagagagacagagacagacagaagaaaagatacacagatagatcgccatgccgcctcagctggagcaccatgagcagcagcagcagacagccggaggtggtggccaccgagcagctgcacctcctcctcctcctcctcccaacagcatgcccacctttagcagcagcagtagtagcagcagcagcagcggcactccctctcctacttctgtttctgccaccaccaccaccaccaacgtcccctccggcgccgtcgtccatcccaccacctccagcccgccgtcgtccgccgcctccgcccgccctgccgccaactccttccctctcgtcctaaagttcgaggaagtggtgtacaaggtgaagctcgggaagccgacggccggatggtgcgacaagctgtcggcggccgcgtcgaacatggcgtccttcggcggcggggacgggagcaagaacaagaaggccactgcgtcggcggcagggtcgtcgtcgtcgtcgtcgcgggcgcgggcgcgggagaagaccatcatcagcggcatgtccggggtggtgcgcccaggcgagatgctagcgatgctgggcccgtccgggagcggcaagacgacgctgctgacggcgctaggcggtcgccacggcgggcgagcggcggtgctgtccggcaagatcacctacaacgggcagcccttctccggcgccgtgaagcgccggaccgggttcgtgacgcagcacgacgtgctgtaccctcacctgactgtctccgagacgctgtggtacacggcggcgctgcggctgccgcggtcgctgagcgccggcgagaagcgcgcgcaggcggaggccgtggcgcgggagctcgggctggcgaaggtggccgggagcatggtgggcggcgtccgcggcgtgcgcgggctgtccggcggcgagcggaagcgcgtcagcatcgggctggagatgctggtggacccgagcctgctgctcctggacgagcccacgtccgggctcgactcgacgacggcggcgcggatcgtcgggacgctccgccggatggcggcgcagggcggccgcaccgtggtggtcaccatccaccagccgtcgtcgcggctgtaccacatgttcgacaaggtgctgctgctgtccgccgacggccgccccatctactacggccgcgccgccgacgcgctcgactacttcgcctccgtcggcttcgcgtcgccgctctcactcaaccccgccgacctcatgctcgacctcgccaacggtatcgcgccgcagacgacgagcggcgacggcgccgcggacgggatggcggcggtgaccagcggcagcgagagcgagcacaaggaggtgcgcgccaagctggcggcggcgtacgagcgccacattgcgccggcggtgaagctggacatctgcgcgcgggagacgacgtcgacggcggcgttgccgccgggcagcagcggcgccgggcacgcgacgacgacgtggacgacggggtggtggacgcagttcctggtgctgttccagcgcgggctcaaggagcgtcgtcacgagtcgttcaacaagctgcgcgtcttccaggtgctgagcgtcgcgacgctggcgggcctcctctggtggcgcacgccggcgtcgcacctgcaggaccggacggcgctcgtcttcttcttctccgtcttctggggcttcttcccgctctacaacgccgtcttcaccttccctctcgagcggcccatgctggtgaaggagcggtgctcggggatgtaccgcctctcctcctacctcgcgtcgcgcgcggcgacggacctccccatggagctcggcctgcccacggcgttcgtgctcatcctctactggatgggcggcctcgacccgcgcccggcgccgttcctcctctccctcgccgtcgtgctctacagcgtgctcgtggcgcagagcctcgggctcgccatcggcgccgtgctcatggacgtcaagcaggggaccacgctggcgtccgtcatcaccatggtcttcctcatcgccggcggctactacgtgcagcacatcccgccgttcgtcgcgtggcttaggtggctcaactacagcttctactgctaccgactcctgctcgggatccagttccccaacggcggcggctactacgactgcggcgacggacacggcaagctctgcgccgtcgccgagttcccggccatcaaggccgtcgggctcaacaaccactgggtcgacgtctgcgtcatggcgctgctcctcgtcggataccgcgtcgtcgcgtacattgccctcgatcgcctcaagcccaggtgatgatgatcagcggccattgtctgcagctgcagtggccgagagctgcctgcccaaacatgaaaatggcatgcatccggccatggatggagcagtagaagagtctgattaatcagtcagctccaagaccaagaggcattac

SEQ ID NO: 463 - DNA, 1016 bp, Sorghum bicolor
aacactgcaccagctccacccaccagcgcgcagtccatggcgatccggatgagcaacaacgtgatccgcgcgctgaccctggtgacgctgctgctctcggtgcccatcatcgtcacgggcgtctggctgcggtcgcgcgccgacggcaccgagtgcgaccacttcctcctgtccacgccggccatcgcgctggggacggtgctcatggccgtctccctcttgggcctcgccggcgcctgctgccgcgccacctggctgctctggctctacctcctcgccatgctggccctcatcgtcgcgctgctctgcttcaccgtcttcgccttcgtcgtcaccagcacgggcggcgctggggaggccgtgtccggcgccgggttcagggagtaccgcctcggcgactactccacctggctgcggcgccacgtcgagggccgcaagaactgggccaggatccggagctgcctcgccgacgcgcacgtctgcaggcgcttcctggaggcggaggaggaggaggaggagagcaaggacgcgaacgcggcgggtggtctggcgcggctcggcggcctctccccggtcgagtccgggtgctgcaagccgcccgcgagctgcaacttcacgtacgccggcggcggcacggagtggacgaccaagacgaaggcggcggcaggggcaggatccgcgcccgccgccggcgccgacccggactgcggcaagtggagcaacgacgaggacgacctctgctacgggtgccagtcgtgcaaggccggcgtggtggacgcgctcaggcgggactggaagcgggccgccattgttaacgtcgtcatcctcgccttcgtcgtcgtcgttttttccgtcggttgttgtgccttcaggaacagtcgccgggacaactacgcctaccacagcggccgcggatggaaacgaagcggtgacgcttaatctaacttctaatagtctgtagagatgattgatttgctagctgctggctgctgatgtaggttccctaggatctgcga

SEQ ID NO: 464 - DNA, 2058 bp, Sorghum bicolor
cttggttaaggaagctgactgcttgaagtgatcatgacggaccatcttgctattatcgcgtccgagctaggggacgcaacggattttgaggttgatggcattgacaacctcagcgagaatgatgtcagtgatgaggagattgatgctgatgagcttgcccggcgaatgtggaaagacaaggtcaagctcaagaggatcagggagaggcagcagaagctcgctttgcagcggttggagctggagaagtccaagacaaagaagatttcagatcaagctctccggaagaagatgacgagggctcaggatgggatcttgaagtacatgctcaagctgatggaagtgtgcaatgcgcgggggttcgtgtacggcatcattcctgagaaagggaagcctgtcagtggtgcatcggataacatcagggaatggtggaaggagaaggtgaagtttgataagaatgggccagcggcgattgtaaaatatgaggttgagcactcgatgctgagtaatcctaagagcagtggagccatgaaccagcatagcttgatggatctccaagacggcactctgggttcattgctttcagcgttgatgcaacactgcagcccacagcagcgaagctatccattggataagggtgtcccgcccccttggtggccatcagggaatgagccatggtggcctgcgttgggccttccaaagggagaagcgcctccgtacaggaaaccacatgatctgaagaaggtttggaaagttggtgttctgacgggtgtgatcaagcacatggccccaaactttgataagatcagaaatcgtgtaaggaaatcaaagtgtctgcaggacaaaatgactgcaaaagagagcctcatttggcttggtgttttgcaacgcgaggagaagtctattcacagttttggcagtgctttactaccgattacccagcatagtacttcagaggacagaactgagggcatatatagcagcagtgatgagtatgatgtcgaccgcctggagcagcctcctcgttctacatcatccaaagatgatgagggagatgctcagcctgttttgcagattagaggggagcagatctcaactagagtgcctaagagaaagcgtcatgataaaccctccaaccaactagctattagcaaggaagaaacgacaaaacctaaacctcgacagcggaatcgcccctcagctcgttctccagttgctgaggttgaggttgaagtgacacaaagaaatgacaatccgccagatgtatcgtgcaatgcagctgatggtatgaaccttattgatccaattgatgtggtgggcatgactaaccagccaacgagctctagccatgccccccctacaattggagctttgcagcagcacggagattgtcaagggaattttctatctcctggtgctgtgatcaacaactacaacagcaaccaggctgcaagtgctgctcaatcaagcacttatctgggcgaccatcccctggcttgtgaaggcagcgatattgccaattcatggtctggacactcgtttcggcaggatattggtattgggcctattggttttaatccttcacaagctgttcatcaggatttggcaatgcagcagccactaccactgcctatggatcaccaagcgcctatcattggaacaggagctctcgccacgaatgactcttacagtctcccgacggcaggcagtgggaattctgggacaatagttggtgagacccaccagcagttcatggacgaccctttcttcggcgaggctggagacagcacttttggtggccttcctttcagcctcgttcctttcagtagtccgatgctcaactttgatgacttggtggacgacgatgacttgatgccgtacctgggcacatgacacagtgtccaattcatacctggtaactatggcgtggataggtggttcatgctcgtgcagccagttactgggagagttgggtgacatgctgatggagcagtggaatgttgatgcagctgcagctcgtgacccatttgtggcgccgtcctgagaaggtcattgctttgt

SEQ ID NO: 465 - DNA, 725 bp, Sorghum bicolor
cacccatggcgtccgcgccttccgcccccgcctccgccgccgtcaaggccgcggtcgtccccatcccaccggtccacccgccatcctccgtggcagtactggcgcggcgcgcgccgacgccggtgccggccgccctgcgcgccctgggcctgggcggcaacgcgcggcatggcgcggcgctggtggcgtccgccgcgctggatgacctgcgcccggccatcgacgagtaccccgagggcatcctgtccggggagtggcccggcaacttctccctcctcagctacgccgacctccgcgcctacctcgagtcccggatcgtcacctccgaccagatgagcccggcggcaaagctcggggacgtgatgtcgcgccccgtgcaggtggccacgccggggcagcgcctcgcggaggtcgatgccatcttcgccgcggagcagttctcgggcctgcctgtggtcgacgaggacggcaggtgcgttggggtgatctccaagaaggacaaggccaaggcgcccaatgggatggagtcaactgtagttgaagtcatgtcatctcctgcgataaccctgacgcccgagaagacagtcttggaggctgcagcactaatgcttaaggagaaggttcacaggataccggttgtgaatgaacagcaacaagtgatcggaattgtgactcgctcggacgtattccaggcacttgaggccaacaacaacaaagcatgatga

SEQ ID NO: 466 - DNA, 1517 bp, Sorghum bicolor
ctgattggcaacacaactcaagataaagatatggagatcagagggaagactttgatggagcggtatgagctggggaggttgctggggaaaggcacatttggcaaggtgcactatggaaggaaccttgagtccaaccagagcgttgctatcaagatgatggacaaggacaaagtgctcaaggtcgggctttcagagcagattaagcgtgagatcagaacaatgaggttagtggaacataagaacattgttcatcttcatgaggtcatggcgacaagaaacaagatctatattgtcatggagtatgtgaaaggtggagagctctttgacaagattgacaagagtggcaagctcacagaggctgctgcacacaagtacttccagcagctcattagtgcagtggatcactgccacagccgaggtgtgtatcaccgggacttgaagcctgagaacctgctgctggatgagaatgagaacctcaaggtgtcggattttggactgagcgcgctttcagagtcaaagaggcaagatgggttgctccatactacctgtggaacgccggcatatgtagctccagaggtgatcagcaagataggctatgatggtgcaaaatcagacatctggtcttgtggtgttgtcctgtttgttcttgctgctggttatctccctttccagggcccaaacttgatggagatgtatcggaagatacagcatggtgatttcaggtgcccaagttggttttcacacaaactcaagaagctgttgtacaagatcctggaccccaacccgagcacaagaatttcaattcagaagataaaagagtctacttggttccggaagggtcctggggagatccgtgcagtaaaggagaaaattcttagcgagaatgccaccacaaattctgacccagtgcttgctactaggcgcaagaagattgctcaagaagatatgaagcccctggctgccacaaacctaaatgcctttgaaattatctcattctcaaccgggttggacctgtctggtctatttgtcaaaaaggagtgcagaaaggagacgaggttcacttcagataaacctgccttggccatcatctcaaagcttcaagaggttgcaaaagcactgaatctcaggataaggaagaaagagaatggcattatcaagattcaagggaggaaggaggggaggaatggtgtccttcagtttgacactgagatctttgagattacagcatcctaccatctcattgagatgaaacaaacaagtggtgattcagttgagtaccagaaactgttggaagaggacatccggccagggctgaaggacattgtctggtcctggcatggagatgatctgcagcaaaagcaggagtagcttcggatgtctcacatagattttgttctgaaaattcgttggattttcagctcagagtgattctgttctacatttgatgtcttatttttttagcagctatattctttttatgtattggaggagcatggtgttgatgtgaaccattaggc

SEQ ID NO: 467 - DNA, 1556 bp, Sorghum bicolor
aaactcgagaaaagcctcatcggcgtcgccaggaccgccttcgcgctcccaacgcgccgttcctccggtacatgaacgaggccgccggcacggtcgtctgcggcgagctcatcgtcggcgccatggcgcagtcgtggaggttcctcatgcagggcgtcacgtcgctcttgttcctctgcgcccgcgccgccgctgccgacgacgacgagtacgtccggccgccgccttgcccgctcgtgctcgtcgcgcacgacaagccggcgtggcatccacagcaggtacacatttcagtcgtcggatccgaccacatgcgcgtctcgtgggtgaccgacgaccgtcgcgcgccgtccgtggtggagtacggcacgtctccggggaactacacggcgtcatcgacgggcgaccacacgacgtaccgctacttcttctacaagtccggcgcgatccaccacgtgaccatcgggccacttgagcccagcacgacctactactaccggtgcgggcggtccggcgacgagttcaccctccggacgccgccgtccacgctgcccatcgagttcgtcgtcgtcggcgacctcggcgagacggggtggacggcgtcgacgctgtcgcacatcaccgccggcggcggcggcgactacgacatgctgctcctcccgggggacctgtcgtataacgcggacacgcagcagccgctgtgggactcgttcggccgtctcgtgcagccgctggcgagcgcgcggccgtggatggtgacggagggcaaccacgaggtggaggcgctgccggggatccccgtggtgggggagctcgtcaagccgttcgtcgcctacaacgcgcggtggcggatgccgtacgacgacggcgacgacgaggcgagtgggtcgtcgtcgtcgtcgacgacgtcgaacctctactactcgttcgacgcggcgggcggcgcggcgcacgtcgtcatgctgggctcgtacgcggcgttcgtggaagggtcggagcagcaccggtggctggcgagggacctggcgcgcgtcgaccgccgccgcacgccgtggctgctggtgctgctccacgcgccgtggtacaacacgaaccaggcgcaccagggcgagggcgagcggatgcgcgtcgccatggagcggttgctctatgaggctcgcgtcgacgtcgtgttcgccggacacgtccacgcctacgagcgatttacgaggatctacgacaatgaggccgacagccggggcccaatgtacatcaccattggcgacggaggcaacaggaaggccttgctctcaagttcatcaaggaccacaagtcggcgcacctgtcggagtttcgggaggcgagcttcgggcatggccggctgaggatcgtcaacgagacgagcgccgtgtggacgtggcaccgcaacgacgacgagttcgccaccgtccgcgacgaggtctggctggagagcttggccgccgccgcaaaaccaggcctggcaccgtcgatacccgccggtcgtgacattgatgagctctagaatgctataggaatacaggatacacgatgaattcttt

SEQ ID NO: 468 - DNA, 1758 bp, Sorghum bicolor
agagctagcgcaagaaatggctccactactgcttcatgcttctgccataagtcacagtgcccatccagggcttagaagccatataggacccaacaatgagcatatctcacggcacctatcttcttcatcacaaaatactaagcgaaggtgcaacattagccttaggtcacgagctcaaaggataagcagtcagcttggaggccagaagctcgagcactgggaaatccctaaaagggactggttccctcctagctttacctttggtgccgccacttcagcattccaaatcgaaggtggttggaatgaagatggaaagggtccaagcacttgggatcacttctgccacacttatccggattttatagccgacaagagcaatggggacgttgcagcggattcataccatctctatgaagaggatgtaaaattgctcaaggaaatgggcatggacgcctataggttctcaatctcttggcccagaatattgccaaacgggacactcagtgacattaatgaaaaaggcatcgcctactacaataatctgatcaacttgttgatagacaacggcatagagccatatgtaacaattttccactgggacacgcctcaagcactggtagatgactacggcggcttcttagataagagaattataaaagattacacagacttcgctggactgtgctttgaacgattcggtgacagggtgaacaattggttaacctttaacgagccacatacatttacatgtttatcctacggaaccgggatccttgcccctggacggtgctcaccaggaatgaaatgtcccgacccaactggggactcaatcagagagccataccttgttggccacaatcttcttctagctcatgctgagactgttgatctttacaacaagtttcataggggtgagaaggggcgcatagggcttgcgcttaatgtaatggggactgtgccatatggaagtacgtttctcgatgaacaagcccatgaaaggtgtatggactacaacctaggatggtacttggagccagtggttcgtggtgactacccccattccatgagatcatcggtgagggataggctaccccacttcacagaaaaagagcaacagaagctagtgggttcctatgacatgatagggatcaactactactcctcaaggttcgccaagcacgttgacatcacagaaaatttctcgccagagctcaacacgcatgactgctgtgccactgaagaaattacagggcctaacggcaatactattggtcctgctactggaaatgcgtgggtctacatgtaccctaaaggcctaaaggatatccttatgatcacgaagaagagatacggaaatccaccggtctacatcactgaaaacgggatgggggacattgacaatggcgatctatccatggaagctgcgttggacgaccacataaggctagattaccttcagcgccacatctcagtccttaaagattcaatagattccggagcgaacgtgcgtggccacttcacatggtctctgttggacaacttcgagtggtctagtggctacaccgagcgtttcggcatcgtctacgtcgatcgtgagaatggctgcaagcgcaccctgaagcggtcagcaaggtggctgaaagagttcaacggagctgcaaaaaggcctggaaatctgattaagccaaatttcagcgaaataaataagatcaaagttgttacgccagcttagaacactggctgatgtttacccgtagt

SEQ ID NO: 469 - DNA, 3691 bp, Sorghum bicolor
catcagcagcttcccctcgcctgcctcgcctcgcctcgcatccgcccccgccctcgacccccgccccttcttcctcctcttcccgccgccgtccgacgccaccgccgcttggcgggggccgcctctcgcacacgcaccgcagtcgcgagcgacgacgaccccatgactatgatgacgccgccccctctcgagcagcagcaggaggacgacgagatgctggtgccgcaccaggagctccctgttgctggtccggaagccgccccacagccgatggaagttgtggcgcagacagagcccgccaacacagcggagagccagccgcccgaggacccgcagacgtcacgcttcacctggacgatcgagagcttcagccgtcttaacactaagaagcactactctgatgtgtttgtcgttggaggatacaaatggcgtgttctaattttccccaaggggaacaatgtggatcacttctcgatgtatttggatgttgcagattctgggaacctcccatacgggtggagccggtatgctcagttcagcttggctgttgtgaatcagatccaccccaagtatacaattcggaaagatacccagcaccaatttaatgcacgcgagagcgactggggtttcacatcatttatgcctttgagtgacctatatgacccaagcaggggctatcttgtgaatgacacagttgttgtagaagctgaggttgctgtccgcagaatggttgattattggacttatgactcaaaaaaagaaacaggttttgtaggtcttaagaatcaaggtgctacctgttatatgaactctctccttcaaactttataccatacaccatattttagaaaggctgtatatcatatgccaacaactgagaatgacatgccatctgggagtatccctttagccctgcagagccttttttacaagctccagtatagtgacaacagtgtagcaacgaaagagttgaccaaatcctttggatgggatacttatgattctttcatgcaacatgacgtgcaagaactcaacagagttctttgtgagaaactggaagataagatgaagggaactgttgtggaaggaacaattgaacaattatttgaaggccaccacattaattacatcgagtgcattaacgtggactataaatctagcagaaaagaatcattttacgatctacagcttgatgtgaaaggttgtcgtgatgtttatgcatcatttgataagtatgtggaagtggagcgtctagagggtgataacaaataccatgcggagagatatggcttacaggatgcaaggaaaggtgtgctcttccttgatttccctcctgttttgcagcttcaactgaagcgttttgaatatgattacatgcgagatacaatggttaagattaatgaccgctatgagttcccgcttcaacttgatcttgatagagacaatggaaaatatctttctccagatgcagatcgaagtattagaaacctctatacgcttcacagtgttcttgttcatagtgggggagtacatggtggtcactactatgctttcattcggccgacactctcagatcagtggtacaaattcgatgatgaacgagttacaaaagaagacactaaaaaggcacttgaagagcagtatgggggtgaggaagagttgcctcaaataaaccctggtttcaataacacaccattcaaattcacaaagtattcgaacgcctatatgcttgtctatatacgtgagagtgacaaggagaaaataatgtgcaatgttgatgagaaggatatcgctgagcatttgcggataaggttgaagaaagaacaagaagagaaagagcacaagaagaaggagaaggctgaagctcatctctacactatcataaagattgctcgagacgaggatttgaaggagcaaattggtaagaatatatattttgacctggtggaccatgaaaaagttcgcagcttccggattcagaagcagttgccttttacttcattcaaggaggaagttgcaaaggaatttggcatccccgtacagtttcagcgcttctggttgtgggctaagaggcagaaccatacataccggccgaatcgtccattgaccccccatgaggaagcacaatcagttggtcagcttagggaagtctcaaataaggcacacaatgctgagctgaagttgtttctggaagttgaacttggaccagagttatgtccaattcgtccacctgagaaaagcaaagaagacatacttcttttcttcaagctttataatgctgagaaggaagagcttcgttttgtcggtaggctttttgtgaaggctctgggaaagccatctgaaatattgacaaaactgaatgaaatggctggattttctccaaatgaagaaattgagctatatgaggaaattaagtttgagccaaatgtgatgtgtgaacatattgacaagaaacttactttccgttctagtcagcttgaagatggagacatcatctgtttccaaaaggctcctgttccagatggtgatacacaagtgcgctatccagatgttccttcattcttggagtatgtgcacaataggcaggttgtgcactttcggtctctggacaaaccaaaggaggatgatttttctttggaattgtcaaagcttcatacttatgatgatgttgttgagagagttgcacatcaacttgggttggatgatccctcaaagattcggcttacatctcacaattgttactctcagcaacctaaaccacagcccattagatataggggagtagaacatctactggatatgcttgttcattataatcagacttctgatatcttgtattatgaggttctggacattccactgccagaattgcagtgtttgaaaacacttaaagttgcattccaccatgcaacaaaagacgaggttgtcgttcatagcataagacttccaagaaatagcactatcagtgatgtgattactgatttgaaaaccaaggttgaactatctaatcctgatgctgagctccgcttgcttgaagtattttaccataagatttataagatctttccgcctcatgagaagatagagaacataaatgatcagtactggacattacgagctgaggagatcccagaggaagagaagaatctcggtccacatgatcgattgattcatgtttaccatttcatgaaagaccctaatcagaaccagcagattcagaatttcggagatccttttttgatggttatccgtgaaggtgagacttctgcagaggtaatggagcgcatccagagaaaactcagagttcctgatgaggagttctccaagtggaagcttgcattcatatccatgaaccggccagagtacctccaggacactgatgttgtatcagcacgttttcagaggagagatgtatacggtgcttgggaacaataccttggcttggagcacactgatacaacatcgaagaggtcttacacagccaatcagaatcggcacacctatgagaagcccgtgaaaatttataattgagaaaccttcatcacgcttcaatcgattgacaaaggcctcaacaagaagtacgccaaagatgatagggggcttggaacagaaaaaagctggtagaggagtatagttgctgtctgtgctgaggcctacaagcccatcaatgctgcgtcaaccttttagtgtt

SEQ ID NO: 470 - DNA, 1219 bp, Sorghum bicolor
agaatcagcttgcacacgtacctgcgcgctatactagtagagagcagctccactgcaccccactccacccaccacccaccgctcacgccccgccacctcctcctcggattcgccgatggagaagatgctccacgcagcccccgtccacgcgacgctcccggagtgcttcatcttcccgtccgacaagctcccgcaggccaagtccacctccggcgcggtctccctgcccatcatcgacctgtccctcggccgcgacgaggtccggcgcgccatcctccatgccggcaaggagatcggcttcttccaggtggtgaaccacggcgtgtccctggaggcgatgcgggacatggaggcggtgtgccaggagttcttcgcgctgccggcggaggacaaggccgggctctactccgaggacacggggaaggcgacgcggatctactccagcaccatgttcgacacgggcgccgagaagtactggcgcgactgcctccgcctcgcctgctccttcccggacgtcggcgacagcccccgcggctggcccgacaagccggccaggctccgggaggtcgtcgagcggttcacggcgcagacgcgcgggctcgggatgcacatcctccgcctcctctgcgagggcctgggcctccgcccggactacctcgacggcgacatcagcggcggcgacgtcgtgctccacgtcaaccactacccgccctgccccgacccgaccgccacgctcggcctcccgccgcactgcgaccgcaacctcctcaccttgctcctccccagcatggtccgtggcctcgaggtctcctacaatggcgactggatcaaggttgaccccgtcgccggcgccttcgtcgtcaacttcggatgccaacttgaggttgtgacgaatgggacgctgaagagcatcgagcaccgggtgatgacgaacctgggggtggcgaggacgacggtggccacgttcatcatgccgaccacggactgcctcatcggccccgccgcagagttcctcagcgacgacaacccgccggcgtaccgcaccatgacgttcggagagttcaagcgcatctacagcgtcgtcaagctggggttgtcgctcaacctcaccacgaatctcaaggacgtgcagaagcaggtctgatccaattaattaatgtaggatcggagtatatatgcaaccaataaaattaagtcccttgttagacctcacttgcag

SEQ ID NO: 471 - DNA, 1457 bp, Sorghum bicolor
cagccatggcgcaccggccggacgccgcggcgccgctgctcgccaagcccgacgccgacgcgacgcctcctccgccgccgaagcgcaacaagtaccccttcttctgcgccgtgctcgcctccatgacctccgtgctcatgggctacaacgtggcggtgacgagcggcgcgcagatcttcatggcggaggacctcggggtgagcgacgcgcagatcgaggtgctctcgggggtcatcaacatctactccctcgtcggcgcgctgctggccggctggacctccgaccgcctcggccgccgcctcaccatcgtgctcgccaacgccttcttcctcgtcggcccgctcgccatggcgctcgcccgcggctacgccttgctcatggtcggccgcttcgtcgccggcgtcggcgtcggctacgcgctcgtcatcgcccccgtctacgccgccgagatcgcgccgccgtcttcccgcggcctcctcacctcacttcctgagatttttatcaacactggggtgatgctgagctacgtgtcgaacctcgccttctcggggctgccggtgcacctgtcgtggcgggtgatgttcgcggcgggcgtggtgcccaccgtgttcctggcggccggggtgctcaccatgccggagtcgccgcggtggctggccatgaagggccgcgtcgccgaggcgaaggccgtgctcgacaggacgtcggacacgcccgccgaggccgagcagcggctgctcgagatccaggacgtcgtgacgaacagcagcagcggcgtcggcggcggcggcgcgtggaaggaggtggcgacgaaggccggcgtccggcgcgtgctggccatggtgctgacgctgcagttcttccagcaggcgtcggggatcgactcggtggtgctgtacggcccgcgcgtgctggccatggccggcgtcacgtccaacaccttgctcctgagcctcaacgtcctgttcggcgtcgccaaggcaggctccatcctcgtcgccatggcgctggcggaccgcgtcgggcggcgcccgctgctgctggtcagcacgggcggcatgacggcggcgctgctcgtcctgggctccctgttcgcggcgttcgcgggggccaaggacgacgccgcggtggccgcggtgagcgtggcggccgtcgtggcgttcgtggtggcgttctccgtcgggctcggcccgctggcgtgggtgtacagctccgagatcctgccgctccggctgcgtgggcagggcgccgggctcggcaccgccatgaaccggatcatgagcggcgtcgtcaccatgaccttcatctcgctctaccagggcatcaccatggccggcgcgttctacctctacgccgccatcgccgccgcgtcgttcgtgttcgtctacgcctgcctgccggagaccagggggcggagcctcgaggacatggaggagctcttccacaccaagtgatga

SEQ ID NO: 472 - DNA, 2275 bp, Sorghum bicolor
aaagtcgactccggttcacgccgcctcgactcgcctcggccctcgccgccatggccggcgaggccgcggagagggtggccgccgccgtggaggcggtgggatccggtggctgggagttccggaacgcgtacaggcgccagctgctggcgctgtcgcggcggatccggctcctcggcccctttgccgaggagctccgggaggcgcgccgtgggcggcccgcggaggaggaggaggaacaggagcgggcgctggcgccgctcgccgacgcgctggaggaggcgctcgacctgctccagctcggccgcgatggcagcaggatcttcctggtccttgataggaataaagtaatgaagaagtttcatgaatcaattgctcagctggagcaagccttgtgtgattttccatacgataaattggatatatctgatgaagttacagagcaggttgagttagtgcatgtacagctcaaaagagccaaagaacgggttgacatgcctgatgatgagttctaccatgaattactttcactgtataacaagagccatgacccaagtgctgaattggatatccttggaagattgtcagaaaagttgcacctgacaaccatcactgatctcacacaagaatcgcttgccttgcatgagatggtggcatctggtggtggtaacgatcctggagaacacattgaaaaaatgtcaatgctattgaagaagatcaaggactttgtgcaaactcagaaccctgaaatgggcccgccggtgactaccaaggtaatggattccaacggggagccaagacctataaacattcctgatgagttccggtgtccaatttctcttgagctgatgaaagaccctgttattgttgctactggccagacatatgagcgggcattcatcgagaaatggatagcttctgggcatcatacttgtccaaatactcaacagaggatgccaaacacgacactgacaccaaactatgttcttagaagccttattgcgcagtggtgcgaagccaacgggattgatccaccgaagcgcccaacggaggctgacaaacccacatcttcatgctctccaagtgaacgtgctatcatcgatgctctcctctccaagttatgctctgcagatcctgaggaacagagatcagctgctgcagagctccggctcctagcaaagcggaatgcaaataatcggatctgcattgccgaggctggtgccattcccttactattgagtctcctgtcgtcatctgacctgcagactcaggaacatgctgtgactgcacttctaaacctctctatacatgaggataacaagtctagcatcatattatctggtgctgtcccaggcatagtccatgttctgaagaatggaagcatgcaggcacgagagaatgctgcagccacccttttcagcctatcggtggttgatgaatacaaagtaacaattgggggaacaggagctatccctgcccttgtagttttgctaagtgagggcagcccacgtgggatgaaggatgcagcagctgctctattcaacttgtgtatttaccaagggaacaagggccgtgctatacgagctggccttgtgccactcatcatggggctcgtgacaaaccccactggtgcgctgttggatgaggctatggcgatactctcaatactctccagccaccctgagggtaaggctgcgatcggtgcagcagagcctgttcccgtgcttgtggagatgattggaagtgggtcaccgaggaatagagagaatgctgcagctgtgatgttgcacctgtctgtgcataacgggcatttagctcgggcacaggagtgcggcatcatggttccactacgggaactggccctgaatggcacagacaggggtaaaagaaaggcggtgcagctccttgagcgaatgagcagattccttgttatgcaacatgaggatactgtttcccaacaattggacgagattgaacgtcaatttgccgccttaggacctaatgttacagaggctgatcttgaacaattgggtgaacaattgggatatctttaacctccacatgctatggttgcatgatgatgatgaatctatcgtcgccacaatactaccaaatgttttttttggataagttaccaaaaggacgagcaagctgtatccgagtcacttggcttctggatccatggtttatgctgaacgagagttcttgtatggcaatgttcaatcggcactgaaatctgtgatgatccgtctggcttggcttcttccatgaattcttt

SEQ ID NO: 473 - DNA, 962 bp, Sorghum bicolor
caagaatggcgggtggcggcgccgacgacgacgacgtggtggaggtgagctgcggcggcagaggcggcggcgaccccggcgcgtacgccgcggtgctcaagaggaagctcgacctgtactgcgccgccgtcgccaaatccatggaagctaaatcacaagaatcttcgttgggctaccccaactcacaagcttcagatacttcgcaattgatttctcaagcttcctttgatggtgacatagatggagcaggccttgtcacaaactctaatgtcataatagaagatgatgattttcaaggcaagccaaccaatagtggtacatcaaaggaactgtcagacgatgatggtgaccttgaagagaacactgaccccactaacgccaagaagatgaggagaatgctgtcaaatcgggaatcagctaggcgatcaagaaagaggaagcaagcacacttgaacgatcttgaatcacaggtttccaggttaacatctgagaatgcatctttgctaaagcgtctggctgatatgactcagaaatacaaggatgcttcccttgacaataaaaatctaacagttgatattgagactatgaggagaaaggtgaacatagccgaggaagctgtcaggagactaactggaacaaccctcatgttatcaaccgcatttgacaagcccatgagcagcacacccttgtcatcatgtgcatctgatgcggcttctgcctctgtcgccattgaagatagcgcgaaacatttcctccatgcgccacttcaaagcggtcagatgaagcttgacatcctgaacgcggcgattcctctgaccagtgaggggataggcaccaagccagcttctctgcagcgtgttgctagcttggagaacctgcagaagaggatcattggagattcgatgcactctgagactgcatcaacattctcagagcctgaagctcttgccgataggtaataa

SEQ ID NO: 474 - DNA, 1517 bp, Sorghum bicolor
ctgttccgaccagagagagagagagaggatcgccagtcgcgaggctgaggagcaagggagatggcgtctccgtacgccgcctcgccgtacgtgctgtcgctgctgcttctggtgctctccgtcccggccgtcttcctcctcgcgccgcgcctcatcccgccgcgcacgctcccggccatcccggacgccgacgagacggaggacctcgcgctgttccgccgcgccgtgctcctctccgccgccccctccaagaccggccccgcctccgcctccgcatccacctcgcgcttcttcggcgcggcccaccgacagaggaagcagaaggtggcgttcctcttcctcaccaactccgacctcgtcttcgccccgctctgggagaagttcttcgcgggccaccacgacctcctcaacgtgtacgtccacgccgacccatccgcggcgctgctcctcccgcccacgccttccttcagggggcgcatcatcgggggaaaagccaccgcgcgcgcctccgccacgctcatctccgccgcgcgccgcctcctcgccaccgcgctgctcgacgacccggccaaccacttcttcgcgctgctctcccagtcctgcgtcccgctgatgcccttcccggcgctctaccgcacgctcgccgccgacaatgccggcccgcgcggacgacaccgcagcttcatcgagatcctcgacgccgagcccacgctgcacgaccgctactacgcgcgcggcgacgacgtcatgctcccggaggtgccctacgagagcttccgcgtcggctcccagttcttcgtgctcaccaggaggcacgccgtcatggtggtcagggacaggaggctctggaacaagttcaaactgccgtgcctcgtcaagaggaagttctcgtgctacccggaggagcactacttccccacgctgctggacatgcaggaccccgccggatgcaccaagttcacgctcaccagggtcaactggaccgactcgttcgacggccatccgcacacgtaccagccggaggaggtctccccggagctcatcagggacctcaggaagtccaatggcacatactcccacatgtttgcgcgcaaattcgcgcctggatgccttgctcccctcatggagattgccgactctgtcattcttcgtgactaggctgcttgcctccctccgtttgcacaactggaagagctgagggttgtgatgtgatgaacaagcgtaagctgatccatccattccctttggaattcttcagagaggaggaaccagcaccaaacctactttgttttgcacctgcaattgctctatggcaaaagttggatgccacgcctcagaggttaatgatggcggtattggtggcgaagggccccagctgcctcttgtgagtatttgttttttgtgagttcttgtttctttttttcccaatgagagctgagtggtggctaaagatgatggagaagtttgcacgtaatagggtcgtagttagcatgatcatcctgtgtatttgcatggag

SEQ ID NO: 475 - DNA, 871 bp, Sorghum bicolor
gtttctttcagctcgggagaggtagccatggggaggtcgccgtgctgcgagaaggcgcacacgaacaagggcgcgtggaccaaggaggaggacgagcggctggtggcgtacatccgggcgcacggggaagggtgctggcgctcgctgcccaaggcggcgggcctgccgcgctgcggcaagagctgcaggctgcggtggatgaactacctccgcccggacctcaagcgcggcaacttcaccgacgacgaggacgagctcatcatccgcctgcacagcctcctcggcaacaagtggtctctgatcgccgggcagctgccgggccggacggacaacgagatcaagaactactggaacacgcacatcaagcgcaagctcctggcccgcggcatcgacccgcagacgcaccgcgcgctcggagtcagagccgacgccgccacggctcccggcgccgtcgcggcgcaccaccgggcggcggcgctgctgcaccaccacgcgggcgccgtcgtcgtcccggtggccccggtcaagctcctcgccgtgaagccggcgcccgcggagtcgtcatccgacgacggcggcagcagcagcaccggcagcagcggcggaggcagcgccggggagccacggtgccccgacctcaacctcaacctcgacctgtccgtgggctcgccgccgccggcggcggctgccgacacgcccacctcgctgtgcctgtgctaccgcctcggcctccgcgccggggaggcgtgcggctgcgaggctgacatcacggggcaacaggggtttagatttttcaggccgttggaacaaggctagtagtgccgtaaactacgagcttctgctatcagacttgagaatgagaacccgagag

SEQ ID NO: 476 - DNA, 2091 bp, Sorghum bicolor
acccatagtctttctcgcagcgccgccgctccatcttctgctccttcccctactcgccgtcagcggcgctcaggctcgggcgctcagcgacggaggggcagtcccaggctcggcggcggcgtcagcggctccccctcccgcctctcgtccttcgcctcgcgccctcgcctccgtcctccgcgcaccggccggcgaccctgcgaactctccaccctggctgctggcgggacgccatggaaggggcggctgcgctctcaccacacgacccctcaaagttttcaaatgcagaggctcccttcccagaccaattacatgggggaggaagaggatctccaaacattgaagaagcaggcttccctcaagaagactgtgagaggttgccaccctagagctgtacggcagttgctgcagctcgatagaagagattctgagcatccaatcgtgatagacaatgaagtaaacgaggaatataaggtcagcgctgatcaatcagcaattatggttctccgcagatccccacggtttcatgtggaagataagagtttgggcaagccgctgttgccaccaaatcacccggagacgcctcctaacaaaaagagtaaaagtgctcatttgaaagacaaaaatcaaaagagtctgaaaagtgatagtagaaatgctcgattggagcctttggcaacaatgaaaaggcagaatgagccccagttactttgtcaagatccccgaggcatcaccagcaggaaaaatattgaagatgtatctaacaaaaagagtgagaagaaagagtttatgcccactaattgtaaagtgttgataggaaagaggaagagaggcagaaaaagggcgttgtcatcgaagaagcaaagttgccaagagccaaaaccattgcctacaaatcgccaagaaattgcaccttgtgatgaacccagaaaatctatccacagaaggattgaaaatgaaccgtctattgtggtgatgcctaaaagtggtgatgaggaattgacaaacattgatgaaaacatcagcaaaccaagtgggactgaaagaggagtgggaaaattttgtagctctgatgattggacaaaagagcaggacatggcattgcgcaaagcttacttcactgctcgaccatccccacatttctggaagagagtttcaaaaatggtgccagggagatctgctgaagactgcttcaacagaattcatgctgacctcacgacaccaactccaatagccccacgtcccagaacaagtaaaacaacattttctcctataggaaatttcacattgtctgatccaaaacttccaaatctcttggaatctagagttgcaaggcaaaggaccgctaaacaaaagggtcttacagcacagaagacagtgaggcatttgttgcagaagcattgtgtcattgaccaagctcaagaggctgatcacttctcagtttttgaaagctcaccaagtgccttacaattgaacttatcttttgaagattctcatgggactcctgacagttatacgaattcaggttctctaggcaaatgcagtggaagctcttcagcacgaaagaaaccaatttcaaggttaagaactaagccatctgaaccgagcccagaagttctaaagcctataaagaatgttatcttacatgagaagtacattgatcaattgtcacgtagagaatatacaaaaaggcctcgcaaaagcactcaaggctctaaagctgctgattctgagaaggctctttctgagcagaaagctggtagtctgaaggctgctaaaaatgctcttatctcagaagcaactgactttataagcagttttaagaaggtgcaagcctgttcccttgcgcatgttgtggaaaatagcgaagatgatgagattgaatgtgatgccagtgattacagccatgatgataaagaataaggaggtgcttatggtgttaattcccagcagctcttagcaattattaccttttttgttaatgggcgttagtcatcactcatcagtgcctggtgcttcaataggtagttactagtatgggtggtatggaggtgtattctgcctaatatgtgtcttgttcctagtgccctc

SEQ ID NO: 477 - DNA, 776 bp, Sorghum bicolor
tccacatggccgctcctctccacgcgcgcctcctcccgctccccttgcccccgaaccctagccccggcctccccccgagcggcgcgcggcgggtgctccggcacccgcgccgctgcctcgcgacgccgccgtcgcggaacgggagctcctcctcgccggagaccgagtggtgcccggtgccgccggagcagcgccccgtgaacgagtacgaggcgctcgcggcgtccctgcccttctcctgggcggcgggggacctccgcgtctactgctcccgcctcgcgctcacgggcgccgccgtcgcgctcttcgtcgggctccccgtcgccgccttcgggggacgcggcggggccggcggcgacgctctgcacctcgcgctcggcgccacggggtccgggatcctcgccgtcacgctcgccgtcgtgcggatgtacctcgggtgggcctacgttggcaaccgcctgctcagcgccacagtggagtatgaggagacgggatggtatgatgggcagatatgggttaaaactccagaagttttagctcgcgatcgacttctaggctcattttctgtcaagcctgtgctaaacagagtgaagttcaccttggtgggtctggcaggctccctgatcctttgcattcttctttacgtgaacaccgaaaacccaaaggaaccatatgttaataccggtggaagggctatccctggagtgtacagtgacactgccgcaaggtcatttgagcctgatgcattctgtggagagcctgatctttcgtagtag

SEQ ID NO: 478 - DNA, 1724 bp, Sorghum bicolor
gttcccgtgcactcagactcagcggcggcgagatggacagcgccgacgcggcgacgccggcgccgctcggcgcgtgggcgtggatccggggatacttcacgccggccacgctcttcctcgtcgtcaacctcgtcatcggcaccatcgcgctcacctcccgcgccacccagcagcgccgtcgcagggagcactactaccacgacgacgcccacggccccggccaccacctccaagaggaaccgctgcacccgcagatggagcaaccggggtacggacactactaccacccggagcagacgctgtacgcggcgccgcctccgcccgcgccgctcgcgcgcacgtcctctgttcttgaccggctcaggtcgctcggcctctaccgcttccgctccggcgagttcccgcccgagtacggcgctgctgctgcggcggcggcggcgccgaactacgcgcaggatgtgtccgctccggtgggggaggaagagacgaccgcgacggcgcactacgccaggagccggtccgagccggcgccttctgcgcgggaggatgagaggaggccggcgctgcccagggtgaagaagtcgggcccggaggtgagaaaatcacaagtggcgccggcgccgcccagggtcgtcaaggcggtcgccgaggtcgacgactccgtggaggaagcgggggcggaggaagccgtcggcggtttcaggcgggtcccgtcgccgctccagcaagagtaccactaccaggaagattacgttcctcctccggcgcgggcgcgggcgcgggcgccagcggcaccggccccgctgcagcgcacgtcgtccgtcctggaccggctccgctcgctggggctctacggcttcctcgctcccgaccaacccaccgccgccgcgccagttccagcgaccgatgccttcgccacccacggggacgagaaccggcacgcgcactacgacaggagccggtccgagccggcaccggtgcagggcaagaaggagaagaagcaggaggcgaagtcaagaatggcaaagtcgggctcggagacgaggaagacgcccgctccgaggccggtggaggccggcggcgagtgcgtcaacgcgagggcggaggcattcatcgacagcttcaggcagcaacagcagcaggtggtgcagcactaccaggaggaggagtacgtcccgcctccagcgcccgcgccgctgtcgcgcacgtcgtccgtcctggaccgcctccgctccttcggcctctaccgcttccgctccggcgacctgggccccgacctccccgccgccgccgacacggacgagaaggagaaggagcagacggcgcactacgggcggagccggtcggagccggcgcgggagcagggcaagaagacgaacaagcaggaggcgaggatgagcaagtcgagctcgagcggcgtcgtggaggaggcggcggcggcggagacggagcagtgcgtggacgcgcgcgcggacgacttcatcaacaagttcaggcaacagctgcagctgcagcggctcaactcgctgctcaactacaaggagatgctcaaccgcggcggcggcggcggcaagcagtaggagcctagcgtcgccgcatgatcagtcatctgtgcgtgcacggcagagaagggttgcatgcaggaattggctagctagatagtaggatccaaattccaaaaacctactaaaacatcaatctttggtcaactactagagtgtggg

SEQ ID NO: 479 - DNA, 2466 bp, Sorghum bicolor
gattagcctctctgtcatgtcgccagtacagcgcgacgctccgcatccacccaaatcggagtagggctgccttgccgcccccacaccctcaaggcatcactcagtagccgccgcatccggccgccggtcccgctcccgcgcgaggggaggagaagatcacggcggcggcgtcttctgctggtttgaggatttggggacatcagctgccgccaggctccatcatggacacggcgtttctgcgccctccgctcgctcgtaatctggtttatgacgagtttgccgttctgcaccccacaagctacccttttcacactcttcggtatttgagatgcaacccgatgtattcaagaccgctgctaacaacatcaccagcttcaccatcaaggggcttgactcagagaatggccgcactacctgatgttgatgatttcttctgggagaaggatcctactccgatcctggacacaattgatgcacccatccatttgaaaaatttatctagtaaggagctcaagcagttagccgacgaagttcgttctgaaatagctttcataatgtccagaaaatgccaaccatgtggtcctggtcgctcagttgtggagctgacaattgctatacattatgtgttcaatgccccaatggataagatactatgggatgctggtcaacatgcgtatgcgcacaagattctcacaggaaggcgctctcaatttcatactattaaacagaaaaatggcctttccgggttcacgtcgcgttttgagagcgagtatgatccctttggtgctggacatggatgcaatagtctatctgctggccttgggatggcggttgcaagggatataaatgggagaaaaaatcgaatagtgacagtaataagtaattggacaaccatggctggccaggtgtacgaggcaatgggtcatgctggtttcctcgattccaacatggtagttattctaaatgatagctgccataccttgcttcctaaagccgatggccggccaaagatgtcagtcaatgccttctctagtgctctcagcaagattcaatccagcaaaggatttagaaggtttagggaggctgcaaagggacttgccaaatggtttggcaaaggaatgcatgaatttgctgccaaagttgatgagtatgctcgtggtatgataggtcctcatggagcaactctttttgaagaacttggattatattatatcggtcctattgatgggcgcaacattgatgatctcatctgtgtactaaaggaggttgcaagcctagattcaactggcccagtacttgtacatgtaattactgggactgaaagtgacactgatggaaatattagaagtgaaataactgcaagtgaggaagggccttcaaattcgagcaatgatcttcttaaatttttagaaactggactttctaggacatataatgactgctttgtagaagcactaacagcagaagcagagaatgacaagcgcattgtggtagttcatggcggcatgggaatggatcggtcactccgcttattccagtctaggttcccagacagattttttgacttgggcatcgctgagcaacatgctgttaccttttctgctggtttggcctgtggaggtttaaagcctttctgcataattccatccacatttcttcagcgagcatatgatcagatagttgaagatgtggacatgcaaaagataccagttcgatttgctatcacaaatgctggtctggtgggatctgagggcccaactaactcaggaccatttgatattacattcatgtcatgcttgccaaacatgattgtcatgtcaccatctaatgaggatgaacttattgacatggtggcaacagctgcaatgattgaggacaaacctatttgcttccgctatcctaggggtgccattgttgggactagtggaactttaacatatgggaatccgcttgagattggtaaaggagagattcttgtcgagggaaaagagatagcttttcttggctatggcgaggtggtccagagatgcttgattgctcgatctcttttgtctaactttggcattcaggcgacagttgcaaatgcgagattttgcaagccacttgacatcgatctaatcagaacgctatgtcagcagcacagttttcttatcacagttgaagaaggaacagttggtggctttggatcacatgtctctcagtttatttcacttgatggtctacttgatggccgaataaagtggagacccattgtgctaccagacaggtacattgaacacgcttcactggcggagcaacttgacttggctggcctaactgcccatcacatagctgcaactgcattgaccctcctagggcgtcatcgtgatgcacttctgttgatgaagtaggggaaggaactgccaagaagaacggatagataaaggcaatttctgcaaaagttccatacggagaccacttgtcatg

SEQ ID NO: 480 - DNA, 1565 bp, Sorghum bicolor
gcgacatgaccggcgcggcggcccacgcggtgagcccccgcggcggcgcctccgcctccgcgtccgcgtcccagccccacgccgcagcagccgcggccgcgggggccggagcggcggggtgcgagccggtgcggaaggcggggcccgtgaccatggagcacgtgctgctcgcgctccacgagacggaggccgagcgggaggcgcggatccgggacatgttcgccttcttcgacaccgagggccgcgggcagctcgactacgcgcagatcgaggccggcctcgccgcgctgcaggtgcccgccgagtgcaagtacgccagggagctgctccgcgcctgcgaccgcgaccgcgacggccgcgtcggctacgacgacttcaggcgctacatggacgacaaggagctcgagctctaccgcatcttccaggccatcgacgtcgagcacaacgggtgcatcctccccgaggagctctgggacgcgctcgtcaaggctggtatagagattaatgatgaggagctggcaagatttgttgagcatgtggataaggacaacaatgggattattacttttgaagaatggagggattttcttctactttaccccaatgaggcgaccattgagaacatttatcatcactgggaaagagtctgccttgttgatataggtgaacatgctgctataccagaaggcataagtaaacatgtcaatgcaagcaaatatctcattgctggagggattgctggtgcagcatctcgtactgcaactgctcctctggatcgccttaaagtgatcatgcaagtacaaacgacgcgtactacagtcatgcatgcaattaaagatatctggactaaaggtggcatgctgggattttttagagggaatggattgaatgttgtaaaagtcgctccagaaagtgcaataagattttatgcctatgaaatgttaaaagaatatattatgaagagcaaaggagaaaataagagtgaaattggtgcttctgaacgtctcgttgctggtggtttagctggtgcagtggctcaaacagcaatttatcctatagatttagtaaagactcgtctacagacgtattcaggtgagggtggtaaagttcctagaattggtcagctctcaagggatattttggtgcatgaaggcccccgagctttttacagaggtcttgttccatctttgcttggtatcgtaccttatgccggaattgatcttgctgtatatgagactttgaaagatgtgtcaaagacatatatactgaaggacagtgatcctggtcctctagtacagctaggttgtgggactgtctctggagctctaggggcaacatgtgtttaccctttacaggtcatcagaacaagactgcaagctcaacaagccaattcagaatctgcctatagaggaatgtctgatgtcttctggagaaccctacagcatgagggtgtttctggattctacaaaggaattctaccaaatctccttaaagtggtgcctgctgcaagtattacctatatagtttatgaggcgatgaagaaaaatctgtctcttgattaataa

SEQ ID NO: 481 - DNA, 1280 bp, Sorghum bicolor
cgtaccaccggatttctgtccgcgcctccacccgctccttcaaaaaccatcggcaccgcacggcacggcacgccggcgagcgacaccaccacgccgggacggggacgggacgggaggcgcaggtgcggtcggcgtcaactgtcgcggcacgcccggcaggcaggcaggcaggcagggagggatgaagaagtgcgcgtcggagctggagctggaggcgttcatcagggagagcggcgacgacgacgcccgcgccgccgccgccgggcgtagcaatcacgggtgcggcggaccaggcgagcccggagggagcgccgtggtgttctcgcccggcgtcggtttcgccgaatcgaacaccatggatgacagcagttggtggtatgggagcgtccgcacgccgaacccagtcatgtcgcggacagcgtccatctccgccagcctcgaggcaaccacctcagcgaatcatgctcttgaaagcgagtcagactccgacagcgaatcactctacgaggtagagggagttccatatgagcgaggcaacaaatctgtagaaacaaagcgaataagaaggatggtgtccaacagggagtctgcgcgacggtctaggcggagaaagcaggcacaattgtcagaacttgagtcacaggttgaacgacttaaaggtgaaaatgcaactctgttccagcgactttcagaagccaaccagcagttcagtactgcagtcacagacaacagaatcctcaagtccgatgtagaagcattaagagtcaaggtaaagatggcagaggatatggtagcgagaagtgctatatcctgtggcctaggcgatcttggcctggcaccatatctgaactcaagaaagatgtgccaagctttgaatatgctcacaaccacaggtttggatttacttgggagtgatgcgttcagaggtccaaccacagctccacaagtacaaaactcaccagtacaaagcactgcaagcctagagaatctggataatcgaaagtccaacgaggtgaccagttgcgcggcagacatttggccttgagcttcaagccattgatcaggttcaaagcttgcttcacccaaaaaacaacaacagtagttcatcaactcaaataactggtggcttgagcagagcttctggcacaaattcccttgaaccatatttccatagaagctttataggatgcatcactcttttgatgtaactatgtgtgtagtacgtctccagtgggaaagtaccatttactggcagctgccttggcagatagggtaatgtc

SEQ ID NO: 482 - DNA, 2605 bp, Sorghum bicolor
tgggttgggttgataacttgaggttgcgatttttttggagctgcgggagagaaaggaagagatggggcagagcaaggcggagttcttggaacagttcggtggggactacggttatccggacgcgcccaggggcatcgacgagctgcgggccgctgagttcaagcggctggaagggatggtttacctggaccatgctggtgcgacactctactcagaggcacagatggcggatgttgctagagatcttatgtctaatgtctacgggaatcctcatagtcagaatgattcaagcatggctacaagcgacattgttacttctgtgcggcatcaggtcctaaaatacttcaatgcatctccaagggattacaaatgtatatttacatcaggggcaacagcagctctgaaacttgttggtgaatgttttccatggagtagagacagttgctatatgtacacaatggaaaatcataatagtgtgcttgggataagagaatatgcactgagcaaaggagctactgtatcagcagttgatgttgaagaggttgttgatccatcaaataatcatgagagtgataggttttttaaggtttcaaaacactcaaaccaaagaagaggtgatgatttgcttttgcacaattatcagaatgggagcctgacagctatttcaggaaacaatttaaatctatttgcattcccttcagagtgcaatttctcaggacataagttcaacctcaacttggtcaagctcatcaaggaaggaaaatttatggatttctcatcacaacagcggggccagtggatggttctgatagatgctgcaaaaggatgtacaactgaaccaccaaacttatccctgtatcctgctgactttgttgtctgttcattttacaagatatttggctatccaactggtcttggtgccttaattgtaaaaaatgaggctgctagtttactgaacaagacatacttcagtggaggaacggtagctgcttcaattgctgacatcgactttgttcagaaaagaaaaggcattgagcaagctcttgaggatggaacaatctcattcttgagcatatcttctcttcaatatggctttaagataatcgatatactaactatctcagctattgcacggcatactgcgtctcttgctacttatgtgagaaataaaatgctggaattgaagcataacaatgagaaaaatgtttgcataatctatggacaagcttctaaggcaaattatctaaaaatgggtcctacaatcacattcaatttgaaaagagaagatggcacctggtttggatatcgtgaggtggagaaacttgcctcattgtcaggaattcatttgcgtacgggctgcttctgtaaccctggtgcatgtgctaagtatgttggtttgtcgcactcagatctagtttccaattttgaggctgggcatgtttgttgggatgataatgacataataaatggaaaaccaactggtgctgtgaggatatcatttggctatatgtcaacatatgaagatgcagaggaatttctgaaattcctgcagtcatcttttgtgtccaaacctgtgggattgaaaaatggctacatggtgaatacggatacttttaatttagtagatgattggcgccagcaagctatttcagatattcgcttaaaatccataactatctatcctgtgaaatcttgccaaggatttagtgtgcagagctggccactgacaactggtggtttaaaatatgatagagaatggcttctccaaggatcaggcggtgaagttttgacacaaaagaaggttcctgaattgagctctatctgcacattgattgacttggagcttgggaaactcttcttagagtcgccgaaatgcaaggataaattgcaaatctgtcttctagagaatctgactcttctgagtgcagaagtagatgtttatggtcaaaggtatgaggtgcaaagttatggcgacaaggtaaactcctggttcagtggagctattggacgtccttgtacatttgtgagatgctcaagttccaagtaccgttcctgcacaattaatggcaggagagatcgcctctgtagggatactcgaagcaaacttagttttgtgaacgaaggacagttgcttcttgtttctgaagatagtatatctgatctcaacagtcgattaagttcaagtaatggaaatggtaagcaaggggtgttggttgatgcaatgagatttcgtccaaatattgttgtctatgggtccacaccatacaatgaggataactggaaaaggcttcacataggggatgcctatttcacttccatggggggatgcaaccgttgtcagatgatcaacctgtatcagagctcagggcaggtgatcaagtcaaaggaaccgctggcaactttagcatcatatagacgaaaacagggaaagattttgtttggcgtcctgttgaactatgaagacggcatggaaggagaagatgatgccattgtagagagatggctcaaagtggggcaagaggtgtatccttctacataaagacttctgtacatgtgtacccagaagtttctcctgcataagaggctgacgggcaacagttagtta

SEQ ID NO: 483 - DNA, 2403 bp, Sorghum bicolor
actactagctgccgtaccgtgggagcgccgcctctccagtctcaccaacacctcctcctgctgctctctgttttggattcccgtgccggattgacaccgctcccgcattacagcggcgctcttcgtgcgtgcgccggggccccggtgctcaggatgggggcgacccacgacgccgaggtggaccaggaggaggaggcgcggcgcatggcgagcctcctagcggcgcgccgcgcgctgcgtgccgggctggagaagtcgcgcgcgctgacccacgcgctggccccgcggctggaggccatccaggcgcgtctcccggccatggaggcgtcggtgcggccgatccgcgcgccgcgggaggcgctggcgacggccgggaccaacatcgaccgcgcgctgggccccgccgccgccgtgctcaaggtgttcgacgccgtgcacggcctcgagcctccgctcctcgaccgcgccgccgtcgccgacgacctcccgggctacctcgccgtgctggcgcagctcgaggccgcgctccgcctgctcgccgacaactgcggtctcgccacgcagtggctcgcggacgtcgtcgcatacctcggggagcgaaggctcgccgacggccgcttcgtggcgggactcgccgccgcgctcgaccggctcagggacgccgccgcgaccgccgacctcgacgccgggctgcttgccgccgcgctcgacttgctcgaggccgagttcaggcggctcctcaaggaccactccgcgccgcttgccatgaaggaccccgccggcggcggctccgacccgccggccgtcgtgccgtctcggatccctgcctccgtcgtgtacaagctcagccttatccttgaccgcctcgctgccaacggccggattgaccactgctcgtccgcgtacgcggacgcgcgaggggataccgtgagcgccagcctccgcgcgcttggacttgattacctcaaggagacatcgggggacgcgcaggcgctcagccccagcgtcgagcgctggggccggcatctggagtttgcggtgcaccacctccttgaagctgagaggaagctctgcgtcgccgtgtttgaacgccggccagaggccgcgccggtgtgctttgctgagattgcagctcgtgctggcattcttgatttcctgaatttcggccgtgccctggctggtgccaggaaggaccccataaagctattgcggctgcttgatgtgtttgattgtttgaacaagctgaggctggacttcaaccgattgttcggtggaaaggcgtgtgtagagatccaaagcaggactagggagcttgtcaagacggtcgtggatggtgctgttgagatctttgaggaattacctgttcaggtggagctgcagcgcaatttgccgccaccagttgacggtggagtgccacgcatcgtgagctttgccgccaagtactgcaatcagcttcttgatcagccgtatcgatctgtgctgacacaggtgatcaccatccaccgcagctggcgcaaagaagtgttcaacgacaagatgctggttgaggcagtgcttagtatcattaagacgctagagataaactttgatacatggtcaaagtcttatggagatccgacacagtcatctctcctcatgatgaacatacactggcacttcttcaaacacctgaagggtactaagctgggtgagctgttaggcgatccatggctccgggagcatgaacagtacaaggattactactcaacaatgtttctgagggagagctggggaacacttgcacccctgttgagcagggagggcatgatcatgttctccaagggccgtgctactgcaagagatttagtgaaacagaggctcaaatcattcaatgctagctttgatgagatgtttcaaaagcagtctaaatgggtgatatcggatagggatttgcagcagaagacgtgccacctcgtggtgcaggctgtagtgcctgtttacaggagcttcatgcagaactatgggccgcttgttgagcaggacgttagtgcgagcaggtatgtgaagtacagcgccgacgatctggataagaagctcaacacactcttcctggccaagccaggcaggccaatgagagctggaagtttccaaatcaaaaattcagatgacaagattaccagcgcaatgaccggactgtatcggagtgcttctactctgaagtagcttcagtgggagtttggaaagactgaacgcacaatttgtgcaataagccaataacttggtaggcaaggatgattcgggccagtaagtcaagatccccacttatgtgggggtgtaataatggtcccatgattagaagagctggagcatataagaagaactgacattgcgggggagaagatgacaggagtgtttcctcagagg

SEQ ID NO: 484 - DNA, 871 bp, Sorghum bicolor
aaaggatcccgaagaaacactccaagaaaccaagaacaccacacacacacccaccgacacacggcaggcgagaacgaacagacaaggaaacaataatggcttcgtcgctcgcgtcgacgccggtgttccccagctgcggcgcgcggcgcggcgcccggtgcgtggcgcgcgcgtccgcgtccgcggtggcggtggcgtctccgtcggcggcgaggacgcactacgaggtgctcggggtcggggccggcgccagcaggtgcgagatcaaggcggcgtaccggcgcctggcgagggaggtgcacccggacgccggcggccgcggcgacgaagggttcatccgcctgcacgacgcgtacgccacgctcgcggaccccgacgagcgcgcgcgctacgaccgcgccgtggccgtcgccgcgccggtccggagcggcagctgggccgcgccgtcagggtccgggtcggggttccggccgcggaggtgggagaccgaccagtgctggtagtagcagcatagcaccatcgccacgtagctgtgcggcgctccacgcctgcacgcgtccctccgctcgagcgcggcggccggtggagtcgccggacgccggagcgcggctcgatggtctggtccccgggcccggggccagctcagctgcgaccgacggggatcgtattgaagatgggccgcatggaaaatggaacggatcgcgatcctggcggcccacatgagctggatcgtggacgttatgggccggaggctccgtgggccttggcgccactggcgatgaggatgccgcggcctgcgggccgagggagcagaggtcgcgtggacgcctctctttcttcgtgtccatcttgccatcatagcggtaccttt

SEQ ID NO: 485 - DNA, 833 bp, Glycine max
acagtatgagcgtcatcgacattctaacccgagtcgattccatttgcaagaagtacgacaaatacgacgtcgaaaagcaccgcgatgccaatgtctccggcgacgatgcctttgccagactatacgcctccgtcgacgccgacatcgtggccttgcttcagaaagcagaaagtgcttctaaggagaaaggtaaggcatctgctgttgcgatcaacgcggagattcgtcgtactaaggctcggttgctggaggaggttcccaagttgcagagattggctgtgaaaaaggtaaaagggctttcgtcacaagagtttgctgcccgtaatgatttggttcttgcattgccagatagaatccaagcaatcccagatggggctcctcctgtgccaaaacaaactggaggctgggcagcttctgcctcccgtcctgaaattaagtttgattcagatgggcgatttgatgatgaatacttccaacaaagtgaacaatcaagtcaatttaggcaggaatatgaaatgcgtagaatgaaacaggcatgtaacttaaagcagttgtcagtggaccaaggattggatgtgattgctgaaggattggatacattgaaaaatatggcacatgatatgaatgaggaactggatagacaagttccacttatggacgagattgacactaaggtggacaaggcatcctctgaccttaagaatacaaatgttagacttaaagacactgtgaaccagcttcgatccagtcgaaacttctgtattgatattgttttgttgattataattttgggaattgctgcctacttatacaacgtactaaagaaatgatga

SEQ ID NO: 486 - DNA, 704 bp, Solanum lycopersicum
atcccatggctcctgctcttgaacaagcaataaccagcgatgcatcatcggacgttaccatcactggaaagatatacacacgagttcgtctcgctacgaaatctgatctttctcatatataccgattgttttaccaaatccatgaataccataactatactcatttatacaaagctactgagtcctccttagccaacttgctctttaaggaaaaccctcttccacttttctacgggccatctgttcttctacttgaagtctctccaaccccttttgacgaacctaaaaatactacagacgaagggttcaagcctgtccttacaacgtttgaccttaaattcccagtcgtagaaggagaagttgaggaattccgatccaaatatgatgataagagtgatgtttacatcgcaggatatgctttcttttacgcgaattattcatgcttttatgacaagcctggattttatttcgagagtctttacttcagagagagttatagaaagttaggaatggggagtttgttgtttgggacagttgcatctattgctgccaacaatgggtttgtatcggtagagggaatagtagcagtttggaacaaaaagtcatatgatttttacgtaaatatgggagttgaaatatttgatgaatttaggtatggaaagttgcatggtgaaaatcttcaaaagtatgctcataactagtag

SEQ ID NO: 487 - DNA, 1453 bp, Solanum lycopersicum
cttgaagtgttgagattgagggaggagggaaaaaaaacaagaaaaagagagatggggtttgagggtatgaaaaagttgaagcctttattgcatttgttgttaccattatgtgttcattggattgctgaagagatgactgtttctgtgcttgttgatgttactactggtgctctttgtccaggcaaaaccacttgttctgaagctatttacatcaatggtgttcaacaaacagtcgttggaatattcaagatgatagtccttcctatcctaggtcagcttgcagatgagtatgggcgtaaaccgcttcttattctcactgtatctacaacaattattcctttcggtttactcaccatcaataagtcaagggaaatggtctatgcttattatgtcttgcggacgatttcctatatcataagtcaagggagcattttctgtatctctgttgcttatgcggcagatgtagttgacgtgagtagtagagctgcagtttttagttggattactggccttttttctgcatcccatgttctcgggaatgtcctcgcacgttttcttcccgtgggctacattttccaggtttcaataggtctcttgatctttgttcctgtttatatgacactgtttctagaagagactgtatcaccaaaaacagaggtgacccgaagttcgacactaaagagcaatacacttaagattgtccaggaacgatataactcaatgagatatgctgcaaatctggtcactagcagcccaacactgaagtgcatttctcttgtatcattcttctacgagttgggaatgtccggcatcagcggtgttttgctgtactatttgaaatcggcttttggcttcaacaaaaatcagttctcagaaattttgatgatggtgggagtaggttccatagtctcacagattgtggtgcttcctcttatcaatcctctttttggggagaaagtgatactttgtctggccttgctttcatcaatagcctatgcaatgctctatggattagcatgggcaccttgggtgccatatttaagtgcttcttttggggtcatctacatcctcgttaaaccttctacttatgctgtaatatctaaagcagcactttcagcagatcagggcaaagcacagggctttgttgctggtattcaatcagtcgcgagtttgttatctccaattgtaatgagtccattgacctcatggtttttatcccgcgatgcacctttcaactgcaaaggattcagtatactctgtgcttctttatgcatggtcgtttcactgtgttatgctagcacgctaaaagttgaggcaccacgagagagaaccttcgatgaaattgcagagaacatagaagcaccacttttgacatgatacttttgagacgttggtgaccattttaccaaaattctctatgctataggcacccgaggatgtccctttatacagc

SEQ ID NO: 488 - DNA, 763 bp, Solanum lycopersicum
aaaggatccaaaacccatccaaagaccaaacattttctctgttttttcaacaatgcagaggtcaacaaaacttagtggtgaagaagagttttcaatcatggttgctgctttaaccaatgtgattactggtgctgcaactatttcatcatttccttgtacgagtggtatgtcgccgcccttgtttcgcgtaccggaagaaacagagcgttgtcagtactgcaaaataaatggttgtttaggctgcaactattttgcaacctcatcagctgcagctggtgttgttaacaacaacaaggcattaaagattgttgggaagacgaaaaagaagaagaagaattacaggggagtgagacagagaccatggggaaaatgggcagcggaaattagagatccaagaagggcagctagagtatggcttggaacatttactacagctgaggacgcagctagagcttatgacagagcagctattgaatttagaggtccaagagctaagcttaatttctcatttacagattacacttcaattcaacaacacaatactactacacccatgcaagtgctgcaacaacaacaaccagctccctcgcagttacaacaaggaataaacacagaagaagaagagttctgggatcaattgatgaattcggacaatgaaattcaacattatctttatagagaatcatctgattctgctaatggctatattgctcatagcttctaggaagcattttgcatgcacgttcagtattagggtaccttt

SEQ ID NO: 489 - DNA, 1140 bp, Triticum aestivum
agtagcaggttgcattgttcactagcagttgactagcgtgcactattaatacatgtacgtacctccccttcatcgtcccgtctcaaaactctctccctccctccatctctccctctctctggctaaggtagcagtgtagcgatccgaccgagaagatgagctctattggcatgatggaggcgaggatgccgccggggttccggttccacccacgggacgaggagctggtcctcgactacctcctccacaagctcaccggccggcgcgcatacggtggcgtcgacatcgtggacgtcgacctcaacaagtgcgagccatgggaccttccagaggcggcgtgcgtgggcggcagggagtggtacttcttcagcctgcgcgaccgcaagtacgccaccggccagcgcaccaaccgcgccacgcgctccggctactggaaggccaccggcaaggaccgcgccatcctcgcgcacggcgaggcgttggtggggatgcgcaagacgctcgtcttctaccaggggagggcccccaaggggacgagaacggagtgggtcatgcacgagttccgcctcgaggaggagcgacaccgccaccaccaccagcagaagggcggcgccgccgccgccgaggcgaggtgccagctcaaggaagactgggtgctatgcagggtgttctacaagagcagaacaagcagcccaaggccaccatctgaagaagtctgcacattttttagcgagctggaccttccgactatgccaccgctcgcgcccctcatcgacgcgtgcatcgccttcgacagcggcaccgcgatgaacaccatcgagcaagtgtcctgcttctccggcctgccagcactacccctcaggggatcgatgagcttcggggacctgctgggctgggacaaccctgagaagaaggccatcaggacatctctgagcaacatgtcaagtaacagcaattccaagttggagttgaccccaaactggagccaggagaacggcttgtcacagatgtggacacccctctgaatcttgatatgagactattgtgctgctagttgaagtgtggtggtggctagtaagtaattagatgacatattctttctaatgatattggagtagcattggactattggttgatgca

SEQ ID NO: 490 - DNA, 1687 bp, Triticum aestivum
aaaggtaccctagctagcgctcgacaccgcggcactgctcggctcggtccccttctccctcgcgggagcacgcggagaggcgaccgaggatcgaccgaccgccggccggcgagcgatgtcgagccacgaggcgtgctgcgggaccatgttctgggtgtacctgctgtcctgcgcggggctggtgatgttcgcggggctcatgtcggggctcaccctgggcctcatgtcgctcagcctcgtggacctggaggtgctggccaaggccggcaccccgcaggaccggcgcaacgccgccaggatcctgcccgtcgtcaagaaccagcacctcctcctctgcacgctcctcatcggcaactccctcgccatggaggcgctccccatcttcctcgactccctcgtgccctccttcggggccatcctcatctccgtcaccctcatcctcgccttcggtgagatcatgccgcaggccatctgcacgcgctacgggctgagcatgggggccaaggcggcgcccatcgtccgggtgctcctcgtcgtcttcttcccggtcgcctaccccatcagcaagcttttggattggttactgggaaagggtcatgttgcacttatgaggagagctgagctgaaaacattagttgatatgcacggcgatgcggccgggaaaggtggagagctgacccatgatgaaactactatcattgcaggagcattagagatgactcaaaagagtgcaaaagatgccatgactcccatatctgaaaccttctcacttgacataaatgccaagctggatgtgcatacggtgggtatgataatgaccaaagggcacagccgtattcctatatactctggaagaccaagcaatatcatcggtcttatattggtaaaaaacttgcttacttgccgacctgaggatgaggtgcccactagacatgttactatcagaaaaattccaagggtggctgatgatcttcctctctatgacattctaaatgagtttcagaaaggtcacagccacatggctgtggttgttaaacgcactaaagaagacggagcatctgccgaaaagaataacagttttacaccagattacaaaatgaccaacgggcatgctcatgctgatggtctgggtctgtcaccctcgcatgtcaacatttccggaagtcgtcgaaataacaatgacaagtacagtaagaaaattgaaagaaaacgggacaacattcttgatttcaacaccgatccacttcctcactattcaatggatgaggaagcggtgggaataattacgatggaagatgtcatggagcaactgctgcaggaagatatcttggatgaaacagatgagtatgttgatgtgcataacaagatcaaaataaacatgttaccgccaggcaaatcattgtcgcctcttatatctcctagtggtggacctctgtctcaaggactaagaaagacccctatggcttctccattgtcgccgtaccataatggcggctccatcttacgttcccctgttacaaaccatgctcgatcacctgggactttaccgacgatgttttctcctggaaggtcaccggcatctcaaactcccgtgcgcggttcgccgacttcaagttgggtctcgaggaattcgtaccgaaatccatagaaatggtggtgagagctaatgccaaagagcggtaccttt

SEQ ID NO: 491 - DNA, 1315 bp, Brachypodium distachyon
aaaggatccagaaggaaaagggggaacctgaagcaaacgacagcttgtgagttccctctttaccttgctgtctccgacaaaatcccaacctctctcggcgatggcggagagccccatgtcgccggcgtcgcgggtggacttctacggcttcctcgaccgcatgcgccgccccgccgccgccgacctcttccgctccatcaagagcttcctcgcatccctctccctcgacgagcccagcgccgaggaggacggcgccagggtccaggccttcttcacggcgatggagacgaccatccgggagcaccccctttgggccaacgccactcatcaggaaatcgaccacgccctcgagggcctggagaagtacatcatgaccaagctgttcgaccgcaccttcgtgtcgtcggcggaggacgcggcggccgacgccgaggtctcggagaagatcggcctcctgcagcagtttctcaggccttgtcatctggacatacccaagattctgcacaacgaagcgtcctggctgcttgcagttaaagagttgcagaagattaattccttcagatcaccacgagataagcttctatgtattatgagctgttgccaagtcatcaataacttgttgctgaatgtgtcaatgtcaaatgaccgatcaccatctggggctgatgagttccttcctattctcatttatattactatcaaggctaatcctcctcagctgcactcaaatctaaagtttgttcaactctttagaagagaagcgaaacttgtttctgaagtcgaatattatctcacaaacctcatttcagcaaagatgtttatagttaatgttaatgggcactcgctatccatggaagaaagtgagtttcagaagcatatggaatctgcaaaactaggtactcaaatatcggctgctagccctagtaccccgcaagggttggctacatctacgaggggaccacagaagcaaactgatatggaaggttccgtattcccttacatggagtcagagactgaaagcttgactgcagcagagctcaagcagttgcatgggctctacaggcaagtagtcaccagatacacactgctgtctaaagctttaagaaagttatccgtagacgaggagcgacttcttgcatcagtagatgatccctgaactgatatgaagatgctggccagagatggcattggtttcatcacaaaacatcctccatatccttgtactgatgcacgtgtgatggagtaaacacacatgcggaattttccatcaagagtacaaaccaggttcaaagctcatgctaccacaggtaccttt

SEQ ID NO: 492 - DNA, 2437 bp, Sorghum bicolor
aaagtcgacgtgcgctttctctagtctgtgcaggcgccggagcccgccgccgccgcggccatgtcctccgcctcgggcctcggcgggaaggagggtccttcctctgccttctccgtggacctcgcggccgccgcgcgccggctgctggccttcctccgcgcggcgccggccggggtgggcccgcggtccgtgtggaggtacgaggagctgtggatgccgctcgcggcgcgggaggcgggcggaggaggagaggcggcgatgctggtgccgccgcccgacgtgcacctcgtctggctctgccactgcttccaccatgagaactactccgcatactgcacgtcgaggtttggacgcctcatcaaccgtccatcaatccttgatgtggagaatgaggagtatgccgaggaccgttgtcgagatgtctgggctactcatttcccatccgagccatttgatcttgacactaatgagattgatggaaacagtgttgataacataacctgtgacaatgtcgatggtgaaattgtcaaaatggtgagacggtacgctgacctagcagaccgctttgcgtcaccctttgtgtgggaaggtgtctaccatgttgctgctaggcggcgatatgtgcgtttcctggaccttatcaagaaggttgtgtgcggaacccaagtattcacacggcttgtgcctagcctagacatgttactgatgtggcttgctcaccagagttttcctgtgtgttatgccacggatatgctagcgatgggcattagggacaatgttgcaaaagtgggggttggttatggagaagtggtgagtgatgaggaggtagggaggacaaggggactgtgggaggatgcatatgatgaaccatatcatatggctggatcagaggttgatgcgggagcagttagcgcagcaagggaggcattttactgggtgccggcagcatcagaggaggatgccaaccggctatacaagagtttgcagccaagatttattatggaggtatatgtgttattgaagggagaatttgataaggagcccaccagcaaggatttcctacgattgagaacacagaggtgtcacagatcactaaaactcgacaaatcaatgtccactttatcctgcaaaagctggcagaaagtatggcacttgtattgtgaattcgcaacccggggcctcctcattgagttcaggcgtaatctaaatgggtgcttcaggaaaagcaagttcctcaagaacatctcattctcatggagcgatgtgttgcatgagaaagcacttgctctcacagaggaacttgatgtcaggatgagggcgatggcttcaattacccctccagttcaagcaccatacttattgaagtgtgtgcctgatcgagtcactgatgatggtggagccatgatttctgatgtcatattgcgcatgagaaattaccgtccacaagaaggacgttggctgacacgaactgtgcttgatcacagtgggagagaatgttttgtcatccggatgagagtaggtagagggatttggcggagaggtgctgaaactcccatggcagtgaaatgggaggataggagcattgaggttcgagaaggatcatggtcatacattgctagtacaagctccattggttatgctcctgaaaagatagtgggcacagcaacagcgatgaaagatcaacaggagaataaggtagtttggagcttgtcaacaggaggtacactcacagtatgtttgggagatgaactcagctttcagttaaaaaataacagctcggacgaggaggcaaggctgcttgtcgggaggagattgagctacagagtaaacacagacaatgcatccagcaaccttgttgaggaggagcaatacctcacacttgttcgtaagtcaccggatcatggtgacagagcaaccatgcttctaaactggaaattacttgctgtggagttcttacatgaagaggacgcagtttttgttcttctcctatgcatggtgattgcacggaccatgacagagatcaggagagaagatgtggctgggcttttagtgcgacggagaataagtgaagcaagggcagggcagagagactggggctcggtaatgcttcctggttcgctttcgccagatcctcatttgcagccttggtaccggaacgcagctcaggttttgagctctgtggagacaggaccaatgcttgcgaagtactcacctgctgatggaaaggacatgttgtacaggcaagctcttataccctgaagtcctgatagagattattaccatcaggacttgcctgatagataaaaacacacacccaatcttcctgggtattgcagggaaattatttcatttcctcaatgctatgacataggatctttgtacaggacaaattttgtgtttgagctgttgtttcactaatggtgatgggggatccttt

SEQ ID NO: 493 - DNA, 2612 bp, Sorghum bicolor
ctcccatggccaccgccgccaccgcctcccacccggcctccgcctccacctccggccgcgacgccctcgccgcatcatcctcctcccacgccgccgtctgcctcgtcccgttcaggtggtgggcgcgggtgcgggaggaggaggcggcgggcggggtgcagtacgcggctaccgccgccgcgtccccgtcctactacggcctcaggctgctccacagcttcctgcacccggatctcgtcctgcgcctcgagcgcggggacttccgcgccggtgacggaggcggaggcggccgcagctacgcgctcgtcccggccgacgagctctccagggcgcttgctaggcaaaactctggtttgggtttacaaaataagcattcgtttgctggagatagtgctggtgcttatcctttagtgcttaggatctctgtccgagaaacaagtatattgacactgaagatcagcaaaaaggacaatccagttgagaactacaaacgggctaacaagatttttaatgttgattctcaaccagttcatgtttgggatttttcagggcagacaaacctaatattaatgaatgaatggaatagactacatgactgctgccatgcagatcaagagaatcttctggaagtgcaagtctatgcaatgtctgactccttaacatccaaaattggtggtgatatgaattctgatttgtcctacagaagctttggaagagctggttctatggggttaataggattggagaatcttggaaatacttgctttatgaacagttcaattcaatgtttggctcacacaccaaagcttgttgattacttccttggtgattatgccaataatataaaccggactaatccattgggactgaatggtgaacttgctttggcgtttggagaactgttgaggagcttatggactgacagaaaacccattccacctcatcatttcaaggaaaaaattgcgtgttttgctcctcagttcagtggctttaatcagcatgattcacaggagcttcttgcttttttattggatggtcttcatgaagatcttaaccaggttaaatgtaaaccgtatgaagaagcaaaagatgcaagtggccgtcctgacgaagaagtagcagatgagtattggagcaaccatctagctcgaaatgattctgttatagttgatacatgccatggacaatataaatctacattaacttgtcctacttgcagtaaaacatctgtcacatttgacccatttatgtacttatctttgcctgtaccttccacggcaaagagggtaatgaccgtaacagttttcagcactgatggtagcagagagccatgctcatatgatgtcagtgtgccaaaatttgggactctgagtgatcttgttcaggctttaagcattgcttgcttacttggagatgatgagatcctgctggttacggaggtctacaataactgcatcattcgatacttggaggagccttcagattcagtttcattgctgagggatggagataaactggcagcataccgtctacccaaaagacatgagaaatccccctttgtggtttttacacatcaatattttgatgagcattctagtgatgataatttaactcgacaaatgagggagtttgaggccccacttttggcagcacttccagagacaattaatggattatcccttcaggatatctacctaaagttgttgagtccatttcgactttccaacagggctggttcacttaatgtttgtatggagtctaatagtgactccatcgatctgacggatgcaacgtcttctgattcaggcagtaatagttttcagaacagccaatcggaagacggccctgaaagcagccactgtagtgctagtgaatgtgaaataatgaaaagacctgatgatttatgtgatgggggttctgattctaacaaggaggcacagatggaggagtttgaattttatttaaaaaatgaaaggggtgatggccagcttcagaagatagaaatcaatgagctcgatttacttgagacagcaccaagccggttgcatgtgaatgtccactggctacgaaacgcttcaaaaaaatatgctacctcaatgctgagcaatctacctgagattcacaagcttgagcttatcccgaaaggaactgaagattctgttgcactacatggttgtctggaagcctttctaaaagaggaaccattgggaccagaggacatgtggtattgcccctgctgcaagaagcatcaacaagcaatgaagaaacttgatctctggaggctgcccgaagttctggtgatccacctcaaaaggttctcctacactcagttcacaagaaacaagctggagacattcgttgacttccccaccaccgatttggatctgtcatcctacatcgctgacaagagcaagcagccaagcagccattatcgcctgtatgctattagcaaccactacggaaacatgggagggggccattataccgccagcatctatcacgaggaagggaaggggtggtataagttcgatgatgactacgtgactcctatgagcgaagacagtataaagacctcggctgcttacgtgctgttctacagacgagagtgatga

SEQ ID NO: 494 - DNA, 1904 bp, Zea mays
gagccatggacggatcggccgcggagctggaggcggcggagcgggtggtgatgcggtgggactcatcctcggcgggcgccggcgcggacgagccgatgctgttcgacggcggcggggaccgggccgaggcggacaggttcctccgcgccgtcgacgatctgcgtcggctcgcgccgccgtcgcccgcggcagtcggcagcccgcgccgcctctcgtcgtcctcggtggcggcgagcggcgccgtgcaggtcgctatggcgcggctcgaggacgagttccgccacgtgctgtcgacgcgcgccctcgacctcgagatcgaggcgctcgccgacctcagctcgctctccatcaacagtgaccgcaccaactcggcctcctccgccgacctccccgccgctgacgaggacgactccgtgtcctcctccatcggccgccgcagcaccgcctaccgctcgctccggagcatccgcgagatcgacctgctacccgacgacgccgtcgcggacctccgcgccatcgcgtcccgcatggccgccgccgggtacggccgcgagtgcgcgcaggtgtacgcctccgtccgcaagcccgccgtcgacgcctccctgcgccggctcggtgtcgagcgcctcagcatcggcgacgtccagcgcctcgagtgggacgcgctcgaggccaagatccgccgatggatccgcgccgcccgcgccgccgtccgcggcgtctttgccagcgagcgccgcctctgcttccacatcttccacgaccttcctatctccaccaccaccatctccgccgcctcagcgtccgccacgcacgacatccctttcgccgaagccgtcaagggcgccgcgctgcagctcttcggcttcaccgaggccatcagcatcggtcgccgctcccctgagaagctcttcaagatcatagacctccacgacgcgctctcggacctcctccccgacgtctccgacatcttcgccgcctccaaggtcgcggagtccatatacgtgcaggccgttgagatccggtctcgcctcgccgatgccgtgagagggatactctcggagttcgagaacgccgtgctccgcgacccgcccaagaccgcggtgcctggcggtaccatccacccgctcactcggtatgtgatgaactatagcagcctcatttgcgactacaaggtcacgctctccgagctgatcatatcacgtccatcagctagcgctcgtctttctgctgagggcaatgagctcgcgccgtccttggccgacctcgagctccctgagcttgagaaccagttaccgcttgcctctcacattgtctggatcattgttgttcttgaacacaacctggagggcaaggcggcactctacaaggatccagctctctcgcatctgttcatgatgaacaatgttcactacattgtccacaaggttaaagattcgccagatctctggagcatgatcggtgataattacttgaaacggcttactaccaagttcacaatggcggccacaaactaccagcgcacctcatggttgaagatcttgaattgtttgcgtgatgaggggctccatgtaagtggtggcttttcgtcggggatatccaagtcggcactgcgggagcggttcaagtccttcaatgctgcatttgaggatgcgcatagggtgcagtcagggtggtgtgtgccagacaaccagctgagggaggagctcaggatctcaattgctgagaagctgctgccagcataccggtcattccttggcagatttcgacatcatatagagaacgggaagcatccagagctctacattaagttctccgttgaggaccttgagatagctgtgagcgatttctttgaaggtgttcctccttccccacataacaggaggaaatcacatggatgatga

SEQ ID NO: 495 - DNA, 3930 bp, Sorghum bicolor
aaagtcgacgtctctgtccacagattcctccataggtcggcaagcgcggggcgcggcaccgactccgactccatcggggaaccgtcctccaccaaaccgacctgacctgtgccgcctataaatccaacccaccccggcggccttcttcctttcgttgatagatagatgaaccgcgtggtcgggatccctcttccttccttccttccctgttctctcgtcggtgcgccatgggggtggatgggtaagtggtaggtaaggcgcagttgttgttggtttcgatctgacgcgtctctctgtttctcgaattcataaggtgtgacggactgaactagccggatggatggatccatttcttttaggttggatggttgttagctattttctctgtacccgtcgtcgggtgtcctactaattaccatttgctgattgacttatatatctaggttattatgctgttgtttacgatgactagggctgtgcagttattttgattcgattgccgttcattctggtgggaggataaggcgtctcggttggtgatctgttgatagcactttgtgttgagtcagatctatttgattggttagcctggatgtttttggcatgatcggatcaagatgaattgaagggtgtgtggtttttggttcgtccatgctgtgatctgttcagttgctgtgatctgtttcagttgaaggttgttgattggctgcttgtatctcttcttccttaggatgctgattttgtggcaaaaaccagtgcctgttggttgttataggaaactatactggactgctcagaattctgcactgtttggtcctgatcgtgtatccctcgtgatgttgtcagtctagtcacaagatttcttaggtcaactcagaactttttatggagatacgatttagcatgtcatatttggagcaagttatataatcagatgagtactatcagattatttgaaagccttgcaactaaaaatcacatcctgaagttcttgtggttttagtagatataagttgcttcaatgggagccagaacagttcatttagagctgatatgaatgatcacggagatgattatacaattgtactcttcagtaccactttttgataaattcaatttggtggtttcttttaaggagacagggagagtttgatttcatataaggcttacatcctcaagttcatgtgcttttaaataagttggctttctttgggagtgaaaacagttcatttagagctaatatagacatagtcatggagatggttctacaattctcttcaatatcaaaatgatcaattcaaatttggcggttccttttaagattacatggatggattcagagtttgatttgcttctctaaggtttaatttaatgctaggttgtgaacaggattatagaagtgtgcctgttcgaagcttcatttgagtaagatatatggaggaatacttaagttgtggctgctttgctaatttactgttggtattagtttctctggtggtatcatgaggccttctgtataattcctacttccatgggtcttctatttctcaggcacaattagtagtggacatgacttttaggcttctgttactggattatgtgctcattcagagtgttgtagagatcttcaattttgttggttcagtagaactgtaatatatgtacatgtatgatggtgaaatatatttttgcctagagctgtaattattatatgatatggatatatggatattggtatagaacttggcacaatcctgcttatattacaaattgcttgtgacatgacttttttattatggatctgctaaactataacaataacttcattctattgtttcttctcattctaatctcttgcagatcgtattcttgaatcccatgcaaatactacatttattttggtgctgcacaaaactttaatgcaaatactgcaaaattttaatctcctgcagatcgttgcagtttgtttggtatcaaaaaggttttcttggagtaggtaaatcagagtagtctgtaacaaattaaatttctccttaatgcaatggtacatagttaggtcaaatatctcctccttaatgcaatggtacatagttaggtcaaatacttcccattccttatctctcataactgcatgcacaatattttactaaacatgttgtgttggttcagtttcccatgtgtgagacagttgcccatgaaactctcagcctgccatgtcttagttctatcttcctattcattgaactgaattataacataaaccccctctttttttctgtatctactttctctttcatttgagtgcatctttttatagatcgttatcgtttgtttgctatcaaaaaggttttcttggagtaggtaaatcagtgtcttagtctgttaaatttctcctcctcaatgcagcggtacctagttaggtcaaatacttcccatgccttatctcttacaattgcatgcacaatattttactaaacatgttggttcagtttcctagttcaagtgtgagatagttcttagcctgccatgtcttaattatatcttctttctgtaactgaccctcttttttctgtatctactttctctgttttatttgagtgcatccttagcttagtatcatgtggttttgttctcattcaggttagacttcctcttcttccctattaagtactgatgggaccagtatttgtccttttttttgcattgagtcttgactgtagtagtgaagtgtgctataaggttttctgtcagttttgatgcctgttcatgtttacagatctggaagtctggttttctggctaggtcttgaggttgttggtttgctcctattgacttgcttaggattctaacatgtagcatagctgatgcctgacaaattctgttgtgtttttgcttccgtcatgttccttattggggacgagtcagtgccagaaggtagatggttgcttaggtgtggagttcaatcgttttttgttgccaatttgttgttatttctgcatgagctttgatctggatcttctaaatttgtgaactaatttgggttcaaactttggctttacggacccctgtggtccgagcgttcagcttatgttattcatctcctgctgtgttcattataatgtcaaatgagtctttaacttatgtatggtcttgtaacttatgtttctgattgtaagcattcaagacctgtagttaacatggatgtctgtatagaagcattattacaacttgcataaatggaaatgtaaaatcagtcaggtaaaacattagattcatatagcttagcatctctggttctggatcaaagtagaaatgtcaagttattctacactcctatgctttttaagcctaatttgatatcttgtgatctttgcagtgttctttattaagttcaactacaataattgaaatgggttgacaaggctttgattagcgcgtctgaaaaaagcaaggtctcagtgtaggaaatctgattggtttagatttagattttgtatgcatgcagtggattgaagcaactcaatatttgatgagtagtagtgctatatgacaaataatttagtgttaacttggaaagtggtgttagacctttcaatttggtccctattgattgatcgtttgttgtcacaatgatttcttaggtcaaatccagatttattgcagagctatgatgtagtgttagtttatttttagtgttgattaaagagcatgctatttttgagcaagttatacttctagtgttttagataagttgatttatttgggatatttagacttgctcatggagatgattctacaattctgttcttcagtgttatcttcttcatcaatccaatttggttgtgcctaacatgggcacatagtttgatttgatttacattaagagatttgatttacagtaagggtcacatccagaagtttgagctcttt

SEQ ID NO: 496 - protein, 619 aa, Hordeum vulgare
MEVERLLDLAVDYGFDRDFAVAALSRLVHLYGEGGQDFITVENCGDDFIAALADATQPTDDWDDLNAIETEACGNLNEMMRKGVNDEKGGVVLDTPLFKRADSSSKHNPKDFDIFNETNTHHDNPVGTQKKAQTRNSKAQTRSSTKSTALLFVFQNNVLKVTKATKRYESTTLTSNREGQPNACLWKRGILSYEQLSSLDDINLANAVIFGNKSFRPLQYEACSAALDNKDCFILMPTGGGKSLCYQLPATLHPGVTVVVCPLLSLIQDQVVALTFKFGIQAAFLNSQQTSAQASAVIQELRNGTPSFKLLYVTPERMAGNYSFMEILKGLHQRGLLARFVIDEAHCVSQWGHDFRPDYRGLGCLKQHFPRVPIMALTATATEAVRKDVLNTLRIPNALVLKRSFDRHNLNYMVIGKTRTPQMQLGDLLKERFMNMSGIVYCLSKNECADTAKFLREKYKIKCAHYHAGLAARQRSSVQEKWHRGEVKVICATIAFGMGIDKPDVRFVVHNTLSKSIESYYQESGRAGRDDLPAHCVVLYQKKDFSRIVCMLRSAENFKSETFKVAMDQAKKMQAYCELKTECRRETLLGHFGEQFNSQRCKDGPSPCDICLKEASRGH

SEQ ID NO: 497 - protein, 232 aa, Hordeum vulgare
MARSRASTMSSPVHRLLIVAAAAALVSACAADPEPVQDFCVAAVTNGSADHPSYPGFPCKPASAVVSDDFFFAGLAKSGAAEAADSPFGSSVTPGNVAAFPGLNTLGVSINRVDLAPGGVNPLHSHPRAAELVHVVAGQMLVGFVSTAGTFYSKVVREGESFVIPRGLVHFQFNTGKEAARAVTVFNSQLPGVVLAAPSLFGADPEIPDAVLAKSFQVDGEIIKLLKSKFRN

SEQ ID NO: 498 - protein, 300 aa, Hordeum vulgare
MESVEGNGTGRGNLQLVVSELCRIQELVRQLELHLHAPDTSVDLCRALTAQIFALTDRSIGFVAAAHSSDAPTTPSSTSSSLSGVSDQPFRTNTKKRKATARWTSQVRVSAAGGAEGPGDDGHSWRKYGQKDILGAKHPRAYYRCTHRNSQGCTATKQVQRADEDPVLFDVVYHGQHTCRPTGGGGGGRRPPTNQHNPHAESLLQSLRAGLAVDADHGGLNTSVCVSPPMTSPSMASPVASGSNGGPTMSPYPAGAYTEWPLDGDLQEVVSVFTAVSAPSMDYLFEFDPTFDVDAPNFFM

SEQ ID NO: 499 - protein, 609 aa, Hordeum vulgare
MCSGPRKPSTPPLAAPAPKDSGAMASLLLELAAADDVVEFRRVVEEEKACLDAAASWYGPSAVGLGRLGAESRTPAMVAALYGSTAVLAHALSVAPGEACRASDTDGATALHMAAAGGAANAVAATHLLLAAGASTEALSVSGLRAGDLLPRAAGVAEKPLRLLLKSPAVSPSSSPKKSASPPATVAAAQEPRKEYPPDLTLPDLKSGLFSTDEFRMYSFKVKPCSRAYSHDWTECPFVHPGENARRRDPRRYSYSCVPCPEFRKGGSCRKGDGCEYAHGVFECWLHPAQYRTRLCKDEVGCARRICFFAHRRDELRSVNPSAVSVGMMQPVSPRSSPPNGMDMGMLSPAGWPSSPASRLKTARELDFDLEMLALDQYQQKLFDKVSNNAHSPRASWGAPNGGLGSPRAAAGSPARNMPDYTDLLGSMDPAMLSQLHALSLKQAGDMSPYSSMPDTQLHMPTSPMVGANNSFGLDHSMAKAIMTSRASAFAKRSQSFIDRGARAPAARSLMSPATIGEPSMLTDWGSPSGGGNLDWGSPGGKLDWGMQGDELHKFRKSASFGFRGQSAMPAASAATSAEPDVSWVNSLVKDGHTGDHFPQWLEQEQMVA

SEQ ID NO: 500 - protein, 223 aa, Hordeum vulgare
MASGLQVFGQPASTDVARVLTCLFEKNLEFDLVRIDTFKREHRLPEFIRLRDPSGQVTFKHGDKTLVDPRAICRYLCTQFPNQGNRNLYGTGSLERASIEQWLQAEAQNFNPPSSALVFQLAFAPVLEIPQDHMVIAENERKLQQVLNVYDEILSKNEYLAGDEFTLADLCHLPDSQYIVSSERGMKLFTSRKNVARWFDQISSRKTWEQVVKMQMEHPGAFE

SEQ ID NO: 501 - protein, 239 aa, Hordeum vulgare
MRPRLVLFGDSITEQSFASGGWGAALAEHFARQADVVLRGLSGYNTRWALKVLDRAMEGAADGGADPAAVTVFFGANDATLPDQAQAHQNVPLGEYQDNLRAICAYFKNKWPSAAVILITPPPIHEPARIRDIYGDNDPSRQPERTNEAAGTYAQACIAVAKELGHPVIDIWTLMQQFPDWQTSALSDGLHFTPSGNKILFDEVLKTLESVGFSQHSLRSDLPLFHEIDPKDPLKAFEI

SEQ ID NO: 502 - protein, 275 aa, Hordeum vulgare
MGLLSNRIGKESLKAGDHIYSWRAAWVYAHHGIYVGDDKVIHFTRGRDQEVGTGTVIDFLLVSSGPNRSSTPCLVCSSDEVTAATETNGVTSSCLSCFLSGGALYRFEYDVNPALFLAKVRGGTCTLAATDSDEVVVRRAKYLLSNGFRCYSLFKNNCEDFAIYCKTGLLVAEGNVGLGQSGQAVSIIGGPLAAVVSTPFRLVTTNIYGMAVMAVGVYCVSRYAGDIGNRRDVLKVEVEELTAGLASGRIRAANITQLATPGQVQAPAVTTLVAA

SEQ ID NO: 503 - protein, 169 aa, Hordeum vulgare
MSHFAAMKSPVPVAAAAATDAKSPLFCPKPRRPVAPLRCHQSSNSDAGAGMDLLDLLLSKGDESNLSAASPQPPLFCGSPPRRASNPVVHDSRFGMDCPSSPLPWWPVMSPATPAPVVVRPTPRPAGPPMSPRSAAGCARVFQPAVRVEGFDCLDGGRSGRGHGIAAMV

SEQ ID NO: 504 - protein, 364 aa, Hordeum vulgare
MELQGLGRYWGVGGRRCGACAGSPAAVHCRTCDGRRGGGDGAYLCAGCDAGHARAGHERVWVCEVCELAPAAVTCKADAAALCAACDADIHHANPLARRHERVPVLPIGSSSPEGQEQDAFVMSFGGSVDGEKQDAVVNLNDALEAGPDGKENVKLDFLFADMMDPFFGSELPRFPHADSVVPSGGAVELDFGGVAAAAAVVSNPSYSSYTAASIGGSGSSSEVGLVPDAICGRGGGIIELDFAQSKAAYLPYTPTPSHSTVSSVDVGPVPERSESAVAAATPAMGEGREARLMRYREKRKNRRFEKTIRYASRKAYAESRPRVKGRFAKRADDADADAVAAATITAPRPCVLDFSGYGVVPTF

SEQ ID NO: 505 - protein, 100 aa, Hordeum vulgare
MGDSSSSSASYIRMVHHLIEKCICFNLNKEGCMEALEKHAKINPVVTSTVWKELEKENKEFFESYNKDRVERNIEAETMERIQKMLTDAAASKSSDDDEG

SEQ ID NO: 506 - protein, 302 aa, Hordeum vulgare
DGARVQAFFAEMEAAIRGHPLWADATHQEIDHALEGLEKYIMTKLFDRTFASSPEDAAADAEVSDKIGLLQRFVRPHHLDIPKLLNNEASWLIAVKELQKINSFKSPRDKLLCMMSCCQVINNLLLNVSMSNDRTPSGADEFLPILIYITIKANPPQLHSNLKFVQLFRRETKLVSEVEYYLTNLISAKMFIINVNGQSLSMEETEFQKHMESAKLGNQMSVASPSSPQGLATSTRGLQKQIDAEGFKFPFMDSEIENLTPEELKQLHGLYRKTVTKYTLLSKALRKLSIDEDQLLASVDDS

SEQ ID NO: 507 - protein, 533 aa, Hordeum vulgare
MAVPTPQRRLLACAATLLLALALSSSCAVANYAGPIKTVVVVVMENRSFDHMLGWMKRLNPTIDGVTGAEWNPANASDPSSGRRVYFGDGAQFVDPDPGHSYQEIRQQIFGSDDASGPPRMNGFVQQAASIGGGNMTDAVMNGFAPDSVAVYRELVSQFAVCDRWFASVPSSTQPNRLFVHSGTSGGATSNNPELLARGYPQRTIFDNVHDAGLSFGVYFQDVPAVLFYRNLRKLKYILNFHPFHNAFRDHARRGSLPNYAVIEQHYMDSKDHPANDDHPSHDVYQGQMFVKEIYETLRASPQWNETLMVLTYDEHGGFFDHVPTPVDGVPSPDDIVGPPPYNFTFNRLGVRVPAILISPWIEKGTVVHGPNGNPTSTSQFEHSSIPATVKKLFNLPQDFLTKRDAWAGTFEGVVQTRTEPRTDCPEQLPMPTRIRQTEANEEAKLSSFQQEIVQLAAVLNGDHQLSSLQERIRERMNVREGTSYMRSAVRRFFEAGMSAKRMGLADDEQIVKMRPSLTTRITSSPADQDDSP

SEQ ID NO: 508 - protein, 667 aa, Hordeum vulgare
MGSKRSCLLITYSPEIVDGVPLYVSSNCLPVKASKYEPAGHSFHAVALKLRGLDEKEDTETDDRSVSSDDKSQDFSAGSDNFSSKGKKKSGSGSQQQDHYALLGLGNLRFLATEDQIRKSYRDMALKHHPDKQAALLLHETTEAAKQAKKDEIESHFKAIQEAYEVLMDPTKRRIFDSTDEFDDDIPTDCAPQDFFKVFGPAFMRNGRWSVSQPIPSLGDDSTPVVDVDQFYNFWYNFKSWREFPHEDEYDLEQAESREHKRWMERQNAKIQEKAKKVEYTRVRNLVDNAYRKDPRIQRRKEEEKAEKQRRKEAKYMAKKLQEEEAARAAEEERKRKEEEAKVAAAAALNQKKLKEKEKKLLRKEKSRLRTLVAPVVAEPSFSLSADDVETVCTSHDVEHLKKLCDIMEDKDTAEKARLLRGALNKEENSSNTSKEEKIHANGVAGSTPKSTAPQGPPKSTAPQVITLGNYEKKEKPWGKEEIELLRKAIQKYPKGTSRRWEVVSEFIGTGRSVEEILKATKTVLLQKPDSTKAFDSFLEKRKAAPSIVSPLSTRDGTEPSKPAGGSTLGAGSEPSKAAEQPAASSSQTANEKTGADPVPEEAPSATDPDAWSEAQVLALVQALKAFPKDANQRWERVATAVPGKTVVQCKKKVSSMRSNFRTKKAE

SEQ ID NO: 509 - protein, 312 aa, Hordeum vulgare
MEGSIHGSSEKRVAVVTGGNRGMGLEICRQLAEHGVTVVLTARDGKRGAEAAERLREEGLSDIVFHQLEISEPASAADLAAFIKGKFGKLDILVNNAGVLGVTTDVGDPATLQQTLAGKDGMERAEWLRQRTTQTTQDAEDCLRINYHGNKTVTDALLPLLRSSSDGRVVNVTSAWGLLRYFSGEELRRELDDVDNLTTQRLDKMSALFLEDLGKGNGALERRGWPADTVYAAYMASKALVCAYTRVIAREEGAALRVNCVHPGYVVTGMNDYTGVLTAAEGAAAAVAVALAEKGGVTGAYFDRTELGASFV

SEQ ID NO: 510 - protein, 592 aa, Hordeum vulgare
MAVSAKERKLSRLGSGQAANGGGGGSFGARGSHRSSAAGGRRRLFAVFFAFLCAGAVVFGGVHVIGASFRPVLMTAWPSATLNALSSERRVQQAGGNSAGTVSPSVQIRHAVVLPDHVLVILGDGSSLPAPGHFECLYSTANSTQLRRRPLSVAALPDEPSLVHCPAAPPGMAVSLSLSQSPPVTPFQWDQLVYTALLDSRDNSTVVFAKGMNLRPGRLGVPSRYECVFGRDLSKPKFVVTSPVVSAAQETFRCVTPVRIRRYLRMTADGNSNRNSDGKPMLVSIRTKGRGSSTLPSIAQPEPLPRYNRHRHTRHRRQQKAHSMCVCTMLRNQARFLREWIIYHSHIGVQRWFIYDNNSDDGIEEVLGSMDPSAYNATRHLWPWMKSQEAGFAHCALRARESCEWVGFIDIDEFLHFPGNQTLQDVLRNYSSRPRIGELRTACHSFGPSGRTKIPKKGVTTGYTCRLAAPERHKSIVRPDALNPSLINVVHHFHLKEGMKYANVGQGVMLINHYKYQVWEVFKEKFAGRVATYVADWQDEENVGSRDRAPGLGTKPVEPEDWPRRFCEVYDTGLKDFVHKEFIDPQSGSLPW

SEQ ID NO: 511 - protein, 856 aa, Hordeum vulgare
MPAAGRSGGPGQVNIMTGRRKLHVVTLAILCFWSSAGVCKAQTVDFKPADSYLVDCGSAKGTTVLGRNFAADGASPVTVSTSQDILAGTSANGVSSFDNPVLYQTARIFTSPSSYTFPIQKQGRHFVRLYFYPFIYQTYDLSTAKFTVSTQDVLLLSDFQQPDKTAPLFKEYSLNITRDQLVISFKPSNGIAFINAIEVVSVPDDLIADVANMVNPVQQYSGLTTQSLETVYRVNMGGPKVFPSNDTLSRTWQKDQKYILNPSVTKTAQYGKAINYRNGGATPLTAPDIVYSTATELAASNTSNALFNMTWQFDVDAGFSYLIRFHFCDIVSKALNQLYFNAYVGGFFAQHDLDLSEQSVNQLATAIYVDVVLSSNDASSKLSISIGPSTLNNALPDGILNGLEIMKMGSGSGSAFTVGNNGSNKKLPIIIGSVLGVVGLLIIILVVVLLCRRKKTDDKQHSKTWMPFSINGLTSLSTGSRTSYGTTLTSGLNGSYGYRFAFNVLQEATNNFDENWVIGVGGFGKVYKGALRDDTKVAVKRGNPKSQQGLNEFRTEIELLSRLRHRHLVSLIGYCDERNEMILVYEYMENGTVKSHLYGSDNPSLNWKQRLEICIGAARGLHYLHTGSAKAIIHRDVKSANILLDENLLAKVADFGLSKTGPELDQTHVSTAVKGSFGYLDPEYFRRQQLTEKSDVYSFGVVMLEVLCARPVIDPSLPREMVNLAEWGMKWQKRGELHQIVDQKLSGAIRPDSLRKFGETVEKCLADYGVERPSMGDVLWNLEYVLQLQDADSSTVSDVNSMNRIVDLSSQVQHVGAMESISVTMAEDGASHEPDHDLSDVSMSRVFSQLIKAEGR

SEQ ID NO: 512 - protein, 91 aa, Hordeum vulgare
MASAASRKAPSLVVAASVGAVEALKDQAGLCRWGYPLRSLYRHAAAAPRVRALSASLSEAAAAATAPRPASLSAEDTKLRKAHHLVCWGPN

SEQ ID NO: 513 - protein, 226 aa, Hordeum vulgare
MDISQEQQQDFGVLLKQGAEGRVFVSTFVGRKCVIKERFSKKYRHPLLDSKLTLKRLNAEARCMTKARRLGVPTPVLYAVDPLPHTLTFEYVDGLCVKDILIGFGSNGINEERLNDIATQIGNAVGKLHDGGLVHGDLTTSNMMIKSSTNQLVLIDFGLSFTSTIPEDKAVDLYVLERALISMHSSCGDVMEKILAAYRKASRQWCATTNKLAQVRQRGRKRTMVG

SEQ ID NO: 514 - protein, 521 aa, Hordeum vulgare
MACAAYSIRGHLKLATGHGLASSHLCGGRKPSLSCPVSRAWSSNVSTDAAQRVDPRSHLAVRSSERWPPIPKASPADGAVVAEERITVLVIGGGGREHALCYALTRSPSCETVLCAPGNAGIAQSRDAFCIPDLDISSSDSVISFCRKRGVGMVVVGPEGPLVAGLANDLVKAGIPTFGPSSEAAALEGSKDFMKRLCDKYNIPTAQYHTFSDAAKAKEYIKDQGAPIVVKADGLAAGKGVVVAMTLDEAFEAINSMMVDESFGSAGSRVVIEEYLEGEEASFFALVDGENALPLESAQDHKRVGDGDTGPNTGGMGAYSPAPIVTEELKSVIMETIIIPTVKGMAAEGCKFVGVLYAGLMIEKKSGLPKLIEYNVRFGDPECQVLMMRLESDLAQVLLSACRGELGKVSLTWSPEIAMVVVMASEGYPGSYKKGTVIKNIDKAEQVSPAVKIFHAGTALDGDGNLVAVGGRVLGVTAKGKDIEEARSRAYDAVDVVDWPEGFFRRDIGWRALKQEQTANY

SEQ ID NO: 515 - protein, 327 aa, Hordeum vulgare
MASEGFAAPVVVDDCRGVLLVYSDGAIVRGDAPGFATPVRDDGTVEWKDAEFDAPRGLGLRLYRPCQRNQLLPVFFYYHGGGFCIGSRTWPNCQNYCLRLAAELDAVVVAPDYRLAPENRLPAAIDDGAAALLWLASQACPAGDTWLTEAADFTRVFISGDSAGGTIAHHLAVRFGSAAGRSELGNVRVRGYVQLMPFFGGTERTRSEAECPDDAFLNRPLNDRYWRLSLPPGATVDHPVSNPFGPDSPALEAVELAPTLVVVGGRDILRDRAVDYAARLRAMGKPVGVREFEGQQHGFFTIDPWSASSAELMRALKRFIDTDGHFD

SEQ ID NO: 516 - protein, 267 aa, Hordeum vulgare
MPAKGRGRAACPHATPSAPARPIDPLAIKHATGACVLHTTASLLACFLPAASRHLHRSLAAMAVNDTKLADAENPGTMCRAIDSDSDVDFAGRANWLRAAVLGANDGLVSTASLMLGVGAVKHEVRAMVISGFAGLLAGACSMAIGEFVSVCSQRDVEIAQLDRDGKRGGDEERALPSPIQAAAASALAFSVGALLPLLAAGFIVGYKLRVAVVVAVATLALAAFGVVGAVLGRAPVVRSSARVVVGGLAAMGLTFGLMRLFRASGI

SEQ ID NO: 517 - protein, 199 aa, Hordeum vulgare
MAGGIGGVGGGTGGEDSLARRAWRQYLLQLQRHPLRTKMITAGFLAGISDSVAQKLSGYQKIEKRRLLLKMIFGFAYGGPFGHFLHKMLDYIFKGKKDTKTVAKKVLLEQITSSPWNNLLFLFYYGYVVEKRPFKEVKIRVKKQYLSVQLSAWMFWPVVGWINHQYVPLQFRVIVHSFVACCWGIFLNLRARAMSLKQS

SEQ ID NO: 518 - protein, 864 aa, Hordeum vulgare
MRPSWGDLAVVWCCFLLLLLLPFLSHGKDMPLGSTLTPGGNSAAWASPNSTFSLAFAPSPTSPSLFVAAVTYAGGISIWSAGAGAPVDSGGSLLLSSTGDLQLVNGSGAVLWSSGTAGRGVSAAALQESGSLVLKNSTGGAVWQSFDHPTDTVVMSQNFASGMNLTSGSYVFAVDRATGNLTLKWANAGSATVTYFNKGYNSTFTANRTLSSPTLTMQTNGIVSLTDGTLNAPVVVAYSSNYGESGDMLRFVRLDSDGNFRAYSAGRGSGTATEQWSAVADQCEVFGYCGNMGVCGYNGTSPVCGCPSRNFQLNDASNPRSGCRRKVELQNCPGNSTMLQLDNTQFLTYTPEITTEQFFVGITACRLNCLSGSSCVASTALSDGSGLCFLKVSNFVSAYQSASLPSTSFVKVCFPGDPNPPVSAGSTSSSRSSGLRGWVVALVVLGVVSGLVLAEWALWWVFCRNSPKYGPASAQYALLEYASGAPVQFSYRELQRSTKGFKEKLGAGGFGAVYRGVLANRTVVAVKQLEGIEQGEKQFRMEVATISSTHHLNLVRLIGFCSEGRHRLLVYEFMKNGSLDSFLFGAGSNSNDSGKAMSWATRFAVAVGTARGITYLHEECRDTIVHCDIKPENILLDEQHNAKVSDFGLAKLINPKDHRHRTLTSVRGTRGYLAPEWLANLPITVKSDVYSYGMVLLETVSGHRNFDISEETNRKKFSVWAYDEYEKGNILPIVDRRLAGEEVDMAQVERALQVSFWCIQEQPSQRPSMGKVVQMLEGIMELERPPPPKSSDSFMTVTTATTGGSASGVSSSVASTFASSVAAPPAPVPSPNVEQEMSVGRSASARTREIASLPLRSSEPYMTM

SEQ ID NO: 519 - protein, 425 aa, Hordeum vulgare
MGIPSPSDEVVQIRHGDAAGDPTVVTVSCPDKTGLGCDLCRLVLLFGLNVLKGDMSTDGRWCYIVLWLAASPPPRARTVAWDLLKDRIVQLCPVPAPFGVDTAYLAAAGLALADGEPQVFLLKFCCYDRIGLLHDVTCVLCEMELTIRRVKVSTTPDGRVMDLFFITDARELLHTKSRREEAYEKLQSVLGDSVTSCEIESATQDMSSCLQASALLPPLVLEQMFSEVDVVDEQSNRSRSDSRLSVTMDNSLSPVHTLIQIQCGDHKGLLYDIMRTVKDCNIQVSYGRFYAGQKGRCEVDLFAVQSDGKKILDQQKQRTMCSRLRTELLRPLRVALVNRGPDAELLVANPVEVSGKGRPLVFYDITLALKNLHRRVFLAEIGRHMVNDREWEVYRVHLGEDDHELSCSVRSKIVDSVTNMLMGWD

SEQ ID NO: 520 - protein, 399 aa, Hordeum vulgare
MQRAAASLASSRSAAAWACTSTTSRHAGTGASYYARRDAVVPLRIRGQEQPPAALPMSLSLLSRRRPARTAKAAAAAAELTPSADEVAAGGGIAGTVQLGAMIVAWYLLNIYFNIYNKQVLQVLPLPLPYTITAFQLAFGSLVIFFMWAARLHPVPKLSAAQLAKIAPLAAGHMLGTVFTNMSLGKVAVSFTHTVKASEPFFTVLLSAFFLGEVPSPLVLGSLVPIVGGVALASLTEVSFNWAGFWSAMASNLLNQTRNVLSKRLLGGEEEEFMDDINLFSVITVLSFLLSVPLMLFAEGVKFSPAFLQSTGLNLQELCVRAALAGLCFHGYQKLSYMILARVSPVTHSVANCVKRVVVIVSSVLFFRTPISPVNALGTGAALAGVYLYSRLKKTKPKS

SEQ ID NO: 521 - protein, 736 aa, Hordeum vulgare
MKLGCSRFLLSCHVLLCLSAIWVPATADVPVAHLTGCQAKCGEVDIPFPFGIGEQCALHRGFNINCTTVNGILKPFAGYVEVTKISVPDGKAWINATTMSWRCYDVATDTMSYQNEGLDLRNTPFWVSEVDNKIIVIGCNTLAYMRRLSVQYVIGCSSICEDVTLENDKCSGAGCCQADVPKGVRYYNGYFNTNYNATKRCSFMAVMEKAAFKFNTSYTESTVFWDTYNGTVPLVLDWLAWPSTCDVAQNMSSYACASTHSECVNSTIDEPGYRCTCAVGYKGNPYVQNGCQDIDECLEDATLCVSGSGTCTNTAGNYTCSCPRGKDWANGSCQSHFPVIPVVGTTVGLVVLVIVLACACMIQERRKLQKMKRDYFRQHGGLILFEEMRSKQGITFKIFTEEELQQATNRFSEQQVLGQGGYGTVYKGVLEGNVEVAVKRCKTVDEQQKKEFGKEMLILSEVNHKNIVKLLGCCLEVEVPMLVYEFVPNGTLFQLIHGNHGLRISLATRLGIAHESADALAYLHSSASTPILHGDVKSSNILLDRDHKAKVADFGASILAPTDKSQFITLVHGTCGYLDPEYMQTNLLTDKSDVYSFGVVLLELLTGKLPFNFSQDVAAREKSLSMMFMYAMKVNKLEEILDDDIKNEESTEIIEEAAELAMRCLEMCGDNRPSMKEVAEKLDSLRKVMQHPWVQRNPEEMECLLGEPSSMVSSTITSAEYFSIEKKAVNGLQSGR

SEQ ID NO: 522 - protein, 367 aa, Hordeum vulgare
MAGEHQGAGAGFWLPDEFLDDDFFSDEKAAAAAAAAAGAARSDSDDEDAGLGGLSRRVAGLDCDAGDRAVPKAEVMSGSPQSTLCVLQASGEDSPTGGASQVSSPPSSPLEQQPADPWDLLHEAAGQVARLRVDSIPVPVVNPAPIHGAAVAPPARNPSPPPLLPSPKPVGPYQYPPNNSFAQRQAQVARFHLLKQQQLMKHQREQQLAMAAAMAWGSADVGPLGLNPSAWPPLQNPPHHAPPSAAGMRAVFLTPPGAKRECTGTGVFIPRQAGAPAEPRKKPSCSTVLLPARVVQALNLNVEDLGARPCYPGTFVLDHDALVSRSNAMQASQKREHNANANADAAAAHSPPLAVACEVNLPQEWTY

SEQ ID NO: 523 - protein, 796 aa, Hordeum vulgare
MDETPTSSGRSEATSCEPSWWPPDFLEKIESVALAREQEVLAEKESRFNLSNSKSSSWKASQLLWSTGTYSGFIPNGFYSIIPDKKLKEIFPTIPSLNDLQSLEADGLKPEIIVVDAEKDKKIFMLKQLSGALVKGLNNPALVIKKIAGLVFDCFKGQNSDASPGRASTEDIHFFGNRGPQLLGQIRHGSCRPRAILFKVLADAVGLESKLVVGLPDDGAVGFVDSYKHMSVVVPLNSMELLVDLMRFPGQLIPFSAKAIFISHISAAGESDSAENDSCDSPLEPNSPLYGLSDKVEAEGTEASSNLSGRSLRNTMLRSRTFSEGKLSTSCSEPNIANAFWRRSQRRGVAEEPRGASSSPEHPLMRAKGRSILGGDRQSFQEYTDRVTLRSDDQGATSTPNPRRIRRRSISITPEIGDDIVRAVRAMNETLKQNRLQRDHVNDGSCSFIGEDKTNANDCPNNDDKSGTNNGLRNRAGSTQKAMSLPTSPHDYGGEISETNNNCDFISEEKMVFAWNKVLQSSPFNKPLSPFQEWNIDFSELTIGTRVGIGFFGEVFRGIWNGTDVAIKVFLEQDLTTENMEDFCNEIYILSRLRHPNVILFLGACMVPPHLSMVTEYMEMGSLYYLIHMSGQKKKLSWRRRLKIIRDICRGLMCIHRMKIVHRDLKSANCLVNKYWTVKICDFGLSRAMTDSPMTDNSSAGTPEWMAPELIRNEPFSEKCDIFSLGVIMWELCTLRRPWDGIAPVQVVYAVTEGSGLEIPEGPLGKLIADCWAEPQDRPSCQEILTRLLDCEYAES

SEQ ID NO: 524 - protein, 324 aa, Hordeum vulgare
MGQDGQIRRDRVIIDTDPGIDDSMTILMAFGEPSVEIIGLTTIFGNVTTEYATRNALLLCERAGHPEVPVAEGSPEPLKGGEPRVADFVHGSDGLGNLSLPAPTSKKVEESAAEFMVNKVSQFPGEISVLALGPLTNVALAIKRDSSFASKVKKIVVLGGAFFAAGNVNPAAEANIYGDPDAADVVFTSGAAIDVVGINITTQCCFTDEDLLELKNSKGVHAQFLCDMCKFYRDWHAKSDSFHGIFLHDPVSFTALVHPEYFTFKKGVVRVETQGICTGHTLMDHGLKKWNSENPWSGYAPISVAWTVNVPKVLAYVKKLLMAP

SEQ ID NO: 525 - protein, 374 aa, Hordeum vulgare
MTSSASHHHDAPSATSTPRAGAGSTGSSNGNGNGNGNGGHHPPPPRAQAQAHGAPYVRLMCSFGGRILPRPGDHQLRYVGGETRIVSVPRTTSHAVLFAALAKLAPALFVPGDPTPALRYKLPHDDLDALISVSSDDDVDNLMEELDRVHSLAATAVKPPRLRLFLFAASPDHSSAGAFGSVLSGVGDASSDQWFVDQLNAPPPGSIERGRSEASSVVSEVPDYLFGFDTTSEEPSPGAGAQPKSDAEMAQGDDDDAPAPVLGAPLAPYVAESAPWPAPPPPYMAQPVYYVPVRPVHYLDPAGHGGYMPGPVYHIVGGGRNQAPGDLYASGGAGAVYGVPRPMPPFRQVMYAPPPATEVYSVEGKPPEGESHSP

SEQ ID NO: 526 - protein, 380 aa, Hordeum vulgare
MLRAVARCCGHWPPGAAAADGMLWQTELRPHAAGEFSMAAAQANLVMEDQAQVLASPAATLVGVYDGHGGPDASRFLRSALFPHVQRFAKEQGGVTAEAIRRAFGAAEEDFLHEVRQAWPKRPRMAAVGSCCLLGAIAGDTLYVANLGDSRAVLGRRVVGGGVAVAERLSTDHNVASEEVRMEVSSQNPDDGQIVVHTRGAWRIKGIIQVSRSIGDVYLKKPEYSLDPLFRQIGPVIALKRPALSAEPQIHVRKLKPTDQFIIFASDGLWEHLSDDAAVQIVFKNPRTGIANRLVRSALKEATKKREVSVHDLRTIERGVRRHFHDDISVVVVYLDRHRGRRQTKVVDSSSNCTSAPVDIYSSSSSVQSAQPRQAYRDSG

SEQ ID NO: 527 - protein, 234 aa, Hordeum vulgare
MKFGKWLKRQIEQSLPAWKDEFLSYNELKPVIGAVSPAEFVARLDVQIEKINAFFIEQEEFFIITHRELQGAIRSALERKVAVPAAAHEAEIAAIRREIVNFHGEMVLLLNYSSVNYIGLAKILKKYDKRTGAGIRLAVIETVLVQPFFTVEAVSLMVRECEAMMEAVFPTAPGEGQAAARRDREALVAAEQRIFRNTVSALLAMQDVRSSSSTRGRHSLPPLNLPDSDWLRSF

SEQ ID NO: 528 - protein, 430 aa, Hordeum vulgare
MASSCCGKGRAPVVVPLLALLAVSCALSVSASGGAGGNGTRTAEFRSGDELRAYRTILARMVRMNKASVKTIQSSDGDVIHCVPAHLQPAFDHPKLRGQKPEAEPVDRPKIVVSHDAAGEEEEGDAEFPQAWSDGGESCPGGTVPIRRTTESDLRRYSGSLRRYGMKPRAAGVRRDSTSDGHEHAVGYVTGDQFYGAKASLNVWPARVASAAEFSLSQIWVISGTFGNDLNTIEAGWQVSPQLYGDNSPRFFTYWTSDAYQATGCYNLHCSGFVQTNRRIAIGAAISPASAYNGRQFDISLLIWKDPRRGHWWLQLGSGPLVGYWPSSLFSHLGGHANMVQFGGEVVNTRPAGSHTPTQMGSGHFPREGFNRAAYFRNVQVVDWDNNLLPARDLRLVADHPACYGIQGGYNRAWGDYFYYGGPGRNVHCP

SEQ ID NO: 529 - protein, 346 aa, Hordeum vulgare
MGRTLDVLLGRTTKQTARLRSLLHLATRRVAVVRAHREVRCAQARGDVEQLLRQGHPDRALLRAEQVIRERDTLDALLLLDAYCALLADRSALLDAAHGRECPAELREAAAGLCYAAARCGDLPELQEARALLAAKFGRGFASGAAELRGGCGVSAKLVQKLATTLPSLESRQMVLLEIGAEKEIPVRLHNDATAAAEHEDPAGRSRHGHGHRKMRHDDDDERRADSDEPEGDRAVSAHSKLTFKDVEEAAQAAFESAATAAAAAKAAIELSRAGSGSPDGSYRRKAHAADETHHRGDDLADGKALERIGHVRNYSSDAEDLPEKRGEQQDTPRSRPASVRTNRGL

SEQ ID NO: 530 - protein, 487 aa, Hordeum vulgare
MKDGGARQHWPCDYCGEAAAALHCRADAARLCVACDRHVHAANALSRKHVRAPLCAGCAARPAAARVAAGGGEPAFLCVDCDGGCEGAARVPVEGFAGCPAAAELAASWGVDLLPGGGGAAAFGCGLGTGAGQEDEDAFFFSSLDYSMLVDPEMRDLYVPCNPPEVAVSAGGGRPLKGEALCDQLAEMARRETDTSQPQGYSDLSPRTPRRSSAGSSGRLPDKQPPPPLPPAPEVPCPYTSLLMMPSAHCAELVGNDRLPDDDEEQLRWEFAPPSSVPPTQIWDFNLGRSRNHNEKSAHEVGFGSNNGGFMIKSYSDMLKEISCGTTKDLEDIYDSGYGAAAEDIMSTNICQVPSKNVSTASNKRMKVSSCTSTMDGPTTSGSNVPASGTLASSSHDRGAAPTREISFGDQTIVPTGAERPTTRIDSETLALNRDSAMQRYKEKRKNRRYEKHIRYESRKLRADTRKRVKGRFVKSNEALNAGSNGG

SEQ ID NO: 531 - protein, 1483 aa, Hordeum vulgare
MAPAAKKPPLKSSSSHNSAAGDAAGKTIEEMYQKKTQLEHILLRPDTYVGSIEKHTAALWVYENRAMVNRQVTYVPGLYKIFDEILVNAADNKQRDPSMDSLKVDIDVAGCCISVFNNGDGVPVEIHQEEGIYVPELIFGHLLTSSNYDDNERKTTGGRNGYGAKLANIFSTEFVIETADGRRQKRYRQVFSENMGKKSEPEIKKCKQSENWTKVTFKPDLAKFNMTELEADVVALMMKRVVDMAGTLGKTVKVELNGEKVAVKSFSDYVQLYIDSASKEGIDLPRIYQKVNDRWEVCVSLSEGQFQQVSFVNGIATIKGGTHVDYVANQIASHVMGVVNKKNKQANMKSHVVKGYLWVFVNALIDNPAFDSQTKETLTTRQGSFGSKCELPDDFLKKVSSSGVVNSLLSWAEFKLSKELKKTDGTKKTSIVGIPKLEDANDAGGKNSDKCTLILTEGDSAKALAMAGIGVVGRDHYGVFPLRGKLLNVREASHKQLMENAEIQNIKKILGLQHEKNYDSTKGLRYGHLMIMTDQDHDGSHIKGLLINFIHKEWPSLLKVPSFLVEFITPIIKATKGKTVEPFYSMPDYEAWKESLGTSASSWTIKYYKGLGTSTAEEGRDYFEQITRHKKDFVWADDKEDGDAIELAFSKKKIAERKDWLTNYQPGTCLDQREKRIKYSDFINKELILFSMADLERSIPSMVDGFKPGQRKILFCSFKKNLIKESKVAQFIGYVSEHSAYHHGEQSLASTIVGMAQDFVGSNNINLLEPRGQFGTRNAGGKDAASARYIFTRLNPITRLIFPKDDDVLLNYLNEDGQSIEPTWYMPIIPMVLVNGSEGIGTGWSTYVPNYNPRDIIANLKRLLNGEAIVPMVPWYRGFKVALKETSSKATGVTYTITGVIEEVADTKLKITELPVRRWTTDYKEFLESMCPIPIKEKEKSKDKNKEKKKDKEKDKDKEKEKSKEPPLLEEIRSQCDHADVEFELILSEQNMNIAKQEGLEKKFKLTTTIGTTNMHLFDSHGKIKKYDNPEDVLQEFFDLRFKFYVNRKKVMMENMGNELLKYQNRVRFILAVISEDIIVNNRKRADLFLELKQKNYTPFPKKKPTSGPVAVGSTEAEEDNDQSPAEAAASDYEYLLAMSIGTLTLEKVNELIAQQDKLKADLEMLRNTEPQTLWLRDLDALEKELDVCDAKLEAEQQNRSSKRAKNSEKAKDSKPAPKRAVAAKKAKANSAGSDDDDYEAAIPKRAAQKKKPPPKKASALVKDEEEEVADLKDRLAAYNINDSSPEPSAMETEEQQKGKKGGNGPSKRGAAKKAMSSLAEISDEDIAEPQHESEDEGSSMEVEKKTKGKQPAAAKPKTAAIRKRAPAQSKGMRQKVMEEIFKPTDDSNLSAPSPEKKVRRIRDSPFNKKSGSVLHRMASTSTGVEDDEAPPSGSSAEPVAPRRTTRERKAAVVYVASGSEDDESEDEDVSEPSDDDDFSEDD

SEQ ID NO: 532 - protein, 326 aa, Brachypodium distachyon
MFIQKAWRTAAFGLYGFTQFTKSGFAEHAKKFREEDMQIRLDGKNCLVTGANSGLGFATAEGLASHGATVYMLCRNKERGETALKQIRSKTGNMNVHLEICDLSSINEIKSFTTRFSSMNKPLHVLVNNAGFLEHKRVTTPEGLELNFAVNVAATYTLTELVMPLLEKAAPDARVITVSSGGMYTEPLNNNLEYRESDFDGTKQYARNKRVQVALTEWWSEKYSNKGIGFYSMHPGWADTPGVSKSLPGLSEKLSGNLRSNEEGADTVVWLALQPMDKLVAGAFYFDRAEAQKHLKFAGTAASHAQIGSIVDSIRSICGLQPPMRR

SEQ ID NO: 533 - protein, 395 aa, Brachypodium distachyon
MEIQSSGRPIEVLMEKVLSMNIVSSDYFKELYKIKTYHEVIDEIYNQVDHVEPWMTGNCRGPSTAFCLLYKLFTMKLTMNQMHGLLKHPDSPYIRAIGFLYLRYVAEPKTLWTWYEPYIQDDEEFSPGSNGKMTTMGVYVRDVLLGQYYFDSLLPRVPLLILRQVTAHLEKMKLPTKQSGMTGDSSRLGSDDTARRPPSVKASLSVSFGQRAPHRASTRDSSPVRKTLPSIRERERSHDGDRAKSPPRKRRSESRERNRGETERDRSDRDRGRYNDREQGRQSRDSRDRDYHRSSYAERDVERRGHERRDRNSDRNGRSSAHRSRSRSRSPSRGRTNGDHRRASPFGKAPESSNLAKLKDLYGDASNAKDDAGDGRARRDSGAEEVIRLGGARWR

SEQ ID NO: 534 - protein, 551 aa, Brachypodium distachyon
MVEAVASAGGLAMASSTSVTPGQASALLGFLWVLAAWVYGEVLSHKKNAASIKTHSDINLPEMDNSSNKAEDQTKLLEEGGQAAGAKPVYASFASQMIRLFFMDQSLLLEHRLTLRAISELGGHLLYFYICDRTNLFGESEKNYSRDLFLFLYFLLIIVAAITSFKVHQDKSTFTGKSVLYLNRHQTEEWKGWMQVLFLMYHYFNAKEIYNAIRVFIAAYVWMTGFGNFSYYYVRKDFSLGRFAQMMWRLNFFVAFCCIVLNNDYTLYYICPMHTLFTLMVYGALGILNKYNEIRSVIAIKFVACFLVVILVWEIPGVFEMVWSPFTFLLGYNDPSKPDLPRLHEWHFRSGLDRYIWIVGMIYAYYHPTVEKWMEKLEEAETRTKLYIKASIVTVSLTVGYLWYEYIYKLDKISYNKYHPYTSWIPITVYICLRNFTQEFRACSMTLFAWLGKITLETYISQFHIWLRSKVPNGQPKWLLTIIPEYPLLNFMLTTAIYVAVSHRLFELTNTLKIAFVPRDNKRLSYNFMAGIAISVALYSVSFVLVGIAGY

SEQ ID NO: 535 - protein, 445 aa, Brachypodium distachyon
MWAVERVVGERRMREIQRFARNAKLTVLCLLLTVVVLRGTLGAGRFGTPQQDLIELRHRFISHPQRALAEHHDARSRASNSAAGKVADRDDEPDPPPRTLRDPPYTLGPKISDWDEQRAAWHRRHPESPPFLNDVKPRVMLVTGSSPKPCENPVGDHYLLKSIKNKMDYCRIHGLEIFYNMALLDAEMAGFWAKLPLLRALLLAHPEVEFLWWMDSDAMFTDMAFELPWERYGPYNFVMHGWDEMVYDDKNWIGLNTGSFLVRNCQWSLDFLDTWAPMGPKGPVRIEAGRVLTKHLKDRPVFEADDQSAMVYILATQREKWGNKVYLENGYYLHGYWGILVDRYEEMLENYKPGLGDHRWPLVTHFVGCKPCSKFGDYPVERCLKQMDRAFNFGDNQVLQMYGFEHKSLASRRVKRIRNETSNPLEVKDDLGLLHPSFKAMKTTT

SEQ ID NO: 536 - protein, 106 aa, Brachypodium distachyon
MITRAKLVEQLREQQIRSAQTYSAALAVFSPNPHISSRRDLKVALLYAFLFCFLMVSCYMALYLKWFRLSSLFVLFGILLQVSLKISRHRRLKRKRERKLLLPLSM

SEQ ID NO: 537 - protein, 714 aa, Brachypodium distachyon
MGAAPSTPRLGEVGAAPPGAAEQMFAALVGDKAYPISSEFWKQLFELPLTLQWPRERVLQACHAFAQNNYNTKHLTKILIHLVWCLQECTSASSVSYGVYRKAINAAYISSIFLKFIIENAKADNWQELCLHIDKDEKGLENFPSDQTVEYFLMKGVLNYIGSVDVSPESCYLHHELLNLMLVLMSTQLCSGPSPEPKDVHPFIDAAMLQESTTVGSVVQKLLLNFVRRPQIPLNGSHPVFSDNGGPGVLQRVGSAAANLVLLPYYTFNYLVNASAEGATSQLADNSLLVLLILIHYRKCISMTESIPIDNIYMSDSNTNIKDAPSFHENPYCKALNNAKDIQFDRADVEGNAQNGPVVRLSFASLFDALGTCLKDESSVLLLYSLVHGNCDFQEYVLVRTDLDTLLMPILEMLYNASRKTSNQIYMLLIILLILSQDSTFNASVHKLVLPSVPWYQERLMHQTSLGSLMVVILIRTIKYNLSKLRDVYLHTNCLAILANMGPHVHRLSAYASQRLVSLFDMLSRKYAKLAELKNDKASKIISDQIEPDNISDDTSTELHIYTDFLRIVLEIVNAILTYALPRNPEVVYAILHRQEVFQPFKNHPRFNELLENIYTVLDFFNSRMDMQQLDGEWSVDKVLELINKNCRSWRGEGMKMFTQLRFTYEQESHPEEFFIPYAWRLILSRGFSFNPGAINLFPVEIHVDDAQPGEQKV

SEQ ID NO: 538 - protein, 563 aa, Brachypodium distachyon
MDADEAAGSSRRMDLNLYLGLPRAPRPRRSDLGSDLALSTPMPSSPSSSAASVDAPPPPEPPHAIYSPPRADLSPRTPEVYSSHHLDDALSADAHLLYAPPPAPVIRDRELPDEIGFGFQAPPPPPPPLVRASELLGWEDRPSSSTASSSFLPDIATRYRRLLEQTGSRWLRPRPRRFRSDLPPLSAEAQPIGQDAAVPVPHQEMTNDDFGDNKVIANGAELGASEESEERGKSAATFECNICFEMAGEPVVTSCGHLFCWPCLYQWLNVYSNHKECPVCKGEVTEANITPIYGRGNSSSDVEKAVEEGKQPGPTVPPRPHGNRLESFRQQFQHLRPMSRRLGDAHGILSSWRRLLDQQIMNSVSRFEGPPEPAVHETGDTAQPASRLGTLPIRMRPRRRYQMEADDLPDGGSVAPDSGLPGNSAPDPHRHGPSPLLPEGIDLLQRLTLIGLANTERLATAMSDLRRIAAPNQYGASASSSNPSNPEPAVDGAHVGAAPSTDQASNSSTIAVIQGDAGISETAGEPSNAGSSRSLRRRGRSNALASLDVDGGPPQRIKRRRMN

SEQ ID NO: 539 - protein, 243 aa, Brachypodium distachyon
MASPGPAPAGELLRIDPIELRFPFELKKQISCSMQLSNLSDDYVAFKVKTTSPKKYSVRPNTGVVLPRSTCDVVVTMQTQREAPPDMQCKDKFLVQSVVAPSGINVKDVTGEMFAKESGNKIEEVKLRVTYVAPPQPPSPVPEESEEGSPSRGESENGDGPAGGFTRALRERIEPQEKSLEAGALISKLTEEKNSAIQQNQKIRQELDMMRREVSKRRGGGFSFVIVLIVALIGIFLGYMMKS

SEQ ID NO: 540 - protein, 284 aa, Brachypodium distachyon
MGAEFEVAVAGVAAPPAKRRRRMVAAAGGARRRATRRAPAPPTRAVQRLFQASRAVFRGPGTVPAPAEVALLRAMLDRMRPEDVGLSADLRFFKAREAAEGKTPTITHTTIYKSENFSMVILFLPPNAVIPLHNHPGMTVFSKLLLGSMHIKSYDWAGPGPDPATSGANSLPDDRLRLAELVVDDVFTAPCDTSVLYPTAGGNMHRFKAIASCAVLDILGPPYSIEEDRDCTYYTEIPYSHQPSSDLVDNEQERRRLAWLKEIDMPKELKMCSVAYGGPPISDR

SEQ ID NO: 541 - protein, 220 aa, Brachypodium distachyon
MNMDSFERLQADSKLRDALRRIQYDEEGTDEEEDEEDERGAEEELACPFCDDEYDSVGLVLHIDDDHPLESKAGRCPICSERVGLDLVGHMTVQHPTFFKGRSRNRQASSGSHSSSRYSELKKNAAYIQYRYGGSSRACSLNTVPDPLLSSFVSSFIDDDLPKEVQEVFLDDVIEKSDSLEPKAAESAEEPLLPEVKEERTRRSQFVQGLVLSLMFDDIL

SEQ ID NO: 542 - protein, 237 aa, Brachypodium distachyon
MFLTRTEYDRGVNTFSPEGRLFQVEYAIEAIKLGSTAIGLKTKDGVVLAVEKRVTSPLLEPSSVEKIMEIDEHVGCAMSGLIADARTLVEHARVETQNHRFSYGEPMTVESTTQAICDLALRFGEGEEESMSRPFGVSLLIAGHDENGPSLYYTDPSGTFWQCNAKAIGSGSEGADSSLQEQFNKELTLQEAETIALSILKQVMEEKVTPNNVDIAKVAPNYHLYTPAEVEAVIGRL

SEQ ID NO: 543 - protein, 534 aa, Brachypodium distachyon
MALELSLALAAPPGGGLLAPPPPAPPGKEQQVAGVGILLQISMLVLSFVLGHVLRRHRFYYLPEASASLLIGLVVGGLANISNTETNTRTWFNFHEEFFFLFLLPPIIFQSGFSLSPKPFFANFGAIVTFAILGTFIASIVTGMLVYLGGLTFLMYKLPLVECLMFGALISATDPVTVLSIFQELGSDVNLYALVFGESVLNDAMAISLYRTMSSVRSNAAGSESIFMMVLQFLEIFVGSMSSGVGVGFISALLFKYAGLDIDNLQNLECCLFVLFPYFSYMLAEGLGLSGIVSILFTGMVMKHYTYSNLSDNSQRFVSAFFHLLSSLAETFVFIYMGFDIAMEEHSWSHVGFILFSIIFIIVARAANVFSCAYLVNISRPEHRRIPLKHQKALCFSGLRGAMAFALALQSVHELPEGHGKAILTTTTAIVVLTVLLIGGSTGTMLEALDVVGDENTSIENYEDNSGYIPPTYEEGTSSGGGLRMKLKEFHKSTTSFTALDKNYLTPFFTSQTDDDTDDFGDQPQNLRRGFYDQ

SEQ ID NO: 544 - protein, 245 aa, Brachypodium distachyon
MVKLVQDEENQRQLLDGHKEKHFTSGEVVRDIIIGVSDGLTVPFALAAGLSGANASSALVLTAGLAEVAAGAISMGLGGYLAAKSDADHYQRELQREQEEIDTVPDTEAAEIGDILSEYGLGPEEYGPVVTSLRNNPKAWLEFMMKFELGLEKPDPRRALTSAATIALAYVVGGLVPLLPYMFVPSADRAMATSVVVTLAALLFFGYVKGRFTGNRPFLSALQTAVIGALASSAAYGMAKAVQAI

SEQ ID NO: 545 - protein, 295 aa, Brachypodium distachyon
MQMADDPNQNFRAFSQPFCTQDVVSFQTSATSSGSGGMPVYLDCSSGMDSTMAMMSSTTPSVAVSTSSSSMAADSAPSLKYGGPLAADWSYLELEVLKDCLDKYVNEQGIMKYIKIAAAIPTKTVRDVAMRCQWIGTKQNTRRRKPAEHHIGRKVKDRKEKMVEPSSWGTSHPVQRDTRVSSFVSSDIQNSLFPSEASEIDRAVHHILEENNRLLSQIETNIVTFQAQNNIDLFHRIRSNIDGLLQTMSQMPGIMSKMPQLPISVNENLASYMLPGLTMAQVLGNRHFKEEPRGW

SEQ ID NO: 546 - protein, 566 aa, Setaria italica
MSLDELADKEQSSPEEIQLDSKFRSFNPGPIPIPAAPTIRSLADSVSDERVDVMASHQSENGSGSISTASSTVSSIESEKAAYEYLAQTPIKSTDAHLVEFSEAMRTVAKALRRVAEGKAAAQAEAAEWKRKYELEMAHKQQSKIKGCGSCISNDLDKLASQLTLETSASDQLGCCGKHGICSHEVLQDEVPGPIPRSNHKMVGRKASFKLSWGCNGDKNGQHKHDFVSFEKGDITTAERSNKQILLKWESTPQTVLFITKPNSNSVHVLCAEMVRWLKEHKNINVFVEPRVSKELLTEDSNYNFIQTWDNDEEMKLLHTKVDLIVTLGGDGTVLWAASLFKGPVPPVVAFSLGSLGFMTPFPSEQYRDCLDNVLNGPFSITLRNRLQCHVIRDAAKDELVTEDPILVLNEVTIDRGISSYLTYLECYCDSSFVTCVQGDGLIISTTSGSTAYSLAAGGSMVHPQVPGILFTPICPHSLSFRPLILPEYVTLRVQVPYNSRGHAWASFDGKDRRQLSPGDALICSISPWPVPTACVMDSTTDFLRSIHEGLHWNLRKSQSSDGPRD

SEQ ID NO: 547 - protein, 539 aa, Setaria italica
MEVFGPVTPGQVSFLLGVFPVLIAWIYSEILEYRKSSSIKVHADSNLEKETVREDDKAVLLEGGLSKSPSTMLRNMSTKTKIIRFITMEESFLLENRAVMRAMAEFGIVLVYFYVCDRTNTFPESKKSYNRDLFLFLYILLIIASALTSLKKHNEKSAFSGKSILYLNRHQTEEWKGWMQVLFLMYHYFAATEIYNAIRIFIAAYVWMTGFGNFSYYYIKKDFSLARFAQMMWRLNFFVAFCCIVLDNDYMLYYICPMHTLFTLMVYGCLGLFNKYNEIPSVMAMKIVGCFLVVILIWEIPGVFELLWRPFTFLLGYKDPEPSKANLPLLHEWHFRSGLDRYIWIIGMIYAYFHPNVERWMEKLEESETKVRLSIKGTIVTTSVVAGYLWYEYIYKLDKLTYNKYHPYTSWIPITVYIALRNCTQQLRSASLTLFAWLGKITLETYISQIHIWLRSSMPNGQPKWLLSFIPGYPMLNFMLVTAIYLLISYRVFELTTILKSAFIPSRDNNRLYQNFVAGIIISLCLYFCSVILLKITVV

SEQ ID NO: 548 - protein, 79 aa, Setaria italica
MRFSKEDLVGSAFMAFGVTLFVGFFYAAVLSKLLPPYENRLLAAVQNDWYYCLLVPLTLPVIIVAVYLHWLSMKMFKHA

SEQ ID NO: 549 - protein, 510 aa, Setaria italica
MAGKAWRQLVAVASLLSVLWLLPWASAIHRSDFPVSFLFGTATSSYQIEGAYLEGNKSLSNWDVFTHAPVSGRIKDGSAGDIADDHYHRYDEDVELMNSLGVNAYRFSISWARVLPEGRFGRVNPLGIEFYNKLIDSLLLKGIEPFVTLNHYDIPQELEDRYGAWLSAEIQRDFGHFADVCFAAFGDRVKYWTTFNEPNVAVLTGYMLGTYPPARCSPPFGSCAGGDSDAEPYVTTHNVVLSHATAVEIYKRKYQSKQKGLIGIVMYTTWYEPLTDTPEDRLAAERALAFSVPWFVDPIVYGDYPPEMRQVLGSRLPTFSPEERRKLGYKLDFIGINHYTTLYARDCMFSSGCPLGQGTQHALAAVTGERNGVPIGPPTGRPMFYVVPDGIEKMVTYIMRRYNNLPMFVTENGYPDGGEAGHDHAKDLLHDQGRIQYLDGYLTKVAKAIRDGADVRGYFVWSLMDNFEWLYGYTLRYGLYYVDYQTLERKPKSSALWYKRFLQSFQHEAQ

SEQ ID NO: 550 - protein, 374 aa, Setaria italica
MIWPRSAAASRVHRFVSEFLGLEKSIMREGQGETIKYRVFAGTWNVGGEAPPDDLDLEGWLDTKADSYDIYVLGFQEIVQLNARNVLGPKQRSAAMKWQLLIEDALNNRRSAQDGGGEEAMDQERDVFRCVMSKQMVGIFVSVWTRSGLRRHVRHAGASTVGAGVLGRLGNKGAVSVRFLLHDTSFCFVCCHLASGGEVGDALRRNADAADILSRTSFLNSSGGVPAPVDLPKKILDHDRVVLLGDLNYRIAMDDGEARQLVRARKWSMLLENDELLLELSEGRQFYGWREGVVTFAPTYKYHRNSDKLYWCADTGHRRQRQHRAPAWCDRILWRGKGIRQIRYERCGGYRLSDHRPVRAMFHAVCEVVESKHG

SEQ ID NO: 551 - protein, 498 aa, Setaria italica
MATPSPGVLPLRALLVALPFLSLLIIFQLLHRPAPLPPPLRTHAHTQRRAEAEEEVSVNSLSSTTSPASRHRSEPEPTSLRHVVFGIASSRRTLPLRLRLLHLWLRPPARAFLFLDAALPAPPDLPSGVALRVSADASRFPYTHPRGLPSAVRVARIAGELVSALDREEEGLSRRRPPPQWLVLADDDTAFVLPNLLRALRRYDHREPWYLGARSESAAQNAWHGFAMAYGGAGIAVSWPLARRLARSLDSCVLRYPHLYGSDARIYACLAELGVELTHEPGFHQIDLHGDISGLLRAHPLSPLVSLHHLDNVYPLYPGMDRTRAMKHFFRAANADPARILQQTVCYDSKRSLTVSIAWGYSVQVFKGNILLPDLLAVQKTFVPWKRGRNVTDVYMFNTKHVPRDECKRGALFFLKSISSGEGKTQTTYNRQPPRKCLPDLIPLKNLSLIKVTAEQLQLIPGKALKRHCCDIVPSSSDTTMDVNIRKCKDDELIAMHS

SEQ ID NO: 552 - protein, 515 aa, Setaria italica
MSSNSSLTESLHEKTIVFGLKLWVVIGIAVGASLLGILLILLICLTIQSCIKRSRKPLNDRPTIQIPPAYKDIKEVGTVDQFSANDFVVHDGLLLTIQNEPEPVESVNRDAVQLAQEEKLKQREENNLSGSFRITDGCDVIQIVSSEEQSSTHATVDSAPLAGLPEFSYLGWGHWFTLRDLELATNRFAKDNVIGEGGYGVVYRGRLSNGTPVAVKKILNNLGQAEREFRVEVEAIGHVRHKNLVRLLGYCVEGTQRMLVYEYVNNGNLESWLHGELSQYSSLTWLARMKILLGTAKALAYLHEAIEPKVVHRDIKSSNILIDDEFNAKISDFGLAKMLGAGKSHIATRVMGTFGYVAPEYANSGLLNEKSDVYSFGVVLLEAITGRDPIDYERPPNEVNLVDWLKMMVANRRSEEVVDPNLERRPSTKELKRALLTALRCIDLNAEKRPSMDQVVRMLDSNEPIPQEERRHRQNRTPETSETEPLRGKNNSGRSDAPEHEARPPRPKSRTFSSK

SEQ ID NO: 553 - protein, 218 aa, Setaria italica
MAGRMVRSCVQTTLKTVNSVVGLAGMAVILYALWMLRAWYREVAQLDQRLPAPWFIYTFLGMGIFLCLLTCSGHIAAETANGHCLSCYMIIVFVLIILEGAITVDVCLNNNWEEDFPPDPSGKFDEFKVFVRSNFEICEWVGLSVVAAQVLSIILGMVLRTLGPDRETDYDSDDDTTVPARLPLLRNQSQHGPADYAEPNTSRRSDSWKLRILDKVNN

SEQ ID NO: 554 - protein, 372 aa, Setaria italica
MKGGDVSSISPLVSFVLGAAMATVCVLFFMSASPTRRLADISAFSTGNSTASTDDLRLASSADSGVADGDGDVVSATPAPAPAPVEAASPWGDLEEVLRRAATKDRTVIMTQINAAWTRPGSLLDLFFESFRTGEGGVARLLDHLVIVTMDPAAYQGCQAVHRHCYFLRTSNGVDYRSEKMFMSKDYLEMMWGRNRFQQTVLELGYNFLFTDVDVMWFRDPFRHISMAADIAISSDVYMGDPYSLRNFPNGGFLFVRSSAKTLDFYRAWQQGRWRFFGKHEQDVFNLIKHEQSAKLDLAIQFLDTTYISGFCQLSKDLNKICTLHANCCVGLGAKLHDLRGVLDVWRNYTAGTPEERRAGKFQWKLPGICIH

SEQ ID NO: 555 - protein, 120 aa, Setaria italica
GLPHPEHCPFCNQEDETIQHLLCSCVFSRQFWLQLLRSFGLPDIAPQPSSTGFFDWWQQAGSTLDKGTKRGFNSLVMLGAWILWKERNDIVFNGASPRMERVLLLAQEEAVLWRLAGAKG

SEQ ID NO: 556 - protein, 446 aa, Zea mays
MGHGVSCARTGDEHNYFRAAQVGDLDALDALLAADPSLARRATLYDRLSALHITAANGHLEVMSMILDHGVPPDAVNRHKQTPLMLAAMHGKIDCARKLLEAGANILMFDSLHGRTCLHHASYFGHVDCLRAILAAARTTPVADSWGFARFVNVRDDRGATPLHLAARQGRSACVQVLLENGAIVSALTGSYGFPGSTSLHLAARSGNLDCIRKLLAWGADRLQRDSAGRIPYAVALKRNHAACAALLNPSAAEPMVWPSPLKFISELDPEAKALLEAALMDANREREEKILKGITKYSQPSPTSPCEHDAIDEASLEASDGELCCICFEQACSIEVQDCGHQMCAACTLALCCHSKPNPATLTPPSPACPFCRGSISRLLVARASPDADDDDKAAAASSPQLVRRRSHNLRWAAATAWTSPSTTCDRHLMLCVAEQTAEHDHFKS

SEQ ID NO: 557 - protein, 190 aa, Zea mays
MSMSKTGQAAEKDEQQQSRGIALMQGICAVVYRKADNTPCPIKQGLYLGSVGAAFNKDALKSLNITHILIVAKSLDPVFPAEFNYKKIEVLDIPDTDLLKHSDECFGFIDEAISSGGNVLVHCFAGRSRSVTIVVAYLMKKHQMSLESALSLVRSKRPQVAPNGGFISQLEKFQKSLQVEQEWRMQPVQH

SEQ ID NO: 558 - protein, 140 aa, Zea mays
MAASTVASLSVPVTTTTFAAAGGGDVLIVVPRRAGAKRVVWFPAAARRGGGRLVAVRSSGPATPPEISDKVSESIKQAEETCADDQKGDAECAAAWDEVEELSATASHARDSLKETNANDPLEKYCKDNPDSEECRIYDN

SEQ ID NO: 559 - protein, 167 aa, Zea mays
MEATGAASQPSAPQTTHPAVAPLAFLLGKWRGEGEGSFPTISSFRYGEELLFSHHPSKPVISYTQKTWKTASGEPMHAESGYWRPRPDGSVDVVIAQSTGLAEVQKGSFDAEKKTVTLQSELVGNASKVKQITRTFQVADGELSYVVQMATITTSLQPHLKALLRRI

SEQ ID NO: 560 - protein, 704 aa, Zea mays
MSGFVGVVVSDPSLQGQFTQVELRSLKAKFVSLKRDSGHVTTKNLPGLMKKLRGLNEVVSEEEIAAFLSESYPDSDHEIEFESFLREYLNLQAQVSAKEGGAGGGRGGKPSFLKSSITTLLHNLNQAEKSSYVAHINTYLREDPFLKKYLPIEPSGNQLFDLIRDGVLLCKLINVAVPGTIDERAINKKRVLNPWERNENHTLCLNSAKAIGCTVVNIGTQDLVEGRPHLVLGLISQIIKIQLLADLNLKKTPQLVELFDDSKDIDEVLSLSPEKMLLRWMNHHLKKAGYKKTVNNFSSDVKDGEAYAYLLKALAPEHSPETTLDTKDPNERAKLVLEQAEKLDCKRYLTPKDITEGSANLNLAFVAQIFQHRNGLTSDTKQVTLTQTATHDDVLLSREERAFRMWINSLGVESYVNNVFEDVRNGWVLLEVLDKVSHGSVNWKLASKPPIKLPFRKLENCNQVVKIGKQLKFSLVNLAGNDIVQGNKKLIVALLWQLMRFNILQLLNKLRFHSQGSEGKEISDADILNWANCKVKASGRTSRIESFKDKSLSNGMFFLDLLSTVQPRVVNWKVVTKGETDEDKKLNATYIISVARKIGCSVFLLPEDIIEVNQKMILTLTASIMYWSLQKQPQSQSELTEQSEPSSMTSDAASEVASEDGASTTAPSESEEVNSLSDSISNLTTDDATSNAPSAENGNGVAGS

SEQ ID NO: 561 - protein, 143 aa, Zea mays
MAQRVMCLLRRSIGFTVPPAQRALSTTATPAAEGAAVAEATAKEAKKRKKKNLFDVVQFLPGWGVGYKVAKTTWRDVSYQITKINLYKDGRHGKAWGFRYKAGVQAADAPTRISGVNKRGWKYIKESQKKLHDAPKVDVAIAG

SEQ ID NO: 562 - protein, 781 aa, Zea mays
MGGACQQLSVDGDARTPANDRDPAGLLQHDDTENQQQQQACWERFLLKETLNVLLVESDDSTRQVVSALLRCCMYQVISAENGQQAWAYLEDKRNNIDLVLTEVFMPGVSGISLLSRIMSHNICKNIPVIMMSSSDAMSTVFKCLSKGAVDFLVKPIRKNELKNLWQHVWRQRCHSGSGSESGIQTQKCTKSKGANESGNNSGSNDDEAGMGLNARDDSDNGSGTQAQNSWTKLAVEIDSPQAMSLDQLADPANSTCAQVIHSKSEICSHRWLPGSSNRNCKKQKYTNDDFKGKDLEIDGPGNLYMDHQSSPNERPIKAADHENNSKESMMGNLGDATVRAADLIGSMAKNMDAQQAARAADTPNFSSEVPEGKGKNDDFKGKDLEIGGPRNLYMDHQSSPNERPIKAADHENNSKESMIENLEEPTVRAADLIGSMAKNMDTQQAARAAEDTPNFSSKVPEGKDGANDTVNDDEQRNSALRRSNLSAFTRYHTSAASNQGGTGLVGSCSPHDNSSEAVKTDSTYNMKSNSDAAAIKQGSNGSSNNNDMGSTTKDVVTKPSTNNERVMLPSAIKANGYTSTFHPVQQWMVPDNATAGKAKADEVANNAGRNSHPGDVQSNLTQQHRPTLHYVHFENSGSGALQCGSSNVFDPPLEGQATNNYGVKAGSNSGSNKGQNNGSTAGASTAAANAGRTDTEIRAIDKSGPGGGSGSGNDTYVRRLAASMTPRQEQLKKYREKKKDRNFGKKVRYQSRKRLADQRPRVRGQFVKQAVQNQEGDGER

SEQ ID NO: 563 - protein, 91 aa, Zea mays
MDYRQSYCMTLRMNIDCNGCYQRIRRALLQMRELEKHLIDKKHGRVVVWGAFSPQDVAIKIRKRTNRRVEILDLSEASPAAPEGGPDGHMS

SEQ ID NO: 564 - protein, 332 aa, Zea mays
MTDGARVETAPRLAQWRVDPLPCYTYRKSLPFLIGLWNWCISVERNNKQTCVKLFAENTSSLKNGSSAPIASFIAKLIVSLPPNQQTIVHPGIFDKQLKYDGFVWTIDSTVTGRFVIEIEFLDLKVADPSGGEPASIWASRQVKQCSDSTALSSLARMLHEDVLTDITINAADGSVGAHRAVLATRSPVFRSMFSHDLREKELSTVDITDMSLDACRAFLSYIYGDVRGGEEFLANRLALLRAADKYDIGDLREACHESLLEDIDARNVLERLQTAHLYRLPRLKGGCLRFLVDFRKVYEMHDDDLNAFLQTADRELVAEVFHGVLAAWSGR

SEQ ID NO: 565 - protein, 531 aa, Zea mays
MAAESCGSRGASPPPPPSAGGAAGRRRKAEAYAEVLRRIRAGAGGYGAARPGLEDELWAHFQGLPARYALDVNVERVEDVLLHKKLLEQAHKPMNGLVFDVRPAQGFTLEESTGFESTTSFKQEEQDPQSSVFTSRDQRPLHEVIFACDDKPKLLSQLTSLLGELGLNIQEAHAYSTSDGYSLDIFVVDGWEYEADILQSALREGVDKIKYRAWPLVPSMSARMDHQPLEVSPSSDFVQIPADAVDVWEVDLRLLKFEQKLASGSFGDLYHGTYCSQDVAIKVLKPERVSVDMLREFAQEVYIMKKVRHKNVVQFIGACTRPPVLCIITEFMHGGSIFDFLYNRRGNFQLPDVIRIASDVSKGMNYLHQINIVHRDLKTANLLMDDQVVKVADFGVARVKDQSGVMTAETGTYRWMAPEVIEHLPYDHRADVFSFGIVLWELLTGKLPYEDMTPLQAAVAVVQKDLRPTIAVDTHPMLAELLQRCWQKDPALRPTFAEIVDILNSIKEAVRSSVHHKRHSCRSHSGRRRGC

SEQ ID NO: 566 - protein, 70 aa, Zea mays
MSKARNAVVATGLLLFAGAGLSFPFLFVKSKNKPIIDSTKPLPPQATFRGPYVNTGSRDIGPDPTNYPKK

SEQ ID NO: 567 - protein, 192 aa, Zea mays
MGSGSFLKVLANNFDVLAGPLISLAYPLYASVRAIETKNPVDDQQWLTYWVLYSFITLFELTFAPIIEWLPFWSYAKLFFNCWLVLPWFNGAAYVYDHFVRPMFVNRQIVNIWYIPRNEKLGKSDDVLSAAERYIEQNGPEAFEKLISKSTKSSKSRNTKRLNLEDGEAENRAKAERESWGENPFYDKNYRY

SEQ ID NO: 568 - protein, 357 aa, Zea mays
MGVAGEKFQLGTVGALSLSVVSSVSIVICNKALMSSLRFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLLGVGVATITDLQLNLVGSVLSLLAIITTCIAQIMTNTIQKKFKVSSTQLLYQSCPYQALTLFLVGPFLDGFLTNQNVFAFDYTTQVLFFIVLSCLISVSVNFSTFLVIGKTSPVTYQVLGHLKTCLVLAFGYVLLHDPFSWRNILGILIAVIGMVLYSYFCTRETQQKPAEASPQAILQAKEGESNPLILDSLSAAENGGSATDDEPLKVPMWSSKYSKA

SEQ ID NO: 569 - protein, 180 aa, Zea mays
MGKKSGRSGADAPKATAFVLKVAMHCRCDGCVPKIRAAVNKLTLRCEGIQSLDQSALDTKGELALVATADPERLRRRLREATGKSVDIVFPKPAAANGGSSGREEANAAVQAQAQAQAQALLLAAGLQQQQQHGRPWYALQQGGYGPPPEPYVASYPATAWGAYPHNGLDDAYGGGWFGY

SEQ ID NO: 570 - protein, 313 aa, Zea mays
METMAKYNRSNPAVKRILQEVKEMQSNPSPDFMALPLEEDIFEWQFAILGPRDSEFEGGIYHGRIQLPSDYPFKPPSFMLLTPSGRFEIQKKICLSISNYHPEHWQPSWSVRTALVALIAFMPTNPGGALGSLDYKKEDRRALGIKSREAPPKFGSPERQKLIDEIHEQMLSKAPPVPQTLPNVPNEESNELPASDPSGEHADKVDEGDNTSGSVSDSSSGLPVPESESGVTENTGETSAVEVANHHVPEASHRENIPRVSSSHQNPAVAIQKPKHDRLLTLAAFGLTLAIMALVIKKFLKINGLGGFIEGKF

SEQ ID NO: 571 - protein, 146 aa, Zea mays
MNNQRKPGDWNCKNCQHLNFSRRDYCQRCRDPRPDLQFGDGYSTVGVLTSLDIRPGDWYCSCGYHNFASRSSCFKCGTIVRDFPAGQGAAGAEGDFAGGRDSAAVRAGWKAGDWICTRPGCNVHNFASRMECYRCNAPREAAGTGR

SEQ ID NO: 572 - protein, 890 aa, Zea mays
MRKLFFSESACKETKLHCAPHSWLPLERGKLSKFSGHAAAGSSIEALMKMPEPAVLPYFKPANYVDILAQIHEELESCPPDEKSCLYLLQFQVFRGLGEAKLSRRSLQSAWEKASTIHEKLIFGAWLKYEKKGEEAISDLLSSCCKCSQEFRLLDFVSQVSTGSHMMNYDDDDDESDEFRGSAVVHFRIRDDMIACDRRKLAALSTPLYAMLNGGFRESYLEVIDMSRNGISPIGMRAISKFSLSGRLPYLSADAILEMLDFANKFCCKGLKDACERKLASFISSRQDAIDFMECALELGCSILAASCLQVLLNELPECLNDEQVVRIFSSANKAQRLTMVGNASFSLYCLLSEVSVSTNPTSDVTVSFLEKLVESASDSRQKQLALHQLACTRFLRKDYPESECLFNAAFSAGHLYSLVGLARLASLRGNKHFALKLLDSVMSSRWPLGWMYQERALYLDGDNKLENLNKATELDPTLTYPYMFRAASLMKRQSVEAALMEINRILGFKLVLECLELRFCCYLALEDYRAALCDVQAILTLAPDYRMIGGRVAAKQLRMLVLENVEQWTPADCWMQLYDRWSSVDDIGSLSVIYQMLESETAKGVLYFRQSLLLLRLNCPEAAMRSLQLAREHAASDHERLVYEGWILYDTGHCEEGLQKAEASIAIQRSFEAFFLKAYALADSSLDPSTTATVVSLLEDALRCPSDRLRKGQALNNLGSVYVDCGKLDLAAECYINALKIGHTRAHQGLARVHFLRNNRVGAYDEMTKLIEKARNNASAYEKRSEYCERELTKTDLQMVTKLDPLRVYPYRYRAAVLMDNHKEKEAVAELTRAIAFKADLNLLHLRAAFHEHIGDISSALRDCRAALLVDPNHQEMLELHHRVNSQEP

SEQ ID NO: 573 - protein, 376 aa, Zea mays
MDVLKRELQRKRQLLNADFGGRKIIRRAEIEARELQRIREVERQLLLQKQHRHSRPLSSPSSSSSSSSPTSAAADADADASRAESGSKESLPREEVIRRLRVLRQPATLFGEDDIARLRRLQVLIEDSGALADIDAAEIGEGQTNDFLRDIQAMRAKAATVTKPKAAGAEAERGEGDSVSIDVPFEELCDEDKITAFFRRLLDEWTQEVDGMPEAERRTAKGKAAIATCKQCTRYLDPLFKQCKKKALPSDVRQALLEVVRCCRRRDYLAAVDNYIKLAIGNSPWPIGVTMVGIHERSAREKIYTNSVAHIMNDETTRKYLQSVKRLITFCQRKYPTDPSRSVEFNSLANGSDLQSLLAQQNAKNSEETLRLVAAS

SEQ ID NO: 574 - protein, 649 aa, Zea mays
QESYSAYCTSRFGRLINRPSIFDMENEEYAEDLCRDVWATHFPSEPFDLDSNEIGGNSVDNITCDNVNGEIVKMVRQYAGLADRFASLFVQEGVYHVAARRRYVRFLDLMKKVACATQECTRLVPSLDILLMWLAHQSFPVCYATDMVAMGISDNVAKVGVCYGEVVSNEAVRRTKELWEDAYDEPYDMAGSEVDVGAVSTAREAFYWVPAASEEDANRLYKSLQPRFLIEVYVFLKGEFDKEPTSKEFLRLRTQRCHRSLKLNISMSNLSCKSWQKVWHLYCEFATRGLFIEFRRTLSGCFRKSKFLKNISFSWSDVLHEKALALTEELDVRMRAMASITPPVQAPYLLKCVPDRVTDDGGAMISDVILRMRNYRPQEGRWLTRTVLDHSGRECFVIRMRVGRGIWRRGAETPMAVKWEDRSIEVREGSWSYIASTSSVGYAPEKIVGTGTVMKDHQENKVVWSLSTGDTLTIRLGDELSFQLKNDSSEEEARLLVGRRLSYRVNTDNASSNLVEEEQYLTLVRKSPYHHGDRATVLLNWKLLAVEFLPEEDAVFVLLLCMVIARTMTEIRREDVAGLLVRRRISEARAGQRDWGSVMLPGSLSPDPHLQPWYRNATQVLSSAETGPVLTKYSPADGKDMLYRQALIP

SEQ ID NO: 575 - protein, 403 aa, Zea mays
MAKGRAHPSKRPTHQLLAAVLSVFVLLPLLVPAAATVAVAVAVAEGGGKQLAVGKDEGKLVSEGDAGGGGLVEENEFAGGFGSLDSMLQWAIGNSDPEKLKEGAADVQKLSADELLERRQEIKELMEKLKMPSDADLMKIAIDDLNNSSISLEDRQRALQELLVLVEPIDNANDLEKLGGLLPVIQELNNANEEIRTTSAWVLGTASQNNELVQNQILGYGALVRLVKMGYSTSTEEAAKALYAISSLIRNNVNGQEAFHSENGSAMLQHILVSNNIDVRLQKKAVFLVTDLADFQLNSGIAQLPFLSDRLFLKSIVDMLSRFDLDLHEKVLLAIKSLLKLSSTDVEDFEFYDLDSVLLRLGVQLEDLTPEDQKEFAVEVDALRREVQTLFQQKLKQGKATST

SEQ ID NO: 576 - protein, 874 aa, Zea mays
MATAATASHPASASTSGRDALAAASSSPAAVCLVPFRWWARVREEEAAGGVQYAATAAASPSYYGLRLLHSLLHPDLVLRLERGECRAGGGNGGGRSYALVPADELSRALARQNSGLGLQNKHSFAGDSAGAYPLVLRISVRETSILTLKISKKDNPFENYKRANKIFNVDSQPVHVWDFSGQTNLILMNEWNRLHDCCHADQENLLEVQVYAMSDSLTSKIGGTNKENYGDISDMNSDSSYRSFGRAGSMGLIGLENLGNTCFMNSSIQCLAHTPKLVEYFLGDYAKNINRTNPLGLNGELALAFGELLRSLWTTDGKPVPPHYFKEKIACFAPQFGGFNQHDSQELLAFLLDGLHEDLNQVKCKPYEEAKDASGRPDEEVADEYWSNHLARNDSVIVDTCHGQYKSTLTCPTCSKTSVTFDPFMYLSLPVPSTAKRVMTVTVFSTDGSREPCSYDVSVPKFGTLSDLVQALSIVCLLGDDEILLVTEVYNNCIIRYLEEPSDSVSLLRDGDKLAAYRLPKRHEKSPLVVFTHQHFVQHSSDGNLTPQMREFEAPLLAALPEEISGLSLQDIYLKLLSPFQLSNGASSLNDCMESNSDSVDTPSDSGSINFQNSQLEDGPESNHCSASECEVTKGPDDLYDGVSGSNKEAHMDFEFYLKSERGEGQQQKIEINELHLLLETAPSRLHVNVHWLQNASRKYATSMLNNLPEIHKLELIPKGTEDSVALHGCLEAFLKEEPLGPEDMWYCPRCKKHQQAMKKLDLWRLPEVLVIHLKRFSYTQFTRNKLETFVDFPTVDLDLSSYVADKSEQPSSHYRLYAVSNHYGNMGGGHYTASIYHEEGKGWYKFDDDCVTPMSEDSIKTPAAYVLFYRRE

SEQ ID NO: 577 - protein, 398 aa, Zea mays
MAGDPGDAPEVGGGGIRSVLTTASLVAPSGDEVQFREIDGKIIGLYFAANWYPKCEAFTPVLAAAYEQLKERGAGFEVVLVSCDEDRPSFERFHGTMPWPAVPFGDLSCKKRLSERFQVEGIPRLVVLAPDGGAVVHPDAADLVHRYGERAFPFTAARVAELEADDQRKYASQTLEKLFSVSGKEYVMNSGNNEKVPVSSLVGKTVGLYFSANHCAPCIKFTTKLAAIYSSLRGKAEDFEVVYVPMDREEDGYLRSCGDMPWLALPYDGAPSRALARYFDVREIPTLVVVGPDGRTVTRDGRNLVNLYFDMAFPFTDAQIRLLQEAEDEAAKEYPRSLRHRGHRHELSIVSEKSGGGPYICCECEEQGLGWAYQCIACGYEIHLRCGQNAEGGSAGTA

SEQ ID NO: 578 - protein, 297 aa, Zea mays
MAFSSSLAPFFPPSGTFRAHPARRLRADAPGRFVASCLPPPDVVVTREQGKNARLISALEKHNVHPLELPLIKHVEGPDTDRLSDVLRNDKFDWIIVTSPEAAAVFLQGWKAAGSPKVRVAVVGEGTARVFHEVSESDDQSLELAFSPSKALGKVLASELPRSNENSCKVLYPASAKAGHEIEDVLSERGFDVTRLNTYTTVPVEDVDPLTLNLAISAPVVAVASPSALRAWLNLISKSDNWNNSVACIGETTASAAKKLGLKSIYYPTTPGLEGWVESILEALRVHRTASKEAPKR

SEQ ID NO: 579 - protein, 403 aa, Zea mays
MYVVKDIGGAIGLMAVALVLLGTWPVVLAVLERRGRLPQHTFLDFSATNFMAAVLIALTFGQIGPASSTPNFLTQLTQFKNNWASVLFAMAGGVTLSLGTLATQYGWAFVGLSVTEVMASSLKVVIGTTVNYFLDGRMNKAEILFPGVGCFLIAAILGSLVHASNAADNQEKLANNNASNAAAAADEEKDLTKHLLELEIPSQEAEPDAGTAGFLVGLEEKRSIKVLGSHTLLGLGIVVFAGIFYALFAPAFNLATNDQWHTLPAGVPHLAVYTAYFYFSLACLAVSAALNVWLLYRPMVGVPSSTLAAYVLDGDGRGLAMLAGMLCGLGNALTFMAGQAAGYAAADSVQALPLVSTFWAVALFGEYRRSSRRTYTLLASMLLMFTVAMVLLMASSGSRSIIH

SEQ ID NO: 580 - protein, 643 aa, Zea mays
MGVATVTELKQSISGKRTFRPSLISRHANEWPPTDVSSDLTVEVGTSSFALHKFPLVSRSGKIRRLVAEAKDAKLARLSLHGTPGGAPAFELAAKFCYGVHVDVTVANVAMLRCAAHYLQITDDFSDKSLELRAEAFLRDAVLPSIASSVAVLRSCEALLPAAEDVGLVPRLIAAVATNVCKEQLTSGLSKLDQCAQLKPAAAFADLDPPADWWGKSVAALGLDFFQRLLSAVKAKGLKQETVTRILINYAQNALHGLMARDVHRCGGADADAVKKQRAVVEAIVGLLPAQSRKSPVPMAFLSGLLKTSMAVSASSICRADLEKRIGMQMDQAILEDILIAAGAAVGAPAGQQHALYDTDVVARIFSVFLNLDDDHNEEDDGFDYDSPRSPKQSLLVKAAKLLDSYLAEVALDSNILPSKFISLAELLPDHARVVTDGLYRAVDIFLKVHPNIKEAERYRLCKAIDCQRLTPDACSHAAQNERLPVQMAVQVLYFEQLRLRSAIQAGGGSSMGGHDGAVFFGCAAAAASVQGSVNMRSGSGVGSGAMSPRDNYASVRRENRELKLEVARMRMRLTDLEKDHVSMKRELVRVGPANRLLRGLARSLGRLFRMRPAAEPGLQQLGAKATADAKVLFQRRRRHSIS

SEQ ID NO: 581 - protein, 191 aa, Zea mays
MEPAADGDDVHGQRRDGGHHAPVVSLRALGLADADAFMAWASDDRVMRHLKRPLCATREQAVAQIRDTVLGHPWFRAVCFGDVPVGQVSVWPYADEGGRRANLGYALAHDQWGRGIAAAAVRMVVGTVFDDLPGLERLEAVTDVANVRSQRVLEKAGFHREGVLRRYIAGRRGSGARDAVIYSFLSSDDRA

SEQ ID NO: 582 - protein, 104 aa, Zea mays
MAERVSRLSTEKAVVIFTTSQCPMCHTVSSLFSELGVCAAVHELDKDPRGRDMERDLARRLGRAPPVPAVFIGGRLVGSTDKIMSLHLAGKLVPMLKGAGAIWL

SEQ ID NO: 583 - protein, 790 aa, Zea mays
MVKFSKRFEGQLVPEWKDAFVDYWQLKKDVKKLQAAAGEAAVAAPARAPAHWAMRLPFFHPLGQPPAAIQVHRKLATDRSVDGAVAGEVYDTAVADGAGFADAEAAKAFFQRLDQQLNKVNRFYEREEREFLERGESLRRQLQILLELKAAVTQQQQARRGGSAADTDDPSVSWSIQLGGQSLRVIAEKEEECEEKLNGGDATAKISSGEGPVSQGLSESGRLCKPNEEMTRTLSGQGRSVRINIPVTTPSRTVTAIRELLFGDMPSQSKKTGAHGTDGSEKLSINKRKVHQAEKMIRGALVELYKGLGYLKTYRSLNMMAFVKILKKFDKVTGKEVQQIYLKAVESSYYNSSDKAVRLMDDVEELFLRHFTEGDRRKAMVYLKPNQREESHCTTFFIGVSTGGFIALFIGYCIMARVAGMYTQQSNKVYMSTSYPVLSMFSLFFLHLFIYGCNIFMWRKTRINHTFIFEFTPTKELKYRDVFLICTASMTIVVGAMFAHLAIIVKGNSSGVVQAIPGSLLLVFLFILVCPFNIVYQSSRYQFLRVIRNIILTPFYKVVMVDFFMADQLCSQVPLLRSLEYLACYYITGSYMTQDYGYCTRVKNFRDLAYAVSFLPYYWRAMQCARRWFDEGDINHIVNLGKYVSAMLAAGTKVAYENNNSTGWMSLVIIVSSIATIYQLYWDFVKDWGLLQFNSKNAWLRNDLILKQKYIYFVSMGLNLVLRLAWLQTVIHPNIGSLDSRVTLFFLAALEVIRRGHWNFYRLENEHLNNAGKFRAVKVVPLPFQEVEEE

SEQ ID NO: 584 - protein, 235 aa, Zea mays
MTMKSSSGGGHVIGVPVTSKAHGIEEVSRDPSFGKGAGDHLAVSLTHPSPYASFGYKHTGSKGQVTHWVSKLSRRAQGFREHVTLGPKLSETVKGKLSLGARILQAGGVERVFRQAFSAADKGERLLKALQCYIYTTGGPIAGMLFVSTRKVAFRSDRPITVTSPGGGGDTARVTYKVAIPLRRIRRVRPSENVHRPEEKYIHVSTVDGFEFWFMGFVSYQRSCKYMQQAVSEMR

SEQ ID NO: 585 - protein, 155 aa, Zea mays
MESTALMTARLPLLTSGSRSKPLPFASFTRAACRLASAPCSGSGSVVLLSRRSRDYAGVGSLVSAAAAPGDTADAGSESILLSVQGMMCDGCAASVKRILESQPEVTSATVDFKEASAVVWTTDEAKGTQGWQKQYGEKLAKHLGTCGFESRLQE

SEQ ID NO: 586 - protein, 158 aa, Zea mays
MANALPLIVALVAAAGCAALASATSYTVGDSQGWTTTGVDYSSWASRNTFVVGDTLVFNYVSKAHTVTEVSKAGYDACSGANALSDDDTGSTTITLQTPGTHYFICNVPGHCASGMKLAVAVSASPSGTAPSAGALQVPAMASVVAAAAGAAIKLALF

SEQ ID NO: 587 - protein, 719 aa, Medicago truncatula
MFGFSRRRTKFGRFKVQQLSDGTRSPVSVRHPKRIPNSILNGEGEEDGIGDAVTGSSGHSHEIDNEIVSSTDISSCSSGGSENWVLLSISGDKPAPRFNHAAAVIGNKIIVVGGESSTGLLDDVQVLNFETFSWTTASSKLYLSPSSLPLKIPACKGHSLVSYGKKALLIGGKTDPGSDRISVWAFDTESECWSLMEAKGDIPVARNGHSVVRASSYLILFGGEDAKRRKLNDLHMFDLKSLTWLPLHYTGTAPSPRLNHVAALYDDKVLYIFGGSSKSKTLNDLYSLDFETMAWSRVKVRGFHPSPRAGCCGVLCGTKWYITGGGSKKKRHGETLIFDIVKNEWSVAITSPPSSITTNKGFSLVLVQYKEKDYLVAFGGSKKEPSNQVEVLELDKNESALRRRSTPSKGPASILLEKHSSSTRLASQLNHCSQRLVDSVARQNLASAVEHGSGRKSLSESVDPNYPPSNVSLRKQFDRDEEYNADVKMDKNSDGSSLPQVADHRTNENDRRKLMNISGAKVNIEGQVLLSGMSNQQNQVFESDALESEVVSFPENDKSGSLSSTNIYQYYESKVAALIRKNGMLEGQLAASMASREAAEKGLSSVHKSRQEMEKKLADALKEMELLREKLAGLELAQEEANNLSNIVHSDNVRLEHDVAFLKAVLDDTQKELHSTRGVIAGERARAFQLQYEVFHLKQRLQSMENRTSTTPRKPFHVQ

SEQ ID NO: 588 - protein, 233 aa, Oryza sativa
MSSSSSMECTGNMSAAPLLVLTVAVLAVLASTCAADPEPIQDFCVAVPRAGGEASPAYPGFPCKPASAVVSDDFFFAGLAAAGSTDNPFGASLKPGNVEAFPALNTLGVAINRVDLAPGGVNPLHSHPRAAELVHVITGRMLVGFVSTAGKYYSKVVGEGETFAIPRGLMHFQYNPGNASARAMTVFNSQLPGVVPAATALFGADPEIPDAVLAKSFQVDAEIIKLLKSKFKK

SEQ ID NO: 589 - protein, 224 aa, Oryza sativa
MAAAAAAAGYRAEEEYDYLFKVVLIGDSGVGKSNLLSRFARDEFSLETRSTIGVEFATKTVRVDDRLVKAQIWDTAGQERYRAITSAYYRGAVGALVVYDVTRRITFENAERWLKELRDHTDANIVVMLVGNKADLRHLRAVPAEDARAFAEAHGTFSMETSALEATNVEGAFTEVLAQIYRVVSRNALDIGDDPAAPPRGRTIDVSAKDDAVTPVNSSGCCSS

SEQ ID NO: 590 - protein, 103 aa, Oryza sativa
MSSSSLSKKASSFVVTASMSAVEALKDQAGLCRWDYALRSLYQRAAAAKQVTGRAVPVSLSSQTGGAAASSSPAAACGRAARSKRSEEEKMQKAYHLVCWGPN

SEQ ID NO: 591 - protein, 327 aa, Oryza sativa
MDAAWRGGVGCSPVCLDLCVGLSPVREPSAARHELLDRPAGCRGGGDSKSMTNDEAKIVEAKVTQMSEENRRLTEVIARLYGGQIPRLGLDGSASPPRPVSPLSGKKRSRESMETANSCDANSNRHQGGDADHAESFAADDGTCRRIKVSRVCRRIDPSDTSLVVKDGYQWRKYGQKVTRDNPSPRAYFRCAFAPSCPVKKKVQRSAEDSSLLVATYEGEHNHPHPSPRAGELPAAAGGAGGSLPCSISINSSGPTITLDLTKNGGAVQVVEAAHPPPPPDLKEVCREVASPEFRTALVEQMASALTSDPKFTGALAAAILQKLPEF

SEQ ID NO: 592 - protein, 364 aa, Oryza sativa
MGAKKHTLQVLPWLLLFAQHTAASACDCANTTDGADRQGAMKLKLIAIASILAAGAAGVLVPVIGRSMAALRPDGDIFFAVKAFAAGVILATGMVHILPAAFDALTSPCLKRGGGDRNPFPFAGLVSMSAAVSTMVVDSLAAGYYHRSQFRKARPVDNINVHKHAGDERAEHAQHINAHTHGGHTHSHGDIVVCGSPEEGSVAESIRHKVVSQVLELGILVHSVIIGVSLGASVRPSTIRPLVGALSFHQFFEGVGLGGCIVQANFKVRATVIMAIFFSLTAPVGIVLGIAISSSYNVHSSTAFVVEGVFNSASAGILIYMSLVDLLATDFNNPKLQINTKLQLMAYLALFLGAGLMSMLAIWA

SEQ ID NO: 593 - protein, 418 aa, Oryza sativa
MEAAVDGRWTRVRTLGRGASGAVVSLAADDRSGALFAVKSAAAAAAAEQLVREGRILSGLRSPHVLPCLGFRAEAGGECQLFLEFAPGGSLADVVARSGGRLDECAIRAYAADVARGLAYLHGMSLVHGDVKGRNVVVGADGRAKIADFGCARTVGSDRPIGGTPAFMAPEVARGEEQEPAADVWALGCTVIEMATGRAPWSDMEDILSAVRRIGYTDAVPEVPEWLSAEAKDFLARCFARNPRERWTSSQLLEHPFLASAGCSVKTGEAAPQWVSPKSTLDVAFWESDTDDEEDDMPASPAERIKALACPCSALPDWDSDEGWIQVLNESSEACDTAVAKVEAEGKGRVLIEALETINESSGGDAECVDPEGTVRLITVASIGQQEVFCLGLINDPLVFSVNKSELTKSLFPQIVSF

SEQ ID NO: 594 - protein, 757 aa, Oryza sativa
MASLKSPVAAEEQAATAAAAAAKGEGERCPVEEVALVVPETDDPTTPVMTFRAWTLGLASCVVLIFLNTFFTYRTQPLTISGILAQILVLPAGQFMAAVLPSREVRLLGGRLGSFNLNPGPFNIKEHVIITIFANCGVSYGGGDAYSIGAITVMKAYYKQSLSFLCALLIVLTTQILGYGWAGMLRRYLVDPADMWWPSNLAQVSLFRALHEKEGGDGGKGSSSRGPTRMRFFLIFFFASFAYYALPGYLLPILTFFSWACWAWPHSITAQQVGSGYHGLGVGAFTLDWAGISAYHGSPLVAPWSSIANTAAGFVMFIYLIVPLCYWKFDTFDARKFPIFSNQLFTASGQKYDTTKVLTREFDLNVAAYESYGKLYLSPLFAISIGSGFLRFTATIVHVALFHGGDIWRQSRSAMSSAAAKMDVHAKLMRRYKQVPQWWFLVLLVGSVAVSLVMSFVYREEVQLPWWGMLFAFALAFVVTLPIGVIQATTNQQPGYDIIAQFMIGYALPGKPIANLLFKIYGRISTVHALSFLADLKLGHYMKIPPRCMYTAQLVGTVVAGVVNLAVAWWMLGSIDNICDVEALHPDSPWTCPKYRVTFDASVIWGLIGPARLFGRHGLYRNLVWLFLAGAVLPVPVWLLSRAFPEKKWIALINVPVISYGFAGMPPATPTNIASWLVTGTIFNYFVFKYRKGWWQKYNYVLSAALDAGTAFMGVLIFFALQNAHHELKWWGTAVDHCPLASCPTAPGIAVKGCPVF

SEQ ID NO: 595 - protein, 502 aa, Sorghum bicolor
MIRLQTYAAFSLLATASAVYYAFSSREQFYPAMVYLSTSKICFVLLLNTGLVAMCVAWQLVKRLFLGSLREAEVERLNEQAWREVVEILFAVTIFRQDFSVSFLAMVAALLLIKALHWLAQKRVEYIETTPSVPLLSHIRIVSFMAFLLIVDCLFLSNSLRSLIQKWEASVAIFFSFEYMILATSTVSTFVKYVFYVSDMLMEGQWERKAVYTFYLELISDLVHLSLYMLFFIAIFLNYGVPLHLIRELYETFRNFRIRIADYVRYRKITSNMNERFPDATAEELNASDATCIICREEMTTAKKLLCGHLFHVHCLRSWLERQHTCPTCRAPIIPPDSGRSASARQHGGQPGVQPGTDTPASEAAQGDNMSRRQAKLEAAAAAASLYGRSLVYPPANTLNRSGPQSTSSTPQSEASNSNQSQKDQELQIQNSSDGLAPSPFSAHGAIGSGPSTSNLENSLQKAQENFIKSQIEMLQIQLQMIRRGAAVSVTNSGNDEHKRND

SEQ ID NO: 596 - protein, 213 aa, Sorghum bicolor
MASAVASQVALPKPVFLMDILASPPASARPLFSTGDAPPRSSSDGVKDTDGVKDSTGEDAAAADRRPERVPKLFTGDVLDLFPEAAIRDLLLALAEDGGGAASMTGFSPRGSSWVSKDDADAVQLKVAMPGLGKEHVKMRVEKDTLVIKGEGDKDSEGDDKKDPAGYICRIDLPSHAFKVDQIKAEMKNGVLMVTVPKIKDGERKDVFEIKVE

SEQ ID NO: 597 - protein, 709 aa, Sorghum bicolor
MASRVKEDERHEKIIRGLLKLPANKRCINCNNLGPQYVCTNFWTFVCTNCSGAHREFTHRVKSVSMAKFTAQEVTALQEGGNERAREVFFKEWDPQRNGYPDSSNADKLRNFIKHVYVERRYTGERSTDRPPRAKDDKDEYSENRRSDGNWGGSRSPPNGSYSDRRSYSGRSDDRNSRYSYGDRSPGYDQNDYKKSPRYFEVVDDRSGKITPVQRFEDRRFSEPRKPDSGSPDFQKEADGSSPVVRPVRDILGDNAPQLRVGEPSKPAAEPPKPSVVRPLDPPKSSVVRPIDPPKPNGTRAIDPPPLTKTISSASSIGSSEGTSEQTKVATAVSLIDFSADPEPASTAPPQPTPMPQQPPVNAAAPQPVLEQGKSAPSVSGGDWASFDAFGQQQTPQTSTSVNPLESALAQLSFSEAPSAPNASAYPASLDPTVKANDGGHSSVLDHSHSLFDAPFGISGNQASTVMSGQGSSVQQSPLAAPTAGFPSQATANPQGISGIQGAASSTDSKFSGRKELPADIFTALYPPSTPMMPGWQRAPQFGMGYAMQYPAGVFQGMQAYPHGAFPQPTYQQPMYSQHAYSHPQPVKASNPFDLGNESAPIQAHMPPSGPPGASAGLASATLIGNSSFGVPPQQPHQLYQSAAQPSHFMMQQVPNSMPMPEQQPNSMLATQQGLGSFNMGFDQQAPPRYPQPNTPPSYGSVGGSNPFG

SEQ ID NO: 598 - protein, 511 aa, Sorghum bicolor
FASSADLPAAADEDDSVYSSIGRRSTAYRSLRSIREIDLLPDDAVADLRAIASRMAAAGYGRECAQVYASVRKPAVDASLRRLGVERLSIGDVQRLEWDALEAKIRRWIRAARAAVRGVFASERRLCFHIFHDLPISSATISAASAPATHDTPFAEAVKGAALQLFGFAEAISIGRRSPEKLFKIIDLHDALSDLLPDVSDIFAASKVAESIYVQAVEIRSRLADAVRGILSEFENAVLRDPPKTAVPGGTIHPLTRYVMNYSSLICDYKVTLSELIISRPSASARLSAEGNELAPSLADLELPELENRLPLASHIVWIIVVLEHNLEGKAALYKDPALSHLFMMNNVHYIVHKVKDSPDLWGMIGDDYLKRLTGKFTVAATNYQRTSWLKILNCLRDEGLHVSGGFSSGISKSALRERFKSFNAAFEDAHRVQSGWCVPDNQLREELRISIAEKLLPAYRSFLGRFRHHIENGKHPELYIKYSVEDLEIAVGDFFEGVPPSPHNRRRSHG

SEQ ID NO: 599 - protein, 565 aa, Sorghum bicolor
MSSKKNYYKEKMMRRKEEKKVEPETPRYRDRAKERREDQNPDYEPTELGSFHAVAPPGTDLRLADAHKISIEKSKYLGGDLEHTHLVKGLDYALLHKVRSEIEKKPDAEDGKDSKSRATKEDQAVSFRTATAKSVYQWIIKPQSIIKENELFLPGRMSFIYNMEEGITNDIPTTLHRSKADCPVPEEMVTVSVDGSVLDRIAKIMTYLRLGSSGKVLKKKKKERDIKGKNNLASGDYDEAVKPSQTNGSALKHQSDMPPPSAPPPRNNNFNGKEKQSAPIARADDDDIFVGDGVDYSVPNKEMSQSPGSEDMEESPHNHQKQSYFTEPMYGPVPPSESAQAWQQPNEYDAAQAQMIAAGYQGDWSGYVYAEQPLGYQEQYAQQSTQEYDVLADPSISQDPRFMTQADKDRGLGSVFKRDDQRLNQLREKDARERDPNFISDSYSECYPGYQEYNNEIAGSDDEDDLSKMDMGGRAKGRLHRWDFETEEEWAKYNDQKEAMPKAAFQFGVKMQDGRKTRKQNKDQKLTNDLHKINKILARKKGEKDGGDDGGHYDDDLPSAKKQRG

SEQ ID NO: 600 - protein, 59 aa, Sorghum bicolor
MAPVSEAASYLELVQGGSIASSSGAVYAAPWDGRCSARGRMAETDSDDDDDDYDCAPAA

SEQ ID NO: 601 - protein, 776 aa, Sorghum bicolor
MLCPRSGCSSRHSSPIAMRMRWLLLWALAAFAPAPAPALAAGEMGYTHCGCDGGGGAGGFWSLDNIFKWQKVSDLLIAAAYFSIPLEILYFVAGLRHLLPFRWVLVQFGAFIVLCGLTHLLAAFTYEPHPFMVVLLLTAAKFLTALVSFLTAITLLTLIPQLLRVKVRESLLWIKARELDREVVLMKRQEEASWHVRMLTQEIRRSLDRHTVLYTTLIELSRVLALNNCAVWMPSEDKSGMCLTHELRRDSDDDGEAVVAADDADVLEVKATDGVKLLPPDSVLGSASGGGKEGTGTVAAIRMPMLKVADFKGGTPEVIKTSYAVLVLVPPSDRNWAPHELEIVEVVADQVAVALSHASLLEESQAMRDRLAEQNRELLQARRDALMANEARDAFQRVMSQGMRRPIHSIQGLVSVVQEEGLTSEQKLVVDTMARTATVVSTLINDVMEMSAANQERFPLETRPFHLHSMIRDAACVARCLCDFRGFGFAVHVENVLPDLVIGDERRIFHVLLHMVGNLIGRIDVGNVTFRVRADDEAMEDQRWNPWRPSYSGGHSSVKFVIGVKRQQNADSPSSLAQFLRRPRTEGFDLRLSFSMCRKLVQMMQGNIWAILDGQGLPESMTLVLRFQLQPSLASSSLGGSFDLQYPSPTNQIAGLKVLLIDDDEINLVVARKLLERLGCTVSSLPSGSGFMNSVGPSSTSSQLVMVNLEMSTINPLDAASRIRQYRSSHWPLVMAMTSEQNVWEKCAQSGINGVLKKPLVLQEVKEELTRILQNT

SEQ ID NO: 602 - protein, 648 aa, Sorghum bicolor
MIMDPRPRDNLNFGARLPTPNPPTPHMISFSLQQPQPQFFPSYGFHSHNHNNPAISSHPSPPSVMPGCTTPSPASTTTTEADNAEDLSEAVADDAVLAYINQFLLEDEDEESYPVTSVPVEDSVLLAAVEKPFVDILKSANHITAKAYEVKSWITDDCHSTGSGRFHDVVTSTLDSTQLAPEMVQGDVVDAVHKGQKNPRDNDLEVERRKSKQSALCDEETVREMFDKVLLCTDKNCAFHSPMPADAQNSGGYVKGSGNRRGRRKGRSGAGAEQEPVDLTTLLIHCAQAAAIDDHRNSSEHLKQIRKHSSATGDAGQRLAHYFADGLEARLAGTGSSIYRSLAAKRTSTGDMLKAFNLYVKACPFRIISHYVANTTILNATKSVTRLHIIDYGIMYGFQWPILMQRLSKRSGGPPTLRITGIDFPLSGFRPAERVEATGRRLHEYARMFNVPFEYQAIAAKWDTIQVKDLNIKSDEFIVVNCLYRMRNMMDETATDDSPRTRVLNTIRKLNPHLFVHGIVNGTYNAPFFVTRFKEAMFFFSSIFDMLEANASRMDEHRLLIEREFFGREAINVIACEGTERIERPETYKQWQMRNLRAGFRQLPLDREIMARARYKVSKTYPRDFLVDEDNLQGWKGRVIYALSAWST

SEQ ID NO: 603 - protein, 731 aa, Sorghum bicolor
MAASARGSVWEIQPRDVEAAGLAAADAAAFVAALRSAAAAAGSGATRDAVWAAVAAAGVLRPEHPHALHQLVYYSTYAGWDRDARGPPPYWFPSPIDCKQTNLGRLMEANGPKLLGSSYKDPISSLSHFYRFSVENQEVYWSMVLKQLAVNFKQEPRSILSTSDRSKKGGTWLQGAVLNIAECCLLPCPSLKRTDDSTAIIWRDEGLDDYPVNRMSLKELRGQVITVAHALDAMFEKGDRIAIDMPMTCNAVIIYLAIILGGFVVVSIADSFAPQEIGSRMGVSKAKAIFTQDFIVRGGKKVPLYSRVVQGTSSKAVVIPAIGDSIGITLRNGDMSWKDFLSRAAGRSSSYSPVYQSVDALTNILFSSGTTGEPKAIPWTQLSPIRCASDTWAHLDVRPCEIGCWPTNLGWVMGPIIIYSCFLNGAALALYHGSPLGRDFCKFVQDAGVTVLGSVPSLVKSWKAGNCAEGLDWTKIRVLGTTGEASDIDDNLWLTSRASYKPIVECCGGTELASSYIQGSLLRPQVFGAFSGASMSTGFVILDEQGTPYPDDVPCTGEVGLFPLYFGASDRLLNANHDKVYFDGMPIYKGRQLRRHGDIIQRTVGGYYIVQGRADDTMNLGGIKTSSVEIERVCNRADECLLETAAVSIKPSGGGPEHLAILAVLKDRSAQYDVNLLKRKFQTAIQKNLNPLFKVSYVKVVPEFPRTASNKLLRRVLRDQLAQELSNRSKL

SEQ ID NO: 604 - protein, 249 aa, Sorghum bicolor
MLAVFDRSVAPSPEGLRQPGAAGGDSAACLADRFREARPDAVTVNLGGSGAMAYSSSKQSPLLPRLFGAVDNIFCMFQGTIANFAVLKQQYGLSKGTNEVNIIIEAYRTLRDRGPYPADQVVRDISGKFAFVLYDCTTKSVFMATDPDGNVPFYWGADTDGRLVVSDDIDLVKKACGKSSAPFPKGFFFTTSGGLKSYEHPMNEVKPVPWVDSKGEVCGTTYTVDASAKKETKTSIPRVGSAADWSSQY

SEQ ID NO: 605 - protein, 157 aa, Sorghum bicolor
MSRGSKLRWLWRAPARALGRARDMYVRGLTGCARYVPADAGFGYPVFVPAPLSRSHSADWRGGAGSGADEDLRELVRAASQRRVEQRRAELQAVARSQSMAASLSMARIDEDAPCEFGADAGDGPGALYPRSQSCVGDAAGRRAHAHRRHGKVVALV

SEQ ID NO: 606 - protein, 650 aa, Sorghum bicolor
MEVEALEKKGHTAFAKAMKSFSSSERYKRSKSYFEDMYATDALRSSDKTIVLPMPQVVKAKVKSDISKEAQPGRGAQSTLRKEILQLEKHLKDQQVVRGALEKALGPNAAQVNLSPENPMPKAANELIREIATLELEVKNMEQYLLTLYRKAFEQQAPAFSPPDAAPAFSPPDRREASKMSVSSRSGQLRETPVAMKSCKSRGDAALRSSYPPVHKKLNDPLADCCTSARSDRAIDSDVLRCQSALSYRGVFSSRILPSEDDSLARALRSCHSQPFSFVEEGETGASGMISLAEYLGTNVADHIPETPNNLSEEMVRCMAGIYCRLADPPLVHHGSSSSPSSSFSSTSAISPQYVGDMWSPHYRRETTLDSRLINPFHVEGLKEFSGPYNTMVEVPMISHDSRRLKEAEDLLQTYKLILYRLEAVDLRRMTNEEKIAFWVNIHNALLMHAYLKNGVPQNNLKKTSLLVKAACKIAGRNINAAVIQSIVLGCNTHCPGQWLRTLLYPRIKSKVSKAGHEWRAFAVAQSEPLLRFALCSGSHSDPAVRVYTPKRLFHQLEAAKEEFIRATAGVWKEQKLLLPKLVEAYAKDVKLSPQGLVDMVQRYLPESMRMAVQRCQQGGRSSGKVVEWVPYNPAFRYLLARDLAFPHLS

SEQ ID NO: 607 - protein, 498 aa, Sorghum bicolor
MASSGDEGRVVVDLRSAAESAAADEEAHATPLHEIESLCMRCGENGITRLLLTLIPHFREVVLMAFECPHCGERNNEIQFAGQLQPKGCCYSLKVPLGQSDILNRQVVKSDSATIKIPELDFEIPPEAQRGTLSTVEGIIMRAVDELQALQDERKKVDPQKAEAIDQFLLKLRSLGSGEAAFTFILDDPAGNSFIENPHAPSSDPLLSVRFYERTREQQAALGFLAEPPTEQPGEAVLPASAVESNSDGLQSVPHGSVGAVAGRRAIAQGNPDEVAAALCRYSAPEEVDTLPSTCGACGTECVTRFFATKIPYFREVIVMATTCDMCGYRNSELKPGGEIPAKGKKITLRVQNARDLTRDVIKSDSASVKVPELELELSSGTLGGMVTTVEGLIVKICEALERIHGFQLGDSTLEWKKKKWEDFKERLSKLLSLQEPWTLIIDDGLAASFVAPATDSLEDDSQLTMEEYQRSWEQNEELGLNDMDTSSADAAYNTTST

SEQ ID NO: 608 - protein, 210 aa, Sorghum bicolor
MECVLGVVGRDFAVVAADTSAVQSILVHKTDEDKVMVLDSHKLMGASGEPGDRVQFTEFIQKNLHLYQFRNTIPLSTAAAANFTRGELATALRKNPYMVNIILGGYDKDVGASLYYIDYIATLHKIDKGAFGYGSYFCLSLMDKLYRPDMTVEEAVDLVDKCIKEIRLRLVVAPQNFVIKIVDKDGAREYARRELVGDNAPVDAAITVAA

SEQ ID NO: 609 - protein, 647 aa, Sorghum bicolor
MVFVGGDRAMGGAPGADAASTMRFALHVMRGRWFMFFASILIMAAAGGTYIFGIYSKAIKTSLGYDQQTLNTLSFFKDVGANVGILPGLINEVTPPWVVLLCGAGMNLVGYLMIYLAITGRTAQPPVWLMCVYIAVGANSQSFANTGSLVTAVKNFPEDRGVVLGLLKGFVGLSGAIFTQLYRAIYGTDNDGADLVLLMAWLPAAISLVFIPTIRIMPRQRDAAAAAARGERRQRERKAFFLFLYASIVLAAYLLVMNVVELEVIHFPKTAYYVTAVVLLLLIFFPIVIVVKQELKTYLAAAPATATTSSATIVTITVDDEKTRASNNNVAPESSSPDHRRGHHQAAVAAEAEDISRRSPSCFQDVFRPPARGQDYTILQALFSVDMLVLFVATICGVGGTLTAVDNLGQIGQSLGYPQRTISTFVSLVSIWNYAGRVVSGFASEYVLARYKVPRPLALTVVLLLACVGHALIAFGVGNGLYAASVILGFCFGAQWPLLFAIISEVFGLKYYSTLYNFGSVASPVGSYILNVRVAGRMYDQEALRQAGGRRGSKDLTCIGVRCFRESFLIITGVTLLGALVSLVLAWRTRNFYRGDLYGQFREVGMAAGAAAAEDGKVHEAEASSSSGGGASDSDTKDTEAVNGSKV

SEQ ID NO: 610 - protein, 1263 aa, Sorghum bicolor
MDAGEMEDVRAAAAAEEVISSRGGSVLGKKTILKSDHFPGCQNKRLTPQIDGAPNYRQAGSLRVHGVAMPTMEGIANVLNHIGAHKKGKQTRILWHSLREEPVIYINGRPFVLRDVERPFSNLEYTGINRERVEQMEFRLKEDILQEASRYGNKILVTDELPSGQMVDQWESVEYDTVKTPLEVYEELQQQGYLVDYERVPITDEKAPKEGDFDNLVRRISQVDIETEIVFNCQMGRGRTTTGMVIATLVYLNRIGASGIPRTGSIGKVFYAGNDVDDYMPSSEEAILRGEYAVIRSLVRVLEGGVEGKRQVDKVIDKCDSMQNLREAIATYRNNILRQPDEMKREASLSFFVEYLERYYFLICFAVYVHSVSSAHQTTLSVEVSFSDWMRARPELYSILRRLLRRDPMGALGYSSSKPPLTKIVESANGRPQDMDVVAAMRNGEVLGRLTVLKSDHCPGNHSLNLPERVEGAPNFREIPGFPVYGVANPTVDGIRAVIQCISTSKGGRPVLWHNMREEPVIYINGKPFVLREVERPCKNMLEYTGIDRARVERMEARLKEDILREAERYGGAIMVIHETDDGEIFDTWENVDNEAVLTPLEVYKNLESEGLPIKYARVPITDGKAPKSSDFDTIAFNVTSASKSTAFVFNCQMGRGRTTTGTVIACLLKLRIDHGRPIRIPVCQYGHEDTIYSTGGDTADHNGHLNSESWKPRTLTKLNSGFGINDILLLRKITRLFDNGIECRQTLDTVIDRCSALQNIRQAVLKYTRVINQQHVEPRVRRVALNRGAEYLERYLKLIAFSAYLGSEAFDGFCGQGETKISFKGWLQQRPEIQTMKWSIRLRPGRFFTVPHEQKTTYPPPQGDVTMETIVKARSGSVLGKGSILKMYFFPGQKRSSSVNFRGAPHVFKVDGYPVYSMATPTIDGASDVLSYLGSKDTTGRSIAQKVVVTDLREEVVVYIKGSPFVLRELDQPVDTLKHVGISGPMVENIETRLKEDILSEIKQLGGRLLLHKEEFNAATNQCSVVGYWEHIDLEDVMTPAEVYSTLRDKGYCIDYKRIPLTREREALAADVDAIQSLIEESARYYLFISHTGYGGVAYAMAITCLGLGADAKFVMEETAETHFVSTSLAKNVSIKTKTDIALRQGDYRDILNLTRVLVHGPKSKEEVDTVIDRCSGAGHLREDIMHYRKVLQDCSHDDDDDDDEEHSYLTDMGTKALRRYFFLITFRSYLYSKRSCEATFTSWMKARPELGHLCDNLKLDK

SEQ ID NO: 611 - protein, 756 aa, Sorghum bicolor
MQKSDHHEQKLTSPRGLIHKILRRTNSRRSPTAADQQPSPVSPETSNSSIFSKQKDADDAIKDSEKPSTHTIRIEDEKSDLLGYEVYSGKLTLDNKAKNSSSEQSGSGSSSNCFDARLSTEALIWGSNILKLEDIVSVSYNSGLRYFTVHACPLEKRSSGLSCFMNPRRTQKDLKFVSTSPHEAFRWVNSFADQQCYINLLPHPMASSKKHSSELIQFDTMFDPYLKKCRSPPKILVILNPRSGHGRSSKVFHGKVEPIFKLAGFKMEVVKTTHAGHAKSLVSTIDFSTCPDGIVCVGGDGIVNEVLNGLLCRDDQNMAASVPIGIIPAGSDNSLIWTVLGVKDPISAALSIVRGGLTPIDVFSVEWIQSGTMHYGTTVSYFGFVSDVLELSEKFQKHFGPLRYFVAGFLKFLCLPKYSFELEYLPVSDVNDAEHTILVGQEKVDASDLYDDVVRRSRAECLPRASSLSSIDSIMSTGMSGAELEVCSPRANNEPSEVVRALDPKSKRLSLGRASTFKEPEEVLHPHSHGTSTPNWRRSKSKSRTEKARPGLSATNDAKSSKVNTDKEDTSSTISDPGPVAVWDSGPKWDDEPKWDNQPNWEPETSIELHSPREDIELGLTKELVPSLDERWTVRKGRYLGVLVCNHSCKTVQSLSSQVVAPKAEYDDNCLDLLLVGGSGRLRLLRFLVLLQFGKHISLPNLEYVKVKSVRLKAGPNTHDGCGIDGELLHVKGQVRCSLLPQQCQLMGRPVKNLVQ

SEQ ID NO: 612 - protein, 607 aa, Sorghum bicolor
MKHPNWVHVGKESVTDLREQILRLIEHDSHDQEEKSRAELLEKLKSCKRDTLIELCHSFDVIGSSANRKEDLVCFLMEFIKDQCSGDGINSDKKFKKRRRVKEDENLSTGKPSKKKKREGEEEADERKGVEDIGKHSDCDLMDNKYTCADSKKGFPNEQTNFDPSERINDSMSQKDGASLSEAPILTDEQLIITTPPTKFVTAATGDSIDVKALKGKMSSITKKKATPKEDCKVKFCGKQESKGDAKPRKQAIKPSKDELREAVFLILDTADFATMTFGDVVKEVDKYFGKDLFERKPLIRCLIEEELFKLADEAEKKELEELEAAEAKARAEQAAKEMAQVQTVESGINKQHVLQAGRDSNTKDSLKNANDSTNKISIDGGASVESAFKRNSCYAAEGSGGHKADTDAKNKVITKDGNGEKVALAPIANSDCTIQLQGSSNVVAELMNNNNVEILEGSKDGKVKGASSGENNDTEDGSNEKNRSENVGSNAEAANGCEAEESNNHGNNERVEHTEGDKAQEANHNENSANVEIHADGDGEAKEGDIDAEQSQADGGSNNTAEDAEHNENTKVDDANSSKNGTAENGKTDVDVKGNSDGTAEGSPLA

SEQ ID NO: 613 - protein, 133 aa, Sorghum bicolor
MGLLDKLWDDTVAGPRPDTGLGRLRKQPARPAAVKINDPAGDASAFVPPSPASGSSEETPVKVTRSIMIKRPAGYPSSPRSAASTPPASPLGTTPPISPFAAAGGRFRRKSSSDAYERATPPGTTSQPPPFEV

SEQ ID NO: 614 - protein, 219 aa, Sorghum bicolor
MAAAARPSNATLLARLRDGTAMFELLDDSSLAHAPPSWPRLHCFARVASSLRGGWSAALTKVEHYGVQRVTGDGRCMFRALAKGMAKNKGIPLAPREEVQDADDLRMAVKEIICDSETERQEYEEAVIAITVEQSLKRYCQRIRRPDFWGGESEFLVLSRLCRQPIIIYIPEREYHGRGNGFIPIAEYGLEFTKNTKQWKKKTPVRLLYSGRNHYDLLV

SEQ ID NO: 615 - protein, 420 aa, Sorghum bicolor
MASWDNLGELSNIAQLTGLDAVKLISLIVRAASTARLHKRNCRRFAQHLKLIGGLLEQLRVSELRKYPETREPLEQLEDALRRGYLLVNSCQDRSYLYLLAMGWNIVYQFRKAQSEIDNYLRLVPLITLVDNARIRDRLEYIERDQCEYSFDEEDKKVQDALLNPDPCTNPTIVLKKTLSCSYPNLPFNEALRKESEKLQVELQRSQSNMDLGSCEVIQHLIGVTKTVESTIPEEETNAKASEKKGSNYSESKGDNAKSFDDDDDYPKKQKDTCSTQRFSSQVPYGHDLVSSRGSYSDEWHADLLGCCSEPALCFKTLFFPCGTFSRIASVAKDRPMSSGEACNDIMAYSLILSCCCYTCCVRRKLRQKLDIAGGCCDDFLSHLLCCCCALVQEWREVEIRGAYTEKTKVTPPPCQYMEH

SEQ ID NO: 616 - protein, 880 aa, Sorghum bicolor
MINLFELSVGASAKVSSRDGSPVRGTQSERKEYVGSKALTGSTRRSSSDRSGGTPMKMLIAQEMAKEGDANQKTTNVVARLMGLDDNVDLPKHVVPSNRRSFPDGHLSATMARVNNQISFEKHTSSAEDVEYKDVYEVGYQPPRGDEYPRRRPNEDHDKRRMDLVRQKFVEAKRLASHDNILQSKEFHDALEVLNSNKDLFLKFLEEPNSLFTKQSGGHNSAPTSPQRKRITVLKPSKSVELKGDKAIKRMKNHAVDGNRIERSNVHKSDAAHVKEDRLPKHTRIVVLKPTSVITSTEQSEQNYHADLDDSEAPGLSRHLSDEIDWSVHGICRHHTESLQGCIQSNLFSADRPYHRYAEEESDSDIGTPTSHHSWEYIYQFSNPYFGSLSHASCSPESHVTREAKKHASDRWAIVPSSEISQQKVPVRRSLSTLGEMLAMPDMKKEEVADQASPDANTHQLCEPTGGVSSNSAVDEGEGERSLRKISRSRSVPVSSTAFDSLRLDGGRLDAQHKEPTVPKEVKPKNGKSSLKGKITSFFSKRKKAEKEKANPSPLGTLNSRASSASTVAVGKSDVPQHVCTSLQDDVASENLEEQFNHGPIGVPVDEPEAPSVSKSPASHEKALSFEIRTSHFDQPSPTSVLDLQFEDISEKSPISSESAITAKQEPLSRSLPIGSIARTLSWDDASQEAPLCSTKGDNLEQEQYEFVEKTLTSAGFCNEKVQDIFVRWHSLDCPLNPAVLDQLLERKVEDAKCRERRSNQRLLIDSVNAALLDIGQSKLWGAYPCTARHSNAPGVATCDVLVTDEAWRLVKSWLFDDENDIAGLGDYPGLAADWVVGKEINGKGWPEMLRLEVDEISKEICEEVLGELVGEAFSQLADH

SEQ ID NO: 617 - protein, 553 aa, Sorghum bicolor
MADRPEVAVDSRSGYCAATRTFRSKRADVPLPADADLDVVRFLASRRHAGVVALIDAATGRRVTFRDLWRAVEGAATALAAPPLSLRKGQVALILSPNSIHFPVAALAAMSLGAVLTTANPLNTPAEIAKQVADARPVVAFTTRDLLPKLPLGAGLRVVLLEPDRLASDPSSVVATIGEISATPPDPARRGDRRVTQDDPATLLYSSGTTGPSKGVVATHRSLISMVQIIMTRFRLEGSDKTETFLCTVPMFHVYGLVAFATGLLGCGATIVVLSKYELPEMLRSINEYGVTYLPLVPPILVAMLAHPKPLPLGNLRKVLSGGAPLSKELIEGFKEKYPQVEILQGYGLTESTAIGASTDSAEESRRYGTAGLLSPNTEAKIVDPETGEALPVNRTGELWIRGPYVMKGYFKNTEATQSTLTPDGWLKTGDLCYIDEDGYLFVVDRLKELIKYKGYQVPPAELEALLLTHSEIQDVAVIPFPDREVGQFPMAYVVRKKGSNLSEREVMEFVAKQVAPYKKVRKVAFVTEIPKNASGKILRKDLIKLATSKSKL

SEQ ID NO: 618 - protein, 581 aa, Sorghum bicolor
MAPAVAAAGSSPRRWLAAAVIALACALAPAAARPDKEMREKFYGTLVTNGTHNATGDGSIAEMFGRVLDKEFSDSDTPDAPDKSSFNNSVSDHQAVLETVAVITHDKKKNDSQHTNSPKSFQIGDMFGGQDENSDDLETVIDKEDNVFVMSNRKTKYPTLQLDLRLIKDLVIIIVSATGGGIIFSCMGQPVIVGYLLAGSLVGPGGLNFINEMVQVETFAQFGVVFLLFALGLEFSLTKLKAVGPVAVLGGLLQIALFMFLCGLTAALCGAKSSEGVFVGAFLSMSSTAVVSKFLVEKGSTNTLHGQVTIGTLILQDCAVGLLFALLPVLGGASGIFGGVMSMAKLLLVLSIFVAVTYMMTWSIVPRFLKLMIQLSSQTNELYQLASVAFCLLLAWCSDYCGLSLELGSFLAGVMISTTDFAHHTMEQVEPIRNLFAALFLASIGMLIHVKFLWNHVDILLAAVILVIIVKSIVVTIVVKAFGYSIRTAFVVGLSLAQIGEFAFVLLSRASHLHLVGGKMYLLLLGTTALSLVTTPLIFKLIPVVMHLGILMRWFPSENSMQSELPLQDKAVMLEAHNRSL

SEQ ID NO: 619 - protein, 474 aa, Sorghum bicolor
MAPPPTSRRLTLGLILIGALCSASVAARFAPADNHLLACGAAAPAVLPDGRRFVPDSGCASTRLRSSSPSLSSAAPPGSPPPPSPLHASARVFSCRASYDLSVRRRGHHILRLHFYPFAPALAASRFHVGAAGLLLLHNFTASSPVVKEFILPVDSDVLVLTFVPDSGSTAFVNAIELVSAPEELVGDIGTFVTSGGAAQIHGLSSQVFETLYRINVAGRKVTPFNGTLWRTWVNDEKFLVDTDSANYRVWSFSGRIAYPKGSRQMTREVAPDNVYNTARSVKPGANVTWGFPVPAGSRYLVRMHFCDIASKALYELYFNIYVNGDLAVKDFDLSSVTGFLAYPYYIDFVVDVKDEGILKLAIGGLKKSLSDEVSGILNALEIMRMNKTSGGMDGDFPIDLDMEYVVGKGIGEFARSLLCGFIFAGLFVALVMRVLRLRTELRNNGAAWSWRPMDSSEGKLARAYQLVPSKTDY

SEQ ID NO: 620 - protein, 535 aa, Sorghum bicolor
MALAFDEFGRPFIILREQEKKTRLRGLDAQKANIAAGKAVARILRTSLGPKGMDKMLQSPDGDVIITNDGATILEQMDVDNQIAKLMVELSRSQDYEIGDGTTGVVVMAGALLEQAEKLLERGIHPIRVAEGYEMASRVAFDHLERISQKFEFTADNIEPLVQTCMTTLSSKIVNRCKRALAEIAVKAVLAVADLERKDVNLDLIKVEGKVGGKLEDTELVYGIIVDKDMSHPQMPKRIEDAKIAILTCPFEPPKPKTKHKVDIDTVEKFQTLREQEQKYFDEMVQKCKDAGATLVICQWGFDDEANHLLMHRNLPAVRWVGGVELELIAIATGGRIVPRFQELSPEKLGKAGLVREKAFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLSPIDTLTAVKAQQVKESNPHCGIDCNDVGTNDMKEQNVFETLIGKQQQILLATQVVKMILKIDDVISPSEY

SEQ ID NO: 621 - protein, 756 aa, Sorghum bicolor
MMKHPIAIARLLSIRRLLLLVLQQLCLLVPLVSVLSAAAAVPPPPPAHRRPEGCPSRCGDVDIPYPFGIGDQCAIDGGFDLSCSLVNGTHYRPFSGPFEVTNISIPDAKAWTKMNISWRCYDSRTNPTTWSTRRENFTHTPFRFSHQDNKIFVVGCNTLGYITSEYYSIGCLSECYNKPRNMSSCSVGSGCCEADVPIDMGYSRSFFNPEYNYTGCGYIAVMEEKMFSYSTTYRDSSTSFFDAYNGTVPVVMDWRIRRYTCEEAKLNISSSYACISYNSQCVNTTNGPGYRCKCQDGYQGNPYVRDGCTDIDECVQDNMNDYCTARGATCQNTQGNFTCLCPPGKSMTNGICMAHHKSSSWLIPVVGASVGLVVLVVTLTCAYLIQQRKLHHTKQRYIQQYGDMWIFEKMKSQQGFKIFTEAQLQEATNKFNEKRVLGHGGQGTVYKGLVEGNVEVAVKRCMSVDEQHKREFGKEMLILSQINHKNIVKLLGCCLEVQVPMLVYEFIPNGTLFQLIHGNHGRQISLAIRIQIAHQSAEALAYLHSWASPPIFHGDVKSSNILIDRDYTAKVSDFGASILAPTDESQFVTFVQGTCGYLDPEYMQTCQLTDKSDVYSFGVVLLELLTRKKPFKFDGPEDEKSLAVRFISVAKQGKLEEILDDHIKKDESMEVLQEVAELAMQCLEMSGANRPTTKEVSERLDSLRKVMQHAQQQHNNPEEMEPLLGESSLASSDEVVVSTGNLSIEMEAARSLERGR

SEQ ID NO: 622 - protein, 280 aa, Sorghum bicolor
MAAKVASPLAFRRDVRGPLGRPHPSGGCRSGTGMPGVLYWSSGAGGSRVLAARARGRNRFGGGSGRTAKDEAADEDEEEVADVVIVDAGDEEEFASDELSGFRGLVLDLSYRPVNVVCWKRAICLEFIGKADVLEYYDQTVSSPSGSFYIPAVLRVPQLLQVVKRRRVKQSLSRKNILYRDDFTCQYCSSGDNLTIDHVIPISRGGKWEWENLVTACARCNSRKGQKTPEQANMKLLKIPRAPKEYDIMAVPLTKSAFRTLKRNHGLPEVWLQYLSRPSP

SEQ ID NO: 623 - protein, 104 aa, Unknown
  Sequence found in Organisms: Sorghum bicolor, Triticum aestivum
MAKAQAMAALMLTVLVVLAASAEMAHGVCNLSSAGIRACQPAAAIRNPTEQPSAECCAALAGADLACLCRYKNAAGVWVRFYRIDINRAMGLPGKCGLAMPANC

SEQ ID NO: 624 - protein, 176 aa, Sorghum bicolor
MQLQSSMASLALHPIIPATAASSTTLAVVVGSRHAATLHRCFRPRRRLITTCKAEPSGGNSTVELAAGAAGLASSAVVAWSLYTLKTTGCGLPPGPGGALGAAEGVSYLVVAGLVGWSATTKVRTGSGLPAGPYGLLGAAEGVAYLTVAAIAVVFGLQFFQQGSIPGPLPSEQCFG

SEQ ID NO: 625 - protein, 155 aa, Sorghum bicolor
MANALLLLVALLVAGCAALASATSYTVGDGQGWTTNVDYSTWASGKSFAVGDKLVFNYMSKAHSVTEVSKSGYDTCSGANPLSDDESGSTVVPLQTPGTHYFICNVPGHCAEGMKLAVAVSATPSSAGGALLQVPAMASVVAAAAAGAAIKLALF

SEQ ID NO: 626 - protein, 510 aa, Sorghum bicolor
MVDLRLQVVATVLGMVALAAAAGGSSSSGKQSEFQEVTVDAIHQGFKNGSLTSTALVRFYLDQIARLNPLLHAVIEVNPDALAQAARADAERSASRGRCAVGLHGIPVLLKDNIATRDRLNTTAGSLALLGSVVRRDAGVVARLRRAGAVILGKANPSEWSNFRPVESGWSARGGQTLNPYVLSATPCGSSAGPGVAAAANMAAVTLGSETDGSILCPSSFNSVVGIKPTVGLTSRSGVIPITPLQDTIGPMCRTVSDAVHVLDVIVGYDELDAEATGAASKYIPHGGYTQFLRIHGLKGKRIGVLDVFFQGYDDMQLAVYEKHLDTMRQQGAVVIKNLDITTNFTDLGEQEILLMAAEFKLSINAYLSDLLYSPVRSLAQIIAFNKAHPVEERLKDFGQPDLIAAEKTNGIGTRERAAIQRLKEISTNGLEKLMKEHQLDAIVAANSDASSVLAVGGYPGIAVPAGYDKQGVPFAICFGGLRGYEPRLIEIGYAFEQATKVRRPPTYKS

SEQ ID NO: 627 - protein, 74 aa, Sorghum bicolor
MVFFCFLVDQRRKVRSSKPAAGICSRCGGCASVADMETATRVCYLLTVHRRTWRAIICTFCGAMLKSYRHYRLY

SEQ ID NO: 628 - protein, 105 aa, Sorghum bicolor
MATAALTAPKAALPPRGPGKEHRTAITVPEFKRWVKQFDTDHDGRISRKELREAIRRRGPWFAGLRALFAVRRADRNRNGFVDDSEIEGLIDFAERELGFRITTE

SEQ ID NO: 629 - protein, 102 aa, Sorghum bicolor
MAADGGPATAALDEALKPFQERASEAEIRIAKLEALLYNKDDLSRGSEATSSAVKDLRSKLDAATAECLTEKEKNKKLIMENEKLQYRMTHLIRAIKEAESR

SEQ ID NO: 630 - protein, 728 aa, Sorghum bicolor
MENSDARAVRRVRCPRCPCVLEEPRAPVYQCGGCGATLRAKNRTGTGSAGDAATASPSRSGLPPRSRHLDASDVASTSRSSTPTPPHVASTSRSGTPPPPHVGTSWHRATTDATSSRHGSGDLALVSAGTRASGDVASTSSTPDATASSRRQGTDATSRRGSGGPVSAARSRASGDVSSTSSTPDASAAMSIGRPGADTTSRGESGGPARNRVPEQVALIEKRSREQIAVGQEVRDDSEGCGPSDAGGAESGVGGAGFSGGNREATPESQDDTEKGMKRQAESTDAARKKHSGEAAVQPQNPHDRRQELAPKSSAQPAAAQPARDDAGEKARSPSRHEIQEEHLGPLRKKILKTVDELKGDLSELFTKSPELNQPRARPARLPKQEGYVSRAAAAAASGFPARARHAAAATDGHRGHHVSAARAVKPRQAAAPPRGLPSRRYRQCRAHPCCHDVEPRPCHHGHGCCRHHGKPECSSCRGYCCRPRAQEPSAPRKPPAGKEPKRRLPPRNHCRPVLKGAPFIVCSSCFKLVQVPADFAVSTRTVRKLRCGSCSTVLSYSYRDPARKKAYQDSVDQCSIDGSELHVGKGDERSDPFAPFIDAFGLSSYSTEDEQRLPVSRNTSFDTLDGTKGVGRLHRLMGYGSASELLRHSPDLYESFSERTTPDVRQHDRKGKGVCIDDGDGDDDYDVDDSDEEDIGALKRSARKGSGWALPWMPGKGTPAAGAIRIK

SEQ ID NO: 631 - protein, 480 aa, Sorghum bicolor
MATLPSASRWSSSTAWPRRAAGAASTALAAAVFAVLDVADALLCFVYALLDGILEDSPVRCYCHRSYDDQVDGGDHEHEEVSGTLYARGRRSAVRDAILYLLRHVVGRRGRAPPDETVAPCKWRSPRWSDCACKSCVAWRGGEGEGGGGGGEGGRLHVVVKEPQPYRKDAGRKQSETTTTRDPENAIFVHGFTSSSSFWAETVFRESSSVLHDYRLFAVDLLGFGRSPKPANCKYRVRDHVEAIERSLGEPPQSLMSGSGSFHLVAHSMGCIIALALAAKHPTRVKSITLVAPPYFLACEQKQASQVALNRLAEKKLWPPLLFGSAVMSWYEHVGRTVCLVVCKNHLLWEWLFSLFTGNNTGVDFRVRDLTKHTHHSAWHTMHNVICGGAALQDTNLEAVAAAGIPVQAVHGADDQVVPVECSRHLKAKLPRAKLRVNVMDRRDHATVVLGRERDFAEELKAFWVWGSATPSTKRRFRGC

SEQ ID NO: 632 - protein, 424 aa, Sorghum bicolor
MGKHEFLTPKAIANRIKAKGLQKLRWYCQMCQKQCRDENGFKCHCMSESHQRQMQVFGMAPDRVVEGFSEEFFESFLSLIRRAHRHSRVAATVVYNEYIADRHHVHMNSTRWATLTEFVKFLGREGYCKVEDTPKGWFMTYIDRDSEQAVKDRLKRKRIKSDMAEDERQERMIARQIERAQKSLSKPNDGDVAEGESESGSEEEYSGSDDDGEEREDDAKEANKATGKIAIALQKAMPGPKVNPFEDKPKMKFGFDEEDDSGTQEKVKDEVPKKKGKDVKAAEARRSALDELMKEEEKAKERSNRKDYWLCPGIVVKVMSKSLAEKGYYKQKGVVKKVIDKYVGEIEMLESKHVLRVDQDELETVIPQIGGLVWIVNGAYRGSNARLLSVDTEKFCAKVQVEKGLYDGKVLRAVEYEDICKISS

SEQ ID NO: 633 - protein, 681 aa, Sorghum bicolor
MDAAELPLVYHIGLVLAALWAAAAIGFRGSLLYLLAFLYLYMVNARCAVRLRKRIQHEEMKSAYQRRLLSDAESVRWLNYAINKMWPVCMEKIVSQLLRPIIPWFLDKFKPWTVSKAGIQELYMGRNPPIFTSMRVLPETSDDDHLVLELGMNFLSGEDMSAVLAMQLHKSVGLGMTAKMHLTSMHVEGKILVGVKFVRSWPFLGRVRLCFVEPPYFQMTVKPLINHGLDVTEFPGISGWLDKLMDTAFGQTLVEPNMIVINVEKFASTPSESNWFSIEERPPIAYVKLEILEGIDMKPSDINGLADPYVKGRLGPFKFQTQIQRKTLSPKWFEEFKIPITSWEATNELVMEVRDKDPMFDDSLGQCTINVHELRGGQRHDKWMSLNNVKKGRIHLAVTVEDISEDQNRSSMDESLKQADTEVPVSTSVYSKVDSGELPEENKVLMDEVEHINIDGQEQPGGLYVHRPGTGVPRTWESRKGRARNPDTQIHQEVDKSKEIPTPKGSGQGGLFNVGSFFRRNSRKGSSKNLDPSLPATPGPQSVTEPDPKLPQTPRPNLKELGEKRTSIKIVVNEEANPADKVGYAENSGEDVAKVIEKNAGEPGRSLTSTLSRKFSRKRADDRLSDIPEQIEAHGSESVSEGPILVRGEPMIAEGHPTAEHGNGDGTEQDVAGAKVATQAS

SEQ ID NO: 634 - protein, 391 aa, Sorghum bicolor
MSETESAAVAAALDPAATAEPKPRRLRGHKKGAVTCCVASSARPGVVASSGEDGCLCWFDLRTKDVLLTMEAANKPISSICFKPGNEDCVYISAGNEILSFDVRMGAQSKPLETYNYNRDEINQIAVSSKGFLAAADDSGDVKIVNTIQKCLYKRLREAHTSICSSVQFIPWRPWTAITGGLDSKLVAWDFSKGRTLFSIDYGSPELQNGNSSGSAGQCFNPAFVHSVAVSEEGILGGLYKVCAVARGDGAVDVIDLEYELAPAKSKGPPRAAISKKSSKGAELGDGSCNQSQAKRIHLDYTMGGHTAAVSCVAFSVFGEKGKFLVSGGNDASVKLWDWSKGFSSETNSKVELVLNIDVKKKVNWLCTAPTDSDNLIVCDTSKVVKVYNFR

SEQ ID NO: 635 - protein, 439 aa, Sorghum bicolor
MDPSLSSSPLRLSATPAGPGATLTTPKPTLVAAAGPGRQPTTTTTCLRAISPSPSPPTPVESFGFDALKETFSVDVAAADARPLDVPLAAPFTIASSRLVAVSNVAVRVELRSGAVGWGEAPVLPSVTAEDQPAALDAAGRACAALEDASAAPLGALLQDVASVLPGHAFASARAGVEMALIDAVANSIRIPLWRLFGGASDSVTTDITIPIVTPNEAAQLAAKYRGQGFQTLKLKVGKNLNSDIEVLKAIRLVHPDCSFILDANEGYTANQAIEVLDRLNEMGVTPVLFEQPVHRDDWDGLRDVSSVAMEKYKVAVAADESCRSLLDAQKIIQGNLAHVINIKLAKLGILGALEIIDAARKANISLMIGGMVETRIAMGFAGHLAAGLGCFSFVDLDTPLLLSEDPVYGGYEAFGPLYKFTNARGHGGFLHLDNDASK

SEQ ID NO: 636 - protein, 289 aa, Sorghum bicolor
MMNQHREEDALRGQAVKNQKAIWDKTLEMRFLLQKGFSTSNKLPQEPIRTRFCNHDKQIEQAYDDLLNSSKQTLSSMMELQEALLESNQATKGANEIPSAANGDNDEWSEVQRLQTRITTFRNTEIDKWQRKIQVTTGAAALKGKLHAFNQNISDQVAGYMRDPSRMINRMYLSNSAVSVFGKDVGEPRTAEEGHIMEGDPELIDDSEFYQQLLKEFLESCDRGASESALYALKKQQVKKRKLVDRRASKSRKIRYHVHEKITNFMAPEPMVVPPMAPKLFENLFGNGN

SEQ ID NO: 637 - protein, 507 aa, Sorghum bicolor
MGPPQPARVGAINIEACARPIAVDHRIRLPYYFRIAGSLLRQANIYRNESNFLDLYVILLRYSSLLCETIPKHRDYHAFKLKEKAFFDKLNDVMKELETLKPVVQRQVAEHNRGGTVESNTNSLNGNYGITRRIEQRTPTSYTPQPFVGSTNGALQKTFHAGRQVALLPSVQKQFMNLPYPKEETLARHSILGPNGLNGRWNGPVTEIKVQYPSNFELTQNDITSLVPSILNQDDSHGPSTAPAPPPPDSSSNDNDDMKSVLSLDDGRWSVPAERTPLPSASLEEELFQLDIKQPSPPPVLAEVQRPISPSRVADPTPGLPTSGTARFQNLHVPIKLMECFLRVAESNTKRSLETCGVLAGTLKKRTFCVTTLIIPKQKSTSNTCEAINEEELFEVQDTGSLFTLGWIHTHPTQSCFLSSIDLHNHYSYQVMLPEAIAIVMAPTDTTRKHGIFHLTDPGGMGVIHDCQERGFHPHKAPLDGSPIYEQCSHVYMDNDIKFDMIDLRER

SEQ ID NO: 638 - protein, 568 aa, Sorghum bicolor
MFSWNDEQQQVGDAIWTEFNESEDHIMPYPKGAEDSTTRKNNEKEVASIDGITEHSEGVQTGLQRMEKQTANQTSAHFSATRIDMESWPDLPSLNPTLDRNYSDDNITSTYLDFSAEPSLQKVTGKATGQLDGESEVFSNDQEEKSNSFLDCDWGNIGDFDDFDRLFSNSDSIFGNEIVANDSDFLSASSNLMDNAVQSIPILVEVQKRPVRSRRKPEERGKSKISSSTSGFSQSKVENASTNLQAPMQPVQTPQYALFQDSKKIGQVQHVNQFMFPGYGYPAYPFPTIPLVSNIQAEGYLTKPTGTSYRTLEDSPKQSSSIEMSQDIPSRALIMTPQEKIEKLRRRQQMQALLAIQQQQQQFGQEGSGSDTMVSQAYSPRNKNPDSLGSSIVIDENANKVFSPEVIPTNHDLVHKSSAISVDPFIEEKIYYQLQDALGKLDTKTRLCIRDSLLRLAYSAAERQIDGDRSSTNKTNKDDDEASENDASTRRTRSPTREAETITNPIDRIVAHLLFHRHCSKVATATKEEIISSTPLILEPEPKVPLGTPRLPSQDQRDEQEIVLPLSQ

SEQ ID NO: 639 - protein, 266 aa, Sorghum bicolor
MAKTNDNDAFSPPVSQERVVVTNKHGERLVGLLHHTGSNKIVVLCHGFISSKNDSLILDLAAALTKEGISVFRFDFSGNGESEGQFEYGNYRKEADDLHSVVLYLYQKSYDIAAVVGHSKGGDVVILYASIYNDVSKIVNLSGRFDLKQGIEERIGEGSIDRINKEGYLDVKDKSEHVNYRVTKESLTERLNTDMHAASVSISKECRFLTVHGSADKTIPVEDAHEFAKHIPNHKLHIIEGANHNYTAHRKEVADAVVDFITSDGV

SEQ ID NO: 640 - protein, 798 aa, Sorghum bicolor
MGSDLKEMKYRRRIGVEERPQCSDPRGGGADWPALQQDPVELLRKLDELRDQITRSCNVVGQPREHRRVSRRAVSMLPEQLEPPPLPAYHRSRYGGRYGHGLPPPSPYAPPRPEHGERYVRQSSGHYRQYPATGRQSENGGMGPGGYHHYGCACPHCLHGQRPLQQEENIPMARYFAGQHESYRFQRSPSVSSDYDRRSVASSLYSHRSVSKRRAEYFRKKAEHICRPVDGAAPFSVCSSCYKLLQMPMGKCIGRKQNRFQCGSCCQIISLKHEEENGIPFVPSSSLYAPEMEQCSSDQMRRDSAHQRHEDFNSMFYNSIDHSNMQNNMDFTDDNSLSSTMSNDRIEKECGSTRSIQSKAEGLSFSPSRSVDIGSPKDILCEREADCKVEPSVDGPLGPRSPALEDKLVDPLCAQENGNDEDDQGMPYRSDLTCKGEYDVSDEYDVGISTRSKQESNEDDKDATEDERSYRSYEQKSKSKEDDCCNVEDSSKTYRQNSGEDDASSLVDGSEKYECMNIKDDDSSPGGEDTWNKYEPKVKGDENCVLGAESIHNNCDENNKDFIGTGSISLRHEELKIEEDNGKLQQPFIEDANSQAGSGSSINERTNSGFSRGSSETGLDEDQSSTGKSGDSSFFAGFLKKGFKDLSLLNKSMDSVKVSINGHPISERALKKAEKKAGPVDPGSYWYDYRAGFWGVMGRECIGIVPPFIREFNYPMARDCAGGDTGVFVNGRELHQRDLDLLVGRGLPRISGKSYSIEMSGNVIDEATGKKLRSLGKLAPTIEKLKRGFGMHVPEEFR

SEQ ID NO: 641 - protein, 277 aa, Sorghum bicolor
MRDMEDRSVVSRRHEPTTVARTADDDDDDVASGDEDSDSDAEFEFPFVSRESEAAADELFAGGRIRAFYPVFGRVLDDEAPAPAPRSPLGRLFQLEQARTSSVASTSSSSSSSTAGAGAAGLDGASPDSYCLWTPGSASAASSPSRSPRKSGSTGSIPRWRRIGELVVGRSHSDGKEKFLFLSAPPSPARDREREHSSPASKSKSKPKQPQPKGSKTAAAAAATELDTVAAGRRVSYGGANAKASTGGARRTFLPYRQDLVGLFANVRGLSRSHHPF

SEQ ID NO: 642 - protein, 798 aa, Sorghum bicolor
MAALLYLALLLLLTFPVCSGASPWQTMTTGSHIRGEDHDKVILLSPDATFSCGFHEVGTNALTFSIWYTTHAAERTVVWTANPYSAERGGYSPVNKYGSRVSLNRDGNLILTDTNGSMVWESKTSSGKHTTVTLLNSGNLVISDSSNKIMWQSFDSPTDTLLPGQNLTKDTRLVSGYHHLYFDNDNVLRMLYDGPEITSIYWPSPDYDAQKNGRNRFNSTRIAVLDDMGNFTSSDGFKIEASDSGPGIKRRITIDYDGNFRMYSLNASTGKWDITGQAVIQMCYVHGLCGKNGLCDYLGGLRCRCPPDYEMVDPTNWNKGCKPMFLTDGNQAREEFTFIEQPHADYYGFDLSSNKSIPFEACRNICWNSSTCLSFTYKGGDGWCYTKDLLYNGQVFPYFPGDNYMKVPMSFNTSTYSISKQKTLTCGPAGSENMLGPASMYGTKKDNINWTYFYVFAAILGALELLVIVTGWYLFFKKHNIPKSMEDGYKLVTNQFRRFTYRELREATGKFKEELGRGGAGIVYRGVLEDKKIVAVKKLTDVRQGEEEFWAEVTLIGRINHINLVRMWGFCSEGTKRLLVYEYVENESLDKYLFGERSTESLLGWSQRYKIALGTARGLAYLHHECLEWVVHCDVKPENILLTRDFEAKIADFGLAKLAKQGSTSFNFTHMRGTMGYMAPEWALNMPINAKVDVYSYGVVLLEIVTGIRASSGIMLDERQIDFLEFVQEAKQILSTGNVSDIVDDRLHGHFHTEQAIAMVKIAFSCLEERRKRPTMDEIVKVLMSCDDEDDYHPAYSY

SEQ ID NO: 643 - protein, 603 aa, Sorghum bicolor
MSATIDRLATPSHEGHAHSDGKRECNSDEENSEGERKPKKGSLKKRAATAGYKFRHSLRRKSKTKDDNHVASIEDIRDVQELETVERFRQCLLDEGLLPEHHDDYHTMLRFLKARKFNIDKAKHMWSEMLRWRKEFGADNIEEFDYTELDEVVKYYPQFYHGVDKEGRPVYIELIGKVDTNKLVQITTIDRYVKYHVKEFERCLQMRFPACSIAAKRHIDSSTTILDVKGVGLKNFSKDARELIMRLQKINNDNYPETLYRLYIINAGQGFKMLWGTIKSFLDPETASKIHVLGNKYQTKLLEIIDGSELPEFLGGKCRCEEYGGCPKSDKGPWKDPEIVKRVINGEANYGRHVLAVSSINQKEVGCTEHSTEQEKGNDASAESISEVEDVSSPTALVDPISPNLTHVDESKFPGRASSSDAPPITGDSIPAVDKVVDACSNPRNSSTPSSSGSFSLRNIPATLGGLKTRIVAWSTILVLSLLAFLRSVLSIVTKRLSNQAITCDHYSADFRQGYTGNGTLTSVLTRLGELEEKIQTLEAKPPQVPFEKEELLRTSVYRVDVLEAELISMKKVLYETLIRQDELLAYIDQQQTAKFCRRKFCF

SEQ ID NO: 644 - protein, 98 aa, Sorghum bicolor
MAAAASAARSFLRSSGSSSLRSAAARAASRAGPAPLPRRMPTSAPRALLRSPVEMSSVCLESLMPMHSATASALMTSLLAAPACKGFGWLSEAGNDDV

SEQ ID NO: 645 - protein, 1118 aa, Sorghum bicolor
MAVSGAPEQPQREQPQQDHDEEMLVPYQDAIEGPQQDVVEGPQPMEESASAVENQLVPDTSTSRFTWCIENFSRRNVRKHYSDDFIVGGYKWRVLVFPRGNNGDHLSMYLDVADSNLLPPGWSRNAQFSLAVVNQLDSKASLRKEAIHQFNSRESDWGFTSFMPLLDLYDSSKGYVVNDKCIIEAEVAVRKTFDFWNYDSKRMTGYVGLKNQGATCYMNSLLQTLYHIPYFRKAVYHMPTTENDTPSGNIPLALQSLFYKLQHCDNSVATKELTKSFGWDSYDSFMQHDVQELNRVLCEKLENKMKGTPVEGAIQKLFEGHHMNYIECINVDSKSTRKESFYDLALDVKGCSDVYASFDKYVAQERLEGDNKYQSEEHGLQDAKKGMLFIDFPPVLQLQLKRFEYDFVRDTMLKINDRYEFPLQLDLDRDDGKYLSPDADRSVRNLYTLHSVLVHSGGVHGGHYYAFIRPKLSDQWYKFEDERVTKEDMKRALEEQYGGEEELPHTNGLKNAPIRFTKHSNAYMLVYIRESDKEKIICDLDDEDIPDHLKVRLRKEQEEKECKKKEKAEAHMFTALKVARDSDFKEQIGRHMHFDLVDFDKVNSFRAPKNMSINDVKEELSKEFGIPVESQRFWVWAKRQNFTYRPSRPLTFLEETSAIGYLKDAIVAKLPNSEVRLFLEVHLGQENQGIASGKTKEDILIFFKLYDPEKEDLRYVGNFFVKASGKPSDIVERLNEIAGFPSDEDIELYEEVKFEPAVMCVPIESNISFRSSQIDNGDIICYQKRCLPDSMDRYRYPSVPSFFEYIHNRQVVYFRLLDKPKEEGFSLELSKRSTYDDVVEKVARQLRLDDPSKIRLTQHNLSSQQPKPHHIKYRSLNYLSDMLHNHNQMCNILYYDVLDIPLPELESTRSLKITFENATNHEMSFHTMRLPKSNTLLDLIEDLKSKVELSCNDAEFRFFGVHLHKICKVYQPGDKIDSVNEPLYIEEVPEEEKNAGPHDRLVHVYHFEDNRHVQYFGEPFFFLIRDGEALSDIKVRIQKRLQVPDEQFIKWKFAHVTFSRPEYLQDSDIVLNRFHKQKPVYGAWEQHLGLEHTATTPRRSYFGSQNRHSFERPVKIYN

SEQ ID NO: 646 - protein, 408 aa, Sorghum bicolor
MGCYGDFFEKAKPYIAMTSLQFGYAGMNVITKVSLNHGMSHYVLVVYRHAFATISIAPFALILERKVRPKMTWSVFLQIFVLALLGPVIDQNFYYAGLKFTGPTFACAMSNILPAMTFVMAVIFRMEKVDLKKVRCQAKVAGTLVTVAGAMMMTLYKGPLMKMAWTSGHGHAQGHGAEAPAAVAAAIDPSGREWFLGSLFVIIATLAWASLFILQAHTLKQYAAPLSLTTLICFVGTLQAIVVTFAMEHRPSVWTIGFDMNLLAAAYAGIVTSSIAYYVQGLVIQKTGPVFASAFSPLMMIIVAVMGSFILAEKIFLGGVLGAVLIVIGLYSVLWGKHKETQEKEEEEAMELPVASKANGSGIIYDDAVFIKEIAAVPAAGVGDECRKANGVVYKSSSSHGHGAAGAV

SEQ ID NO: 647 - protein, 517 aa, Sorghum bicolor
MGEDLVTTLSMENGGGGGGHHGPCTLLSMDPSGHLSAPDDRAVGVMVQALIGGAVGVGARAHAVSPSGAPPPDINQPWQTDLCDMLDVGLGPQVYSAEAVLSCAPKAGNRKAAKRGDTIWGAWFFFTFYFKPLLSDKCKDKVVRDNSGVSGFDKSDLRLDMFLVQHDMENMYMWVFKERPENALGKMQLRSYMNGHSRPGEPQFPFSVDRGFVRSHRMQRKHYRGLSNPQCIHGIEVVRSPNLAGLTEADLRRWAELTGRELNFIIPQEASDFGTWRTITNSELELEKPHPVMKSNGTQNPKKAGLNLSSPSNHSGEDGMDLSPVSSKRRKELSPQAMDEEVFFPLNSCPQKTQQDVEMHSPAQPAWLHEFAGVMKNACGPVTAAKSIYEDDQGYLIMVSLPFVDQQRVKVSWRNTLTHGIVKIVCVSTARMQHIRRHGRMFMLADPSPEHCPPGDFIREIPLATRIPEDAKLEACFDEAASVLEIMVPKRGNEPEEHEVRVSLRPPHFGANDLLLT

SEQ ID NO: 648 - protein, 1479 aa, Sorghum bicolor
MDSSSPFSPDDQTDADFFDKLVDDDDDPAPPPATDLPRPVSATSLNAADDPPAPEPQPPVPAPPEGSGKGGAGVHTAVKQVQWASFGGGADDGPDPFADLSGGAGDDDGFLGSTAGTQTASGQDFFAGTNSSSDQQNVNGQHDQGGGTSTAVDPADPKSWEAMYPGWKYDEASQQWYQLDGSVNSTGNAAQVLENSNQNAQQQLNTSYLHNSSHAGLETIAEEGTAAAGAVSSWGQGAASEYPPNMLFYAEYPGWYFDTNTQQWHSLESYQQAAMQAGTASTGQTVVANDVVAANSSSLTGYNAAQTEDVAAHNQVTHHNSFSNSFTLQNQWQTTDAFGNNVRSESATDNSLASSFYGFEQNRNAETTTSSTSQQAGFNTVETVTDHYGARKGFESSSLQSGYSSSDSQQSSYKAFEPSTRYKAGYKAFEPAMDNQSGYKAFKPSTGHHSASQGFMPSTGHRTDFKGSRASTVHQAGYKEFETSTGYSTSFKAFEPSSSQHAGYKGSQPNYTGFDSSANHHGYGDANGVVSTQGFVPMQTTYQGQKQVNATSQGHLSNSYFGTENSMNFNQQQFLGANASNLQFDHSPHEGRSSAGRPPHALVTFGFGGKLIVLKETSSMPASFNTGNQFKGNSSSTVSVLNLSEVVIDRVDPSSITNGSALSYFHALCHQPVPGPLVGGSAASKDVNKWLDEMIAWYESSSSEFQKGDTRKLLISLLKILSQHYGKLRSPFASDPLQEETNGPEMAVTKLFSSCKRSTAHMGDYGSIVPCMKNIASESQMQAVAQEVQSLLVSGRRKEALQCAQRGQLWGPAIILALQLGDQFYVDTVKKMAHFHFVSGSPLRTLCLLIAGQPADVFNVENNVNSDYGTSRQPMEPGPNGMLDDWEENLAIITANRTKGDDLVITHLGDCLWKEKYEVAAAHSCYLVAELNIDSYSESARLCLIGADHLKCPRTFASPEAIQRTEVYEYAKVLGNSQYILLPFQPYKLIYAYMLVDVGKVSDSLRYCQASMKVLKASGGAPELEVWKQLFSSLEERIRTHQQGGYGTNLAPAKLVGKIFTSLDKSISHMMGTPSAPLPPLPHGSVSDRESHSMPAAAKFGNSQSAMAMSSLMASASMQSMTEIAENSGGTGRTIAQNRSVSEPEFGRTSKQGAGSDGTQSSASGSGSSRFGWLVQKTMDLVSKSHRQAKLGDQNKFYYDEKLKRWVEEGAAVPAEEPPLPPPPTKPSFQNGMPDHKLNGPVSVNHAPNGVTEWKSSNSSDQGGLGMPPIPPSQNQFSARGRMGVRSRYVDTFNKSGASGAVPSYNKPAAPSVTPPAGAKFFMPTAAPAAADQMVPHQAAEIHSETIHQDERSASPPAETSISSTPPPTQFSSPPPHLQFSSPMQSTIHRQSSMENISTPYLGSGVSSLSSSSSFSKSRAASWSGTYSEQYSAFAGTQSPDRQTMPSPLMPGKPSHSRSNSNSSLQLNGLAEDLHEVEL

SEQ ID NO: 649 - protein, 655 aa, Sorghum bicolor
MDLYMKLLLASLSCILLMQAASCDGTTGETETANWTCVCAAHPLDEPNSNSSLLSNCSSSCHCQQDDNGGTGSWNCTCAADKGLQKEEHAVLRARSCFTSCNCTSGIGSSEEGKRHVSSKTVIITLLVCVILTTTAFLVTTVYYFRRKDALSPRSQIYSFDKYTSWSSRSNLVSNRSSPLPQLKSKPRLGVLKEFLCSCNLICGGESGTFPGVIIRFSYAELEQATGKFSDEHLIGVGGSSKVYRGQLGDGKVVAVKKLRPLGGADEDFEFLSEIELLSRLNHCHVVPLLGYCSESQGRQLERLLVFECMSNGNLRDCLDLKQGRRPMDWQTRVSIALGAARGVEYLHEAAAPRILHRDIKSTNILLDDKFRAKITDLGMAKCLMNDGVTSCSSSPARMLGTFGYFAPEYAIVGKASLKSDVFSFGVVVLELITGRPPIHKSSSTRADESLVIWATSRLRDSRLVVTELPDPTLQGKFPAEEMQIMAHLARECLQWDPEARPTMTEVVQILATIAPLQQGAKRRNLPIAAAFNLTASPHVGRCDPEPKDDDDDIERQQLQQQECSPTTPVQWKQQARRAPSPPPGRASWPGDRGNVVSRGAVVSGELVNGTLLMSPHGRGSWRRPPPPPGDDEEAVDVDLTEPRMEAFTQPAAFR

SEQ ID NO: 650 - protein, 369 aa, Sorghum bicolor
MNTDFHMTEGEGEWSYSKNSRRQEIFFLETRPMIENAIKEVYTTLLPKTMIIADLGCSSGPNTMLFISSVINIIVEKCKSTGDDCMELQFFLNDLPGNDFNELFRSIEKFKRPNTTGEREHLPPLYYIMGLPESYYKRLFPRESVHLFHSSYCLHWRSQEPEGLEAWRKTYLNKNNIYITKTTTPFVVKQFQKLFYKDFSLFLQLRHEELVHGGQMVLIFLGRKNEDVYNGDLNQLFALVARSLQSLVLKGIVEKEKLESFNLPIYGPSVGEVKELVMQSHLFNMDLIKQFEMNWDPFDDLEGDDVEDNTRSSMNIAKFIMSVLKYLIVHHFGETILDAWFAEFKCLVGEHLEKEKTKFTVIAMSLKKE

SEQ ID NO: 651 - protein, 374 aa, Sorghum bicolor
MGWGWSSCCKRSDGAEPGRRKKKKDTTWRIFSLKELQSATNNFNYDNKLGEGGFGSVYWGQLWDGSQIAVKRLKSWSNKAEREFAVEVEILARVRHKSLLSLRGYCAEGQERLIVYDYMPNLSIHSQLHGQHAAECNLSWERRMKIAVDSAEGIAYLHHYATPHIIHRDVKASNVLLDSNFQARVADFGFAKLIPDGATHVTTKVKGTLGYLAPEYAMLGKASESCDVFSFGIMLLELASGKKPVEKLNPTTKKTITEWALPLVRDKKFKEIADPKLKDSFVEDELKRMVLVGIACSQDKPEQRPIMSEVVELLKGESTEKLSNLENDDLFKPDSSFQSSSGPDSSDCVTEERSPKADAIEEAVDSSETVPSAR

SEQ ID NO: 652 - protein, 497 aa, Sorghum bicolor
MGEEAAAAPTVAAAAATGTGGAPPHLLLICFPGQGHVNPMLRLAKRIAAKGLLVTFSSVSTVGAKLAASAGVSAGGDGVAVGRGRVRFEFLDDEDPGPDLDDLMRHLAREGPPAFAKLLARQAAERRPVACVVVNPFMPWAADVAADAGIPSAVLWVQSCAVFSLYYHHVHGLVEFPREDDPDARFTLPGLPEMSVADVPSFLLPSNPYKLLVDAIIAQFRAIGRASWVLVNSFTELERDVAAALPGVTPRPPELIPVGPLIELAGDGDGAVRGDLIKAADDCVEWLDAQPPRSVVYASVGSVVLLNAEEVGEMAHGLAATGRPFLWVVRPDTREHLPEGFLDAVAGRGTVVPWSPQDRVLAHPSTACFLTHCGWNSTLETIAAGVPVVAFPQWGDQCTDAKFLVEELRMGVRLRGSPLRRDAVREAVEAAVAGAEADAMLASARRWSAAAREAVAPGGSSDKHVQAFVDEVARRACGVQAAKVVPPPPPSSETPDS

SEQ ID NO: 653 - protein, 662 aa, Sorghum bicolor
MPLRLPACRVFLLLATAAAVSASAESNSSANCTFRDGDIIRAAFSQVANFPLPLPAPAGRRRRASCRPVRRLHFPSRNLTGAVNWAELANLTSLLTVDLSDNSLHGRIDDDASFWRAPLLRAVDVSRNHLQGVLRFDDDPGTRLASLNVSGNRFTSVHGVAGLSRVVHLDVSRNAIGTVPEGLRSLTLVRVLNLSGNNMTGVFPDDLPPLAGIQVLDISHNNFSGAVDAATVLKFGNSSFFQAGNALRVIDDVAPASSPALAPSSNGGDMNRRAVTIALISVGATVTLACLAACALTRRRRNKKKKKKDKDGKTAVWEDEEVVVGAVKVAAAAPVVVLERPLMELTLADLAAATSGFGRESQLADTGGRSGAAYRAVLPGDLHVVVRVVEGAVAGVAEDADAAAIEAGFRELARLRHPNILPLLGYCIAGNQKLVLYEYMEKGDLHRWLHELPVGSMDTEDICMDTMEAIEDRKPAGDWPTRYRIILGVARGLAFLHQGWTGAAAGSGRRRRPIVHGRLVPTNILLGDDMEPRISDFLHRPGGGGGGDETATPASDVYRFGTVVFEVVTGQARWGDAATTSWARGVIRNRKGLNLVDDRLRDETAGTDAEKEMAECLQVGFLCTAGAPEKRPTMQQVVGLLKDVRPPATTAGAGGVPPLGVS

SEQ ID NO: 654 - protein, 174 aa, Sorghum bicolor
MNVAEEEEVSMAGEEKGGASGGVRDGEVRTAAAGAGAVSLETLRKRMADFATERDWEQFHSPRNLLLALVGEVGELSEIFQWKGEVPKGLPGWDDNEKEHLGEELADVLLYLVRLSDMCGVDLGKAALRKMEINARKYPVGQCKGSSKKHTHYGSTNNVSDNANTVNKENSNGV

SEQ ID NO: 655 - protein, 402 aa, Sorghum bicolor
MQSSVMAFFPSVATAKLELNSLYRKYVDMFGISLNNSTVGCHLTRKMAHLPVLLIDRTFFSTGSAIQSIATSYGALIRRWLLNRTSVVQHTLISSAMNSLSWCGSLPFFVSIGVLITKLCDCTMTPNRFCGRQCILSHSANLRGESVLVMDNNELGNDQSFLSSFLGRKRDYVVLALQCICYPACLKVVDVPHKKLSFSRQWIRTGHDTSAIWRIMARNEQYLACMIVLAALQVFLRLTRVNVTILFLPMLSRAISSRSSPAVIGNIVLVLVNSCGVLGSALSVKQLGREVTFAISAIVMVICQVAIPLILEVQIGVGGGTRMPMGYTTAMFVLTCVVSCGLSWSWGSFFWTFPGRKVHSAGQVLAMAVNLGVCFAQMQYFLLVLCRLKNATLAYYALWIWS

SEQ ID NO: 656 - protein, 392 aa, Sorghum bicolor
MSDNLMDKVSAFGERLKITGTEVSKKMTAGMSSMSFKMKELFQGQTPADKIVEDATSENLDGPDWNSNLEICDLINTEKVNSVELIRGIKKRIMLKDARVQYLSLVLLETIVKNCEKAFSEVAAERVLDEMVRLIDDPQTVVNNRNKTLMLIEAWGESGDELRYLPVYEETYKSLKSRGVRFPGRDNESLAPIFTPPRSVAEADVDSSLPQQAFEDIHVHTYTAEETKEAFDVARNSIELLSTVLSSSPEQDALQDDLTATLVQQCYQSQHTIQRIIETVGDNEAVLFEALSVNDEIQKVLSKYEEMKQPRASEHAEQRPVVIPIATEHEDSTAIGNEDALVRKPAAARARSGGDDDILDDLDEMIFGKKGGSSSQDGPKKPDPKKDDLISF

SEQ ID NO: 657 - protein, 185 aa, Sorghum bicolor
MEAYFLFHSGRASACAEQEEDIGAPSDSESPSTSMSRESAGSSSSSELDDDATSTSSGSDPDRFEMSALMTQLPLKRGLSRFFDGKSQSFASLAAVGSLEDLPKPAARKRIKPSRSCGGALDAHNRGRFLSPRRHCTKPKPAAARKQAAARSGALSVFAVAAVAPRMPPSVTRPEGVAAKVLIVN

SEQ ID NO: 658 - protein, 221 aa, Sorghum bicolor
MGFPVGYSEMLLPRVLLQVLLLLGHLHRFLLWAFHAVGLGDLIDLGCNYYPPPPPTPTAQEHQDAAAAAPLQHRRPEFRPVPSVLIEEALPVVRFDELGGTACGDGDCDCAVCLSGIGARDEVRRLSNCRHAFHRACLDRWMLAHDQRTCPLCRAPLIPGAGAAAADPWAAAGGVAPWPDAGDYDMSYPSSLPSTPLLTALPTPTLLRPHELLLTGLGGFQ

SEQ ID NO: 659 - protein, 567 aa, Sorghum bicolor
MSSCAGATVALRDAAEEALNASLLSKADVRLPVEDVPPVLTSKPPGRFARAVKEAWSVSLSVTFPMMPSMSAGAAGAEARSILGLALPMILTGLLLYLRSMISMLFLGRLGGLALAGGSLAIGFANITGYSVLSGLAMGMEPICGQAFGAGHYELLGVTTQRAVLMLLAAAVPIGGLWVHIRPLLLLCGQDAGIAAVAETYILASLPDLLLQAFLHPVRIYLRTQSINLPLTLCAALAIALHLPINYVLVSVLGLGISGVALASVLANLNLLLFLLAYILFKGVHKRTGGLALSAESFRGWGELVSLALPSCVSVCLEWWWYEIMILLCGLLANPQATVASMGILIQTTSLIYIFPSSLGFGVSTRVSNELGANRPDHAGRAATVGLMLGFAFGGVASAFAYLVRGAWATMFTADPAIVALTASVLPILGACELGNCPQTTGCGVLRGSARPKDAASINLRSFYLVGTPVALVLAFWYHYDFQGLWLGLLAAQATCVVRMLLVIGRTDWAAEAKRAQQLTGAGTVEETKDKESSGKGSHASKVTAAGGDEELGLPIDVVIERPKDQC

SEQ ID NO: 660 - protein, 333 aa, Sorghum bicolor
MASSSAAEPSSRLSDRAKRSSLGLRFMVLLMHLLFVGAVFILDPTLDWRIHEEPWYIGLYGVLVLLTLVQYFYTAGSSPGYVVDVMRAGSMMHATFVNTTALSKQSNSRNGNTSSPTSRAQLQKLSTMTPTSSWAQMVMDLYPPGSSSRDWTCTYCRVVQPPRTRHCHDCDKCVLQFDHHCIWLGTCIGKKNHCRFWWYIFEETILCIWTAALYIESLRLDMDKAWWKDFVGVILLAVLIFILIFLLLLWLFHSYIALTNQTTYEVARRKRIFYLRGVPERVHPFSRGICRNLYDFCCSSQKGYILEAVPPSEELEARAARYTCRDVICCRCC

SEQ ID NO: 661 - protein, 701 aa, Sorghum bicolor
MDCDLLAAWWSSSTRLISRIFRGSAADAPGPSPMRPAIPLHQKQAGLAASKLGVGTSKKHRAFVASDEQWYNKIFDPSSDFILTWNRIFLFSCFVALFIDPLYFYVPKISYGSPKFCVGTDTRFAVGVTFFRSIADLLYVLHIIIKFRTAYINPSSTLRVFGRGDLVTNPKQIACKYIRSDLAVDVAAALPLPQIIVWFVIPAIKYTSAEHNNNILVLIVLAQYLPRLYLIFPLTYEIVKATGVVAKTAWEGAAYNMLLYLIASHVLGALWYLLSVDRQTFCWKTRCLNETGCDLKYLDCDSTLNATWASTTSVFSKCNASDDTISFDFGMFGPALSNQAPAQSFAMKYFYSLWWGLQNLSCYGQTLVVSTYLGETLYCIFLAVLGLVLFAHLIGNVQTYLQSITVRVEEWRLKQRDTEEWMRHRQLPCELRERVRRFIQYKWLATRGVNEESILQALPADLRRDIKRHLCLGLVRRVPFFSQMDDQLLDAICERLVSSLCTKGTYIVREGDPVTEMLFIIRGKLESSTTNGGRTGFFNSITLKPGDFCGEELLGWALVPRPTTNLPSSTRTVKALIEVEAFALQAEDLKFVASQFRRLHSKKLQHTFRYYSHHWRTWASCFIQAAWRRYKRRKMAKDLSMRESFNSVRLDEVDNEDDDSPPKNSLALKFIARTRKVPQNMKELPKLTKPDEPDFSAEPED

SEQ ID NO: 662 - protein, 343 aa, Sorghum bicolor
MGRVTMSSSSACGDEEEEEQQQLVCVTGAGGFIGSWVVKELLQRGYLVRGTARNPEHGKNAHLLALDGAKERLTLCRADVLDSASLRAAFVGCHGVFHVASPVSNDPELVPVAVEGTRNVITAAADEGVRRVVFTSSYGAVHMDPNRSPDAVLDETCWSDYDFCKRSDNLYCCAKMMAEITATEVAAARGLQLAVVVPCITLGPMLQQTLNVSTHHILRYVMGTKRSIPNAVAAYVDIRDVARAHVLAYERPAARGRYLCIGTVLHRAQLVAMLRDLFPKYPVTAKCEDDGKPMVKPYRFSNQRLRDLGLEFTPLRESLYETVVCLQQKGHLPVIKQKQRACL

SEQ ID NO: 663 - protein, 652 aa, Sorghum bicolor
MSLSPLDSSSPPAAAEVPLAPGFRFHPTDEELVSYYLRRRVLGRRLRVDAIAEVDLYRLEPWDLPSLSRIRSRDAQWYFFARLDRKVAGAGAGGRGGPGNRTNRATPRGYWKTTGKDREVHHRGKPVGMKKTLVFHAGRAPKGERTNWVMHEYRLLDADGPQDLHVVCRIFQKHGSGPQNGAQYGAPYMEEEWEEDDDAIENGPTSGASAQMAAITCAVDEESNEDDENAYCETNRPARVEPSHLPLVHEMLNPPEMAPQQGQDSKETSDGSCADGAISLEEVLQEPLSNISVENIGRLEGQNATDDSINVDDLLSAYPRKDNGYVGQDNTMNGSGPADGDHTSWPLRAYSNQNYVNGPLADEFFDTGNDTNGVAYSGQQQADGFPAPRQVDDSMVFYDAPSDYNLVDGNDDFVYLNDLLNEPLGNESLFDGDDVMAYFDATENDFKYDILGSAQGSNYQLADMPLNFAQKSDNKDKFTFDGISEVPEANAQYGASSSGSHEDLYADTEFPGVPTDDTADKTYGKRLASMLGSIPAPPAMASEFPPSTGKSVGMLSAVSSSSIRVTAGIIQLDGLTFSSGSDRWPLQKNGDLSLLVSFAVESDVSSKLPVGLEDATRISTVPMVMRSGFYLFFMSAMILLLSYKVGSCIYSR

SEQ ID NO: 664 - protein, 448 aa, Sorghum bicolor
MKTEATHKAIAAGGKMTVLHSPVGVRSIVTSMVAFFILASSIVFLLDRGQEEQVQMAIEHGRQEVQVKLEAGLQEPAIRGTTDEGDASNEECNWSRGRWVYDNVSRPLYNGLKCTFIFPEVACDKYGRKDVMYQHWRWQPHGCDLPRFDAIKLLEKLRNKRLVFVGDSVNRNQWVSLVCMVEASIPDDRLKTRIFNGSLISFKALEYNATIDFYWSPLLVESNSDNPIIHRVEYRIIRADRIEKHASVWRDADIIVFNSYLWWRKQKDDMRMKVMYGSFEDGDAKLDEMEMVDGFEIALKKLTEWLGENIDKNKTRIFFAGSSPAHSWASDWGGEDKNKCLNETEPIYKTGYKAATTDYSLMATAKSYFRTLEPKGIHVQILNITELSDYRKDGHPTVFRKQFAPLTKEQIADPASYADCTHWCLPGVPDVWNEFLYGYLVHQMMSKL

SEQ ID NO: 665 - protein, 602 aa, Sorghum bicolor
MAASSMDRITQWVSSQVQQVSADLTVRIADSVFPLHKAVMVPKCGYIRRAVAAAAAVATSQTQGPGPASVELDLSALPGGADAFEKAARYCYGGSLEITARDAAAVRCAAAFLDAPDLARRAEDYLAQTALRSLPCAAAVLRSCECEALLRAAEETGVARRAADAVALGVCNEALFPTARAAPGWWVAELAALSPASFRKVVTALRCRRAGPEVVAAAAVAYAERVLAGVLAPAAPGRRDAVVVVARNADADADRRALLEAVVDALPPAADAPLPAAFLCRLLHAVVTAEASAKTCRDMELRVAGVLHQATAGDLLGVALDGAGERVRNADTVRRVVAAFVERPQTQEGRRASLAGGPAAGELGALEKVAKTVDEVAAEMATEESLGISKFVGVAGAVPKDARASHDCLYRAVDMYLKTHPGLDEIEREKVCSVMDPLRLSYQARLHASQNKRLPLQAVLSALYYDQLKLRSADGGGGDGAEGGAGWEPQSAAGKARAQARADASLARENEALRSELARMRAYVSGMQQHSKGSGSRSSSASLVPASAAGKKASFLGSVSRTLSRLNPFKGGWAKDTASIADGRDRSAMHVVKPKRRRFSIG

SEQ ID NO: 666 - protein, 315 aa, Sorghum bicolor
MGRSPCCEQAHTNKGAWTKEEDQRLIAYIKAHGEGCWRSLPKAAGLLRCGKSCRLRWINYLRPDLKRGNFTEEEDELIIKFHELFGNKWSLIAGRLPGRTDNEIKNYWNTHIKRKLLARGTDPQTHRPLAAASGAPAGQQHYQLEQQMQAAAAGVGTVGHPHHHRHHQQQHQAPQQQDVISNSPEAACTSRSSDDEPRSSTPTPPPPPRRHLDIDLNLSISLSAYQPPEEESGSIKSPLMMMMMKQEEETAAASAAGGTNAAAAVCLCLNSLGYRPGVECACGGNGGVGSSSQSQQWARSFLQAAAAATPCYRGQ

SEQ ID NO: 667 - protein, 383 aa, Sorghum bicolor
MMRSPRGVGGGCYRGAGGQDQHVDLIPGIPDDVAVDCLARVPHASHRAMRGVCRGWRSAASTPAFASARAQADANEDLVYLMQFGNPSAAADDAEPKGDDGPANTPAYGVAVYNVTTGEWRRDRGAPPVVPVFAQCAAVGTRLAVLGGWDPRTFEPVADVHVLDAATGRWRRGAPMRSARSFFACAEAGGKIYVAGGHDKHKNALKTAEAYDPRADAWDPLPDMSEERDECDGMATVAGDRFLAVSGYRTARQGGFERDAEWFDPAARAWRRLERVRAPPSAAHVVVKGRVWCIEGNAVMEWMGTRRGWREVGPYPPGLKAGTARAVCVGGGEKVVVTGALDGEGGGGRHALWVFDVKTKSWTVVRPPSEFAGFVFSVASVRI

SEQ ID NO: 668 - protein, 302 aa, Sorghum bicolor
MRQWKSLVPAALHLHGSAASCFPHPPSSPRAAAEETTTDDLQLPSLGAAAAKGTAVRLVGCDGRVRAYAPPVTARELMQEHPRHLVSRADALLIGEKIPAVAPGEELQPGEAYFLLPAHLFRSVLSFVSLASSLLLLLSSSSSSTTTAAGAGAGAGAGKKAGAGRPFELHRTASGTLQIKFSDDFLLADNGNGEDEEEEDEAPAQKEQQQRAVLLRGDDRLAKDYEELVGYSKSRRWAPKLETIEEAVPPAAAAAPESAGAASPKAQRGGRKSRALPFLGRLGSRRRSRDRDACSAVVACSG

SEQ ID NO: 669 - protein, 208 aa, Sorghum bicolor
MSSPAMAMAVIRLARPAAIRPPSAPSLRPTARLLRRLRVVRCRAGGGGNGEGGKGKEEGEAAEAPESLFARELRRRGMAPGAAAAGANKEAEEGAPPEAGAKRRVAAAEFERAAAADGQRQRSMALNSEGLEGLVPRAKLLLSLGGTFFLAFGPLILVTVSLFAGLYVYFGPSFVHDASKTPVSVPPYIDPYELLEDERLSRPSPDVF

SEQ ID NO: 670 - protein, 105 aa, Sorghum bicolor
MAMEHVARLASERAVVVFTASNCSMGDVVTSLLSSLGVNAAVHDLDRDPRGMEMQRELARRLGAGATVPAVFVGGDLVGGTSRVMALHLSGELVPMLRNAGALWL

SEQ ID NO: 671 - protein, 293 aa, Sorghum bicolor
MAMQARHHSHDYFLSRAGSLFLDEYAGCVPLPTSPAVGIRDMPLLSDFAGSELSFGYSFLPRKRARMEDHRVVLPPAVMQGLVQVQVQLPMTSSNVMGSGAVTSTSGREIDALLRVESERMRAALEAAWRRHARALASAVGRTAAGRMRAAESELDGALRRNGELEETARQMVAECQAWMGVARSHEAVAAGLRASLDQLLLQSPPCAVATGGACEGHGETEDARSCCFEPGCSGGRGPQGAVEECRSCGGGEACVLLLPCRHLCLCRACEAAVDACLVCAAAKNASLLVLVS

SEQ ID NO: 672 - protein, 92 aa, Sorghum bicolor
MKHIFKIAAILIAISAIWIALLETSTVPRSYTWLLPIYLVVALGCYGLFMVGFGLMLFPSCPQEAVLLQQDIVEAKEFLAKKGVDVGSILSG

SEQ ID NO: 673 - protein, 86 aa, Sorghum bicolor
MALDARSLLPVVSVVVVPALELEVCSGMMPRTRNGGGVPSATTTGAAEVSVVDVPALWSDEGRMKRELVAWAKAVASMAIRETMKC

SEQ ID NO: 674 - protein, 298 aa, Sorghum bicolor
MAEIPVIDLRLAGSSREESARLRAACERLGCFRVTGHGVPAGLLAEMKAAVRALFDLPDDAKRRNADVIPGSGYVPPSAANPLYEAFGLLDAAAPADVDAFCARLDAPPHVRETVKAYAEKMHDVIVGVAGELASSLGLEKHSFQDWPCQFRINRYNYTQETVGSSGVQTHTDSGFLTVLQEDECVGGLEVLDPATGEFVPVDPVAGSFVVNIGDVGTAWSNGRLHNVKHRVRCVAPVPRISVAMFLLAPKDDGVSAPEAFVDEDHPRRYKAFNYDDYRRLRLSTGERAGEALARMAA

SEQ ID NO: 675 - protein, 353 aa, Sorghum bicolor
MARPRGKKRTASQAAATDSVELEAAAGASSKPEAAAAEPATRGRGKRVKAPPKPKPETDYFPEKRNLEDLWLSAFPVGTEWENIDKIKEFNWSFENLEKALEEGGELHGKTVYMFGSTEPQLLDVNGESKIVLIPIVVVVDCPFPPSDKIGINSVQRENEEIVPMKAMKMAWVPYVPLEDRLSRIDSLKTKIFTLGCTQRRSALKHLKIERVKKFDYCMPYYMPLQPLEDEDDTVINFLYPLEPPIVDEFDWEMDDYEDFSDQKVQEGSLPEGEKEKFKEFLKEKVRERKRELKQAKEARKKAIDDMDPKMKEAFENIKFYKFYPVKTPDTPDVNNVKARYINRYYRNAHYLM

SEQ ID NO: 676 - protein, 711 aa, Sorghum bicolor
MVLGGGPLGAIIGRYPSAAAGDDEQGDPGPGGSVIRHDRKCRDWPFLFLFAAFWVAMIVNSSFGFNQGNPLRLTYGLDYKGNICGSRHGDPDLRELDVRYWLNPNQVYQSGLKTSHIELPDAKAICLMECPLPAEDGLNFVCDYPEGDIRLSVDDWIDRDYDYFEYLTPDMRNSSLQLQGPCYPVIFPSVNVYWSCQFIARASNASLKHWKDMGGVSIDENMLIDETIHDAINSKSAVMKRYVADIGKSWPVLILCGGLLPLFLSVIWLLMIRFFVAGMSWITVVVFNALVISVTMFFYIKAGWIGHDPLTVVIGESDPYVSIGGREINHLHAASVLMTVIMILAFLTSIAIARRIMIATSVLKVAAKVIGEVQALIIFPVVPYFILAIFYMFWFSATLHLFSAGQVIRNDCNNDCCSYDLKLGKVNCDSCCGYSIHYTPHIGIAILFHFFGCYWATQFFIGCSSTIIAGSVASYYWARGEISRDIPFHTVVSSLKRLLRYSLGSVALGSLIVSIIEWVRFILESLRRRLKFVDSARESRLGKAVSSSSQCCLGCIDWTLKSVNRNAYVMIAITGKGFFKASVLATELIMNNILRIGKVNVIGDVILLLGKLCVSLLCALFAFLMLDEHKYRSGHNKISSPLVPVLLSWVLGYIVAKLFFAVVEMSIDTMVLSFCQDSEEHQGSAQYAPPLLMETLDEESELRRLTQGQGP

SEQ ID NO: 677 - protein, 274 aa, Sorghum bicolor
MACRGFFECVLKLLNLVVMAVGLAMVGYGAYLLVMWLQVAPPLPPPAPSPAPSGGDLVRLGRPLLLLVDASLSDSDGTAERLSSAWFIFAFIGVGAILFITSIFGCAGARNGCCLSIYSFLIILFILVELGAGGFIFFNHSWKEVIPVDKTGNFDMMYSFLKENWRIAKWVALGAVVFEALLFTVAIIVQSGNQADYDSDDEYIGARSGIRQPLVNQQAAATDPRVPNLDYRPIRNDAWSQRMREKYGVDSFDPNRFQQATISPGEQRNRCTIL

SEQ ID NO: 678 - protein, 749 aa, Sorghum bicolor
MPPQLEHHEQQQQTAGGGGHRAAAPPPPPPPNSMPTFSSSSSSSSSSGTPSPTSVSATTTTTNVPSGAVVHPTTSSPPSSAASARPAANSFPLVLKFEEVVYKVKLGKPTAGWCDKLSAAASNMASFGGGDGSKNKKATASAAGSSSSSSRARAREKTIISGMSGVVRPGEMLAMLGPSGSGKTTLLTALGGRHGGRAAVLSGKITYNGQPFSGAVKRRTGFVTQHDVLYPHLTVSETLWYTAALRLPRSLSAGEKRAQAEAVARELGLAKVAGSMVGGVRGVRGLSGGERKRVSIGLEMLVDPSLLLLDEPTSGLDSTTAARIVGTLRRMAAQGGRTVVVTIHQPSSRLYHMFDKVLLLSADGRPIYYGRAADALDYFASVGFASPLSLNPADLMLDLANGIAPQTTSGDGAADGMAAVTSGSESEHKEVRAKLAAAYERHIAPAVKLDICARETTSTAALPPGSSGAGHATTTWTTGWWTQFLVLFQRGLKERRHESFNKLRVFQVLSVATLAGLLWWRTPASHLQDRTALVFFFSVFWGFFPLYNAVFTFPLERPMLVKERCSGMYRLSSYLASRAATDLPMELGLPTAFVLILYWMGGLDPRPAPFLLSLAVVLYSVLVAQSLGLAIGAVLMDVKQGTTLASVITMVFLIAGGYYVQHIPPFVAWLRWLNYSFYCYRLLLGIQFPNGGGYYDCGDGHGKLCAVAEFPAIKAVGLNNHWVDVCVMALLLVGYRVVAYIALDRLKPR

SEQ ID NO: 679 - protein, 300 aa, Sorghum bicolor
MAIRMSNNVIRALTLVTLLLSVPIIVTGVWLRSRADGTECDHFLLSTPAIALGTVLMAVSLLGLAGACCRATWLLWLYLLAMLALIVALLCFTVFAFVVTSTGGAGEAVSGAGFREYRLGDYSTWLRRHVEGRKNWARIRSCLADAHVCRRFLEAEEEEEESKDANAAGGLARLGGLSPVESGCCKPPASCNFTYAGGGTEWTTKTKAAAGAGSAPAAGADPDCGKWSNDEDDLCYGCQSCKAGVVDALRRDWKRAAIVNVVILAFVVVVFSVGCCAFRNSRRDNYAYHSGRGWKRSGDA

SEQ ID NO: 680 - protein, 618 aa, Sorghum bicolor
MTDHLAIIASELGDATDFEVDGIDNLSENDVSDEEIDADELARRMWKDKVKLKRIRERQQKLALQRLELEKSKTKKISDQALRKKMTRAQDGILKYMLKLMEVCNARGFVYGIIPEKGKPVSGASDNIREWWKEKVKFDKNGPAAIVKYEVEHSMLSNPKSSGAMNQHSLMDLQDGTLGSLLSALMQHCSPQQRSYPLDKGVPPPWWPSGNEPWWPALGLPKGEAPPYRKPHDLKKVWKVGVLTGVIKHMAPNFDKIRNRVRKSKCLQDKMTAKESLIWLGVLQREEKSIHSFGSALLPITQHSTSEDRTEGIYSSSDEYDVDRLEQPPRSTSSKDDEGDAQPVLQIRGEQISTRVPKRKRHDKPSNQLAISKEETTKPKPRQRNRPSARSPVAEVEVEVTQRNDNPPDVSCNAADGMNLIDPIDVVGMTNQPTSSSHAPPTIGALQQHGDCQGNFLSPGAVINNYNSNQAASAAQSSTYLGDHPLACEGSDIANSWSGHSFRQDIGIGPIGFNPSQAVHQDLAMQQPLPLPMDHQAPIIGTGALATNDSYSLPTAGSGNSGTIVGETHQQFMDDPFFGEAGDSTFGGLPFSLVPFSSPMLNFDDLVDDDDLMPYLGT

SEQ ID NO: 681 - protein, 238 aa, Sorghum bicolor
MASAPSAPASAAVKAAVVPIPPVHPPSSVAVLARRAPTPVPAALRALGLGGNARHGAALVASAALDDLRPAIDEYPEGILSGEWPGNFSLLSYADLRAYLESRIVTSDQMSPAAKLGDVMSRPVQVATPGQRLAEVDAIFAAEQFSGLPVVDEDGRCVGVISKKDKAKAPNGMESTVVEVMSSPAITLTPEKTVLEAAALMLKEKVHRIPVVNEQQQVIGIVTRSDVFQALEANNNKA

SEQ ID NO: 682 - protein, 445 aa, Sorghum bicolor
MEIRGKTLMERYELGRLLGKGTFGKVHYGRNLESNQSVAIKMMDKDKVLKVGLSEQIKREIRTMRLVEHKNIVHLHEVMATRNKIYIVMEYVKGGELFDKIDKSGKLTEAAAHKYFQQLISAVDHCHSRGVYHRDLKPENLLLDENENLKVSDFGLSALSESKRQDGLLHTTCGTPAYVAPEVISKIGYDGAKSDIWSCGVVLFVLAAGYLPFQGPNLMEMYRKIQHGDFRCPSWFSHKLKKLLYKILDPNPSTRISIQKIKESTWFRKGPGEIRAVKEKILSENATTNSDPVLATRRKKIAQEDMKPLAATNLNAFEIISFSTGLDLSGLFVKKECRKETRFTSDKPALAIISKLQEVAKALNLRIRKKENGIIKIQGRKEGRNGVLQFDTEIFEITASYHLIEMKQTSGDSVEYQKLLEEDIRPGLKDIVWSWHGDDLQQKQE

SEQ ID NO: 683 - protein, 429 aa, Sorghum bicolor
MNEAAGTVVCGDLIVGAMAQSWRFLMQGVTSLLFLCARAAAADDDEYVRPPPCPLVLVAHDKPAWHPQQVHISVVGSDHMRVSWVTDDRRAPSVVEYGTSPGNYTASSTGDHTTYRYFFYKSGAIHHVTIGPLEPSTTYYYRCGRSGDEFTLRTPPSTLPIEFVVVGDLGETGWTASTLSHITAGGGGDYDMLLLPGDLSYNADTQQPLWDSFGRLVQPLASARPWMVTEGNHEVEALPGIPVVGELVKPFVAYNARWRMPYDDGDDEASGSSSSSTTSNLYYSFDAAGGAAHVVMLGSYAAFVEGSEQHRWLARDLARVDRRRTPWLLVLLHAPWYNTNQAHQGEGERMRVAMERLLYEARVDVVLAGHVHAYERFTRIYDNKADSRGRMYITIGDGGNRKALLSSSSRTTSRRTCRSFGRRASGMAG

SEQ ID NO: 684 - protein, 571 aa, Sorghum bicolor
MAPLLLHASAISHSAHPGLRSHIGPNNEHISRHLSSSSQNTKRRCNISLRSRAQRISSQLGGQKLEHWEIPKRDWFPPSFTFGAATSAFQIEGGWNEDGKGPSTWDHFCHTYPDFIADKSNGDVAADSYHLYEEDVKLLKEMGMDAYRFSISWPRILPNGTLSDINEKGIAYYNNLINLLIDNGIEPYVTIFHWDTPQALVDDYGGFLDKRIIKDYTDFAGLCFERFGDRVNNWLTFNEPHTFTCLSYGTGILAPGRCSPGMKCPDPTGDSIREPYLVGHNLLLAHAETVDLYNKFHRGEKGRIGLALNVMGTVPYGSTFLDEQAHERCMDYNLGWYLEPVVRGDYPHSMRSSVRDRLPHFTEKEQQKLVGSYDMIGINYYSSRFAKHVDITENFSPELNTHDCCATEEITGPNGNTIGPATGNAWVYMYPKGLKDILMITKKRYGNPPVYITENGMGDIDNGDLSMEAALDDHIRLDYLQRHISVLKDSIDSGANVRGHFTWSLLDNFEWSSGYTERFGIVYVDRENGCKRTLKRSARWLKEFNGAAKRPGNLIKPNFSEINKIKVVTPA

SEQ ID NO: 685 - protein, 1122 aa, Sorghum bicolor
MTMMTPPPLEQQQEDDEMLVPHQELPVAGPEAAPQPMEVVAQTEPANTAESQPPEDPQTSRFTWTIESFSRLNTKKHYSDVFVVGGYKWRVLIFPKGNNVDHFSMYLDVADSGNLPYGWSRYAQFSLAVVNQIHPKYTIRKDTQHQFNARESDWGFTSFMPLSDLYDPSRGYLVNDTVVVEAEVAVRRMVDYWTYDSKKETGFVGLKNQGATCYMNSLLQTLYHTPYFRKAVYHMPTTENDMPSGSIPLALQSLFYKLQYSDNSVATKELTKSFGWDTYDSFMQHDVQELNRVLCEKLEDKMKGTVVEGTIEQLFEGHHINYIECINVDYKSSRKESFYDLQLDVKGCRDVYASFDKYVEVERLEGDNKYHAERYGLQDARKGVLFLDFPPVLQLQLKRFEYDYMRDTMVKINDRYEFPLQLDLDRDNGKYLSPDADRSIRNLYTLHSVLVHSGGVHGGHYYAFIRPTLSDQWYKFDDERVTKEDTKKALEEQYGGEEELPQINPGFNNTPFKFTKYSNAYMLVYIRESDKEKIMCNVDEKDIAEHLRIRLKKEQEEKEHKKKEKAEAHLYTIIKIARDEDLKEQIGKNIYFDLVDHEKVRSFRIQKQLPFTSFKEEVAKEFGIPVQFQRFWLWAKRQNHTYRPNRPLTPHEEAQSVGQLREVSNKAHNAELKLFLEVELGPELCPIRPPEKSKEDILLFFKLYNAEKEELRFVGRLFVKALGKPSEILTKLNEMAGFSPNEEIELYEEIKFEPNVMCEHIDKKLTFRSSQLEDGDIICFQKAPVPDGDTQVRYPDVPSFLEYVHNRQVVHFRSLDKPKEDDFSLELSKLHTYDDVVERVAHQLGLDDPSKIRLTSHNCYSQQPKPQPIRYRGVEHLLDMLVHYNQTSDILYYEVLDIPLPELQCLKTLKVAFHHATKDEVVVHSIRLPRNSTISDVITDLKTKVELSNPDAELRLLEVFYHKIYKIFPPHEKIENINDQYWTLRAEEIPEEEKNLGPHDRLIHVYHFMKDPNQNQQIQNFGDPFLMVIREGETSAEVMERIQRKLRVPDEEFSKWKLAFISMNRPEYLQDTDVVSARFQRRDVYGAWEQYLGLEHTDTTSKRSYTANQNRHTYEKPVKIYN

SEQ ID NO: 686 - protein, 342 aa, Sorghum bicolor
MEKMLHAAPVHATLPECFIFPSDKLPQAKSTSGAVSLPIIDLSLGRDEVWRAILHAGKEIGFFQVVNHGVSLEAMRDMEAVCQEFFALPAEDKAGLYSEDTGKETRIYSSTMFDTGAEKYWRDCLRLACSFPDVGDSHRGWPNKPTRLREIVERFTAQTRGLGMHILRILCEGLGLRPDYLDGDISDGDVVLHVNHYPPCPDPTATLGLPPHCDRNLLTLLLPSMVRGLEVSYNGDWIKVDPVAGAFVVNFGCQLEVVTNGTLKSIEHRVMTNLGVARTTVATFIMPTTDCLIGPAAEFLSDDNPPAYRTMTFGEFKRIYSVVKLGLSLNLTTNLKDVQKQV

SEQ ID NO: 687 - protein, 482 aa, Sorghum bicolor
MAHRPDAAAPLLAKPDADATPPPPPKRNKYPFFCAVLASMTSVLMGYNVAVTSGAQIFMAEDLGVSDAQIEVLSGVINIYSLVGALLAGWTSDRLGRRLTIVLANAFFLVGPLAMALARGYALLMVGRFVAGVGVGYALVIAPVYAAEIAPPSSRGLLTSLPEIFINTGVMLSYVSNLAFSGLPVHLSWRVMFAAGVVPTVFLAAGVLTMPESPRWLAMKGRVAEAKAVLDRTSDTPAEAEQRLLEIQDVVTNSSSGVGGGGAWKEVATKAGVRRVLAMVLTLQFFQQASGIDSVVLYGPRVLAMAGVTSNTLLLSLNVLFGVAKAGSILVAMALADRVGRRPLLLVSTGGMTAALLVLGSLFAAFAGAKDDAAVAAVSVAAVVAFVVAFSVGLGPLAWVYSSEILPLRLRGQGAGLGTAMNRIMSGVVTMTFISLYQGITMAGAFYLYAAIAAASFVFVYACLPETRGRSLEDMEELFHTK

SEQ ID NO: 688 - protein, 666 aa, Sorghum bicolor
MAGEAAERVAAAVEAVGSGGWEFRNAYRRQLLALSRRIRLLGPFAEELREARRGRPAEEEEEQERALAPLADALEEALDLLQLGRDGSRIFLVLDRNKVMKKFHESIAQLEQALCDFPYDKLDISDEVTEQVELVHVQLKRAKERVDMPDDEFYHELLSLYNKSHDPSAELAILGRLSEKLHLTTITDLTQESLALHEMVASGGGNDPGERIEKMSMLLKKIKDFVQTQNPEMGPPVTTKVMDSNGELRPINIPDEFRCPISLELMKDPVIVATGQTYERAFIEKWIASGHHTCPNTQQRMPNTTLTPNYVLRSLIAQWCEANGIDPPKRPTEADKPTSSCSPSERAIIDALLSKLCSADPEEQRSAAAELRLLAKRNANNRICIAEAGAIPLLLSLLSSSDLQTQEHAVTALLNLSIHEDNKSSIILSGAVPGIVHVLKNGSMQARENAAATLFSLSVVDEYKVTIGGTGAIPALVVLLSEGSPRGMKDAAAALFNLCIYQGNKGRAIRAGLVPLIMGLVTNPTGALLDEAMAILSILSSHPEGKAAIGAAEPVPVLVEMIGSGSPRNRENAAAVMLHLSVHNGHLARAQECGIMVPLRELALNGTDRGKRKAVQLLERMSRFLVMQHEDTVSQQLDEIERQFAALGPNVTEADLEQLGEQLGYL

SEQ ID NO: 689 - protein, 317 aa, Sorghum bicolor
MAGGGADDDDVVEVSCGGRGGGDPGAYAAVLKRKLDLYCAAVAKSMEAKSQESSLGYPNSQASDTSQLISQASFDGDIDGAGLVTNSNVIIEDDDFQGKPTNSGTSKELSDDDGDLEENTDPTNAKKMRRMLSNRESARRSRKRKQAHLNDLESQVSRLTSENASLLKRLADMTQKYKDASLDNKNLTVDIETMRRKVNIAEEAVRRLTGTTLMLSTAFDKPMSSTPLSSCASDAASASVAIEDSAKHFLHAPLQSGQMKLDILNAAIPLTSEGIGTKPASLQRVASLENLQKRIIGDSMHSETASTFSEPEALADR

SEQ ID NO: 690 - protein, 365 aa, Sorghum bicolor
MASPYAASPYVLSLLLLVLSVPAVFLLAPRLIPPRTLPAIPDADETEDLALFRRAVLLSAAPSKTGPASASASTSRFFGAAHRQRKQKVAFLFLTNSDLVFAPLWEKFFAGHHDLLNVYVHADPSAALLLPPTPSFRGRIIGGKATARASATLISAARRLLATALLDDPANHFFALLSQSCVPLMPFPALYRTLAADNAGPRGRHRSFIEILDAEPTLHDRYYARGDDVMLPEVPYESFRVGSQFFVLTRRHAVMVVRDRRLWNKFKLPCLVKRKFSCYPEEHYFPTLLDMQDPAGCTKFTLTRVNWTDSFDGHPHTYQPEEVSPELIRDLRKSNGTYSHMFARKFAPGCLAPLMEIADSVILRD

SEQ ID NO: 691 - protein, 262 aa, Sorghum bicolor
MGRSPCCEKAHTNKGAWTKEEDERLVAYIRAHGEGCWRSLPKAAGLPRCGKSCRLRWMNYLRPDLKRGNFTDDEDELIIRLHSLLGNKWSLIAGQLPGRTDNEIKNYWNTHIKRKLLARGIDPQTHRALGVRADAATAPGAVAAHHRAAALLHHHAGAVVVPVAPVKLLAVKPAPAESSSDDGGSSSTGSSGGGSAGEPRCPDLNLNLDLSVGSPPPAAAADTPTSLCLCYRLGLRAGEACGCEADITGQQGFRFFRPLEQG

SEQ ID NO: 692 - protein, 546 aa, Sorghum bicolor
MQRLPSQTNYMGEEEDLQTLKKQASLKKTVRGCHPRAVRQLLQLDRRDSEHPIVIDNEVNEEYKVSADQSAIMVLRRSPRFHVEDKSLGKPLLPPNHPETPPNKKSKSAHLKDKNQKSLKSDSRNARLEPLATMKRQNEPQLLCQDPRGITSRKNIEDVSNKKSEKKEFMPTNCKVLIGKRKRGRKRALSSKKQSCQEPKPLPTNRQEIAPCDEPRKSIHRRIENEPSIVVMPKSGDEELTNIDENISKPSGTERGVGKFCSSDDWTKEQDMALRKAYFTARPSPHFWKRVSKMVPGRSAEDCFNRIHADLTTPTPIAPRPRTSKTTFSPIGNFTLSDPKLPNLLESRVARQRTAKQKGLTAQKTVRHLLQKHCVIDQAQEADHFSVFESSPSALQLNLSFEDSHGTPDSYTNSGSLGKCSGSSSARKKPISRLRTKPSEPSPEVLKPIKNVILHEKYIDQLSRREYTKRPRKSTQGSKAADSEKALSEQKAGSLKAAKNALISEATDFISSFKKVQACSLAHVVENSEDDEIECDASDYSHDDKE

SEQ ID NO: 693 - protein, 255 aa, Sorghum bicolor
MAAPLHARLLPLPLPPNPSPGLPPSGARRVLRHPRRCLATPPSRNGSSSSPETEWCPVPPEQRPVNEYEALAASLPFSWAAGDLRVYCSRLALTGAAVALFVGLPVAAFGGRGGAGGDALHLALGATGSGILAVTLAVVRMYLGWAYVGNRLLSATVEYEETGWYDGQIWVKTPEVLARDRLLGSFSVKPVLNRVKFTLVGLAGSLILCILLYVNTENPKEPYVNTGGRAIPGVYSDTAARSFEPDAFCGEPDLS

SEQ ID NO: 694 - protein, 515 aa, Sorghum bicolor
MDSADAATPAPLGAWAWIRGYFTPATLFLVVNLVIGTIALTSRATQQRRRREHYYHDDAHGPGHHLQEEPLHPQMEQPGYGHYYHPEQTLYAAPPPPAPLARTSSVLDRLRSLGLYRFRSGEFPPEYGAAAAAAAAPNYAQDVSAPVGEEETTATAHYARSRSEPAPSAREDERRPALPRVKKSGPEVRKSQVAPAPPRVVKAVAEVDDSVEEAGAEEAVGGFRRVPSPLQQEYHYQEDYVPPPARARARAPAAPAPLQRTSSVLDRLRSLGLYGFLAPDQPTAAAPVPATDAFATHGDENRHAHYDRSRSEPAPVQGKKEKKQEAKSRMAKSGSETRKTPAPRPVEAGGECVNARAEAFIDSFRQQQQQVVQHYQEEEYVPPPAPAPLSRTSSVLDRLRSFGLYRFRSGDLGPDLPAAADTDEKEKEQTAHYGRSRSEPAREQGKKTNKQEARMSKSSSSGVVEEAAAAETEQCVDARADDFINKFRQQLQLQRLNSLLNYKEMLNRGGGGGKQ

SEQ ID NO: 695 - protein, 722 aa, Sorghum bicolor
MDTAFLRPPLARNLVYDEFAVLHPTSYPFHTLRYLRCNPMYSRPLLTTSPASPSRGLTQRMAALPDVDDFFWEKDPTPILDTIDAPIHLKNLSSKELKQLADEVRSEIAFIMSRKCQPCGPGRSVVELTIAIHYVFNAPMDKILWDAGQHAYAHKILTGRRSQFHTIKQKNGLSGFTSRFESEYDPFGAGHGCNSLSAGLGMAVARDINGRKNRIVTVISNWTTMAGQVYEAMGHAGFLDSNMVVILNDSCHTLLPKADGRPKMSVNAFSSALSKIQSSKGFRRFREAAKGLAKWFGKGMHEFAAKVDEYARGMIGPHGATLFEELGLYYIGPIDGRNIDDLICVLKEVASLDSTGPVLVHVITGTESDTDGNIRSEITASEEGPSNSSNDLLKFLETGLSRTYNDCFVEALTAEAENDKRIVVVHGGMGMDRSLRLFQSRFPDRFFDLGIAEQHAVTFSAGLACGGLKPFCIIPSTFLQRAYDQIVEDVDMQKIPVRFAITNAGLVGSEGPTNSGPFDITFMSCLPNMIVMSPSNEDELIDMVATAAMIEDKPICFRYPRGAIVGTSGTLTYGNPLEIGKGEILVEGKEIAFLGYGEVVQRCLIARSLLSNFGIQATVANARFCKPLDIDLIRTLCQQHSFLITVEEGTVGGFGSHVSQFISLDGLLDGRIKWRPIVLPDRYIEHASLAEQLDLAGLTAHHIAATALTLLGRHRDALLLMK

SEQ ID NO: 696 - protein, 518 aa, Sorghum bicolor
MTGAAAHAVSPRGGASASASASQPHAAAAAAAGAGAAGCEPVRKAGPVTMEHVLLALHETEAEREARIRDMFAFFDTEGRGQLDYAQIEAGLAALQVPAECKYARELLRACDRDRDGRVGYDDFRRYMDDKELELYRIFQAIDVEHNGCILPEELWDALVKAGIEINDEELARFVEHVDKDNNGIITFEEWRDFLLLYPNEATIENIYHHWERVCLVDIGEHAAIPEGISKHVNASKYLIAGGIAGAASRTATAPLDRLKVIMQVQTTRTTVMHAIKDIWTKGGMLGFFRGNGLNVVKVAPESAIRFYAYEMLKEYIMKSKGENKSEIGASERLVAGGLAGAVAQTAIYPIDLVKTRLQTYSGEGGKVPRIGQLSRDILVHEGPRAFYRGLVPSLLGIVPYAGIDLAVYETLKDVSKTYILKDSDPGPLVQLGCGTVSGALGATCVYPLQVIRTRLQAQQANSESAYRGMSDVFWRTLQHEGVSGFYKGILPNLLKVVPAASITYIVYEAMKKNLSLD

SEQ ID NO: 697 - protein, 287 aa, Sorghum bicolor
MKKCASELELEAFIRESGDDDARAAAAGRSNHGCGGPGEPGGSAVVFSPGVGFAESNTMDDSSWWYGSVRTPNPVMSRTASISASLEATTSANHALESESDSDSESLYEVEGVPYERGNKSVETKRIRRMVSNRESARRSRRRKQAQLSELESQVERLKGENATLFQRLSEANQQFSTAVTDNRILKSDVEALRVKVKMAEDMVARSAISCGLGDLGLAPYLNSRKMCQALNMLTTTGLDLLGSDAFRGPTTAPQVQNSPVQSTASLENLDNRKSNEVTSCAADIWP

SEQ ID NO: 698 - protein, 825 aa, Sorghum bicolor
MGQSKAEFLEQFGGDYGYPDAPRGIDELRAAEFKRLEGMVYLDHAGATLYSEAQMADVARDLMSNVYGNPHSQNDSSMATSDIVTSVRHQVLKYFNASPRDYKCIFTSGATAALKLVGECFPWSRDSCYMYTMENHNSVLGIREYALSKGATVSAVDVEEVVDPSNNHESDRFFKVSKHSNQRRGDDLLLHNYQNGSLTAISGNNLNLFAFPSECNFSGHKFNLNLVKLIKEGKFMDFSSQQRGQWMVLIDAAKGCTTEPPNLSLYPADFVVCSFYKIFGYPTGLGALIVKNEAASLLNKTYFSGGTVAASIADIDFVQKRKGIEQALEDGTISFLSISSLQYGFKIIDILTISAIARHTASLATYVRNKMLELKHNNEKNVCIIYGQASKANYLKMGPTITFNLKREDGTWFGYREVEKLASLSGIHLRTGCFCNPGACAKYVGLSHSDLVSNFEAGHVCWDDNDIINGKPTGAVRISFGYMSTYEDAEEFLKFLQSSFVSKPVGLKNGYMVNTDTFNLVDDWRQQAISDIRLKSITIYPVKSCQGFSVQSWPLTTGGLKYDREWLLQGSGGEVLTQKKVPELSSICTLIDLELGKLFLESPKCKDKLQICLLENLTLLSAEVDVYGQRYEVQSYGDKVNSWFSGAIGRPCTFVRCSSSKYRSCTINGRRDRLCRDTRSKLSFVNEGQLLLVSEDSISDLNSRLSSSNGNGKQGVLVDAMRFRPNIVVYGSTPYNEDNWKRLHIGDAYFTSMGGCNRCQMINLYQSSGQVIKSKEPLATLASYRRKQGKILFGVLLNYEDGMEGEDDAIVERWLKVGQEVYPST

SEQ ID NO: 699 - protein, 682 aa, Sorghum bicolor
MGATHDAEVDQEEEARRMASLLAARRALRAGLEKSRALTHALAPRLEAIQARLPAMEASVRPIRAPREALATAGTNIDRALGPAAAVLKVFDAVHGLEPPLLDRAAVADDLPGYLAVLAQLEAALRLLADNCGLATQWLADVVAYLGERRLADGRFVAGLAAALDRLRDAAATADLDAGLLAAALDLLEAEFRRLLKDHSAPLAMKDPAGGGSDPPAVVPSRIPASVVYKLSLILDRLAANGRIDHCSSAYADARGDTVSASLRALGLDYLKETSGDAQALSPSVERWGRHLEFAVHHLLEAERKLCVAVFERRPEAAPVCFAEIAARAGILDFLNFGRALAGARKDPIKLLRLLDVFDCLNKLRLDFNRLFGGKACVEIQSRTRELVKTVVDGAVEIFEELPVQVELQRNLPPPVDGGVPRIVSFAAKYCNQLLDQPYRSVLTQVITIHRSWRKEVFNDKMLVEAVLSIIKTLEINFDTWSKSYGDPTQSSLLMMNIHWHFFKHLKGTKLGELLGDPWLREHEQYKDYYSTMFLRESWGTLAPLLSREGMIMFSKGRATARDLVKQRLKSFNASFDEMFQKQSKWVISDRDLQQKTCHLVVQAVVPVYRSFMQNYGPLVEQDVSASRYVKYSADDLDKKLNTLFLAKPGRPMRAGSFQIKNSDDKITSAMTGLYRSASTLK

SEQ ID NO: 700 - protein, 137 aa, Sorghum bicolor
MASSLASTPVFPSCGARRGARCVARASASAVAVAVASPSAARTHYEVLGVGAGASRCEIKAAYRRLAREVHPDAGGRGDEGFIRLHDAYATLADPDERARYDRAVAVAAPVRSGSWAAPSGSGSGFRPRRWETDQCW

SEQ ID NO: 701 - protein, 1844 aa, Sorghum bicolor
MSLEQKALLNKRRRDLYAQKNAARKLQMTPQEKKVKRKESKKKYNTMVRENRANNLHPDSIAMESPHFNPQIIFPASPQSSEAPLDDMEIPEFGGTPVHIAPTVVQNPEVQTPELVAAQTIHRHRVTNGERNALLSRRNRVFEANIGARARGADEKCNDSNGLTQPSVVCNDGVTQQTPIQAPNNCNGTQTQPSVADGTSSMPPYSAQDHTSDSMVEDDYDEDVIFEEDEEEDEAYFFAGQEDEDEGTDVDTYEQENHEPDVPDPYDRVYANVPSESHMLPSVPNCKHCNAKKFDGEPPGFCCRGGKIHLSSPETPPELMRLWSSSDADARHFRANIRYFNGHFSFTSLYCHLDRITTNMRICGVYTFRAHGQIYHNIRSFGKEEGVEKRHLELYFYDDDPSLEHRMSKCREQCAQKDREVIQQLVGILEGNPYSQQLRSMGHVENLEDYRVELNLDQRLDQRTYNVPLTSEVAAVWVEGSERHGQFEHSVLLQGKDRSIHGIRSYNACYDSLSYPLFFPKGELGWHNCIPKVGVTMAQIDRARATRKRRAENGDDDGEPVSNTCVSVRDYYCYKFQMRPGIFNPILYGRRLFQQFAVDTYIKIESSRLDYMRNNQDTLRADLYQGLVDSMHSGEGSAENVGRRTVLSSSFIGGPRDMRRRYMDAMALVRKYGKPDIFLTMTCNPNWDEIKNELYPGQTPQDRPDLVTRVFRAKLDAMRKMLMEKDILGKVKAYVYVVEFQKRGLPHAHFLLIMERKYKLTCPEQYDMIISAELPNKKKYPELYKMVTKHMMHGPCGTLNPSCPCTAGRGSCKNRYPRPFCEATSQGKDSYPIYRRRNDGRMLKVRGHYLDNQWVVPYNPCLLRTFNCHINVEACGSIKLVKYLFKYIYKGHDRASVVMRETDKEDGKGNIDEIKQYRDARWVTPPEALWRIYGFDLSKNHPPVQQLQLHLPDMHMVAFHKRDKVEKIVNRPGVEESMLTAYFDANKHDEEARKILYRDFPEYFTWQSDGKFWQKRKNSVFQIGRVISAHPAEGERYFLRVLLNNVAGATSYEHLRTVDGVLLPSFREAAERRGLIEEDNTLDECLTEATLFEMPNSLRRLFATILVFCEPHDVMGLWTKHYDAMSEDYSRNYPSSDLVQQMVLIDIRNMLQSMGKDIRSFPLPHIDHSYDDASHIPREIFEEASVEQNPQDVLFKQGGLFFVDGPGGTGKTFLYRALLAKLRSQDKLAVATATSGVAAAIMPGGRTAHSPFKIPLTLQEGGCCSFTKQSGTAKLLQQAALIIWDEASMTKRQNLEALDNSLRDIMGRSHLPFGGKTVVLGGDFRQVLPVVRKGSRAQIVGASLRRSYLWESMRHLKLVRNMRAQSDPWFADYLLRIGGGTEEVNGDGNVRIPDEICIPYSGDAEKDLHSLIDSIFPNLNANMADKDYITTRAILSTRNDWVDMINMKMIDMFQGGETVYHSFDTAVDDPHNYYPSEFLNSLTPNGLPPHVLKLKLGCPVILLRNIDPANGLCNGTRLVVRGFRRNTIDAEIVVGQHAGKRVFLPRIPLCPSDDEMFPFQFKRKQFPIRLSFAMTVNKSQGQTIPNVGVYLPAPVFSHGQLYVAMSRATSRTNIKILALPADAEAQEEEAKNLEKKNAKKNTTGKKPKNALLNKKDKDKKTLTTDGTFTKNIVYKEAIPSSTPSLTFVCHVARLFASRDADATLVLTRANAARLGGPVAGTAATGFRVRIITLTFPQRPLGLQVATRAPTAFPTGPFAIVVDLLAPLFADLLRRQPANAVVFDSILPWAATAASELGIRRYAFIGTGSFALSVQRAQLLHNPQNGVASDTESFLASLTPCGSPG

SEQ ID NO: 702 - protein, 274 aa, Glycine max
MSVIDILTRVDSICKKYDKYDVEKHRDANVSGDDAFARLYASVDADIVALLQKAESASKEKGKASAVAINAEIRRTKARLLEEVPKLQRLAVKKVKGLSSQEFAARNDLVLALPDRIQAIPDGAPPVPKQTGGWAASASRPEIKFDSDGRFDDEYFQQSEQSSQFRQEYEMRRMKQACNLKQLSVDQGLDVIAEGLDTLKNMAHDMNEELDRQVPLMDEIDTKVDKASSDLKNTNVRLKDTVNQLRSSRNFCIDIVLLIIILGIAAYLYNVLKK

SEQ ID NO: 703 - protein, 231 aa, Solanum lycopersicum
MAPALEQAITSDASSDVTITGKIYTRVRLATKSDLSHIYRLFYQIHEYHNYTHLYKATESSLANLLFKENPLPLFYGPSVLLLEVSPTPFDEPKNTTDEGFKPVLTTFDLKFPVVEGEVEEFRSKYDDKSDVYIAGYAFFYANYSCFYDKPGFYFESLYFRESYRKLGMGSLLFGTVASIAANNGFVSVEGIVAVWNKKSYDFYVNMGVEIFDEFRYGKLHGENLQKYAHN

SEQ ID NO: 704 - protein, 441 aa, Solanum lycopersicum
MGFEGMKKLKPLLHLLLPLCVHWIAEEMTVSVLVDVTTGALCPGKTTCSEAIYINGVQQTVVGIFKMIVLPILGQLADEYGRKPLLILTVSTTIIPFGLLTINKSREMVYAYYVLRTISYIISQGSIFCISVAYAADVVDVSSRAAVFSWITGLFSASHVLGNVLARFLPVGYIFQVSIGLLIFVPVYMTLFLEETVSPKTEVTRSSTLKSNTLKIVQERYNSMRYAANLVTSSPTLKCISLVSFFYELGMSGISGVLLYYLKSAFGFNKNQFSEILMMVGVGSIVSQIVVLPLINPLFGEKVILCLALLSSIAYAMLYGLAWAPWVPYLSASFGVIYILVKPSTYAVISKAALSADQGKAQGFVAGIQSVASLLSPIVMSPLTSWFLSRDAPFNCKGFSILCASLCMVVSLCYASTLKVEAPRERTFDEIAENIEAPLLT

SEQ ID NO: 705 - protein, 223 aa, Solanum lycopersicum
MQRSTKLSGEEEFSIMVAALTNVITGAATISSFPCTSGMSPPLFRVPEETERCQYCKINGCLGCNYFATSSAAAGVVNNNKALKIVGKTKKKKKNYRGVRQRPWGKWAAEIRDPRRAARVWLGTFTTAEDAARAYDRAAIEFRGPRAKLNFSFTDYTSIQQHNTTTPMQVLQQQQPAPSQLQQGINTEEEEFWDQLMNSDNEIQHYLYRESSDSANGYIAHSF

SEQ ID NO: 706 - protein, 289 aa, Triticum aestivum
MSSIGMMEARMPPGFRFHPRDEELVLDYLLHKLTGRRAYGGVDIVDVDLNKCEPWDLPEAACVGGREWYFFSLRDRKYATGQRTNRATRSGYWKATGKDRAILAHGEALVGMRKTLVFYQGRAPKGTRTEWVMHEFRLEEERHRHHHQQKGGAAAAEARCQLKEDWVLCRVFYKSRTSSPRPPSEEVCTFFSELDLPTMPPLAPLIDACIAFDSGTAMNTIEQVSCFSGLPALPLRGSMSFGDLLGWDNPEKKAIRTSLSNMSSNSNSKLELTPNWSQENGLSQMWTPL

SEQ ID NO: 707 - protein, 510 aa, Triticum aestivum
MSSHEACCGTMFWVYLLSCAGLVMFAGLMSGLTLGLMSLSLVDLEVLAKAGTPQDRRNAARILPVVKNQHLLLCTLLIGNSLAMEALPIFLDSLVPSFGAILISVTLILAFGEIMPQAICTRYRLSMGAKAAPIVRVLLVVFFPVAYPISKLLDWLLGKGHVALMRRAELKTLVDMHGDAAGKGGELTHDETTIIAGALEMTQKSTKDAMTPISETFSLDINAKLDVHTVGMIMTKGHSRIPIYSGRPSNIIGLILVKNLLTCRPEDEVPTRHVTIRKIPRVADDLPLYDILNEFQKGHSHMAVVVKRTKEDGASAEKNNSFTPDYKMTNGHAHADGLGLSPSHVNISGSRRNNNDKYSKKIERKRDNILDFNTDPLPHYSMDEEAVGIITMEDVMEQLLQEDILDETDEYVDVHNKIKINMLPPGKSLSPLISPSGGPLSQGLRKTPMASPLSPYHNGGSILRSPAANHARSPGTLPTAFSPGRSPASQTPVRSSPTSSWVSRNSYRNP

SEQ ID NO: 708 - protein, 351 aa, Brachypodium distachyon
MAESPMSPASRVDFYGFLDRMRRPAAADLFRSIKSFLASLSLDEPSAEEDGARVQAFFTAMETTIREHPLWANATHQEIDHALEGLEKYIMTKLFDRTFVSSAEDAAADAEVSEKIGLLQQFLRPCHLDIPKILHNEASWLLAVKELQKINSFRSPRDKLLCIMSCCQVINNLLLNVSMSNDRSPSGADEFLPILIYITIKANPPQLHSNLKFVQLFRREAKLVSEVEYYLTNLISAKMFIVNVNGHSLSMEESEFQKHMESAKLGTQISAASPSTPQGLATSTRGPQKQTDMEGSVFPYMESETESLTAAELKQLHGLYRQVVTRYTLLSKALRKLSVDEERLLASVDDP

SEQ ID NO: 709 - protein, 732 aa, Sorghum bicolor
MSSASGLGGKEGPSSAFSVDLAAAARRLLAFLRAAPAGVGPRSVWRYEELWMPLAAREAGGGGEAAMLVPPPDVHLVWLCHCFHHENYSAYCTSRFGRLINRPSILDVENEEYAEDRCRDVWATHFPSEPFDLDTNEIDGNSVDNITCDNVDGEIVKMVRRYADLADRFASPFVWEGVYHVAARRRYVRFLDLIKKVVCGTQVFTRLVPSLDMLLMWLAHQSFPVCYATDMLAMGIRDNVAKVGVGYGEVVSDEEVGRTRGLWEDAYDEPYHMAGSEVDAGAVSAAREAFYWVPAASEEDANRLYKSLQPRFIMEVYVLLKGEFDKEPTSKDFLRLRTQRCHRSLKLDKSMSTLSCKSWQKVWHLYCEFATRGLLIEFRRNLNGCFRKSKFLKNISFSWSDVLHEKALALTEELDVRMRAMASITPPVQAPYLLKCVPDRVTDDGGAMISDVILRMRNYRPQEGRWLTRTVLDHSGRECFVIRMRVGRGIWRRGAETPMAVKWEDRSIEVREGSWSYIASTSSIGYAPEKIVGTATAMKDQQENKVVWSLSTGGTLTVCLGDELSFQLKNNSSDEEARLLVGRRLSYRVNTDNASSNLVEEEQYLTLVRKSPDHGDRATMLLNWKLLAVEFLHEEDAVFVLLLCMVIARTMTEIRREDVAGLLVRRRISEARAGQRDWGSVMLPGSLSPDPHLQPWYRNAAQVLSSVETGPMLAKYSPADGKDMLYRQALIP

SEQ ID NO: 710 - protein, 867 aa, Sorghum bicolor
MATAATASHPASASTSGRDALAASSSSHAAVCLVPFRWWARVREEEAAGGVQYAATAAASPSYYGLRLLHSFLHPDLVLRLERGDFRAGDGGGGGRSYALVPADELSRALARQNSGLGLQNKHSFAGDSAGAYPLVLRISVRETSILTLKISKKDNPVENYKRANKIFNVDSQPVHVWDFSGQTNLILMNEWNRLHDCCHADQENLLEVQVYAMSDSLTSKIGGDMNSDLSYRSFGRAGSMGLIGLENLGNTCFMNSSIQCLAHTPKLVDYFLGDYANNINRTNPLGLNGELALAFGELLRSLWTDRKPIPPHHFKEKIACFAPQFSGFNQHDSQELLAFLLDGLHEDLNQVKCKPYEEAKDASGRPDEEVADEYWSNHLARNDSVIVDTCHGQYKSTLTCPTCSKTSVTFDPFMYLSLPVPSTAKRVMTVTVFSTDGSREPCSYDVSVPKFGTLSDLVQALSIACLLGDDEILLVTEVYNNCIIRYLEEPSDSVSLLRDGDKLAAYRLPKRHEKSPFVVFTHQYFDEHSSDDNLTRQMREFEAPLLAALPETINGLSLQDIYLKLLSPFRLSNRAGSLNVCMESNSDSIDLTDATSSDSGSNSFQNSQSEDGPESSHCSASECEIMKRPDDLCDGGSDSNKEAQMEEFEFYLKNERGDGQLQKIEINELDLLETAPSRLHVNVHWLRNASKKYATSMLSNLPEIHKLELIPKGTEDSVALHGCLEAFLKEEPLGPEDMWYCPCCKKHQQAMKKLDLWRLPEVLVIHLKRFSYTQFTRNKLETFVDFPTTDLDLSSYIADKSKQPSSHYRLYAISNHYGNMGGGHYTASIYHEEGKGWYKFDDDYVTPMSEDSIKTSAAYVLFYRRE

SEQ ID NO: 711 - protein, 631 aa, Zea mays
MDGSAAELEAAERVVMRWDSSSAGAGADEPMLFDGGGDRAEADRFLRAVDDLRRLAPPSPAAVGSPRRLSSSSVAASGAVQVAMARLEDEFRHVLSTRALDLEIEALADLSSLSINSDRTNSASSADLPAADEDDSVSSSIGRRSTAYRSLRSIREIDLLPDDAVADLRAIASRMAAAGYGRECAQVYASVRKPAVDASLRRLGVERLSIGDVQRLEWDALEAKIRRWIRAARAAVRGVFASERRLCFHIFHDLPISTTTISAASASATHDIPFAEAVKGAALQLFGFTEAISIGRRSPEKLFKIIDLHDALSDLLPDVSDIFAASKVAESIYVQAVEIRSRLADAVRGILSEFENAVLRDPPKTAVPGGTIHPLTRYVMNYSSLICDYKVTLSELIISRPSASARLSAEGNELAPSLADLELPELENQLPLASHIVWIIVVLEHNLEGKAALYKDPALSHLFMMNNVHYIVHKVKDSPDLWSMIGDNYLKRLTTKFTMAATNYQRTSWLKILNCLRDEGLHVSGGFSSGISKSALRERFKSFNAAFEDAHRVQSGWCVPDNQLREELRISIAEKLLPAYRSFLGRFRHHIENGKHPELYIKFSVEDLEIAVSDFFEGVPPSPHNRRKSHG

SEQ ID NO: 712 - protein, 658 aa, Hordeum vulgare
RQRDGTHPHPQLFAAFTRLTDARVSIRAGVRGRRACQPEMEVERLLDLAVDYGFDRDFAVAALSRLVHLYGEGGQDFITVENCGDDFIAALADATQPTDDWDDLNAIETEACGNLNEMMRKGVNDEKGGVVLDTPLFKRADSSSKHNPKDFDIFNETNTHHDNPVGTQKKAQTRNSKAQTRSSTKSTALLFVFQNNVLKVTKATKRYESTTLTSNREGQPNACLWKRGILSYEQLSSLDDINLANAVIFGNKSFRPLQYEACSAALDNKDCFILMPTGGGKSLCYQLPATLHPGVTVVVCPLLSLIQDQVVALTFKFGIQAAFLNSQQTSAQASAVIQELRNGTPSFKLLYVTPERMAGNYSFMEILKGLHQRGLLARFVIDEAHCVSQWGHDFRPDYRGLGCLKQHFPRVPIMALTATATEAVRKDVLNTLRIPNALVLKRSFDRHNLNYMVIGKTRTPQMQLGDLLKERFMNMSGIVYCLSKNECADTAKFLREKYKIKCAHYHAGLAARQRSSVQEKWHRGEVKVICATIAFGMGIDKPDVRFVVHNTLSKSIESYYQESGRAGRDDLPAHCVVLYQKKDFSRIVCMLRSAENFKSETFKVAMDQAKKMQAYCELKTECRRETLLGHFGEQFNSQRCKDGPSPCDICLKEASRGH

SEQ ID NO: 713 - protein, 232 aa, Hordeum vulgare
MAHSRASTMSSPVHRLLIVAAAAALVSACAADPEPVQDFCVAAVTNGSADHPSYPGFPCKPASAVVSDDFFFAGLAKSGAAEAAESPFGSSVTPGNVAAFPGLNTLGVSINRVDLAPGGVNPLHSHPRAAELVHVVAGQMLVGFVSTAGTFYSKVVLEGESFVIPRGLVHFQFNTGKEAARAVTVFNSQLPGVVLAAPSLFGADPEIPDAVLAKSFQVDGEIIKLLKSKFRN

SEQ ID NO: 714 - protein, 307 aa, Hordeum vulgare
PSAEADGARVQAFFAEMEAAIRGHPLWADATHQEIDHALEGLEKYIMTKLFDRTFASSPEDAAADAEVSDKIGLLQRFVRPHHLDIPRLLNNEASWLIAVKELQKINSFKSPRDKLLCMMSCCQVINNLLLNVSMSNDRTPSGADEFLPILIYITIKANPPQLHSNLKFVQLFRRETKLVSEVEYYLTNLISAKMFIINVNGQSLSMEETEFQKHMESAKLGNQMSVASPSSPQGLATSTRGLQKQIDAEGFKFPFMDSEIENLTPEELKQLHGLYRKTVTKYTLLSKALRKLSIDEDQLLASVDDS

SEQ ID NO: 715 - protein, 206 aa, Hordeum vulgare
MAVNDTKLADAENPGTMCRAIDSDSDVDFAGRANWLRAAVLGANDGLVSTASLMLGVGAVKHEVRAMVISGFAGLLAGACSMAIGEFVSVCSQRDVEIAQLDRDGKRGGDEERALPSPIQAAAASALAFSVGALLPLLAAGFIVGYKLRVAVVVAVATLALAAFGVVGAVLGRAPVVRSSARVVVGGLAAMGLTFGLMRLFRASGI

SEQ ID NO: 716 - protein, 128 aa, Hordeum vulgare
IFGFAYGGPFGHFLHKMLDYIFKGKKDTKTVAKKVLLEQITSSPWNNLLFLFYYGYVVEKRPFKEVKIRVKKQYLSVQLSAWMFWPVVGWINHQYVPLQFRVIVHSFVACCWGIFLNLRARAMSLKQS

SEQ ID NO: 717 - protein, 389 aa, Hordeum vulgare
CPAAAELAASWGVDLLPGGGGAAAFGCGLGTGAGQEDEDAFFFSSLDYSMLVDPEMRDLYVPCNPPEVAVSAGGGRPLKGEALCDQLAEMARRETDTSQPQGYSDLSPRTPRRSSAGSSGRLPDKQPPPPLPPAPEVPCPYTSLLMMPSAHCAELVGNDRLPDDDEEQLRWEFAPPSSVPPTQIWDFNLGRSRNHNEKSAHEVGFGSNNGGFMIKSYSDMLKEISCGTTKDLEDIYDSGYGAAAEDIMSTNICQVPSKNVSTASNKRMKVSSCTSTMDGPTTSGSNVPASGTLASSSHDRGAAPTREISFGDQTIVPTGAERPTTRIDSETLALNRDSAMQRYKEKRKNRRYEKHIRYESRKLRADTRKRVKGRFVKSNEALNAGSNGG

SEQ ID NO: 718 - protein, 881 aa, Hordeum vulgare
MAPAAKKPPLKSSSSHNSAAGDAAGKTIEEMYQKKTQLEHILLRPDTYVGSIEKHTAALWVYENRAMVNRQVTYVPGLYKIFDEILVNAADNKQRDPSMDSLKVDIDVAGCCISVFNNGDGVPVEIHQEEGIYVPELIFGHLLTSSNYDDNERKTTGGRNGYGAKLANIFSTEFVIETADGRRQKRYRQVFSENMGKKSEPEIKKCKQSENWTKVTFKPDLAKFNMTELEADVVALMMKRVVDMAGTLGKTVKVELNGEKVAVKSFSDYVQLYIDSASKEGIDLPRIYQKVNDRWEVCVSLSEGQFQQVSFVNGIATIKGGTHVDYVANQIASHVMGVVNKKNKQANMKSHVVKGYLWVFVNALIDNPAFDSQTKETLTTRQGSFGSKCELPDDFLKKVSSSGVVNSLLSWAEFKLSKELKKTDGTKKTSIVGIPKLEDANDAGGKNSDKCTLILTEGDSAKALAMAGIGVVGRDHYGVFPLRGKLLNVREASHKQLMENAEIQNIKKILGLQHEKNYDSTKGLRYGHLMIMTDQDHDGSHIKGLLINFIHKEWPSLLKVPSFLVEFITPIIKATKGKTVEPFYSMPDYEAWKESLGTSASSWTIKYYKGLGTSTAEEGRDYFEQITRHKKDFVWADDKEDGDAIELAFSKKKIAERKDWLTNYQPGTCLDQREKRIKYSDFINKELILFSMADLERSIPSMVDGFKPGQRKILFCSFKKNLIKESKVAQFIGYVSEHSAYHHGEQSLASTIVGMAQDFVGSNNINLLEPRGQFGTRNAGGKDAASARYIFTRLNPITRLIFPKDDDVLLNYLNEDGQSIEPTWYMPIIPMVLVNGSEGIGTGWSTYVPNYNPRDIIANLKRLLNGEAIVPMVPWYRGFKV

SEQ ID NO: 719 - protein, 290 aa, Brachypodium distachyon
MQIRLDGKNCLVTGANSGLGFATAEGLASHGATVYMLCRNKERGETALKQIRSKTGNMNVHLEICDLSSINEIKSFTTRFSSMNKPLHVLVNNAGFLEHKRVTTPEGLELNFAVNVAATYTLTELVMPLLEKAAPDARVITVSSGGMYTEPLNNNLEYRESDFDGTKQYARNKRVQVALTEWWSEKYSNKGIGFYSMHPGWADTPGVSKSLPGLSEKLSGNLRSNEEGADTVVWLALQPMDKLVAGAFYFDRAEAQKHLKFAGTAASHAQIGSIVDSIRSICGLQPPMRR

SEQ ID NO: 720 - protein, 262 aa, Brachypodium distachyon
MVAAAGGARRRATRRAPAPPTRAVQRLFQASRAVFRGPGTVPAPAEVALLRAMLDRMRPEDVGLSADLRFFKAREAAEGKTPTITHTTIYKSENFSMVILFLPPNAVIPLHNHPGMTVFSKLLLGSMHIKSYDWAGPGPDPATSGANSLPDDRLRLAELVVDDVFTAPCDTSVLYPTAGGNMHRFKAIASCAVLDILGPPYSIEEDRDCTYYTEIPYSHQPSSDLVDNEQERRRLAWLKEIDMPKELKMCSVAYGGPPISDR

SEQ ID NO: 721 - protein, 327 aa, Setaria italica
LSRRRPPPQWLVLADDDTAFVLPNLLRALRRYDHREPWYLGARSESAAQNAWHGFAMAYGGAGIAVSWPLARRLARSLDSCVLRYPHLYGSDARIYACLAELGVELTHEPGFHQIDLHGDISGLLRAHPLSPLVSLHHLDNVYPLYPGMDRTRAMKHFFRAANADPARILQQTVCYDSKRSLTVSIAWGYSVQVFKGNILLPDLLAVQKTFVPWKRGRNVTDVYMFNTKHVPRDECKRGALFFLKSISSGEGKTQTTYNRQPPRKCLPDLIPLKNLSLIKVTAEQLQLIPGKALKRHCCDIVPSSSDTTMDVNIRKCKDDELIAMHS

SEQ ID NO: 722 - protein, 96 aa, Zea mays
VPVEDVDPLTLNLAISAPVVALASPSALRAWLNLISKSDNWNNSVACIGETTASAAKKLGLKSIYYPTTPGLEGWVESILEALRVHRTASKEAPKR

SEQ ID NO: 723 - protein, 494 aa, Zea mays
MQVHRKLATDRSVDGAVAGEVYDTAVADGAGFADAEAAKAFFQRLDQQLNKVNRFYEREEREFLERGESLRRQLQILLELKAAVTQQQQARRGGSAADTDDPSVSWSIQLGGQSLRVIAEKEEECEEKLNGGDATAKISSGEGPVSQGLSESGRLCKPNEEMTRTLSGQGRSVRINIPVTTPSRTVTAIRELLFGDMPSQSKKTGAHGTDGSEKLSINKRKVHQAEKMIRGALVELYKGLGYLKTYRSLNMMAFVKILKKFDKVTGKEVQQIYLKAVESSYYNSSDKAVRLMDDVEELFLRHFTEGDRRKAMVYLKPNQREESHCTTFFIGVSTGGFIALFIGYCIMARVAGMYTQQSNKVYMSTSYPVLSMFSLFFLHLFIYGCNIFMWRKTRINHTFIFEFTPTKELKYRDVFLICTASMTIVVGAMFAHLAIIVKGNSSGVVQAIPGSLLLVFLFILVCPFNIVYQSSRYQFLRVIRNIILTPFYKASCHG

SEQ ID NO: 724 - protein, 161 aa, Zea mays
MESTALMTARLPLLTSGSRSKPLPFASFTRAACRLASAPCSGSGSVVLLSRRSRDYAGVGSLVSAAAAPGDTADAGSESILLSVQGMMCDGCAASVKRILESQPEVTSATVDFKEASAVVWTTDEAKGTQGWQKQYGEKLAKHLGTCGFESRLQDDQRTIT

SEQ ID NO: 725 - protein, 743 aa, Medicago truncatula
MFGFSRRRTKFGRFKVQQLSDGTRSPVSVRHPKRIPNSILNGEGEEDGIGDAVTGSSGHSHEIDNEIVSSTDISSCSSGGSENWVLLSISGDKPAPRFNHAAAVIGNKIIVVGGESSTGLLDDVQVLNFETFSWTTASSKLYLSPSSLPLKIPACKGHSLVSYGKKALLIGGKTDPGSDRISGSIRGLLMYISRCEVALIIFLVFAVWAFDTESECWSLMEAKGDIPVARNGHSVVRASSYLILFGGEDAKRRKLNDLHMFDLKSLTWLPLHYTGTAPSPRLNHVAALYDDKVLYIFGGSSKSKTLNDLYSLDFETMAWSRVKVRGFHPSPRAGCCGVLCGTKWYITGGGSKKKRHGETLIFDIVKNEWSVAITSPPSSITTNKGFSLVLVQYKEKDYLVAFGGSKKEPSNQVEVLELDKNESALRRRSTPSKGPASILLEKHSSSTRLASQLNHCSQRLVDSVARQNLASAVEHGSGRKSLSESVDPNYPPSNVSLRKQFDRDEEYNADVKMDKNSDGSSLPQVADHRTNENDRRKLMNISGAKVNIEGQVLLSGMSNQQNQVFESDALESEVVSFPENDKSGSLSSTNIYQYYESKVAALIRKNGMLEGQLAASMASREAAEKGLSSVHKSRQEMEKKLADALKEMELLREKLAGLELAQEEANNLSNIVHSDNVRLEHDVAFLKAVLDDTQKELHSTRGVIAGERARAFQLQYEVFHLKQRLQSMENRTSTTPRKPFHVQ

SEQ ID NO: 726 - protein, 504 aa, Sorghum bicolor
MIRLQTYAAFSLLATASAVYYAFSSREQFYPAMVYLSTSKICFVLLLNTGLVAMCVAWQLVKRLFLGSLREAEVERLNEQAWREVVEILFAVTIFRQDFSVSFLAMVAALLLIKALHWLAQKRVEYIETTPSVPLLSHIRIVSFMAFLLIVDCLFLSNSLRSLIQKWEASVAIFFSFEYMILATSTVSTFVKYVFYVSDMLMEGQWERKAVYTFYLELISDLVHLSLYMLFFIAIFLNYGVPLHLIRELYETFRNFRIRIADYVRYRKITSNMNERFPDATAEELNASDATCIICREEMTTAKKLLCGHLFHVHCLRSWLERQHTCPTCRAPIIPPDSGRSASARQHGGQPGVQPAAGTDTPASEAAQGDNMSRRQAKLEAAAAAASLYGRSLVYPPANTLNRSGPQSTSSTPQSEASNSNQSQKDQELQIQNSSDGLAPSPFSAHGAIGSGPSTSNLENSLQKAQENFIKSQIEMLQIQLQMIRRGAAVSVTNSGNDEHKRND

SEQ ID NO: 727 - protein, 633 aa, Sorghum bicolor
MASRVKEDERHEKIIRGLLKLPANKRCINCNNLGPQYVCTNFWTFVCTNCSGAHREFTHRVKSVSMAKFTAQEVTALQEGGNERAREVFFKEWDPQRNGYPDSSNADKLRNFIKHVYVERRYTGERSTDRPPRAKDDKDEYSENRRSDGNWGGSRSPPNGSYSDRRSYSGRSDDRNSRYSYGDRSPGYDQNDYKKSPRYFEVVDDRSGKITPVQRFEDRRFSEPRKPDSGSPDFQKEADGSSPVVRPVRDILGDNAPQLRVGEPSKPAAEPPKPSVVRPLDPPKSSVVRPIDPPKPNGTRAIDPPPLTKTISSASSIGSSEGTSEQTKVATAVSLIDFSADPEPASTAPPQPTPMPQQPPVNAAAPQPVLEQGKSAPSVSGGDWASFDAFGQQQTPQTSTSVNPLESALAQLSFSEAPSAPNASAYPASLDPTVKANDGGHSSVLDHSHSLFDAPFGISGNQASTVMSGQGSSVQQSPLAAPTAGFPSQATANPQGISGIQGAASSTDSKFSGRKELPADIFTALYPPSTPMMPGWQRAPQFGMGYAMQYPAGVFQGMQAYPHGAFPQPTYQQPMYSQHAYSHPQPVKASNPFDLGNESAPIQAHMPPSGPPGASAGLASATLIGNSSFGVPP

SEQ ID NO: 728 - protein, 378 aa, Sorghum bicolor
MVTVSVDGSVLDRIAKIMTYLRLGSSGKVLKKKKKERDIKGKNNLASGDYDEAVKPSQTNGSALKHQSDMPPPSAPPPRNNNFNGKEKQSAPIARADDDDIFVGDGVDYSVPNKEMSQSPGSEDMEESPHNHQKQSYFTEPMYGPVPPSESAQAWQQPNEYDAAQAQMIAAGYQGDWSGYVYAEQPLGYQEQYAQQSTQEYDVLADPSISQDPRFMTQADKDRGLGSVFKRDDQRLNQLREKDARERDPNFISDSYSECYPGYQEYNNEIAGSDDEDDLSKMDMGGRAKGRLHRWDFETEEEWAKYNDQKEAMPKAAFQFGVKMQDGRKTRKQNKDQKLTNDLHKINKILARKKGEKDGGDDGGHYDDDLPSAKKQRG

SEQ ID NO: 729 - protein, 584 aa, Sorghum bicolor
MPGCTTPSPASTTTTEADNAEDLSEAVADDAVLAYINQFLLEDEDEESYPVTSVPVEDSVLLAAVEKPFVDILKSANHITAKAYEVKSWITDDCHSTGSGRFHDVVTSTLDSTQLAPEMVQGDVVDAVHKGQKNPRDNDLEVERRKSKQSALCDEETVREMFDKVLLCTDKNCAFHSPMPADAQNSGGYVKGSGNRRGRRKGRSGAGAEQEPVDLTTLLIHCAQAAAIDDHRNSSEHLKQIRKHSSATGDAGQRLAHYFADGLEARLAGTGSSIYRSLAAKRTSTGDMLKAFNLYVKACPFRIISHYVANTTILNATKSVTRLHIIDYGIMYGFQWPILMQRLSKRSGGPPTLRITGIDFPLSGFRPAERVEATGRRLHEYARMFNVPFEYQAIAAKWDTIQVKDLNIKSDEFIVVNCLYRMRNMMDETATDDSPRTRVLNTIRKLNPHLFVHGIVNGTYNAPFFVTRFKEAMFFFSSIFDMLEANASRMDEHRLLIEREFFGREAINVIACEGTERIERPETYKQWQMRNLRAGFRQLPLDREIMARARYKVSKTYPRDFLVDEDNLQGWKGRVIYALSAWST

SEQ ID NO: 730 - protein, 678 aa, Sorghum bicolor
MEVEALEKKGHTAFAKAMKSFSSSERYKRSKRLVSAGFCIVFCSDGNNAQNVIKRFLNGSYFEDMYATDALRSSDKTIVLPMPQVVKAKVKSDISKEAQPGRGAQSTLRKEILQLEKHLKDQQVVRGALEKALGPNAAQVNLSPENPMPKAANELIREIATLELEVKNMEQYLLTLYRKAFEQQAPAFSPPDAAPAFSPPDRREASKMSVSSRSGQLRETPVAMKSCKSRGDAALRSSYPPVHKKLNDPLADCCTSARSDRAIDSDVLRCQSALSYRGVFSSRILPSEDDSLARALRSCHSQPFSFVEEGETGASGMISLAEYLGTNVADHIPETPNNLSEEMVRCMAGIYCRLADPPLVHHGSSSSPSSSFSSTSAISPQYVGDMWSPHYRRETTLDSRLINPFHVEGLKEFSGPYNTMVEVPMISHDSRRLKEAEDLLQTYKLILYRLEAVDLRRMTNEEKIAFWVNIHNALLMHAYLKNGVPQNNLKKTSLLVKAACKIAGRNINAAVIQSIVLGCNTHCPGQWLRTLLYPRIKSKVSKAGHEWRAFAVAQSEPLLRFALCSGSHSDPAVRVYTPKRLFHQLEAAKEEFIRATAGVWKEQKLLLPKLVEAYAKDVKLSPQGLVDMVQRYLPESMRMAVQRCQQGGRSSGKVVEWVPYNPAFRYLLARDLAFPHLS

SEQ ID NO: 731 - protein, 699 aa, Sorghum bicolor
MMKHPIAIARLLSIRRLLLLVLQQLCLLVPLVSVLSAAAAVPPPPPAHRRPEGCPSRCGDVDIPYPFGIGDQCAIDGGFDLSCSLVNGTHYRPFSGPFEVTNISIPDAKAWTKMNISWRCYDSRTNPTTWSTRRENFTHTPFRFSHQDNKIFVVGCNTLGYITSEYYSIGCLSECYNKPRNMSSCSVGSGCCEADVPIDMGYSRSFFNPEYNYTGCGYIAVMEEKMFSYSTTYRDSSTSFFDAYNGTVPVVMDWRIRRYTCEEAKLNISSSYACISYNSQCVNTTNGPGYRCKCQDGYQGNPYVRDGCTGASVGLVVLVVTLTCAYLIQQRKLHHTKQRYIQQYGDMWIFEKMKSQQGFKIFTEAQLQEATNKFNEKRVLGHGGQGTVYKGLVEGNVEVAVKRCMSVDEQHKREFGKEMLILSQINHKNIVKLLGCCLEVQVPMLVYEFIPNGTLFQLIHGNHGRQISLAIRIQIAHQSAEALAYLHSWASPPIFHGDVKSSNILIDRDYTAKVSDFGASILAPTDESQFVTFVQGTCGYLDPEYMQTCQLTDKSDVYSFGVVLLELLTRKKPFKFDGPEDEKSLAVRFISVAKQGKLEEILDDHIKKDESMEVLQEVAELAMQCLEMSGANRPTTKEVSERLDSLRKVMQHAQQQHNNPEEMEPLLGESSLASSDEVVVSTGNLSIEMEAARSLERGR

SEQ ID NO: 732 - protein, 518 aa, Sorghum bicolor
MVDLRLQVVATVLGMVALAAAAGGSSSSGKQSEFQEVTVDAIHQGFKNGSLTSTALVRFYLDQIARLNPLLHAVIEVNPDALAQAARADAERSASRGRCAVGLHGIPVLLKDNIATRDRLNTTAGSLALLGSVVRRDAGVVARLRRAGAVILGKANPSEWSNFRPVESGWSARGGQTLCLLCVKLQNPYVLSATPCGSSAGPGVAAAANMAAVTLGSETDGSILCPSSFNSVVGIKPTVGLTSRSGVIPITPLQDTIGPMCRTVSDAVHVLDVIVGYDELDAEATGAASKYIPHGGYTQFLRIHGLKGKRIGVLDVFFQGYDDMQLAVYEKHLDTMRQQGAVVIKNLDITTNFTDLGEQEILLMAAEFKLSINAYLSDLLYSPVRSLAQIIAFNKAHPVEERLKDFGQPDLIAAEKTNGIGTRERAAIQRLKEISTNGLEKLMKEHQLDAIVAANSDASSVLAVGGYPGIAVPAGYDKQGVPFAICFGGLRGYEPRLIEIGYAFEQATKVRRPPTYKS

SEQ ID NO: 733 - protein, 697 aa, Sorghum bicolor
MENSDARAVRRVRCPRCPCVLEEPRAPVYQCGGCGATLRAKNRTGTGSAGDAATASPSRSGLPPRSRHLDASDVASTSRSSTPTPPHVASTSRSGTPPPPHVGTSWHRATTDATSSRHGSGDLALVSAGTRASGDVASTSSTPDATASSRRQGTDATSRRGSGGPVSAARSRASGDVSSTSSTPDASAAMSIGRPGADTTSRGESGGPARNRVPEQVALIEKRSREQIAVGQEVRDDSEGCGPSDAGGAESGVGGAGFSGGNREATPESQDDTEKGMKRQAESTDAARKKHSGEAAVQPQNPHDRRQELAPKSSAQPAAAQPARDDAGEKARSPSRHEIQEEHLGPLRKKILKTVDELKGDLSELFTKSPELNQPRARPARLPKQEGYVSRAAAAAASGFPARARHAAAATDGHRGHHVSAARAVKPRQAAAPPRGLPSRRYRQCRAHPCCHDVEPRPCHHGHGCCRHHGKPECSSCRGYCCRPRAQEPSAPRKPPAGKEPKRRLPPRNHCRPVLKGAPFIVCSSCFKLVQVPADFAVSTRTVRKLRCGSCSTVLSYSYRDPARKKAYQDSVDQCSIDGSELHVGKGDERSDPFAPFIDAFGLSSYSTEDEQRLPVSRNTSFDTLDGTKGVGRLHRLMGKGKGVCIDDGDGDDDYDVDDSDEEDIGALKRSARKGSGWALPWMPGKGTPAAGAIRIK

SEQ ID NO: 734 - protein, 624 aa, Sorghum bicolor
MGSDLKEMKYRRRIGVEERPQCSDPRGGGADWPALQQDPVELLRKLDELRDQITRSCNVVGQPREHRRVSRRAVSMLPEQLEPPPLPAYHRSRYGGRYGHGLPPPSPYAPPRPEHGERYVRQSSGHYRQYPATGRQSENGGMGPGGYHHYGCACPHCLHGQRPLQQEENIPMARYFAGQHESYRFQRSPSVSSDYDRRSVASSLYSHRSVSKRRAEYFRKKAEHICRPVDGAAPFSVCSSCYKLLQMPMGKCIGRKQNRFQCGSCCQIISLKHEEENGIPFVPSSSLYAPEMEQCSSDQMRRDSAHQRHEDFNSMFYNSIDHSNMQNNMDFTDDNSLSSTMSNDRIEKECGSTRSIQSKAEGLSFSPSRSVDIGSPKDILCEREADCKVEPSVDGPLGPRSPALEDKLVDPLCAQENGNDEDDQGMPYRSDLTCKGEYDVSDEYDVGISTRSKQESNEDDKDATEDERSYRSYEQKSKSKEDDCCNVEDSSKTYRQNSGEDDASSLVDGSEKYDYRAGFWGVMGRECIGIVPPFIREFNYPMARDCAGGDTGVFVNGRELHQRDLDLLVGRGLPRISGKSYSIEMSGNVIDEATGKKLRSLGKLAPTIEKLKRGFGMHVPEEFR

SEQ ID NO: 735 - protein, 778 aa, Sorghum bicolor
MAALLYLALLLLLTFPVCSGASPWQTMTTGSHIRGEDHDKVILLSPDATFSCGFHEVGTNALTFSIWYTTHAAERTVVWTANPYSAERGGYSPVNKYGSRVSLNRDGNLILTDTNGSMVWESKTSSGKHTTVTLLNSGNLVISDSSNKIMWQSFDSPTDTLLPGQNLTKDTRLVSGYHHLYFDNDNVLRMLYDGPEITSIYWPSPDYDAQKNGRNRFNSTRIAVLDDMGNFTSSDGFKIEASDSGPGIKRRITIDYDGNFRMYSLNASTGKWDITGQAVIQMCYVHGLCGKNGLCDYLGGLRCRCPPDYEMVDPTNWNKGCKPMFLTDGNQAREEFTFIEQPHADYYGFDLSSNKSIPFEACRNICWNSSTCLSFTYKGGDGWCYTKDLLYNGQVFPYFPGDNYMKVPMSFNTSTYSISKQKTLTCGPAGSENMLGPASMYGTKKDNINWTYFYVFAAILGALELLVIVTGWYLFFKKHNIPKSMEDGYKLVTNQFRRFTYRELREATGKFKEELGRGGAGIVYRGVLEDKKIVAVKKLTDVRQGEEEFWAEVTLIGRINHINLVRMWGFCSEGTKRLLVYEYVENESLDKYLFGERSTESLLGWSQRYKIALGTARENILLTRDFEAKIADFGLAKLAKQGSTSFNFTHMRGTMGYMAPEWALNMPINAKVDVYSYGVVLLEIVTGIRASSGIMLDERQIDFLEFVQEAKQILSTGNVSDIVDDRLHGHFHTEQAIAMVKIAFSCLEERRKRPTMDEIVKVLMSCDDEDDYHPAYSY

SEQ ID NO: 736 - protein, 92 aa, Sorghum bicolor
MAAAASAARSFLRSSGSSSLRSAAARAASRAGPAPLPRRMPTSAPRALLRSPVEMSSVCLESLMPMHSATASALMTSLLAAPACKGFGWLSE

SEQ ID NO: 737 - protein, 1071 aa, Sorghum bicolor
SASAVENQLVPDTSTSRFTWCIENFSRRNVRKHYSDDFIVGGYKWRVLVFPRGNNGDHLSMYLDVADSNLLPPGWSRNAQFSLAVVNQLDSKASLRKEAIHQFNSRESDWGFTSFMPLLDLYDSSKGYVVNDKCIIEAEVAVRKTFDFWNYDSKRMTGYVGLKNQGATCYMNSLLQTLYHIPYFRKAVYHMPTTENDTPSGNIPLALQSLFYKLQHCDNSVATKELTKSFGWDSYDSFMQHDVQELNRVLCEKLENKMKGTPVEGAIQKLFEGHHMNYIECINVDSKSTRKESFYDLALDVKGCSDVYASFDKYVAQERLEGDNKYQSEEHGLQDAKKGMLFIDFPPVLQLQLKRFEYDFVRDTMLKINDRYEFPLQLDLDRDDGKYLSPDADRSVRNLYTLHSVLVHSGGVHGGHYYAFIRPKLSDQWYKFEDERVTKEDMKRALEEQYGGEEELPHTNGLKNAPIRFTKHSNAYMLVYIRESDKEKIICDLDDEDIPDHLKVRLRKEQEEKECKKKEKAEAHMFTALKVARDSDFKEQIGRHMHFDLVDFDKVNSFRAPKNMSINDVKEELSKEFGIPVESQRFWVWAKRQNFTYRPSRPLTFLEETSAIGYLKDAIVAKLPNSEVRLFLEVHLGQENQGIASGKTKEDILIFFKLYDPEKEDLRYVGNFFVKASGKPSDIVERLNEIAGFPSDEDIELYEEVKFEPAVMCVPIESNISFRSSQIDNGDIICYQKRCLPDSMDRYRYPSVPSFFEYIHNRQVVYFRLLDKPKEEGFSLELSKRSTYDDVVEKVARQLRLDDPSKIRLTQHNLSSQQPKPHHIKYRSLNYLSDMLHNHNQMCNILYYDVLDIPLPELESTRSLKITFENATNHEMSFHTMRLPKSNTLLDLIEDLKSKVELSCNDAEFRFFGVHLHKICKVYQPGDKIDSVNEPLYIEEVPEEEKNAGPHDRLVHVYHFEDNRHVQYFGEPFFFLIRDGEALSDIKVRIQKRLQVPDEQFIKWKFAHVTFSRPEYLQDSDIVLNRFHKQKPVYGAWEQHLGLEHTATTPRRSYFGSQNRHSFERPVKIYN

SEQ ID NO: 738 - protein, 575 aa, Sorghum bicolor
VSSQVQQVSADLTVRIADSVFPLHKAVMVPKCGYIRRAVAAAAAVATSQTQGPGPASVELDLSALPGGADAFEKAARYCYGGSLEITARDAAAVRCAAAFLDAPDLARRAEDYLAQTALRSLPCAAAETGVARRAADAVALGVCNEALFPTARAAPGWWVAELAALSPASFRKVVTALRCRRAGPEVVAAAAVAYAERVLAGVLAPAAPGRRDAVVVVARNADADADRRALLEAVVDALPPAADAPLPAAFLCRLLHAVVTAEASAKTCRDMELRVAGVLHQATAGDLLGVALDGAGERVRNADTVRRVVAAFVERPQTQEGRRASLAGGPAAGELGALEKVAKTVDEVAAEMATEESLGISKFVGVAGAVPKDARASHDCLYRAVDMYLKTHPGLDEIEREKVCSVMDPLRLSYQARLHASQNKRLPLQAVLSALYYDQLKLRSADGGGGDGAEGGAGWEPQSAAGKARAQARADASLARENEALRSELARMRAYVSGMQQHSKGSGSRSSSASLVPASAAGKKASFLGSVSRTLSRLNPFKGGWAKDTASIADGRDRSAMHVVKPKRRRFSIG

SEQ ID NO: 739 - protein, 482 aa, Sorghum bicolor
MNEAAGTVVCGDLIVGAMAQSWRFLMQGVTSLLFLCARAAAADDDEYVRPPPCPLVLVAHDKPAWHPQQVHISVVGSDHMRVSWVTDDRRAPSVVEYGTSPGNYTASSTGDHTTYRYFFYKSGAIHHVTIGPLEPSTTYYYRCGRSGDEFTLRTPPSTLPIEFVVVGDLGETGWTASTLSHITAGGGGDYDMLLLPGDLSYNADTQQPLWDSFGRLVQPLASARPWMVTEGNHEVEALPGIPVVGELVKPFVAYNARWRMPYDDGDDEASGSSSSSTTSNLYYSFDAAGGAAHVVMLGSYAAFVEGSEQHRWLARDLARVDRRRTPWLLVLLHAPWYNTNQAHQGEGERMRVAMERLLYEARVDVVLAGHVHAYERFTRIYDNKADSRGPMYITIGDGGNREGLALKFIKDHKSAHLSEFREASFGHGRLRIVNETSAVWTWHRNDDEFATVRDEVWLESLAAAAKPGLAPSIPAGRDIDEL

SEQ ID NO: 740 - protein, 293 aa, Sorghum bicolor
MEKMLHAAPVHATLPECFIFPSDKLPQAKSTSGAVSLPIIDLSSAATRAFDTGKETRIYSSTMFDTGAEKYWRDCLRLACSFPDVGDSHRGWPNKPTRLREIVERFTAQTRGLGMHILRILCEGLGLRPDYLDGDISDGDVVLHVNHYPPCPDPTATLGLPPHCDRNLLTLLLPSMVRGLEVSYNGDWIKVDPVAGAFVVNFGCQLEVVTNGTLKSIEHRVMTNLGVARTTVATFIMPTTDCLIGPAAEFLSDDNPPAYRTMTFGEFKRIYSVVKLGLSLNLTTNLKDVQKQV

SEQ ID NO: 741 - protein, 396 aa, Sorghum bicolor
FLCVVQTYERAFIEKWIASGHHTCPNTQQRMPNTTLTPNYVLRSLIAQWCEANGIDPPKRPTEADKPTSSCSPSERAIIDALLSKLCSADPEEQRSAAAELRLLAKRNANNRICIAEAGAIPLLLSLLSSSDLQTQEHAVTALLNLSIHEDNKSSIILSGAVPGIVHVLKNGSMQARENAAATLFSLSVVDEYKVTIGGTGAIPALVVLLSEGSPRGMKDAAAALFNLCIYQGNKGRAIRAGLVPLIMGLVTNPTGALLDEAMAILSILSSHPEGKAAIGAAEPVPVLVEMIGSGSPRNRENAAAVMLHLSVHNGHLARAQECGIMVPLRELALNGTDRGKRKAVQLLERMSRFLVMQHEDTVSQQLDEIERQFAALGPNVTEADLEQLGEQLGYL

SEQ ID NO: 742 - protein, 1834 aa, Sorghum bicolor
MSLEQKALLNKRRRDLYAQKNAARKLQMTPQEKKVKRKESKKKYNTMVRENRANNLHPDSIAMESPHFNPQIIFPASPQSSEAPLDDMEIPEFGGTPVHIAPTVVQNPEVQTPELVAAQTIHRHRVTNGERNALLSRRNRVFEANIGARARGADEKCNDSNGLTQPSVVCNDGVTQQTPIQAPNNCNGTQTQPSVADGTSSMPPYSAQDHTSDSMVEDDYDEDVIFEEDEEEDEAYFFAGQEDEDEGTDVDTYEQENHEPDVPDPYDRVYANVPSESHMLPSVPNCKHCNAKKFDGEPPGFCCRGGKIHLSSPETPPELMRLWSSSDADARHFRANIRYFNGHFSFTSLYCHLDRITTNMRICGVYTFRAHGQIYHNIRSFGKEEGVEKRHLELYFYDDDPSLEHRMSKCREQCAQKDREVIQQLVGILEGNPYSQQLRSMGHVENLEDYRVELNLDQRLDQRTYNVPLTSEVAAVWVEGSERHGQFEHSVLLQGKDRSIHGIRSYNACYDSLSYPLFFPKGELGWHNCIPKVGVTMAQIDRARATRKRRAENGDDDGEPVSNTCVSVRDYYCYKFQMRPGIFNPILYGRRLFQQFAVDTYIKIESSRLDYMRNNQDTLRADLYQGLVDSMHSGEGSAENVGRRTVLSSSFIGGPRDMRRRYMDAMALVRKYGKPDIFLTMTCNPNWDEIKNELYPGQTPQDRPDLVTRVFRAKLDAMRKMLMEKDILGKVKAYVYVVEFQKRGLPHAHFLLIMERKYKLTCPEQYDMIISAELPNKKKYPELYKMVTKHMMHGPCGTLNPSCPCTAGRGSCKNRYPRPFCEATSQGKDSYPIYRRRNDGRMLKVRGHYLDNQWVVPYNPCLLRTFNCHINVEACGSIKLVKYLFKYIYKGHDRASVVMRETDKEDGKGNIDEIKQYRDARWVTPPEALWRIYGFDLSKNHPPVQQLQLHLPDMHMVAFHKRDKVEKIVNRPGVEESMLTAYFDANKHDEEARKILYRDFPEYFTWQSDGKFWQKRKNSVFQIGRVISAHPAEGERYFLRVLLNNVAGATSYEHLRTVDGVLLPSFREAAERRGLIEEDNTLDECLTEATLFEMPNSLRRLFATILVFCEPHDVMGLWTKHYDAMSEDYSRNYPSSDLVQQMVLIDIRNMLQSMGKDIRSFPLPHIDHSYDDASHIPREIFEEASVEQNPQDVLFKQGGLFFVDGPGGTGKTFLYRALLAKLRSQDKLAVATATSGVAAAIMPGGRTAHSPFKIPLTLQEGGCCSFTKQSGTAKLLQQAALIIWDEASMTKRQNLEALDNSLRDIMGRSHLPFGGKTVVLGGDFRQVLPVVRKGSRAQIVGASLRRSYLWESMRHLKLVRNMRAQSDPWFADYLLRIGGGTEEVNGDGNVRIPDEICIPYSGDAEKDLHSLIDSIFPNLNANMADKDYITTRAILSTRNDWVDMINMKMIDMFQGGETVYHSFDTAVDDPHNYYPSEFLNSLTPNGLPPHVLKLKLGCPVILLRNIDPANGLCNGTRLVVRGFRRNTIDAEIVVGQHAGKRVFLPRIPLCPSDDEMFPFQFKRKQFPIRLSFAMTVNKSQGQTIPNVGVYLPAPVFSHGQLYVAMSRATSRTNIKILALPADAEAQEEEAKNLEKKNAKKNTTGKKPKNALLNKKDKDKKTLTTDGTFTKNIVYKEAIPSSTPSLTFVCHVARLFASRDADATLVLTRANAARLGGPVAGTAATGFRVRIITLTFPQRPLGLQVATRAPTAFPTGPFAIVVDLLAPLFADLLRRQPANAVVFDSILPWAATAASELGIRRYAFIGTGSFALSVQRAQLLHNPQNGVASDTESFL

SEQ ID NO: 743 - protein, 441 aa, Solanum lycopersicum
MGFEGMKKLKPLLHLLLPLCVHWIAEEMTVSVLVDVTTGALCPGKTTCSEAIYINGVQQTVVGIFKMIVLPILGQLADEYGRKPLLILTVSTTIIPFGLLTINKSREMVYAYYVLRTISYIISQGSIFCISVAYAADVVDVSSRAAVFSWITGLFSASHVLGNVLARFLPVGYIFQACWCLLIFVPVYMTLFLEETVSPKTEVTRSSTLKSNTLKIVQERYNSMRYAANLVTSSPTLKCISLVSFFYELGMSGISGVLLYYLKSAFGFNKNQFSEILMMVGVGSIVSQIVVLPLINPLFGEKVILCLALLSSIAYAMLYGLAWAPWVPYLSASFGVIYILVKPSTYAVISKAALSADQGKAQGFVAGIQSVASLLSPIVMSPLTSWFLSRDAPFNCKGFSILCASLCMVVSLCYASTLKVEAPRERTFDEIAENIEAPLLT

SEQ ID NO: 744 - protein, 233 aa, Solanum lycopersicum
RPNIFSVFSTMQRSTKLSGEEEFSIMVAALTNVITGAATISSFPCTSGMSPPLFRVPEETERCQYCKINGCLGCNYFATSSAAAGVVNNNKALKIVGKTKKKKKNYRGVRQRPWGKWAAEIRDPRRAARVWLGTFTTAEDAARAYDRAAIEFRGPRAKLNFSFTDYTSIQQHNTTTPMQVLQQQQPAPSQLQQGINTEEEEFWDQLMNSDNEIQHYLYRESSDSANGYIAHSF

SEQ ID NO: 745 - protein, 253 aa, Triticum aestivum
KNLLTCRPEDEVPTRHVTIRKIPRVADDLPLYDILNEFQKGHSHMAVVVKRTKEDGASAEKNNSFTPDYKMTNGHAHADGLGLSPSHVNISGSRRNNNDKYSKKIERKRDNILDFNTDPLPHYSMDEEAVGIITMEDVMEQLLQEDILDETDEYVDVHNKIKINMLPPGKSLSPLISPSGGPLSQGLRKTPMASPLSPYHNGGSILRSPAANHARSPGTLPTAFSPGRSPASQTPVRSSPTSSWVSRNSYRNP

SEQ ID NO: 746 - protein, 377 aa, Zea mays
MDGSAAELEAAERVVMRWDSSSAGAGADEPMLFDGGGDRAEADRFLRAVDDLRRLAPPSPAAVGSPRRLSSSSVAASGAVQVAMARLEDEFRHVLSTRALDLEIEALADLSSLSINSDRTNSASSADLPAADEDDSVSSSIGRRSTAYRSLRSIREIDLLPDDAVADLRAIASRMAAAGYGRECAQVYASVRKPAVDASLRRLGVERLSIGDVQRLEWDALEAKIRRWIRAARAAVRGVFASERRLCFHIFHDLPISTTTISAASASATHDIPFAEAVKGAALQLFGFTEAISIGRRSPEKLFKIIDLHDALSDLLPDVSDIFAASKVAESIYVQAVEIRSRLADAVRGILSEFENAVLRDPPKTAVPGGTIHPLTR

SEQ ID NO: 747 - protein, 607 aa, Hordeum vulgare
MEVERLLDLAVDYGFDRDFAVAALSRLVHLYGEGGQDFITVENCGDDFIAALADATQPTDDWDDLNAIETEACGNLNEMMRKGVNDEKGGVVLDTPLFKRADSSSKHNPKDFDIFNETNTHHDNPVGTQKKAQTRNSKAQTRSSTKSTVTKATKRYESTTLTSNREGQPNACLWKRGILSYEQLSSLDDINLANAVIFGNKSFRPLQYEACSAALDNKDCFILMPTGGGKSLCYQLPATLHPGVTVVVCPLLSLIQDQVVALTFKFGIQAAFLNSQQTSAQASAVIQELRNGTPSFKLLYVTPERMAGNYSFMEILKGLHQRGLLARFVIDEAHCVSQWGHDFRPDYRGLGCLKQHFPRVPIMALTATATEAVRKDVLNTLRIPNALVLKRSFDRHNLNYMVIGKTRTPQMQLGDLLKERFMNMSGIVYCLSKNECADTAKFLREKYKIKCAHYHAGLAARQRSSVQEKWHRGEVKVICATIAFGMGIDKPDVRFVVHNTLSKSIESYYQESGRAGRDDLPAHCVVLYQKKDFSRIVCMLRSAENFKSETFKVAMDQAKKMQAYCELKTECRRETLLGHFGEQFNSQRCKDGPSPCDICLKEASRGH

SEQ ID NO: 748 - protein, 609 aa, Hordeum vulgare
MCSGPRKPSTPPLAAPAPKDSAAMASLLLELAAADDVVEFRRVVEEEKACLDAAASWYGPSAVGLGRLGAESRTPAMVAALYGSTAVLAHALSVAPGEACRASDTDGATALHMAAAGGAANAVAATHLLLAAGASTEALSVSGLRAGDLLPRAAGVAEKPLRLLLKSPAVSPSSSPKKSASPPATVAAAQEPRKEYPPDLTLPDLKSGLFSTDEFRMYSFKVKPCSRAYSHDWTECPFVHPGENARRRDPRRYSYSCVPCPEFRKGGSCRKGDGCEYAHGVFECWLHPAQYRTRLCKDEVGCARRICFFAHRRDELRSVNPSAVSVGMMQPVSPRSSPPNGMDMGMLSPAGWPSSPASRLKTARELDFDLEMLALDQYQQKLFDKVSNNAHSPRASWGAPNGGLGSPRAAAGSPARNMPDYTDLLGSMDPAMLSQLHALSLKQAGDMSPYSSMPDTQLHMPTSPMVGANNSFGLDHSMAKAIMTSRASAFAKRSQSFIDRGARAPAARSLMSPATIGEPSMLTDWGSPSGGGNLDWGSPGGKLDWGMQGDELHKFRKSASFGFRGQSAMPAASAATSAEPDVSWVNSLVKDGHTGDHFPQWLEQEQMVA

SEQ ID NO: 749 - protein, 856 aa, Hordeum vulgare
MPAAGRSGGPGQVNIMTGRRKLHVVTLAILCFWSSAGVCKAQTVDFKPADSYLVDCGSAKGTTVLGRNFAADGASPVTVSTSQDILAGTSANGVSSFDNPVLYQTARIFTSPSSYTFPIQKQGRHFVRLYFYPFIYQTYDLSTAKFTVSTQDVLLLSDFQQPDKTAPLFKEYSLNITRDQLVISFKPSNGIAFINAIEVVSVPDDLIADVANMVNPVQQYSGLTTQSLETVYRVNMGGPKVFPSNDTLSRTWQKDQKYILNPSVTKTAQYGKAINYRNGGATSLTAPDIVYSTATELAASNTSNALFNMTWQFDVDAGFSYLIRFHFCDIVSKALNQLYFNAYVGGFFAQHDLDLSEQSVNQLATAIYVDVVLSSNDASSKLSISIGPSTLNNALPDGILNGLEIMKMGSGSGSAFTVGNNGSNKKLPIIIGSVLGVVGLLIIILVVVLLCRRKKTDDKQHSKTWMPFSINGLTSLSTGSRTSYGTTLTSGLNGSYGYRFAFNVLQEATNNFDENWVIGVGGFGKVYKGALRDDTKVAVKRGNPKSQQGLNEFRTEIELLSRLRHRHLVSLIGYCDERNEMILVYEYMENGTVKSHLYGSDNPSLNWKQRLEICIGAARGLHYLHTGSAKAIIHRDVKSANILLDENLLAKVADFGLSKTGPELDQTHVSTAVKGSFGYLDPEYFRRQQLTEKSDVYSFGVVMLEVLCARPVIDPSLPREMVNLAEWGMKWQKRGELHQIVDQKLSGAIRPDSLRKFGETVEKCLADYGVERPSMGDVLWNLEYVLQLQDADSSTVSDVNSMNRIVDLSSQVQHVGAMESISVTMAEDGASHEPDHDLSDVSMSRVFSQLIKAEGR

SEQ ID NO: 750 - protein, 521 aa, Hordeum vulgare
MACAAYSIRGHLKLATGHGLASSHLCGGRKPSLSCPVSRAWGSNVSTDAAQRVASRSHLAVRSSERWPPIPKASPADGAVVAEERITVLVIGGGGREHALCYALTRSPSCETVLCAPGNAGIAQSRDAVCIPDLDISSSDSVISFCRKRGVGMVVVGPEGPLVAGLANDLVKAGIPTFGPSSEAAALEGSKDFMKRLCDKYNIPTAQYHTFTDAAKAKEYIKDQGAPIVVKADGLAAGKGVVVAMTLDEAFEAINSMMVDESFGSAGSRVVIEEYLEGEEASFFALVDGENALPLESAQDHKRVGDGDTGPNTGGMGAYSPAPIVTEELKSVIMETIIIPTVKGMAAEGCKFVGVLYAGLMIEKKSGLPKLIEYNVRFGDPECQVLMMRLESDLAQVLLSACRGELGKVSLTWSPEIAMVVVMASEGYPGSYKKGTVIKNIDKAEQVSPAVKIFHAGTALDGDGNLVAVGGRVLGVTAKGKDIEEARSRAYDAVDVVDWPEGFFRRDIGWRALKQEQTANY

SEQ ID NO: 751 - protein, 864 aa, Hordeum vulgare
MRPSWGDLAVVWCCFLLLLLLPFLSHGKDMPLGSTLTPGGNSAAWASPNSTFSLAFAPSPTSPSLFVAAVTYAGGISIWSAGAGAPVDSGGSLLLSSTGDLQLVNGSGAVLWSSGTAGRGVSAAALQESGSLVLKNSTGGAVWQSFDHPTDTVVMSQNFASGMNLTSGSYVFAVDRATGNLTLKWANAGSATVTYFNKGYNSTFTANRTLSSPTLTMQTNGIVSLTDGTLNAPVVVAYSSNYGESGDMLRFVRLDSDGNFRAYSAGRGSGTATEQWSAVADQCEVFGYCGNMGVCGYNGTSPVCGCPSRNFQLNDASNPRSGCRRKVELQNCPGNSTMLQLDNTQFLTYTPEITTEQFFVGITACRLNCLSGSSCVASTALSDGSGLCFLKVSNFVSAYQSASLPSTSFVKVCFPSDPNPPVSAGSTSSSRSSGLRGWVVALVVLGVVSGLVLAEWALWWVFCRNSPKYGPASAQYALLEYASGAPVQFSYRELQRSTKGFKEKLGAGGFGAVYRGVLANRTVVAVKQLEGIEQGEKQFRMEVATISSTHHLNLVRLIGFCSEGRHRLLVYEFMKNGSLDSFLFGAGSNSNDSGKAMSWATRFAVAVGTARGITYLHEECRDTIVHCDIKPENILLDEQHNAKVSDFGLAKLINPKDHRHRTLTSVRGTRGYLAPEWLANLPITVKSDVYSYGMVLLETVSGHRNFDISEETNRKKFSVWAYEEYEKGNILPIVDRRLAGEEVDMAQVERALQVSFWCIQEQPSQRPSMGKVVQMLEGIMELERPPPPKSSDSFMTVTTATTGGSASGVSSSVASTFASSVAAPPAPVPSPNVEQEMSVGRSASARTREIASLPLRSSEPYMTM

SEQ ID NO: 752 - protein, 734 aa, Hordeum vulgare
MKLGCSRFLLSCHVLLCLSAIWVPATADVPVAHLTGCQAKCGEVDIPFPFGIGEQCALHRGFNINCTTVNGILKPFAGYVEVTKISVPDGKAWINATTMSWRCYDVATDTMSYQNEGLDLRNTPFWVSEVDNKIIVIGCNTLAYMRSFPYVIGCSSICEDVTLENDKCSGAGCCQADVPKGVRYYNGYFNTNYNATKSCSFMAVMEKAAFKFNTSYTESTVFWDTYNGTVPLVLDWLAWPSTCDVAQNMSSYACASTHSECVNSTIDEPGYRCTCAVGYKGNPYVQNGCQDIDECLEDATLCVSGSGTCTNTAGNYTCSCPRGKDWANGSCQSHFPVIPVVGTTVGLVVLVIVLACACMIQERRKLQKMKRDYFRQHGGLILFEEMRSKQGITFKIFTEEELQQATNRFSEQQVLGQGGYGTVYKGVLEGNVEVAVKRCKTVDEQQKKEFGKEMLILSEVNHKNIVKLLGCCLEVEVPMLVYEFVPNGTLFQLIHGNHGLRISLATRLGIAHESADALAYLHSSASTPILHGDVKSSNILLDRDHKAKVADFGASILAPTDKSQFITLVHGTCGYLDPEYMQTNLLTDKSDVYSFGVVLLELLTGKLPFNFSQDVAAREKSLSMMFMYAMKVNKLEEILDDDIKNEESTEIIEEAAELAMRCLEMCGDNRPSMKEVAEKLDSLRKVMQHPWVQRNPEEMECLLGEPSSMVSSTITSAEYFSIEKKAVNGLQSGR

SEQ ID NO: 753 - protein, 372 aa, Hordeum vulgare
MTSSASHHHDAPSATSTPRAGAGSTGSSNGNGNGNGGHHPPPPRAQAQAHGAAYVRLMCSFGGRILPRPGDHQLRYVGGETRIVSVPRTTSHAVLFAALAKLAPALFVPGDPTPALRYKLPHDDLDALISVSSDDDVDNLMEELDRVHSLAATAVKPPRLRLFLFAASPDHSSAGAFGSVLSGVGDASSDQWFVDQLNAPPPGSIERGRSEASSVVSEVPDYLFGFDTTSEEPSPGAGAQPKSDAEMAQGDDDDAPAPVLGAPLAPYVAESAPWPAPPPPYMAQPVYYVPVRPVHYLDPAGHGGYMPGPVYHIVGGGRNQAPGDLYASGGAGAVYGVPRPMPPFRQVMYAPPPATEVYSVEGKPPEGESHSP

SEQ ID NO: 754 - protein, 346 aa, Hordeum vulgare
MGRTLDVLLGRTTKQTARLRSLLHLATRRVAVVRAHREVRCAQARGDVEQLLRQGHPDRALLRAEQVIRERDTLDALLLLDAYCALLADRSALLDAAHGRECPAELREAAAGLCYAAARCGDLPELQEARALLAAKFGRGFASGAAELRGGCGVSAKLVQKLATTLPSLESRQMVLLEIGAEKDIPVRLHNDATAAAEHEDPAGRSRHGHGHRKMRHDDDDERRADSDEPEGDRAVSAHSKLTFKDVEEAAQAAFESAATAAAAAKAAIELSRAGSGSPDGSYRRKAHAADETHHRGDDLADGKALERIGHVRNYSSDAEDLPEKRGEQQDTPRSRPASVRTNRGL

SEQ ID NO: 755 - protein, 1483 aa, Hordeum vulgare
MAPTAKKPPLKSSSSHNSAAGDAAGKTIEEMYQKKTQLEHILLRPDTYVGSIEKHTAALWVYENRAMVNRQVTYVPGLYKIFDEILVNAADNKQRDPSMDSLKVDIDVAGCCISVFNNGDGVPVEIHQEEGIYVPELIFGHLLTSSNYDDNERKTTGGRNGYGAKLANIFSTEFVIETADGRRQKRYRQVFSENMGKKSEPEIKKCKQSENWTKVTFKPDLAKFNMTELEADVVALMMKRVVDMAGTLGKTVKVELNGEKVAVKSFSDYVQLYIDSASKEGIDLPRIYQKVNDRWEVCVSLSEGQFQQVSFVNGIATIKGGTHVDYVANQIASHVMGVVNKKNKQANMKSHVVKGYLWVFVNALIDNPAFDSQTKETLTTRQGSFGSKCELPDDFLKKVSSSGVVNSLLSWAEFKLSKELKKTDGTKKTSIVGIPKLEDANDAGGKNSDKCTLILTEGDSAKALAMAGIGVVGRDHYGVFPLRGKLLNVREASHKQLMENAEIQNIKKILGLQHEKNYDSTKGLRYGHLMIMTDQDHDGSHIKGLLINFIHKEWPSLLKVPSFLVEFITPIIKATKGKTVEPFYSMPDYEAWKESLGTSASSWTIKYYKGLGTSTAEEGRDYFEQITRHKKDFVWADDKEDGDAIELAFSKKKIAERKDWLTNYQPGTCLDQREKRIKYSDFINKELILFSMADLERSIPSMVDGFKPGQRKILFCSFKKNLIKESKVAQFIGYVSEHSAYHHGEQSLASTIVGMAQDFVGSNNINLLEPRGQFGTRNAGGKDAASARYIFTRLNPITRLIFPKDDDVLLNYLNEDGQSIEPTWYMPIIPMVLVNGSEGIGTGWSTYVPNYNPRDIIANLKRLLNGEAIVPMVPWYRGFKGSLKETSSKATGVTYTITGVIEEVADTKLKITELPVRRWTTDYKEFLESMCPIPIKEKEKSKDKNKEKKKDKEKDKDKEKEKSKEPPLLEEIRSQCDHADVEFELILSEQNMNIAKQEGLEKKFKLTTTIGTTNMHLFDSHGKIKKYDNPEDVLQEFFDLRFKFYVNRKKVMMENMGNELLKYQNRVRFILAVISEDIIVNNRKRADLFLELKQKNYTPFPKKKPTSGPVAVGSTEAEEDNDQSPAEAAASDYEYLLAMSIGTLTLEKVNELIAQQDKLKADLEMLRNTEPQTLWLRDLDALEKELDVCDAKLEAEQQNRSSKRAKNSEKAKDSKPAPKRAVAAKKAKANSAGSDDDDYEAAIPKRAAQKKKPPPKKASALVKDEEEEVADLKDRLAAYNINDSSPEPSAMETEEQQKGKKGGNGPSKRGAAKKAMSSLAEISDEDIAEPQHESEDEGSSMEVEKKTKGKQPAAAKPKTAAIRKRAPAQSKGMRQKVMEEIFKPTDDSNLSAPSPEKKVRRIRDSPFNKKSGSVLHRMASTSTGVEDDEAPPSGSSAEPVAPRRTTRERKAAVVYVASGSEDDESEDEDVSEPSDDDDFSEDD

SEQ ID NO: 756 - protein, 395 aa, Brachypodium distachyon
MEIQSSGRPIEVLMEKVLSMNIVSSDYFKELYKIKTYHEVIDEIYNQVDHVEPWMTGNCRGPSTAFCLLYKLFTMKLTMNQMHGLLKHPDSPYIRAIGFLYLRYVAEPKTLWTWYEPYIQDDEEFSPGSNGKMTTMGVYVRDVLLGQYYFDSLLPRVPLLILRQVTAHLEKMKLPTKQSGMTGDSSRLGSDDTARRPPSVKASLSVSFGQRAPHRASTRDSSPVRKTLPSIRERERSHDGDRAKSPPRKRRSESRERNRGETERDRSDRDRGRYNDREQGRQSRDSRDRDYHRSSYAERDVERRGHERRDRNSDRNGRSSAHRSRSGSRSPSRGRTNGDHRRASPFGKAPESSNLAKLKDLYGDASNAKDDAGDGRARRDSGAEEVIRLGGARWR

SEQ ID NO: 757 - protein, 284 aa, Brachypodium distachyon
MGAEFEVAVAGVAAPPAKRRRRMVAAAGGARRRATRRAPAPPTRAVQRLFQASRAVFRGPGTVPAPAEVALLRAMLDRMRPEDVGLSANLRFFKAREATEGKTPTITHTTIYKSENFSMVILFLPPNAVIPLHNHPGMTVFSKLLLGSMHIKSYDWAGPGPDPATSGANLLPDDRLRLAELVVDDVFTAPCDTSVLYPTAGGNMHRFKAIAPCAVLDILGPPYSIEEDRDCTYYTEIPYSHQPSSDLVDNEQERRRLAWLKEIDMPKELKMCSVAYGGPPISDR

SEQ ID NO: 758 - protein, 510 aa, Setaria italica
MAGKAWRQLVAVASLLSVLWLLPWASAIHRSDFPVSFLFGTATSSYQIEGAYLEGNKSLSNWDVFTHAPVSGRIKDGSAGDIADDHYHRYDEDVELMNSLGVNAYRFSISWARVLPEGRFGRVNPLGIEFYNKLIDSLLLKGIEPFVTLNHYDIPQELEDRYGAWLSAEIQRDFGHFADVCFAAFGDRVKYWTTFNEPNVAVLTGYMLGTYPPARCSPPFGSCAGGDSDAEPYVTTHNVVLSHATAVEIYKRKYQSKQKGLIGIVMYTTWYEPLTDTPEDRLAAERALAFSVPWFVDPIVYGDYPPEMRQVLGSRLPTFSPEERRKLGYKLDFIGINHYTTLYARDCMFSSGCPLGQGTQHALAAVTGERNGVPIGPPTGRPMFYVVPDGIEKMVTYIMRRYNNLPMFVTENGYPDGGEAGHNHAKDLLHDQGRIQYLDGYLTKVAKAIRDGADVRGYFVWSLMDNFEWLYGYTLRYGLYYVDYQTLERKPKSSALWYKRFLQSFQHEAQ

SEQ ID NO: 759 - protein, 498 aa, Setaria italica
MATPSPGVLPLRALLVALPLLSLLIIFQLLHRPAPLPPPLRTHAHTQRRAEAEEEVSVNSLSSTTSPASRHRSEPEPTSLRHVVFGIASSRRTLPLRLRLLRLWLRPPARAFLFLDAALPAPPDLPSGVALRVSADASRFPYTHPRGLPSAVRVARIAGELVSALDREEEGLSRRRPPPQWLVLADDDTAFVLPNLLRALRRYDHREPWYLGARSESAAQNAWHGFAMAYGGAGIAVSWPLARRLARSLDSCVLRYPHLYGSDARIYACLAELGVELTHEPGFHQIDLHGDISGLLRAHPLSPLVSLHHLDNVYPLYPGMDRTRAMKHFFRAANADPARILQQTVCYDSKRSLTVSIAWGYSVQVFKGNILLPDLLAVQKTFVPWKRGRNVTDVYMFNTKHVPRDECKRGALFFLKSISSGEGKTQTTYNRQPPRKCLPDLIPLKNLSLIKVTAEQLQLIPGKALKRHCCDIVPSSSDTTMDVNIRKCKDDELIAMHS

SEQ ID NO: 760 - protein, 374 aa, Setaria italica
MKGGDVSSISPLVSFVLGAAMATVCVLFFMSASPTRRLADISAFSTGNSTASTDDLRLASSADSGVADGDGDGDVVSATPAPAPAPVEAASPWGDLEEVLRRAATKDRTVIMTQINAAWTRPGSLLDLFFESFRTGEGGVARLLDHLVIVTMDPAAYQGCQAVHRHCYFLRTSNGVDYRSEKMFMSKDYLEMMWGRNRFQQTVLELGYNFLFTDVDVMWFRDPFRHISMAADIAISSDVYMGDPYSLRNFPNGGFLFVRSSAKTLDFYRAWQQGRWRFFGKHEQDVFNLIKHEQSAKLDLAIQFLDTTYISGFCQLSKDLNKICTLHANCCVGLGAKLHDLRGVLDVWRNYTAGTPEERRAGKFQWKLPGICIH

SEQ ID NO: 761 - protein, 704 aa, Zea mays
MSGFVGVVVSDPSLQGQFTQVELRSLKAKFVSLKRDSGHVTTKNLPGLMKKLRGLNEVVSEEEIAAFLSESYPDSDHEIEFESFLREYLNLQAQVSAKEGGAGGGRGGKPSFLKSSITTLLHNLNQAEKSSYVAHINTYLREDPFLKKYLPIDPSGNQLFDLIRDGVLLCKLINVAVPGTIDERAINKKRVLNPWERNENHTLCLNSAKAIGCTVVNIGTQDLVEGRPHLVLGLISQIIKIQLLADLNLKKTPQLVELFDDSKDIDEVLSLSPEKMLLRWMNHHLKKAGYKKTVNNFSSDVKDGEAYAYLLKALAPEHSPETTLDTKDPNERAKLVLEQAEKLDCKRYLTPKDITEGSANLNLAFVAQIFQHRNGLTSDTKQVTLTQTATHDDVLLSREERAFRMWINSLGVESYVNNVFEDVRNGWVLLEVLDKVSHGSVNWKLASKPPIKLPFRKLENCNQVVKIGKQLKFSLVNLAGNDIVQGNKKLIVALLWQLMRFNILQLLNKLRFHSQGSEGKEISDADILNWANCKVKASGRTSRMESFKDKSLSNGMFFLDLLSTVQPRVVNWKVVTKGETDEDKKLNATYIISVARKIGCSVFLLPEDIIEVNQKMILTLTASIMYWSLQKQPQSQSELTEQSEPSSMTSDAASEVASEDGASTTAPSESEEVNSLSDSISNLTTDDATSNAPSAENGNGVAGS

SEQ ID NO: 762 - protein, 150 aa, Zea mays
MAQLAMCLLRRSIGFTAPPAQRALSTTATPAQRALSTNAEGAAVAEATAKEAKKRKKKNLFDVVQFLPGWGVGYKVAKTTWRDVSYQITKINLYKDGRHGKAWGFRYKAGVQAADAPTRISGVNKRGWKYIKESQKKLHDAPKVDVAIAG

SEQ ID NO: 763 - protein, 808 aa, Zea mays
MGGACQQLSVDGDARTPANDRDPAGLLQHDDTENQQQQQACWERFLLKETLNVLLVESDDSTRQVVSALLRCCMYQVISAENGQQAWAYLEDKRNNIDLVLTEVFMPGVSGISLLSRIMSHNICKNIPVIMMSSSDAMSTVFKCLSKGAVDFLVKPIRKNELKNLWQHVWRQRCHSSSGSGSESGIQTQKCTKSKGANESGNNSGSNDDEAGMGLNARDDSDNGSGTQAQNSWTKLAVEIDSPQAMSLDQLADPANSTCAQVIHSKSEICSHRWLPGSSNRNCKKQKYTNDDFKGKDLEIDGPGNLYMDHQSSPNERPIKAADHENNSKESMMGNLGDATVRAADLIGSMAKNMDAQQAARAADTPNFSSEVPEGKGKNDDFKGKDLEIGGPRNLYMDHQSSPNERPIKAADHENNSKESMIENLEEPTVRAADLIGSMAKNMDTQQAARAAEDTPNFSSKVPEGKGKNDQHDNYVLPSLELSLKRSRSCGDGANDTVNDDEQRNSALRRSNLSAFTRYHTSAASNQGGTGLVGSCSPHDNSSEAVKTDSTYNMKSNSDAAAIKQGSNGSSNNNDMGSTTKDVVTKPSTNNERVMLPSAIKANGYTSTFHPVQQWMVPDNATAGKAKADEVANNAGRNSHPGDVQSNLTQQHRPTLHYVHFENSGSGALQCGSSNVFDPPLEGQATNNYGVKAGSNSGSNKGQNNGSTAGASTAAANAGRTDTEIRAIDKSGPGGGSGSGNDTYVRRLAASMTPRQEQLKKYREKKKDRNFGKKVRYQSRKRLADQRPRVRGQFVKQAVQNQEGDGER

SEQ ID NO: 764 - protein, 531 aa, Zea mays
MAAESCGSRGASPPPPPSAGGAAGRRRKAEAYAEVLRRIRAGAGGYGAARPGLEDELWAHFQGLPARYALDVNVERVEDVLLHKKLLEQAHKPMNGLVFDVRPAQGFTLEESTGFESTTSFNQEEQDPQSSVFTSRDQRPLHEVIFACDDKPKLLSQLTSLLGELGLNIQEAHAYSTSDGYSLDIFVVDGWEYEADILQSALREGVDKIKYRAWPLVPSMSARMDHQPLEVSPSSDFVQIPADAADVWEVDLRLLKFEQKLASGSFGDLYHGTYCSQDVAIKVLKPERVSVDMLREFAQEVYIMKKVRHKNVVQFIGACTRPPVLCIITEFMHGGSIFDFLYNRRGNFQLPDVIRIASDVSKGMNYLHQINIVHRDLKTANLLMDDQVVKVADFGVARVKDQSGVMTAETGTYRWMAPEVIEHLPYDHRADVFSFGIVLWELLTGKLPYEDMTPLQAAVAVVQKDLRPTIAVDTHPMLAELLQRCWQKDPALRPTFAEIVDILNSIKEAVRSSMHHKRHSGRSHSGRRRGC

SEQ ID NO: 765 - protein, 356 aa, Zea mays
MGMAGEKFQLGTVGALSLSVVSSVSIVICNKALMSSLRFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLLGVGVATITDLQLNLVGSVLSLLAIITTCIAQIMTNTIQKKFKVSSTQLLYQSCPYQALTLFLVGPFLDGFLTNQNVFAFDYTTQVLFFIVLSCLISVSVNFSTFLVIGKTSPVTYQVLGHLKTCLVLAFGYVLLHDPFSWRNILGILIAVIGMVLYSYFCTRETQQKPAEASPQAIQAKEGESSPLILDSLSAAENGGSATDDEPLKVPMWSSKYSKA

SEQ ID NO: 766 - protein, 181 aa, Zea mays
MGKKSGRSGADAPKATAFVLKVAMHCRCDGCVPKIRAAVNKLTLRCEGIQSLDQSALDTKGELALVATADPERLRRRLREATGKSVDIVFPKPAAANGGSGSGREEANAAVQAQAQAQAQALLLAAGLQQQQQHGRPWYALQQGGYGPPPEPYVASYPATAWGAYPHNGLDDAYGGGWFGY

SEQ ID NO: 767 - protein, 145 aa, Zea mays
MNNQRKPGDWNCKNCQHLNFSRRDYCQRCRDPRPDLQFGDGYSTVGVLTSLDIRPGDWYCSCGYHNFASRSSCFKCGTIVRDFPAGQGAAGAEGDFAGGRDSAAVRAGWKAGDWICTRPGCNVHNFASRMECYRCNAPREAGTGR

SEQ ID NO: 768 - protein, 376 aa, Zea mays
MDVLKRELQRKRQLLNADFGGRKIIRRAEIEARELQRIREVERQLLLQKQHRHSRPLSSPSSSSSSSSPTSAAADADADASRAESGSKESLPREEVIRRLRVLRQPATLFGEDDIARLRRLQVLIEDPGALADIDAAEIGEGQTNDFLRDIQAMRAKAATVTKPKAAGAETERGEGDSVSIDVPFEELCDEDKITAFFRRLLNEWTQEVDGMPEAERRTAKGKAAIATCKQCTRYLDPLFKQCKKKALPSDVRQALLEVVKCCRRRDYLAAVDNYIKLAIGNSPWPIGVTMVGIHERSAREKIYTNSVAHIMNDETTRKYLQSVKRLITFCQRKYPTDPSRSVEFNSLANGSDLQSLLAQQNAKNSEETLRLVAAS

SEQ ID NO: 769 - protein, 402 aa, Zea mays
MAKGRAHPSKRPTHQLILAAVLSVSVLLPLLVPAAATVAVAVAEGGGKQLAVGKDEGKLVAEGDAGGGGLVEENEFAGGFGSLDSMLQWAIGNSDPEKLKEGAVDVQKLSADELLERRQEIKELMEKLKMPSDADLMKIAIDDLNNSSISLEDRQRALQELLVLVEPIDNANDLEKLGGLLPVIQELNNANEEIRTTSAWVLGTASQNNELVQNQILGYGALARLVKMGYSTSTEEAAKALYAISSLIRNNVNGQEAFHSENGSAMLQHILVSNNIDVRLQKKAVFLVTDLADFQLNSGIAQLPFLSDRLFLKSIVDMLSRFDLDLHEKVLLAIKSLLKLSSTDVEDFEFYDLDSVLLRLGVQLEDLTPEDQKEFAVEVDALRREVQTLFQQKLKQGKATST

SEQ ID NO: 770 - protein, 297 aa, Zea mays
MAFSSSLAPFFPPSGTFRAHPARRLRADAPGRFVASCLPPPDVVVTREQGKNARLISALEKHNVHPLELPLIKHVEGPDTDRLLDVLRNDKFDWIIVTSPEAAAVFLQGWKAAGSPKVRVAVVGEGTARVFHEVSESDDQSLELAFSPSKALGKVLASELPRSNRNSCKVLYPASAKAGHEIEDVLSERGFDVTRLNTYTTVPVEDVDPLTLNLAISAPVVAVASPSALRAWLNLISKSDNWNNSVACIGETTASAAKKLGVKSIYYPTTPGLEGWVESILEALRVHMTASKEAPKR

SEQ ID NO: 771 - protein, 155 aa, Zea mays
MESTALMTARLPLLTSGSRSKPLPFASFTTAACRLASAPCSGSGSVVLLSRRSRDYAGVGSLVSAAAAPGDTADAGSESILLSVQGMMCDGCAASVKRILESQPEVTSATVDFKEASAVVWTTDEAKGTQGWQKQYGEKLAKHLGTCGFESRLQE

SEQ ID NO: 772 - protein, 718 aa, Medicago truncatula
MFGFSRRRTKFGRLKVQQLSDGTRSPVTVRHPKRIPNSILNGEGEEDGDAVTGSSGHSHEIDNEIVSSTDISTTCSSGGSENWVLLSISGDKPAPRFNHAAAVIGNKIIVVGGESATGLLDDVQVLNFDTFSWTTASSKLYLSPSSLPLKIPACKGHSLVSYGKKALLIGGKTDPGSDRISVWAFDTESECWSLMEAKGDIPVARNGHSVVRASSYLILFGGEDAKRRKLNDLHMFDLKSLTWLPLHYTGTAPSPRLNHVAALYDDKVLYIFGGSSKSKTLNDLYSLDFETMAWSRVKVRGFHPSPRAGCCGVLCGTKWYITGGGSKKKRHGETLIFDIVKNEWSVAITSPPSSITTNKGFSMVLVQYKEKDYLVAFGGSKKEPSNQVEVLELDKNESALRRRSTPSKGPASILLEKHSSSTRLASQLNHCSQRLVDSVARQNLASAVEHGSGRKSLSESVDPNYPPSNVSLRKQFDRDEEYNADVKMDKNSDGSSLPQAAYHRTNENDRGKLMNIGGAKANIEGQVLLSGMSNQQNQVFENDALESDGVSFPENDKSGSLSSTNIYQYYESKVASLIRKNGMLEGQLAASMASREAAEKGLASVHKSRQEMEKKLADALREMELLREKLAGLELAQEEANNLSNIVHSDNVRLEHDVAFLKAVLDDTQKELHSTRGVIAGERARAFQLQYEVFHLKQRLQSMENRTSTTPRKPFHVQ

SEQ ID NO: 773 - protein, 213 aa, Sorghum bicolor
MASAVASQVALPKPVFLMDILASPSASARPLFSTGDAPPRSSSDGVKDTDGVKDSTGEDAAAADRRPERVPKLFTGDVLDLFPEAAIRDLLLALAEDGGGAASMTGFSPRGSSWVSKDDADAVQLKVAMPGLGKEHVKMRVEKDTLVIKGEGDKDSEGDDKKDPAGYICRIDLPSHAFKVDQIKAEMKNGVLMVTVPKIKDGERKDVFEIKVE

SEQ ID NO: 774 - protein, 709 aa, Sorghum bicolor
MASRVKEDERHEKIIRGLLKLPANKRCINCNNLGPQYVCTNFWTFVCTNCSGAHREFTHRVKSVSMAKFTAQEVTALQEGGNERAREVFFKEWDPQRNGYPDSSNADKLRNFIKHVYVERRYTGERSTDRPPRAKDDKDEYSENRRSDGNWGGSRSPPNGSYSDRRSYSGRSDDRNSRYSYGDRSPGYDQNDYKKSPRYFEVVDDRSGKITPVQRFEDRRFSEPRKPDSGSPDFQKEADGSSPVVRPVRDILGDNAPQLRVGEPSKPAAEPPKPSVVRPLDPPKSSVVRPIDPPKPNGTRAIDPPPLTKTISSASSIGSSEGTSEQTKVATAVSLIDFSADPEPASTAPPQPTPMPQQPPVNAAAPQPVLEQGKSAPSVSGGDWASFDAFGQQQTPQTSTSVNPLESALAQLSFSEAPSAPNASAYPASLDPTVKANDGGHSSVLDHSHSLFDAPFGISGNQASTVMSGQGSSVQQSPLAAPTAGFPSQATANPQGISGIQGAASSTDSKFSGRKELPADIFTALYPPSTPMMPGWQRAPQFGMGYAMQYPAGVFQGMQAYPHGAFPQPTYQQPMYSQHAYSHPQPVKASNPFDLGNESAPIQAHMPPSGPPGASAGLASQTLIGNSSFGVPPQQPHQLYQSAAQPSHFMMQQVPNSMPMPEQQPNSMLATQQGLGSFNMGFDQQAPPRYPQPNTPPSYGSVGGSNPFG

SEQ ID NO: 775 - protein, 651 aa, Sorghum bicolor
MIMDPRPRDNLNFGARLPTPNPPTPHMISFSLQQPQPQFFPSYGFHSHNHNNPAISSHPSPPSVMPGCTTPSPASTTTTEADNAEDLSEAVADDAVLAYINQFLLEDEDEESYPVTSVPVEDSVLLAAVEKPFVDILKSANHITAKAYEVKSWITDDCHSTGSGRFHDVVTSTLDSTQLAPEMVQGDVVDAVHKGQKNPRDNDLEVERRKSKQSALCDEETVREMFDKVLLCTDKNCAFHSPMPADAQNSGGYVKGSGNRRGRRKGRSGAGAEQEPVDLTTLLIHCAQAAAIDDHRNSSEHLKQIRKHSSATGDAGQRLAHYFADGLEARLAGTGSSIYRSLAAKRTSTGDMLKAFNLYVKACPFRIISHYVANTTILNATKSVTRLHIIDYGIMYGFQWPILMQRLSKRSGGPPTLRITGIDFPLSGFRPAERVEATGRRLHEYARMFNVPFEYQAIAAKWDTIQVKDLNIKSDEFIVVNCLYRMRNMMDETATDDSPRTRVLNTIRKLNPHLFVHGIVNGTYNAPFFVTRFKEAMFFFSSIFDMLEANASRMDEHRLLIEREFFGREAINVIACEGTERIERPETYKQWQMRNLRAGFRQLPLDREIMARARYKVSKTYPRDFLVDEDNKWMLQGWKGRVIYALSAWST

SEQ ID NO: 776 - protein, 759 aa, Sorghum bicolor
MMKHPIAIARLLSIRRLLLLVLQQLCLLPLVSVVLSAAAAVPPPAHRRPPESCPSRCGDVDIPYPFGIIGGDDQQHCAIHTGFNVNCTRLVDGTERPFMGPFEVTSISVPDAKAWMKMNISWRCYDSRTNPTTWSTRRENFTHTPFRFSHQDNKIFVVGCNTLGYITSEYYSIGCLSECYNKPRNMSWCSAGSGCCEADVPIDMGYSRSYFNSEYNYTGCGYIAVMEEKMFSYSTTYRNSSTSFFDAYNGTVPVVMDWRIRRYTCEEAKLNSSSYACVSNNSQCVNTTNGPGYRCKCQDGYQGNPYVSDGCTDIDECVQDNMNDYCTARGATCQNTQGNFTCLCPPGKSMTNGICMAHHKSSSWLIPVVGASVGLVVLVVTLTCAYLIQQRKVHHTKQRYIQQYGDMRIFEKMKSQQGFKIFTEAQLQEATNKFNEKRVLGHGGQGTVYKGLVEGNVEVAVKRCMSIDEQHKREFGKEMLILSQINHKNIVKLLGCCLEVQVPMLVYEFIPNGTLFQLIHGNHGRQISLAIRIQIAHQSTEALAYLHSWASPPIFHGDVKSSNILIDRDYTAKVSDFGASILAPTDESQFVTFVQGTCGYLDPEYMQTCQLTDKSDVYSFGVVLLELLTRKKPFKFDGPEDEKSLAVRFISVAKQGKLEEILDDHIKNDESMEVLQEVAELAMQCLEMSGANRPTMKEVSERLDSLRKVMQHAQQQHNNPEEMEPLLGESSLASSDEVVVSTGNLSIEMEAARSLERGR

SEQ ID NO: 777 - protein, 477 aa, Sorghum bicolor
MATLPSASRWSSSTAWPRRAAGAASTALAAAVFAVLDVADAVLCFVYALLDGILEDSPVRCYCHRSYDDGVDGGDHEHEEVSDTLYARGRRSAVRDAILYLLRHVVGRRGRAPPDETVAPCKWRSPRWSDCACKSCVAWRGGEGEGEGGGGRLHVVVKEPQPYRKDAGRKQSETTTTRDPENAIFVHGFTSSSSFWAETVFRESSSVLHDYRLFAVDLLGFGRSPKPANCKYRVRDHVEAIERSLGEPPQSLMSGSGSFHLVAHSMGCIIALALAAKHPTRVKSITLVAPPYFLACEQKQASQVALNRLAEKKLWPPLLFGSAVMSWYEHVGRTVCLVVCKNHLLWEWLFSLFTGNNTGVDFRVRDLTKHTHHSAWHTMHNVICGGAALQDTNLEAVAAAGIPVQAVHGADDQVVPVECSRHLKAKLPRAKLRVNVMDRRDHATVVLGRERDFAEELKAFWVWGSATPSTKRRFRGC

SEQ ID NO: 778 - protein, 424 aa, Sorghum bicolor
MGKHEFLTPKAIANRIKAKGLQKLRWYCQMCQKQCRDENGFKCHCMSESHQRQMQVFGMAPDRVVEGFSEEFFESFLSLIRRAHRHSRVAATVVYNEYIADRHHVHMNSTRWATLTEFVKFLGREGYCKVEDTPKGWFMTYIDRDSEQAVKDRLKRKRIKSDMAEDERQERMIARQIERAQKSLSKPNDGDVAEGESESGSEEEYSGSDDDGEEREDDAKEANKATGKIAIALQKAMPGPKVNPFEDKPKMKFGFDEEDDSGTQEKVKDEVPKKKGKDVKAAEARRSALDELMKEEEKAKERSNRKDYWLCPGIVVKVMSKSLAEKGYYKQKGVVKKVIDKYVGEIEMLESKHVLRVDQDELETVIPQIGGLVRIVNGAYRGSNARLLSVDTEKFCAKVQVEKGLYDGKVLRAVEYEDICKISS

SEQ ID NO: 779 - protein, 391 aa, Sorghum bicolor
MSETESAAVAAALDPAATAEPKPRRLRGHKKGAVTCCVASSARPGVVASSGEDGCLCWFDLRTKDVLLTMEAANKPISSICFKPGNEDCVYISAGNEILSFDVRMGAQSKPLETYNYNRDEINQIAVSSKGFLAAADDSGDVKIVNTIQKCLYKRLREAHTSICSSVQFIPWRPWTAITGGLDSKLVAWDFSKGRTLFSIDYGSPELQNGNSSGSAGQCFNPAFVHSIAVSEEGILGGLYKVCAVARGDGAVDVIDLEYELAPAKSKGPPRAAISKKSSKGAELGDGSCNQSQAKRIHLDYTMGGHTAAVSCVAFSVFGEKGKFLVSGGNDASVKLWDWSKGFSSETNSKVELVLNIDVKKKVNWLCTAPTDSDNLIVCDTSKVVKVYNFR

SEQ ID NO: 780 - protein, 440 aa, Sorghum bicolor
MDPSLSSSPLRLSGTPAGPGATLTTPKPTLVAAAGPGRQPTTTTCLRAISPSPSPSPPTPVESFGFDALKETFSVDVAAADARPLDVPLAAPFTIASSRLVAVSNVAVRVELRSGAVGWGEAPVLPSVTAEDQPAALDAAGRACAALEDASAAPLGALLQDVASVLPGHAFASARAGVEMALIDAVANSIRIPLWRLFGGASDSVTTDITIPIVTPNEAAQLAAKYRGQGFQTLKLKVGKNLNSDIEVLKAIRLVHPDCSFILDANEGYTANQAIEVLDRLNEMGVTPVLFEQPVHRDDWDGLRDVSSVAMEKYKVAVAADESCRSLLDAQKIIQGNLAHVINIKLAKLGILGALEIIDAARKANISLMIGGMVETRIAMGFAGHLAAGLGCFSFVDLDTPLLLSEDPVYGGYEAFGPLYKFTNARGHGGFLHLDNDASK

SEQ ID NO: 781 - protein, 600 aa, Sorghum bicolor
MFSWNDEQQQVGDAIWTEFNESEDHIMPYPKGAEDSTTRKNNEKEVASIDGITEHSEGVQTGLQRMEKQTANQTSAHFSATRIDMESWPDLPSLNPTLDRNYSDDNITSTYLDFSAEPSLQKVTGKATGQLDGESEVFSNDQEEKSNSFLDCDWGNIGDFDDFDRLFSNSDSIFGNEIVANDSDFLSASSNLMDNAVQSIPILQLPLNKQPSCDRGPSLLLTNEISSGVTKQENKVEVQKRPVRSRRKPEERGKSKISSSTSGFSQSKVENASTNLQAPMQPVQTPQYALFQDSKKIGQVQHVNQFMFPGYGYPAYPFPTIPLVSNIQAEGYLTKPTGTSYRTLEDSPKQSSSIEMSQDIPSRALIMTPQEKIEKLRRRQQMQALLAIQQQQQQFGQEGSGSDTMVSQAYSPRNKNPDSLGSSIVIDENANKVFSPEVIPTNHDLVHKSSAISVDPFIEEKIYYQLQDALGKLDTKTRLCIRDSLLRLAYSAAERQIDGDRSSTNKTNKDDDEASENDASTRRTRSPTREAETITNPIDRIVAHLLFHRHCSKVATATKEEIISSTPLILEPEPKVPLGTPRLPSQDQRDEQEIVLPLSQ

SEQ ID NO: 782 - protein, 798 aa, Sorghum bicolor
MGSDLKEMKYRRRIGVEERPQCSDPRGGGADWPALQQDPVELLRKLDELRDQITRSCNVVGQPREHRRVSRRAVSMLPEQLEPPPLPAYHRSRYGGRYGHGLPPPSPYAPPRPEHGERYVRQSSGHYRQYPATGRQWENGGMGPGGYHHYGCACPHCLHGQRPLQQEENIPMARYFAGQHESYRFQRSPSVSSDYDRRSVASSLYSHRSVSKRRAEYFRKKAEHICRPVDGAAPFSVCSSCYKLLQMPMGKCIGRKQNRFQCGSCCQIISLKHEEENGIPFVPSSSLYAPEMEQCSSDQMRRDSAHQRHEDFNSMFYNSIDHSNMQNNMDFTDDNSLSSTMSNDRIEKECGSTRSIQSKAEGLSFSPSRSVDIGSPKDILCEREADCKVEPSVDGPLGPRSPALEDKLVDPLCAQENGNDEDDQGMPYRSDLTCKGEYDVNDEYDVGISTRSKQESNEDDKDATEDERSYRSYEQKSKSKEDDCCNVEDSSKTYRQNSGEDDASSLVDGSEKYECMNIKDDDSSPGGEDTWNKYEPKVKGDENCVLGAESIHNNCDENNKDFIGTGSISLRHEELKIEEDNGKLQQPFIEDANSQAGSGSSINERTNSGFSRGSSETGLDEDQSSTGKSGDSSFFAGFLKKGFKDLSLLNKSMDSVKVSINGHPISERALKKAEKKAGPVDPGSYWYDYRAGFWGVMGRECIGIVPPFIREFNYPMARDCAGGDTGVFVNGRELHQRDLDLLVGRGLPRISGKSYSIEMSGNVIDEATGKKLRSLGKLAPTIEKLKRGFGMHVPEEFR

SEQ ID NO: 783 - protein, 276 aa, Sorghum bicolor
MRDMEDRSVVSRRHEPTTVARTADDDDDVASGDEDSDSDAEFEFPFVSRESEAAADELFAGGRIRAFYPVFGRVLDDEAPAPAPRSPLGRLFQLEQARTSSVASTSSSSSSSTAGAGAAGLDGASPDSYCLWTPGSASAASSPSRSPRKSGSTGSIPRWRRIGELVVGRSHSDGKEKFLFLSAPPSPARDREREHSSPASKSKSKPKQPQPKGSKTAAAAAATELDTVAAGRRVSYGGANAKASTGGARRTFLPYRQDLVGLFANVRGLSRSHHPF

SEQ ID NO: 784 - protein, 603 aa, Sorghum bicolor
MSATIDRLATPCHEGHAHSDGKRECNSDEENSEGERKPKKGSLKKRAATAGYKFRHSLRRKSKTKDDNHVASIEDIRDVQELETVERFRQCLLDEGLLPEHHDDYHTMLRFLKARKFNIDKAKHMWSEMLRWRKEFGADNIEEFDYTELDEVVKYYPQFYHGVDKEGRPVYIELIGKVDTNKLVQITTIDRYVKYHVKEFERCLQMRFPACSIAAKRHIDSSTTILDVKGVGLKNFSKDARELIMRLQKINNDNYPETLYRLYIINAGQGFKMLWGTIKSFLDPETASKIHVLGNKYQTKLLEIIDGSELPEFLGGKCRCEEYGGCPKSDKGPWKDPEIVKRVINGEANYGRHVLAVSSINQKEVGCTEHSTEQEKGNDASAESISEVEDVSSPTALVDPISPNLTHVDESKFPGRASSSDAPPITGDSIPAVDKVVDACSNPRNSSTPSSSGSFSLRNIPATLGGLKTRIVAWSTILVLSLLAFLRSVLSIVTKRLSNQAITCDHYSADFRQGYTGNGTLTSVLTRLGELEEKIQTLEAKPPQVPFEKEELLRTSVYRVDVLEAELISMKKVLYETLIRQDELLAYIDQQQTAKFCRRKFCF

SEQ ID NO: 785 - protein, 1118 aa, Sorghum bicolor
MAVSGAPEQPQREQPQQDHDEEMLVPHQDAIEGPQQDVVEGPQPMEESASAVENQLVPDTSTSRFTWCIENFSRRNVRKHYSDDFIVGGYKWRVLVFPRGNNGDHLSMYLDVADSNLLPPGWSRNAQFSLAVVNQLDSKASLRKEAIHQFNSRESDWGFTSFMPLLDLYDSSKGYVVNDKCIIEAEVAVRKTFDFWNYDSKRMTGYVGLKNQGATCYMNSLLQTLYHIPYFRKAVYHMPTTENDTPSGNIPLALQSLFYKLQHCDNSVATKELTKSFGWDSYDSFMQHDVQELNRVLCEKLENKMKGTPVEGAIQKLFEGHHMNYIECINVDSKSTRKESFYDLALDVKGCSDVYASFDKYVAQERLEGDNKYQSEEHGLQDAKKGMLFIDFPPVLQLQLKRFEYDFVRDTMLKINDRYEFPLQLDLDRDDGKYLSPDADRSVRNLYTLHSVLVHSGGVHGGHYYAFIRPKLSDQWYKFEDERVTKEDMKRALEEQYGGEEELPHTNGLKNAPIRFTKHSNAYMLVYIRESDKEKIICDLDDEDIPDHLKVRLRKEQEEKECKKKEKAEAHMFTALKVARDSDFKEQIGRHMHFDLVDFDKVNSFRAPKNMSINDVKEELSKEFGIPVESQRFWVWAKRQNFTYRPSRPLTFLEETSAIGYLKDAIVAKLPNSEVRLFLEVHLGQENQGIASGKTKEDILIFFKLYDPEKEDLRYVGNFFVKASGKPSDIVERLNEIAGFPSDEDIELYEEVKFEPAVMCVPIESNISFRSSQIDNGDIICYQKRCLPDSMDRYRYPSVPSFFEYIHNRQVVYFRLLDKPKEEGFSLELSKRSTYDDVVEKVARQLRLDDPSKIRLTQHNLSSQQPKPHHIKYRSLNYLSDMLHNHNQMCNILYYDVLDIPLPELESTRSLKITFENATNHEMSFHTMRLPKSNTLLDLIEDLKSKVELSCNDAEFRFFGVHLHKICKVYQPGDKIDSVNEPLYIEEVPEEEKNAGPHDRLVHVYHFEDNRHVQYFGEPFFFLIRDGEALSDIKVRIQKRLQVPDEQFIKWKFAHVTFSRPEYLQDSDIVLNRFHKQKPVYGAWEQHLGLEHTATTPRRSYFGSQNRHSFERPVKIYN

SEQ ID NO: 786 - protein, 652 aa, Sorghum bicolor
MSLSPLDSSSPPAAAEVPLAPGFRFHPTDEELVSYYLRRRVLGRRLRVDAIAEVDLYRLEPWDLPSLSRIRSRDAQWYFFARLDRKVAGAGAGGRGGPGNRTNRATPRGYWKTTGKDREVHHRGKPVGMKKTLVFHAGRAPKGERTNWVMHEYRLLDADGPQDLHVVCRIFQKHGSGPQNGAQYGAPYMEEEWEEDDDAIENGPTSGASAQMAAITCAVDEESNEDDENAYCETNRPARVEPSHLPLVHEMLNPPEMAPQQGQDSKETSDGSCADGAISLEEVLQEPLSNISVENIGRLEGQNATDDSINVDDLLSAYPRKDNGYVGQDNTMNGSGPADGDHTSWPLRAYSNQNYVNGPLADEFFDTGNDTNGVAYSGQQQADGFPAPRQVDNSMVFYDAPSDYNLVDGNDDFVYLNDLLNEPLGNESLFDGDDVMAYFDATENDFKYDILGSAQGSNYQLADMPLNFAQKSDNKDKFTFDGISEVPEANAQYGASSSGSHEDLYADTEFPGVPTDDTADKTYGKRLASMLGSIPAPPAMASEFPPSTGKSVGMLSAVSSSSIRVTAGIIQLDGLTFSSGSDRWPLQKNGDLSLLVSFAVESDVSSKLPVGLEDATRISTVPMVMRSGFYLFFMSAMILLLSYKVGSCIYSR

SEQ ID NO: 787 - protein, 599 aa, Sorghum bicolor
MAASSMDRITQWVSSQVQQVSADLTVRIADSVFPLHKAVMVPKCGYIRRAVAAAATSQTQGPGPASVELDLSALPGGADAFEKAARYCYGGSLEITARDAAAVRCAAAFLDAPDLARRAEDYLAQTALRSLPGAAAVLRSCECEALLRAAEETGVARRAADAVALGVCNEALFPTARAAPGWWVAELAALSPASFRKVVTALRCRRAGPEVVAAAAVAYAERVLAGVLAPAAPGRRDAVAVVARNADADADRRALLEAVVDALPPAADAPLPAAFLCRLLHAVVTAEASAKTCRDMELRVAGVLHQATAGDLLGVALDGAGERVRNADTVRRVVAAFVERPQTQEGRRASLAGGPAAGELGALEKVAKTVDEVAAEMATEESLGISKFVGVAGAVPKDARASHDCLYRAVDIYLKTHPGLDEIEREKVCSVMDPLRLSYQARLHASQNKRLPLQAVLSALYYDQLKLRSADGGGGDGAEGGAGWEPQSAAGKARAQARADASLARENEALRSELARMRAYVSGMQQHSKGSGSRSSSASLVPASAAGKKASFLGSVSRTLSRLNPFKGGWAKDTASIADGRDRSAMHVVKPKRRRFSIG

SEQ ID NO: 788 - protein, 302 aa, Sorghum bicolor
MRQWKSLVPAALHLHGSAASCFPHPPSSPRAAAEETTTDDLQLPSQGAAAAKGAAVRLVGCDGRVRAYAPPVTARELMQEHPRHLVCRADALLIGEKIPAVAPGEELQPGEAYFLLPAHLFRSVLSFVSLASSLLLLLSSSSSSTTTAAGAGAGAGAGKKAGAGRPFELHRTASGTLQIKFSDDFLLADNGNGEDEEEEDEAPAQKEQQQRAVLLRGDDRLAKDYEELVGYSKSRRWAPKLETIEEAVPPAAAAAPESAGAASPKAQRGGRKSRALPFLGRLGSRRRSRDRDACSAVVACSG

SEQ ID NO: 789 - protein, 107 aa, Sorghum bicolor
MAMEHVARLASERAVVVFTASNCSMGDVVTSLLSSLGVNAAVHDLDRDPRGLEMQRELARRLGAGGTPTVPAVFVGGDLVGGTSRVMALHLSGELVPMLRNAGALWL

SEQ ID NO: 790 - protein, 429 aa, Sorghum bicolor
MNEAAGTVVCGELIVGAMAQSWRFLMQGVTSLLFLCARAAAADDDEYVRPPPCPLVLVAHDKPAWHPQQVHISVVGSDHMRVSWVTDDRRAPSVVEYGTSPGNYTASSTGDHTTYRYFFYKSGAIHHVTIGPLEPSTTYYYRCGRSGDEFTLRTPPSTLPIEFVVVGDLGETGWTASTLSHITAGGGGDYDMLLLPGDLSYNADTQQPLWDSFGRLVQPLASARPWMVTEGNHEVEALPGIPVVGELVKPFVAYNARWRMPYDDGDDEASGSSSSSTTSNLYYSFDAAGGAAHVVMLGSYAAFVEGSEQHRWLARDLARVDRRRTPWLLVLLHAPWYNTNQAHQGEGERMRVAMERLLYEARVDVVFAGHVHAYERFTRIYDNEADSRGPMYITIGDGGNRKALLSSSSRTTSRRTCRSFGRRASGMAG

SEQ ID NO: 791 - protein, 342 aa, Sorghum bicolor
MEKMLHAAPVHATLPECFIFPSDKLPQAKSTSGAVSLPIIDLSLGRDEVRRAILHAGKEIGFFQVVNHGVSLEAMRDMEAVCQEFFALPAEDKAGLYSEDTGKATRIYSSTMFDTGAEKYWRDCLRLACSFPDVGDSPRGWPDKPARLREVVERFTAQTRGLGMHILRLLCEGLGLRPDYLDGDISGGDVVLHVNHYPPCPDPTATLGLPPHCDRNLLTLLLPSMVRGLEVSYNGDWIKVDPVAGAFVVNFGCQLEVVTNGTLKSIEHRVMTNLGVARTTVATFIMPTTDCLIGPAAEFLSDDNPPAYRTMTFGEFKRIYSVVKLGLSLNLTTNLKDVQKQV

SEQ ID NO: 792 - protein, 666 aa, Sorghum bicolor
MAGEAAERVAAAVEAVGSGGWEFRNAYRRQLLALSRRIRLLGPFAEELREARRGRPAEEEEEQERALAPLADALEEALDLLQLGRDGSRIFLVLDRNKVMKKFHESIAQLEQALCDFPYDKLDISDEVTEQVELVHVQLKRAKERVDMPDDEFYHELLSLYNKSHDPSAELDILGRLSEKLHLTTITDLTQESLALHEMVASGGGNDPGEHIEKMSMLLKKIKDFVQTQNPEMGPPVTTKVMDSNGEPRPINIPDEFRCPISLELMKDPVIVATGQTYERAFIEKWIASGHHTCPNTQQRMPNTTLTPNYVLRSLIAQWCEANGIDPPKRPTEADKPTSSCSPSERAIIDALLSKLCSADPEEQRSAAAELRLLAKRNANNRICIAEAGAIPLLLSLLSSSDLQTQEHAVTALLNLSIHEDNKSSIILSGAVPGIVHVLKNGSMQARENAAATLFSLSVVDEYKVTIGGTGAIPALVVLLSEGSPRGMKDAAAALFNLCIYQGNKGRAIRAGLVPLIMGLVTNPTGALLDEAMAILSILSSHPEGKAAIGAAEPVPVLVEMIGSGSPRNRENAAAVMLHLSVHNGHLARAQECGIMVPLRELALNGTDRGKRKAVQLLERMSRFLVMQHEDTVSQQLDEIERQFAALGPNVTEADLEQLGEQLGYL

SEQ ID NO: 793 - protein, 135 aa, Sorghum bicolor
MASSLASTPVFPSCGARRGARCVARASASAVAVASPSAARTHYEVLGVGAGASRCEIKAAYRRLAREVHPDAGGRGDEGFIRLHDAYATLADPDERARYDRAVAVAAPVRSGSWAAPSGSGSGFRPRRWETDQCW

SEQ ID NO: 794 - protein, 510 aa, Triticum aestivum
MSSHEACCGTMFWVYLLSCAGLVMFAGLMSGLTLGLMSLSLVDLEVLAKAGTPQDRRNAARILPVVKNQHLLLCTLLIGNSLAMEALPIFLDSLVPSFGAILISVTLILAFGEIMPQAICTRYGLSMGAKAAPIVRVLLVVFFPVAYPISKLLDWLLGKGHVALMRRAELKTLVDMHGDAAGKGGELTHDETTIIAGALEMTQKSAKDAMTPISETFSLDINAKLDVHTVGMIMTKGHSRIPIYSGRPSNIIGLILVKNLLTCRPEDEVPTRHVTIRKIPRVADDLPLYDILNEFQKGHSHMAVVVKRTKEDGASAEKNNSFTPDYKMTNGHAHADGLGLSPSHVNISGSRRNNNDKYSKKIERKRDNILDFNTDPLPHYSMDEEAVGIITMEDVMEQLLQEDILDETDEYVDVHNKIKINMLPPGKSLSPLISPSGGPLSQGLRKTPMASPLSPYHNGGSILRSPVTNHARSPGTLPTMFSPGRSPASQTPVRGSPTSSWVSRNSYRNP

SEQ ID NO: 795 - DNA, 1630 bp, Triticum aestivum
gcaagccgataagcacgtcgtggtacgatcaagtcaaccgccgcagccgccaccgcatccgccgccgcctcctctcctgcacctcgcgatcgagagatatcgctgatcacttgctcgcttccttccttctcctccgccgatcgaacgtgttcttccgtgtccgcggcaatggagagcgtggaggggaacggcaccggccgcgggaacctgcagcttgtggtgtcggaactgtgccgagtccaggagctggtccggcagctggagctgcacctacacgcaccggacgcctccatcgacctgtgccgcgccctcaccgccgagatcttcgcgctcaccgaccggtccatcggcttcgtcgccgccgcacatttccccgacgccccgaccacgccctccagcacgtccagctccctcagcggcgtctccgaccagcccttcaggaccaacaccaagaagaggaaggcgacggcgaggtggacgagccaggtgagggtgagtgcggccggcggcgcggaggggcctggcgacgacggccacagctggaggaagtacgggcagaaggacatcctcggcgccaagcacccgagggcctactaccgctgcacccaccgcaactcgcagggctgccccgccaccaagcaggtgcagcgcgccgaccaggaccccgcgctcttcgacgtcgtctaccacggccagcacacctgcaggccaacgggcggtaggaggccgccgacgaaccaacacaacccgcacgcggagagcctgctgcagagcctcagagccggcctgaccgtggacgcggaccacggcgccctgaacaacacctcagtctcaccgccgtcgatggcctcgcctgtggcgtctggctccaacggtggtctggccatgtcgccgtacccggtgccagccggcgcgtacacggagtggccgctggacggcgacctccaggaggtggtgtcggcgctcacagccgtgtcggccccgagcatggactgccttttcgagttcgacccgaccttcggcgttggtgtgcccaacttcttcatgtgaggacgacgaacagagcatcgaagtggaattgtgacactacccagcccctgcctgtccttggtaagagggtagaagaacagagcatcttcaaagtgcagatttaggcactaggcagaaagccttaggatatctgaatagttatttcttttcttctactacagttttgattggttaggttctgttgatttattttgtaagaaagcggagaaaaaataaggtgttgaaattcatgttctcctgaatccatgaactgtatcctggaactgtcctttaaagcccgctatgtctatggacattggaggagtgttcctttgttgtgaaggaagtatctgctccttttgtcaagaacttttttctctcgtagaatcaaatgttctgagactgataagaagaaacgttggagcacatcaaatataaacagagtgagaaacacgtccggtttcatgttgtcagacactactgtgagaaaacaagatgcacatttggaggtctcaataaagaagcaaacttccagaaatgcattaccacaacaactagtggttacaatgacagtcgccaaagtcctaatctgagctcgagc

SEQ ID NO: 796 - DNA, 1153 bp, Secale cereale
cgcgatcgagagatatcgctgatcacttgctcgcttccttctcgtccgccgatcgaacgtgttcttccgtgtccgcggcaatggagagcgtggagggaaacggcaccggccgcgggaacctgcagcttgtggtgtcggaactgtgccgcgtccaggagctggtacggcagctggagctgcacctgcacgcgccggacacctccatcgacctgtgccgcgccctcaccgccgagatcttcgcgctcaccgaccggtccatcggcttcgtcgccgcgcatttccccgacgccccgacgacgccctccagcacgtccagctccctcagcggcgtctccgaccagcccttcaggaccaacaccaagaagaggaaggcgacggcgaggtggacgagccaggtgagggtgagtgcggccggcggcgcggaggggcccggcgacgacggccacagctggaggaagtacgggcagaaggacatcctcggcgccaagcacccgagggcctactaccgctgcacccaccgcaactcgcagggctgccccgccaccaagcaggtgcagcgcgccgacgaggaccccgcgatcttcgacgtcgtctaccacggccagcatacctgcagggcaacaggcggcggcaggaggccgccgacgaaccaacacaacaacccgcacgcggagagcctgcctgcagagcctcaaagccggcctgaccgtggacgcggaccacggcggcctgaacgccagtgtctcgccgccgtcgatggcctcgcccgtggcgtctggctccaacggtggtctgaccatgtcgccgtacccggtgccggccggcgcgtacgcggagtggcctttggacggcgacctccaggaggtggtgtcggcgctcacagccgtgtcagccccgagcatggactgccttttcgagttcgacccggccttcggcgatggtgtgcccaacttcttcatgtgaggacgacgaacagagcatggaagtgccttaggatatctgatgatgatgaatagcttaccctgttcccttctttctttcttttcttctacagtttttgtttggttaggtttatcagttttgctaggtttattgattttgttttttgtaaggaaagcagaaaataataataaggtgttgaattgtatgttct

SEQ ID NO: 797 - DNA, 2420 bp, Secale cereale
cgtactggaaggaaggaagaggagcaagaaccaagaaagaatcgtctctcttaacgagaacgcagcgtctcttttgaatatttgttagctgcggacaggccttcttccgtcatgtgctccggtccgcgcaagccgtcgaccccgccgccggtggcggcggcgccgaaggattcggtggatatcgcctcgctcctgctggagctggcggcggcggataacgtggtggagtttaggcgggtcgtggaggaggagaaggcgtgccttgatgctgcgggatcgtggtatgggccgtcggctgtcggccttggccggctggccgcggagagccggacgccggccatggtcgccgcgctctacgggagcacggccgtgctggcgcacgcgctgtccgtcgctccgggcgaggcctgccgcgcgtctgatacggacggcgccaccgcgctccatatggctgctgccggcggcgcggccaacgccgtcgcggccacgcacctgctcctcgccgcgggggcctccacggaggcgctctcggtgtccgggctccgcgccggggacctgctcccgcgcgccgcaggcgtgtcggagaagccactccgcctgctgctcaagtcccccgccgtgtcgccctcctcgtcgcccaagaagtccgcctcgccgccggcgatggtcgccgcgcaggagcccaggaaggagtacccgccggacctgacgctgccggacctcaagagcgggctcttcagcaccgacgagttccgcatgtacagcttcaaggtgaagccctgctcccgcgcctactcccacgactggaccgagtgccccttcgtgcaccccggcgagaacgcgcgccgccgcgacccgcgccgctactcctacagctgcgtgccctgcccggagttccgcaagggcgggtcgtgccgcaagggcgacggctgcgagtacgcgcacggcgtcttcgagtgctggctccacccggcgcagtaccggacgcgcctctgcaaggacgaggtcggctgcgcgcgccgcatctgcttcttcgcgcacaggcgcgacgagctccgctccgtcaacccctccgccgtctccgtgggcatgatgcagcccgtctccccgcgctcctcgcctcccaacgggatggacatggggatgctcaaccccgcggggtggccgtcgtccccggtcagccggctcaagaccgcgcgggagctcgacttcgacctggagatgctcgcgctggaccagtaccagcagaagctgttcgacaaggtgtccaacaacgcgcactcgccgagggcgagctggggcgcgcccaacggcggcctcggctcgccgcacgccgccgggtcgcccgcaagaaacatgccggactacaccgacctgctcgggtccatggacccggccatgctttcccagctccacgcgctgtcgctgaagcaggcgggcgacatgtcgccgtacagctccatgccggacacgcagctgcacatgccgacctcgccgatggtgggcgcgaacaactcgttcggcctcgaccactccatggccaaggccatcatgacctcgcgcgcctccgcgttcgccaagcgcagccagagcttcatcgaccgcggcgcgcgcgccccggccgcgcgctccctcatgtcgccggccaccacgatcggcgagccctccatgctcgccgactggggctctcccagcggcggcggcaacctcgactggggctcacccggcggcaagctggactggggcgtgcagggagacgagctgcacaagttccgcaagtcggcgtccttcgggttccgcgggcagaccgccatgccggcggccgccgcagccaccccggccgaacccgacgtctcatgggtgaactctcttgtcaaggatggccacacaggcgaccattttccgcagtggctggagcaggagcagatggtggcctgatcccaccccgtcgacgatcgatcaattcactggctcatagcatctagctgaccaaagttctttccttcaaattttttccacccctttttatttgcttaatttgattcatatgagatggttctttagtacgtacatatatgctgttcacaaaaataaacattgctcatcagcaatcagcatggatgcccaaagggagccttaggttgatgaagaacagcaccaccaatatttactctttttcccccttcccctcggtttattataaatactagctgtatacaagaattccatcaagagtttatttacttggtatttatatatacatactttgagacctagcaagatttgtcccgtgtctcttgattgataacttgaacttgtgctaatatctactcttctcattgtccaaaagtgtacatacaatggaagtggttacaccaagacctaaaaaaaaaaaaaacgtaagagtacccgaacggaca

SEQ ID NO: 798 - DNA, 2252 bp, Avena sativa
ccctccctccctcctcttgtcccaatcacgaacgtactcgaagaagaagaagagaatcgtgtccggccctccctcataacgagaacgcaagaaagtatcttgaatctttctggtatatagctcagtttagtcgcgccgccatgtgctctggcccgcgcaagccctccaccccgccgcctccggtgcaggattccacggcgatggcctcgcttcttctcgagctggcggcggaggacgacgtggcggagttcaggcgggccgtggaggaggacaaggcgtgcttggacgttgaggcttcttggtacggtccctccgcggtaggccagggccggctggcgaccgagagccggacgccggccatggtcgccgcgctgtacgggagcgcgtcggtgctggcgtacgcgctgtccgtctcgcctcgcgaggccacccgcgcgtcgggcacggacggcgccacggcgcttcacctcgcggcggcgggcggcgccgcgaacgcggtcgcggccacgcacctgctgctcgcggcgggcgcgtccaccgaggcgctctcggcgtccgggctccgcgcgggcgacctcctcccgcgcgccgccaccgccgccgagaagccgctccggctcctgctcaagtccccggcctcgtcgccgtcgtcctcgcccaagaagtccgcgacgatggccgccgcggcgcaggagcccaggaaggagtacccgccggacctgacgctgccggacctcaagagcggcctcttcagcaccgacgacttccgcatgtacagcttcaaggtgaagccctgctcccgcgcctactcccacgactggaccgagtgccccttcgtgcacccgggcgagaacgcgcgccgccgcgacccgcgccgctactcctacagctgcgtgccctgcccggagttccgcaagggcggctcctgccgcaagggcgacggctgcgagtacgcgcacggggtcttcgagtgctggctccacccggcgcagtaccggacgcgcctctgcaaggacgaggtcggctgcgcgcgccgcatctgcttcttcgcgcacaggcgcgacgagctccgctccgtcaacccctccgcggtctccgtcggcatgatgcagcccgtctccccgcgctcctcgcctcccaacgggatggacggcatggggatgctcaacccgggggcgtggccgtcgtcgccggccagcaggctcaagacggccagggagctcgacttcgacctggagatgctcgcgctcgaccagtaccagcagaagctgtttgacaaggtgtccagcagcgcgcactcgcccagggctagctggggcgcgcccaacggcggcctcggctcgccgcgcgccgccgcgtcgcctggcagaaacatgccggactacaccgacctgctcggctccatggacacggccatgctgtcccagctccacgcgctctcgctgaagcaggcaggcgacatgtcgccatacagctcgctgccggactcgcagctgcacatgccgacctcgcccatgatgggcgccaacaactccttcggcctcgaccactccatggccaaggccatcatgacctcccgcgcctccgcgttcgctaagcgtagccagagcttcatcgaccgtggcgcccgtgcccccgcggcgcgctccctcatgtcgccggccacgatcggcgagccggctatgctcacggactggggctctcccagcggcaatctcgactggggctcgcccagcggcaagctcgactggggcgtccagggcgacgagctgcacaagttccgcaagtccgcgtcttttggattccgcgggcaatccgccatgccggcgacctctccggccacccaggccgaaccggacgtgtcatgggttaactctcttgtcaaggatggccacgccggcggcgaccattttccgcagtggctggagcaggagcagatggtggcctaatttgccgttgatgatcatcaccggctcatagcacctagctgaccaaagttctttccttcaattgttttccctttttatttgctttatttgattcatatgagatggttctttagtacatatataggctgttcacagaaaaaaaataatgttgttcatcaacaacaaccatggatgcccaaagggagcattagattgatgaagaacagccgatattacttttccccccttcggttcataaatagttgtatacagaaattccaatgagagtttattacttgatgatatttatacatattctgagac

SEQ ID NO: 799 - DNA, 2541 bp, Brachypodium distachyon
atgacaccttcgtctcctacttcccttatctccatcctccattattccccttctgcttttcctctctacatatacccattctccccgcttccccactacccacccttcttcctcctccctcctccctcctcttcttggtcccgaacctgctggaagaagaacaactgaggattgttcctccctcttaacgagaacgcgattctgtgttgactcttggtaacggagtcttttctttttacaagcgccgtcatgtgctccggcacgcgcaagccgaccgcgcccccgccgccgagggattcggccgagcttctgatggagctggcggcggcggacgacgtggttgggttcaggcaggctgtggaggaggacaaggcgtgtattgatggcgcgggcctgtggtatggcccctcggcggccgtggggcggcggctggggatggagagccggacgccggccatggtcgccgcgctgtacgggagcacgggcgtgctggcgtacgcgctgtccgccgcgccgcgggaggcatgccgcgcgtcccccacggacggcgccaccgcgctccacatggcggcggccggcggggccgccggcgccgtcgccgccacgcacctgctgctcgccgccggcgcgtctacggaggcgctctcggcgtccgggctccgcgccggggacctcctcccgcgtgccgcgggccccgcggacaagccgctccgcgtgctcctcaaatcccctgccgtgtcgccttcctcgtcccccaagaaatccgcgtccccgccggcggccatggcgatggcgcaggagcccaggaaggagtacccgcctgacctgaccctcccggacctcaagagcggcctcttcagcaccgacgagttccgcatgtacagcttcaaggtgaagccctgctcccgcgcctactcccacgactggaccgagtgccccttcgtccaccccggcgagaacgcccgccgccgcgacccgcgccgctactcctacagctgcgtcccttgcccggagttccgcaaggggggctcgtgccgcaagggcgacggttgcgagtatgcacacggggtgtttgagtgctggcttcacccggcgcagtaccggacccgcctctgcaaggacgaggtcggctgcgcccgccgcatctgcttcttcgcgcacaagcgcgacgagctccgcgccgtcaacccttccgccgtttccgtcggtatgcagccgtcgtccccgcgatcgtctccgcccaacgggatggacatggggatgctcaacccggcctggccgtcgtccccggcgagcagccggctcaagacggcccgggagctcgacttcgacctggagatgctcgcgctcgaccagtaccagcagaagctgttcgacaaggtgtccaacgcggcatcgccgagggcaaactggggcgccgcgaacggcggccttggctcgccgcacgccgtggcccaggcgccgcctagaaacatgccggattacagcgacctcctcgggtccatggacacggccatgctgtcccagctccacgccctgtctctgaagcaggccggcgacatgtcgccctacagctcgctgccggacacgcagctgcacatgccgacctcaccgatggtgggcgcgaacacctcgttcggcctcgaccactccatggcgaaggccatcatgagctcccgcgcctcggcgttcgctaagcgtagccagagcttcatcgaccgtggcgcacgggctccggcggcacgctccctcatgtcgccggccacgatgggtgagccatcgatgctcacagactggggctctcccagcggcaataatatggactggggctctcccagtggcaagctggactggggcgtccagggcgatgagctgcacaagttccgcaaatcggcttctttcgggttccgcgcacaatccgccatgcctgtggcctcccaagccacccaggccgagccggatgtgtcgtgggtgaactctcttgtcaaggatggccactccggcgaccattttgcgcagtggctggagcaggagcagatggtggcctaatcccgttgatcgatgatcactggctcatagcatctagctgaccaaagttctttccttcaattatttccctttttatttgcttaatttgattcatatgagatggttctttagtacatataggctgttcacaaaaataatattgttcatcaacaagaagcttggatgcccaaagggagccttagattgatgatgaacagccaatattactttttttccccttcggttataaatagttgtatacaagaattccaacaagagtttatttacttgatatctatatatatttggagaccagacagatttgtttcatgtgcttcctgtctcaagataaatactatgagaagttgtactcttctcatgccaagtacatcaactggatgtgtttatcaatataagtattctgggttctcccatgagcacatcttgcttcgtttgattccattccctaaaggagtggattgcagaccattggcatttgtacaatttgataga

SEQ ID NO: 800 - DNA, 1998 bp, Secale cereale
ctcccctccctcctcttgtcacaatcaatacaagaacgtacgtggaaggaaggaagaagaagaaaccaagaaagaaccgtctctacttaacgagaacgcagcggctcttttgaatctttgttagctgcggacaggccttcttccgtcatgtgctctggtccgcgcaagccgtcgaccccgccgccggtggcggcggcgccgaaggattcggtggatatcgcctcgctcctgctggagctggcggcggcggataacgtggtggagtttaggcgggtcgtggaggaggagaaggcgtcccttgatgctgcggggtcgtggtatgggccgtcggctgtcggccttggccggctggccgcggagagccggacgccggccatggtcgccgcgctctacgggagcacggccgtgctggcgcacgcgctgtccgtcgcgccgggcgaggcgtgccgcgcgtccgacacggacggcgccaccgcgctccatatggctgctgccggtggcgcggccaacgccgtcgcggccacgcacctgctgctagccgcgggggcctctacggaggcgctctcgctctccgggctccgcgccggggacctgctcccgcgcgccgccggcgtttcggagaagcctctccgcctgctgctcaagtcccctgccgtgtcgccctcctcgtcgcccaagaagtccgcctcgccgccggcgatggtcgccgcgcaggagcccaggaaggagtacccgccggacctgacgctgccggacctcaagagcgggctcttcagcaccgacgagttccgcatgtacagcttcaaggtgaagccctgctcccgcgcctactcccacgactggaccgagtgccccttcgtgcaccccggcgagaacgcgcgccgccgcgacccgcgccgctactcctacagctgcgtgccctgcccggagttccgcaagggcgggtcgtgccgcaagggcgacggctgcgagtacgcgcacggcgtcttcgagtgctggctccacccggcgcagtaccggacgcgcctctgcaaggacgaggtcggctgcgcgcgccgcatctgcttcttcgcgcacaggcgcgacgagctccgctccgtcaacccctccgccgtctccgtgggcatgatgcagcccgtctccccgcgctcctcgcctcccaacgggatggacatggggatgctcaaccccgcggggtggccgtcgtccccggtcagccggctcaagaccgcgcgggagctcgacttcgacctggagatgctcgcgctggaccagtaccagcagaagctgttcgacaaggtgtccaacaacgcgcactcgccgagggcgagctggggcgcgcccaacggcggcctcggctcgccgcacgccgccgggtcgcccgccagaaacatgccggactacaccgacctgcttgggtccatggacccggccatgctttcccagctccacgcgctgtcgctgaagcaggcgggcgacatgtcgccgtacagctccatgccggacacgcagctgcacatgccgacctcgccgatggtgggcgcgaacaactcgttcggcctcgaccactccatggccaaggccatcatgacctcccgcgcctccgcgttcgccaagcgcagccagagcttcatcgaccgcggcgcgcgcgccccggcgcgcgctccctcatgtcgccggccaccacgatcggcgaccccttccatgctcaccgactggggttctcccagcggcggcggcaacctcgacgtgggctcacccggcggcaagctggacgtggggcgtgcgagggagacgagctgcacaagttccgcaagtcggctccgttcggttccgcggcagaccgccatcgccggcggccgccgcacgccgaccccggcccgaacccgacgtctcagtgggtgaactctcttgtacaaggatcggccacacgaggcgacctattttccgcagtggcgtggagcagggagcagagtgggtcggcctgactccccgacc

SEQ ID NO: 801 - DNA, 969 bp, Pseudoroegneria spicata
  misc_feature (143)..(143): n is a, c, g, or t
  misc_feature (164)..(164): n is a, c, g, or t
  misc_feature (543)..(543): n is a, c, g, or t
  misc_feature (825)..(825): n is a, c, g, or t
ccgttgctgtcggacaaagagatcaatcaagccaaggagaaaggatggcatcaggcttgcaagtgtttggccagccagcatccaccgatgttgccagggttctgacatgcctctttgagaagaatttggagtttgatctcgtncgcatcgacacattcaagagncagcacaagcttcctgagttcatcaggctgcgggatccaagtggacaagtgacattcaagcatggcgacaagactcttgtcgacccaagggctatttgccggtatctctgcacccagttcccaaaccagggaaacaggagcctctatggaacaggttctctggagcgggcatcaattgaacagtggctgcaagcagaggctcagaacttcaaccctcccagctcggccctcgtgtttcagctggcatttgctcctcttctgggaatccctcaagaccacatggtcattgcagagaatgagaggaagcttcagcaggtcctcaatgtttacgacgaaatactctccaagaatgagtacctggctggcgacgagttcaccntggctgacctctcccaccttccggactcgcagtacattgtgagctcggagagggggatgaagctcttcacctccaggaagaatgtggcgaggtggttcgaccaaatctcgaggcgcaaggcctgggagcaggttgtcaagatgcagatggagcatcctggcgcgttcgagtaacgccttggtggtcgcaaggaagtgttttgagttcatcttgaagagctctctacgtttatcgatcgtactgtcatgtgttctttcgtcattgttgctacttgtgttgtcnttgtttaccgaatcctcatcaactttgtcttgtgaaccagaataatatgaggcctgtttgtgatgtgttatgtacattgcgccttttaaaatgcttttgccctggagtatttccactgaataaaattatctgtctgttttttca

SEQ ID NO: 802 - DNA, 994 bp, Triticum aestivum
attgctcattgccattgcatagcctgacaaagagatcaatcaagccaaagagaaaggatggcttcaggcttgcaagtgtttggccagccagcatccaccgatgttgccagggttctgacatgcctctttgagaagaatttggagtttgatctcgtccgcatcgacacattcaagaggcagcacaagcttcctgagttcatcaggctgcgcgatccaagtggacaagtgacattcaagcatggtgacaagactcttgtcgacccaagggctatttgccggtacctctgtacccagttcccaaaccagggaaacaggaacctctatgggactggctctctggaacgggcatcaatagaacagtggctgcaagcagaggctcagagcttcaaccctcccagctcggccctcgtgtttcagctggcatttgctcctcttctggaaatccctcaggaccacatggccattgcagagaatgagaggaagcttcagcaagtcctcaatgtttacgacgaaatactctcgaagaatgagtacctggctggcgatgagttcaccctggctgacctctcccaccttccggactcgcagtacattgtgagctcggagagggggaggaagctcttcacctccaggaggaatgtggcgaggtggttcgaccaaatctcgaggcgcaaggcgtgggagcaggttgtcaagatgcagatggagcatcctggtgcctttgagtaacgccttggtggtggcaagcaagtattttgagttcatcttgaagagctctctacgtttatcgatcttactttcatgtgttctttggtcatcattgctacttgtgctgtcgtcgtttaccgaatcctcatccacgttttcttgtgaaccagaataatatgagccgtgatgtgttatgtacattgcgctgtttaaaatgcttttgccctgaacattgcgccgtgatgtgttatgtacattgtgatgtgttatctactgaataaaatta

SEQ ID NO: 803 - DNA, 998 bp, Secale cereale
agcctgacaaagagatcaatcaagccaaagagaagggatggcatcaggcttgcaagtgtttggccagccagcatccaccgatgttgccagggttctgacatgcctctttgagaagaatttggagtttgatctcgtccgcatcgacacattcaagaagcagcacaagcttcctgagttcgtcaggctgcgggatccgagcgggcaagtgacattcaagcatggtgacaacactcttgtcgatccaagggctatttgccggtacctctgtacccagttcccaaaccagggaaacaggaggctctatgggactggctctctggaacgggcttcaatagaacagtggctgcaagcagaggctcagaacttcaaccctcccagctcggccctggtgtttcagctggcatttgctcctcttctgggaattcctcaggaccaaatggtcattgcggagaatgagaggaagcttcagcaagtcctcaacgtctacgacgaaatactctccaagaatgagtacctggctggcgacgagttcaccctggccgacctctcccacctcccggactcgcagtacattgtgagctcggagagggggaggaagctcttcacctccaggaggaatgtggcgaggtggttcgaccaaatctcgaggcgcaaggcgtgggagcaggttgtcaagatgcagatggagcatcctggagcctttgagtgatgctttggtgcctgcgagcaagtgtcaagttcatcttgaagagctctatatgtttatcgatcttacattcatgtgttcttttgtcatcgttgctacttgtgctgtctttgtttactgaatcctcatcaactttgtcttgtgaaccagaataatatgaggcctgtttgtgatgtgttatgtacatcggctgtttaaaatgcttttgcccttatgtgttatgtactactgaataagatcatcttcctgttttcttcacatgtaccatagtctataacagaagaaattgaat

SEQ ID NO: 804 - DNA, 2026 bp, Brachypodium distachyon
tgggcagtggcccgtcgctgtgcggcagcatccgactcttctccgaccagcgacgggtaaagtggccacttgctatctcactcctacccgtcctccatcttttccgcttcctcctagtcctgcgtctaggtcctccttaggagcggcgatgtcggcgcccgtgacggtgtacgggccgatgatctcgccggcggtggcgcgggtggcggcgtgcctcctggagaaggacgtgcctttccagctccagccggtggacatgtccaagggcgagcacaagtccccctccttcctcaagctccagcccttcggccaggtccccgccttcaaagaccacctcaccacagtcttcgagtcaagggccatttgccgttacatctgcgaccagtacgctgaccgtggtaaccggagtctcctaggccgggaagaagatggggcggtaggccgtgctgccattgagcaatggatagagtctgaaggccaggcgtttaacccgccgagcttggcgatcgcattccagctcacatttgcaccacttatgggtagggccactgacatagctgtggtcgagcagaatgaagcgaagcttgcaaaggtgcttgacgtgtatgagcagcggctgggggagagccagtattttgcaggcgacgagttcagccttgcagaccttgtgcacatgcctaataccgatctcctggtgagcaagaccaacaaggcggggctgatcaccgagagaaagaatctggcgagatggtgggatgaagtctcagttcgtccttcgtggaagaaagttgttgagatgcagagtgtaccacggccctctaaatctacttgagcagcttctgatggcaggtttgtttgctactagagacactatgattgctgcaagcaagaatccagactcctcctttctctttacactttcccttttccatctctgtggtgcaaggcaacaaggcaagtatggaatttcaccttttgtttctttaaataccttgcaacaaaacctgttattcccatcccttgccaccatttcatagcttggcaaagagatcaagcaaaccaaaacagaggatggcagcaggcttgcaagtgtttggtcagccagcatctaccgatgttgccagggttctgacatgcctctttgagaagaatttggagtttgagcttgtccgaatcgatacattcaagagacagcacaagcttcctgagtttattaaactgcgggatccgagtgggcaagttacattcaaacatggcaacaaaactcttgtcgatccacgggcaatttgccggtacctctgtacccagttcccaaatgagggaaacaggaacctctacggaactggttctctggaacgggcgtcaatagaacagtggctacaagcagaagcacaaaactttaaccctcccagctccgcccttgtctttcatctggcatttgctcctcatctggacattcctcaagactatgctgctattgctgaaaatgaaaagaaacttcaacaagtcctcaatgtttacgatgaaatactctcaaagaatgagtacctggctggcgatgaattcaccctggctgatctttcccacctaccagactcacaatacattgtggattctgatagagggaggaagcttttcacttccaggaagaatgtggctaggtggtttgaccaaatctcaaggcgcgaggcatgggagcaggttgtcaagatgcagatggagcatcctggcgcgttcgagtaatggtttaattgttgcaagaaagtggcgagttcatcttgaagagctcaatctggcttctactgtcctgtcttctgtcatcatggtttctacttgtgttgccgtcgtttgtcaaatctaccatctacattgccttgtgaaccaaaataatatgaggccagcttgtgatatccgcgttccaaattctttgtcttggtgtatggtgtatatctactgaataaaaataaaaatatttatctgactgccaattttgtgtgtctggtttatacatatgtcctttgaaaaa

SEQ ID NO: 805 - DNA, 1408 bp, Oryza sativa
cgttgcttttgttgaaaagcttattcttataccctggcggaagtcacaacatcttctttgtatgtctagtacttgattccaatcttcttcttactgtcctatataaattctcataaacaatataaaagaatcttgtagtactgtgtagcaagctccttctatgctatatttttcactctagtgctgaaggacttcatagatactaataaagaaggctgttttgtaggatttgtttttgttctagacaatatgattgttgcaagcaagaatccagatcttcctctttttctttacacttttccttttccatttttgtggtgcctggtagcaaggcaagcatagaacttctccttttgtttctataaatacctgattaagaatcctgctgtcatcatccctcgttgtcgttttaaacaacttgatcaggtgatcaatcaaatcaatagaaacgatggctgcaggcttgcaagtgtttggccagccagcatctactgatgttgccagggtcctgacatgcctctttgagaaggatctggaatttgaacttgtccgcattgatacattcaagagagagcacaagcttcctgagttcattaagctgcgggatcctaatgggcaagtgacatttaaacatggtgacaaaaccatcgtcgattcaagggctatatgccggtacgtttgtactcagtttccagagggaaataagaccctttatggaacgggatctctagaacgggcatcaatagaacagtggcttcaagcagaagctcaaaatttcagccctcccagctcggccctcgtcttccatctcgcatttgctccccatctgaacattccccaggaccatgctgttattgcagaaaatgagaagaaacttcagcaagtcctcaatgtttatgatgagatactctcaaagaatgagtacctggctggtgatgagttcaccctggctgacctttctcaccttccaaactcacattacattgtgagttctgagagaggaaggaagctcttcactggcaggaagaatgtggcaaggtggtacgaccaaatctcaaagcgcgagacatggaagcaggtggtcaagatgcagagggagcatccgggtgcattcgagtaatggcctgatatattgcccaagttcatcgtgtccgttgtcgatcgatctggcttctgctgtcctgtgttgtcatcgtcgctagtttgcctgttccctgcttatattgtcgtgtgaccaaataatatgaagcctcttcttgttgtgacgtagtttcataccatgtacctcgttgctttacaggtcatttgttttctcccttgtttagtgattaaataaaattgttaatcgacctggcagttctaaatctgttgttttcttcgcctgaataatagtattcttttgtgcttg

SEQ ID NO: 806 - DNA, 1128 bp, Hordeum vulgare
cggtcgctcgctggctataaagcacctggccatggatcttacagtccccatcagcagccagtcgcttcactcactcactgatcgcctgcagtgcagattgatcggagctaacagagatctctcaccgagaagcttgaagcgatggcggcgggtctgcaggtgttcgggcagccggcgtcgacggacgtggcccgggtgctcacctgcctcttcgagaagaacctcgagttcgagctcgtccgcatcgacaccttcaagagggagcacaagctgcccgagttcatcaagctaagggatccaactgggcaggtgaccttcaagcatggtgacaagacccttgttgattcaagggcgatatgccggtacctgtgcacccaattcccggaggacggcaaccgcgggatctacggcacggggtcgctggagcgcgcgtccatagagcagtggctccaggcggagtcccagagcttcgacgccccgagctcggagctggtcttccacctggccttcgcgccgcagctcaacatgatccccgacgaggcccgcatcgcggagaacgagaggaagctgcagcagatgctcggcgtctacgacgagatcctggccaagaaccagtacctcgctggcgacgagttcacgctcgccgacctgtcccacctgccggcctcccactacatcgccggctcccagaggggcaggaagctcttcacctccaagaagcacgtggccaggtggtacgacgccatctccagccgcccctcctggaagcaggtggtcaagatgcagcacgagcaccccggcaccttcgagtgatcggcgagctcgatcgatcgccgtccgtacgtacgtcgtcgatcggcagcatgcatgcatgcatgcatgaatcttccatcgggcttcacaccgtgatgtctccgtacgccgtcaaggtccctctcgtctacgtccgttcgttcgttgtcgtgttggctagaataatgtgaagccctaattaaagcgcgcggtgtctctcgtaatgtcttccatttttgcaacgccattgtccgtcaaggggttgtaacgctcagttgctttcagttcaacaaataaattgttcccagtcgatcgaaccttcttgctcctttgtct

SEQ ID NO: 807 - DNA, 1092 bp, Triticum aestivum
tcgctagctataaaacgcctggccatggatcctatggtctccatcagcagtcgtcgcttcactcactcgctcactgatcaccggcctgcacatcgatcgaagccagtgatcggtctctcaccaagaaatttgaagcaatggcggccggtctgcaggtgttcgggcagccggcgtcgactgacgtggcccgggtgctcacctgcctcttcgagaagaacctcgagttcgagctcgtccgcatcgacaccttcaagagggagcacaagctgcccgagttcatcaagctaagggatcctaccgggcaggtgaccttcaagcatggtgacaagacccttgttgattcaagggcgatatgccggtacctgtgcacccagttcccggaggacggcaaccgcgggatctacggcacggggtcgctggagcgcgcgtccatcgagcagtggctccaggcggaggcccagagcttcgacgccccgagctcggagctcgtcttccacctggccttcgcgccgcagctcaacatgctccccgacgaggcccgcatcgcggagaacgagcggaagctgcagcagatgctcggcgtctacgacgagatcctcgccaagaaccagtacctcgccggcgacgagttcacgctcgccgacctctcccacctgccggcctcccactacatcgccggctcccagcggggccggaagctcttcacctccaagaggcacgtggccaggtggtacgacgccatctccagccgcccctcgtggcagcaggtggtcaagatgcagcacgagcaccccggcaccttcgagtgatcggcgagctcgatcgtcgtctgtcatcgatcggcaacatgcatgaatcttccatcgggcttcataccgtgatgtctccgtcgtcaaggtccctctcgtctacgttcgttcgttcgttgtcgtgttggctaaaataatgtgaagccctaaagcgcgcggtgtctctcgtaatgtcttccattattgcaacaccattgtccttccaagttccaaggggttgtatcagttgctttcagttcagcaaataaattgttcccaatcgagccttcttgctcgtttgtct

SEQ ID NO: 808 - DNA, 1268 bp, Oryza sativa
gctttctcttttcctcgccgtcctgtaatcctctgcagcaaggcaagcacctaatccatccctataaatacccatcggcgtctctgcctcctcacagcgagccacacaggttaagtcactttcacctgcaaatccacaagcacattgctcgatcaccgaggaagaaaactagctagcttaatcaccgggaagagttgagcaatggcggcaggattgcaggtgttcggccagccggcgtccaccgacgtcgcgagggtcctgacctgtctcttcgagaagaacctcgagttcgagctcatccgcatagacaccttcaagaaggagcacaagctccccgagttcatcaagctacgggatccgaccgggcaggtgactttcaagcatggcgacaagactcttgttgattcaagagcgatatgccgatacctgagcactcagttcccagacgacgggaacaggacgatctacgggacggggtcgctggagcgggcgtcgatcgagcagtggctgcaggcggaggcgcagagcttcgacgcgccgagctcggagctggtgttccacctggcgttcgcgccgcagctcaacataccggccgacgaggcccgcatcgcggagaacgagcggaagctgcagcagatgctgaacgtgtacgacgagatcctggcgaagaacaagtacctcgccggcgacgagttcaccctggccgacctgtcccacctcccgaactcccactacatcgtcaacgcgcggtcgccgaggggcaagaagctcttcacctccaagaagcacgtcgcgaggtggtacgaggagatctccaaccgcgcctcctggaagcaggtggtcaagatgcagagcgagcaccctggcgcgttcgagtgatatgcgcacgcgcagctcaaaaactctcttgcattctgcggcgagctctgctttgtctcgtccacggctttaattcgtcgggcttcatgcagtgatgtggttgtcgtctacgttaattgtcgtttcggctaagaataatatgaagccttcttgaggtctcctctcagtgtattccttttgcaacgccatgtctttcgattcaataaatataaatgtgtcccagccttttttgctcatgtgcaggcagtatatgtagccctccgaaaaaactaattttactgcaagtctagctagcatgggccaacaattgagtacgtagtttgacctagctaacgcctaggtcaatacacaataatactttgggggatccattgtactgctgtctactt

SEQ ID NO: 809 - DNA, 1263 bp, Triticum aestivum
tcttccgatctcggccggccggaacatgcccgctcgtcgggactcgggagtaccgaccaatcctcgccgcctgccgatcagaagtcgcgacgagctcacctaatattccacctctccctggccgccacccaacaacctaaccacatggccgtataatactccactgcagaagcgaggtgctcgtgaagtcggcttgatatccggagtagccagcaagcccagcccagcggccgatccgtgatccgtgttggagagagcgagggagagaagatgcggccgcggctggtgctcttcggcgactcaatcaccgagcagtcctttgcccccggcggctggggcgccgccctcgcggagcacttcgcgaggcaggcggatgtggtgctgcgcgggctcagcgggtacaacacgcgctgggcgctgaaggtgctggacagagccatggagggggcggccgacggcggcgcggacccggcggcagtgacggtgttcttcggcgccaacgacgccaccctgcccgacgaggtgcaggcgcaccagcacgtgccgctcggggagtacaaggacaacctgcgcgcgatctgtgcctacttcaagaataagtggccctccgctgccatcatactcatcacccctccaccgatccacgagccggcgaggattcgagacatatatggagataatgacccttcaagacagcctgaaagaacaaatgaagctgctggcacttatgcacaagcatgcataactgttgctaaagaattgggtcatccagttatagacatctggacgcagatgcagcaatgtcctgattggcaaacatctgcattaagtgacgggctacatttcaccccgttcgggaacaaaattttgttcgacgaggtgctgaagacactggaaagtgttggtttcagccagcacagtctccggtccgatctccctctcttccatgaaattgaccccaaggacccactgaaagcctttgagatttgaagaaggtatctgccgcatggttggattcccagaaggaaggcactatggctcagctttatgttctgaaaacaaactatgttggtttggtgactgatgtgttctgtaacttggatatattgtgccgatgttctatgtctgcaatgcttgtgacttgttttgaagatgttgcaatttgcatgtattgaaggcaagtgaaaatgagtgaaacataaatggacatcttctgctgttcgtttcgtatgcaagaggcacaaatttacttcttgttgaggc

SEQ ID NO: 810 - DNA, 970 bp, Leymus cinereus x Leymus triticoides
ggctggtgctcttcggcgactcaatcactgagcagtccttttcctccggcggctggggcgccgccctcgcggagcacttcgcgaggcaggcggatgtggttctgcgcgggctcagcgggtacaacacgcgctgggcgctgaaggtgctggatagagccatggagggggcggccgacggaggcgcggacccggcggcggtgacggtgttcttcggcgccaacgacgccaacctgcccgaccaggcgcaggcgcaccagcacgtgccgctcggggagtaccaggacaacctacgcgcgatctgtgcctacttcaagaataagtggccctccgctgctatcatactcatcacccctccaccaatccacgagccggcaaggattcgagacatatatggagataatgacccttcaagacagcctgaaagaaccaatgaagctgctggcacttatgcacaggcgtgcataactgttgctaaagaattgggtcatccagttatagacatctggacgcagatgcagcaatttcctgattggcaaacatctgcattaagtgatgggctacatttcaccccgttcgggaacaaaattttgttcgacgaggtgttgaagacactggaaagtgttggtttcagccagcacagtctccggtccgatctgcctctcttccatgaaattgactccaaggacccgctgaaagcctttgaaatttgaagaaggtatccgccgcatggttggattcccagaaggaaggcactatggctcagctttatgttctgaaaacaagctatgtttggtttggtgactgatgtgttgtgtaacgtggatatattgtgccgatgttctatgtcagcaatgctcctgacttgttttcaagatgtagcatgttgcatgtattgcaggcaagtgaaaatgagtgaaaaataaatggacatcttctgctgttcgtttcctacgacgcagattgttctgta

SEQ ID NO: 811 - DNA, 934 bp, Pseudoroegneria spicata
  misc_feature (758)..(758): n is a, c, g, or t
  misc_feature (821)..(821): n is a, c, g, or t
ggttggtgctcttcggcgactcaatcactgagcagtcctttgcccccggcggctggggcgccgccctcgcggagcacttcgcgaggcaggcggatgtggtgctgcgcgggctcagcgggtacaacacgcgctgggcgctgaaggtgctggatagagccatggagggggcggccgacggaggcgcggacccggcggcggtgacggtgttcttcggcgccaacgacgccagtctgcccgaccaggtgcaggcgcaccagcacgtgccgctcggggagtacaaggacaacctacgcgctatctgtgcctacttcaagaataagtggccctccgccgccgtcatactcatcacccctccaccgatccacgagccggcaaggattcgagacatatatggagataatgacccttcaagacagcctgaaagaaccaatgaagctgctggcacttatgcacaggcgtgcatagctgttgctaaagaattgggtcatccagttatcgacatctggacgcagatgcagcaatttcctgattggcaaacgtctgcattaagtgacgggctacatttcaccccgttcgggaacaaaattttgttcgacgaggtgctgaaaacaatggaaagtgttggtttcagccagcacagtctccggtccgatctccctctcttccatgaaattgaccccaaggacccgctgaaagcctttgaaatttgaaggtatccgccgcatggttggattcccagaaggaaggcactatggctnagctttagttctgaaaacaagctatgtttggtttggtgactgatgtgttgtctaacatggatntattgtgccgatgttgtatgtcagcaatgttcgtgacttgtttttaagatgttgcattttgcatgtattgaaggcaagtgaaaatgaatgaaaaataaatggacatcttctgc

SEQ ID NO: 812 - DNA, 1132 bp, Secale cereale
agcccacctaaccttacaactaccacgatcggtgatgctcacacgacagtaaaaaatactccaccgcggatcgaggtccacgaggagtcgacgtgatatccggggtagtcagccagccagtccagtggccgatccgtgatccgtttggaggtaggagtagagactagagagtgagggagcgaagatgcggccgcggctggtgctcttcggcgactcaatcaccgagcagtccttctcccccggcggctggggcgccgccctcgcggagcgcttcgcgaggcaggccgatgtggtgctgcgcgggctcagcgggtacaacacgcgctgggcgctgaaggtgctggacagagccatggagggggcggccgacggaggcccggaccctgcggcggtgacggtgttcttcggcgccaacgacgccaccctgcccgaccaggcgcaggcgcaccagcacgtgccgctcggggagtacaaggacaacctgcgcgcgatctgtgcctacttcaagaataagtggccctctgctgccatcatactcatcacacctccgccgatccacgagccggcgagaattcgagacatatatggagataatgacccttcaagacagcctgaaagaaccaatgaagctgctggcacttatgcacaagcgtgcatagttgttggtaaagaattgggtcatccagttatagacatctggacacagatgcagcaatttcctgattggcaaacatctgcattaagtgacgggctacatttcaccccgtccgggaacaaaattttgttcgacgaggtgctgaagacgctggaaagtgttggtgtcagccagcacagcctccggtccgatctccctctcttccatgacattgaccccaaggaccccctgaaagcctttgaaatttgaagaaggtagcagccgcatggttggatttccccgaaggaaggcactatggcccagctttatgttctgaaaacaagctatgtttggtttggtgaccgatgtgttgtgtaacgtggatatgttgtaccgatgttcgatgtcggcaatgctcgtgatttgttttcaagatgtagcatgttgcatgtattgcaggcaagtggacaatgaatgacatcttctgctgttcgtttc

SEQ ID NO: 813 - DNA, 1186 bp, Brachypodium distachyon
atgggcgtaactgcacaaagcgagttgaagctactcaagatgctctggtatccgcccagccatcgtgccaacaacctcaaggactacggtggtcctacgaagagatcaggagagagcgaggcggagaagatgcgcccgcggctggtgctcttcggcgactccatcaccgagcagtccttctcccccggcggttggggcgccgccctcgccgaacacttcgcccgccaggcggatgtggtgctgcgcgggctcagcgggtacaacacgcggtgggcgctgaaggtgctggatagagccatggagggggcggccgccggggccgcggacccggcggccgtcactgtgttcttcggcgccaacgacgccaacctgcccgaccagccgcaggcgcaccagcacgtgccgctcgaggagtaccaggccaacctccgcgcgatctgcgcccacttcaagaatcaatggccttcagctgctgtcatacttatcacgcctccaccgatctacgaaccggcgaggatcctagacatttatggagacaatgccccttcaagacagcctgaaagaaccaatgaagctgctggcacttatgcacaggcatgcatagctgttgctaaagaactggatcatccagttatcgacatctggacaaagatgcagcaattccctgattggcaaacatctgcattatgtgacggactgcatttcaccccgttcgggaacaagattttgttcgacgaggtactgaagacactgggaagtatcggtttcagccagcacagcctcccgtcggatcttcctctcttccatgaaattgaccccaaggacccattgaaagcctttgaaatatgaagaaggtaaacctgcatggtttgattcccagaatgaatgctatgcttgctttgatcgactgatgtactgtgacaactgggacaccgtatggcaatgttgtttgccatcatgtactagacttgttctgaagacatgccttgtgtttcatgtaatgttgacaggtgaaaaagagtggaataaatggccattttgtgcccttctccggtacgttttgtaaggttgcaggctgttctgcaaaatttggcctgtgatgctactgattgcattttttttttcttgagcgcatgctactgattgaaggactgctgcggatgtttcggcttacagaaatgtaaac

SEQ ID NO: 814 - DNA, 1139 bp, Avena sativa
acgagctcacctaggattccggctcgttcacgtgcggccatctaaacccaaccaccacgacaggtgatactaggttataatactgcactgcagaaggtgaggtgttcgtgaagttgccgtgatctcttctccgaggtagtccagcgcccgatccgtgatccgtgtcggagggaagaggagagagtgagagtgagaagatgcggccgcggctggtgctcttcggcgactccatcaccgagcagtccttcgcctccggcggctggggcgcagccctcgccgaccacttcgcccgccaggcggacgtggtgctgcgcgggctcagcgggtacaacacgcgatgggcgctgaaggtgctggacagagccatggagggggtggccgctgggggcgcggacccggcggccgtcacgctgttcttcggcgccaacgacgccagcctgcccgaccagccgcaggcgcaccagcacgtgccgctcgacgagtaccaggacaacctccgcgcgatctgcgccagcttggagaaaaagtggccctctgctgctatcatacttatcacccctccaccggtccacgagccagccaggattctacacatgtatggagacaatgccccttcgagacagcctgaaagaacaaatgaatctgctggcgcttatgcacaggcatgcatagctgttgctaaagaattggatcatccagttatagacatctggacacagatgcagaagtttcctgattggcaaacatctgcattatgcgatggacttcatttcaccccgtccgggaacaagattttgtttgacgagttgctcaagacactggaaagtattggtttcagccagcacagcctccggtcggatctccctctgttccatgaaatcgaccccaaggaccctttgaaagcattggaaatttgagcaaggcagctgcattgtctgattgttcagaaagacaagctctgattggtttgaacactgctgtatttgtcgtgataactgggtcagctctgtgtggcagcatgtgcggtacttgtttagaagaagatgtggtttatgttccatgtatcgcgccattctgtggtttgagagataaaaaaaaagacagtacatttcgtaaggtgcgaaaaaaaaaaaaaaagg

SEQ ID NO: 815 - DNA, 1306 bp, Sorghum bicolor
cagggcctaaaactgcagcagaggtgaagcgccccgtgctcgcagtcctgctcctcggatctcacggcggaactcggaagtcgtcggtgcagtcagcgagcaaacgagccctcgcggcggattccccgatccgagcaaagcaacccggtcgacatgcggccgcggctggtgctcttcggcgactccatcaccgagcagtccttcgcgtccggcggatggggcgccgcgcttaccgaccgcttcgcccgccaggcggacgtggtgctgcgcgggctcagcggctacaacacgcggtgggcgctcaaggtgctgccgcgcgccatggagggcgcggcgggcgcgggtgcggacccggcggcggtgaccgtcttcttcggcgccaacgacgccacgctgcctgatcaggtgcaggcgcaccagcacgtgccgctccaggagtaccagagcaacctccgcgccatatccgcatacttcaaggagcgatggccctccactgctatcatactcatcactcccccaccgatctatgaaccagcgagaatccgagacgtgtatggagaagacgacccttcacgccaaccagaaagaagcaatgaggctgctggcgcttatgctcaggcatgcatagctgttgccacagaattgaatcatccagttatagacatctggacgaagatgcaggaatttccagattggcaaacatctgcattgagcgacgggctccacttcacgccggcaggaaacaagatcctgttcgacgaggtggtgaagacgctggagagcatcggtttcagccaggagaggctcccgtccgacctccccctgttccacgagatccaccccaaggaccccatgaaagccttcggagcttgaagaagaagacgcctcggcgcacgattggatcagcgacgtttgctcgatcgtgtcaagtgacgtgctccactcgttgtctgtggtgctgcgcgtgcgacttttccttgtggagatagatgtttttcttccccttgtgagtacattattcagtatgcataaaggactgctgaggccattgcaggaacattttgaggcttaataaatggcattttttttttcagtaccgtatattatagggacaatgtggtttcaacaaatgtcactatggaacagttaagcctgtgtcttggatggagccgtctgatgacgaactgacgtacgaaaaaaggggctcaggccttgtttagtttggaaaattttttggttttgattactatagcatttttgtttgtatttcacaattattatctaattatatggactaattagcttt

SEQ ID NO: 816 - DNA, 1129 bp, Pennisetum glaucum
ccggactcgaaggactgctcggtgatggagtcgccgaagagcaccagccgcatcccgagaagcgaagcgaagcgctccgcgagtgaagagcccgcgcgggcgggatccccgatccgagcgatccgccaccatgcggccgcggctggtgctcttcggcgactccatcaccgagcagtccttcgagtccggcggatggggcgccgcgctcgccgaccgcttcgcccgccaggcggacgtggtgctgcgcgggctcagcgggtacaacacgcggtgggcgctcaaggtgctgccgcgggccatggagggcgcggcggacgcggacgcggacccggcggccgtcaccgtcttcttcggcgccaacgacgcctcgctgcccgaccaggtgcaggcgcaccagaacgtgccgctcgaggagtaccaggccaacctccgcgccatctgcgcctacttcaaggagcgatggccctccgctgctatcatactcatcactcctccaccgatttacgagacggcgagaatccgagacgtttatggtgttgctgacccttcacgacaagcagaaagaaccaatgaggctgctggctcttatgcacaggcatgcatagctgtagccaaagaattgggttatccagttatagacatttggacaaagatgcaggaatttccagattggcaaacatctgcattaagtgatgggcttcacttcacccctactggaaacaagatcctgttcgacgaggtggtgcagacgctggcaagcatcggtttcagcaacgagaggctcccatatgatctccccctctacccagaaatcgaccccaaggaccccatgaaagctttcggtgcttaaggaagacaccttagtggtgcatgattggattagtgctgtttgctcgtgtcaaataatgggccctactctctatgtattgctccctccgttccaaattacatatgttttagtttttctagatacattcattttgttatgtatctagacataaatatatatctaggtgcataacaaaagaaatacctggaaaggtcaaaatgacgataatttgaaacggagagagtaactgttattgtatgacagtgtgtatgtgacttttccttgtaaagacgtcccttg

SEQ ID NO: 817 - DNA, 1363 bp, Zea mays
ctcacgtgttttttttggaaaagtttttcttttcttcgtttgtgaaaatgaaaggcaaataattggatcgccagtcaatttgtaagctcaatcaaagagtcccgtctcatccagaccagatcagatcacggacgacacagacggccaccaaatctgcacctgccccagatgcagcagaggtagtcgccacggcgccacctgcccactgcactgcccccagagcctccaagctgcatatcggaagtgaagcgcctcgcagtcctcctctcggatctcgcggtggaagtcgccggtccactcgatcagcgagcgagtcggtgccgcgcggcggattccccgacccgagcaaaggaaccggacatgcggccgcggctggtgctcttcggcgactccataaccgagctgtccttcgcgtccggcggatggggggccgcgctcaccgaccgcttcgcccgccaggctgacgtggtgctgcgcgggctcagcggctacaacacgcggtgggcgctcaaggtgctgccgcgggccatggagggcgcggcgggcgcgggcgcgggcgcggacccggcggccgtgacagtcttcttcggcgccaacgacgcctctctgcccgaccaggtgcaggcgcaccagcacgtgccgctcaaggagtaccagagcaacctccgcgccatctgcgcctatttcaaggagcgatggccctccactgctgtcatactcatcactcccccaccgatttacgagccagcgagaatccgagacatgtatggagacgacgagccttcacgccaaccagaaaggagcaatgaggctgccggcgcttacgcacaggcatgcatagatgttgccacagaattgaaccatccagttatagacatctggaccaagatgcaggaatttccagactggcaaacatctgcattgagcgacgggctccacttcaccccagtaggaaacaagatcctgttcgaggaggtggtgaagacgctggagacgagcatcggtttcagccaggagcggctcccgtcggacctcccgctgttccacgagatcgaccccaaggaccccatgaaagccttcggagcttagcttgggccttatcggaggagacgcacggtcgttggatcagccacgtctgctgcatttgagttcgtcgtcagtatgcccgaggcctgctgaggccattacaggaacagtgagctttaataagcggtgttttcagtaccgtttggttgtcagcgcatcacgtgttgttggaacactgtggttggataaaaaaatcataccctctccgtccgaaattaaaattcattttaccttttttataattcgtacaataattaattaatacatgtgttatata

SEQ ID NO: 818 - DNA, 1102 bp, Panicum virgatum
gattccgtctcatccagatcacacgccaccaaacccgcgccccagatgacgaggtagccgccagtgccactgccagtccgcgctcgtgctctcggatctcggacggaagccgtcgctccagtagcccagcgagtgagcccgcgcggcggaatccccgacccgagcgatccgccatgcggccgcggctggtgcttttcggcgactccatcaccgagcagtccttccagtccggcggatggggggccgcgctcaccgacctcttcgcccgccaggcggacgtggtgctgcgcggcctcagcgggtacaacacgcggtgggcgctcaaggtgctgccgcgggccatggagggcgcggcggacccggcggccgtcaccgtcttcttcggcgccaacgacgcctcgctgcccgaccaggtgcaggcgcaccagaacgtgccgctcgacgagtaccagaccaacctccgcgccatctgcggctacttcaaggagcgatggccctccactgctatcatactcatcactccgccaccgatttatgagccagcgagaatccgagacatttatggagttgatgatccttcacgacaagctgaaagaaccaacgaggctgctggctcttatgcacaggcatgcatggctgttgccaaagaattgggtcatccagttatagacatctggacaaagatgcaggaatttccagattggcaaacatctgcattaagtgatggtcttcacttcaccccaactgggaacaagatcctgtttgacgaggtggtgaagacgctagcaagcatcggtttcagcaaggagagcctcccatctgacctccccctctaccatgacattgaccccaaagaccccatgcaagcttttggagcatgaagaagacaccttagtgcatgattagattagtgatgcttgctggtttcaaatgatgtgtccgaagtcaggctctattctgtatggcaacgcttgtgcggcttttccttctggagatggtttttgtgcttgtgcattaataatatgcatatgtattaacgatgccaccacataaacagcaaaatctaataaaagactttttgtctctattttttagtactgca

SEQ ID NO: 819 - DNA, 1076 bp, Setaria italica
cacggccacctaccctgcgccagatgacgaggtagccgccactgccactgccagtccgccgcacagcctccaaagccgcatcccaagaagcgaagcgctctgtgactgagtgagtgagcccgcgcggcagattccccgatccgagcgatccaccatgcggccgcggctggtgctcttcggcgactccatcaccgagcagtccttcgagtccggcggatggggcgccgcgctcaccgaccgcttcgcccgccaggcggacgtggtgctgcgcgggctcagcgggtacaacacgcggtgggcgctcaaggtgctgccgcgggccatggagggcgcggcggacgcggacccggcggccgtcaccgtcttcttcggcgccaatgacgcctcgctgcccgaccaagtgcaggcgcaccagaacgtcccgctcgaggagtaccagaccaacctccgcgccatctgcgcctactttaaggagcgatggccctccgctgctatcatactcatcactcccccaccgatttacgagacagcgagaatccgagacatttatggagttgatgactctgcacgacaagcagaaagaaccaacgaggctgctggctcttatgcacaggcatgcatagctgttgccaaagaattgggccatccggttatagacatctggacaaagatgcaggaatttccagattggcaaacatctgcattaagtgatgggcttcacttcacgcctactggaaacaagatcctgttcgacgagttggtgcagacgctggcaggcatcggtttcagcaaggagagcctcccatatgatctccccctctaccccgaaatcgaccccaaggaccccatgaaagctttcggagcttgaagaggacgccttagtgcatgattggattagagatgtttgctcgtgtcaaatgatgtgccctactcactatctgttctgtttggcagtgcgtgtgcgacttttacttctggaattgtgttttgtcctttgtaattaatatgcataagtactactgatgccatcacataaacagtgaaattcaataaatggcatttttttcagtacttca

SEQ ID NO: 820 - DNA, 1241 bp, Oryza sativa
ccggaatatgcttgtcactgtataacagctcaccgctcgtcactgacaacggcatcttggactccttggaggcacgacaaatttacaagtcagttgctgccactgttttctataaaatcaaaacttgcacggaagtgaagtgaagcgagatgggatcttgaagttgaagacaaggcagttgttcagtctcctctagcacagcactagcgagtgactgccccaggcggatattctgaatccaaggaggaaagatgaggccgcggctggtgctcttcggcgactccatcaccgagctctccttcgccgacggcggctggggcgccgccctcgccgaccacttcgcccgcaaggccgacgtggtgctgcgcgggttcagcggctacaacacgcggtgggcgctgcgggtgctggcgagggcgatggagggcgcggccgccgccgcggacccggcggccgtcacggtgttcttcggcgccaacgacgcgtcgctgccggaacggaagcaggtgcaccagcacgtgccgctcgacgagtaccagagcaacctccgctccatctgcgcctacttcaaggagcaatggccctccactaaaattatactcatcacgcctccaccaatctatgaaccggcgagaatccgggacatgtatggagaagatgacccttcaaaactacctgaaagaaccaatgaagctgctggcacttatgcacaggcatgcctgacagttgctaaagaattgaaccatccagtcatagacatctggacaaagatgcagcaatttcctgactggcaaacatctgcattatgtgatggactgcacttcaccccattgggaaacaaaattttgtttgactgtgtgctggagacactggaaagcattggtttcagccaagggagtcttcaaccagatcttcctctcttccatgatatcgacccaaaggaccctttgaaagcctttgaaatctgaagaaggtcccggccggcatggtttgttcaggcacggatactcgttgtaacagggacaccttatgccatcgtgttgtgccagctgtatgtgcttgaattttccattataagatggttgaatttccatgtagaacataataaatggtttgtatttccatgtagaacataataaatagtcatacaattccatggttcacatttaaaaagaaagggaaatttattttggatctgcaaatatagaagctaaaagaatttcccagaaaagaaaaggaac

SEQ ID NO: 821 - DNA, 913 bp, Panicum virgatum
ggctggtgcttttcggcgactccatcaccgagcagtccttccagtccggcggatggggggccgcgctcaccgatctcttcgcccgccaggcggacgtggtgctgcgcggcctcagcgggtacaacacgcggtgggcgctcaaggtgctgccgcgggccatggagggcgcggcggacccggcggccgtcaccgtcttcttcggcgccaacgacgcctcgctgcccgaccaggtgcaggcgcaccagaacgtgccgctcgacgagtaccagaccaatctccgcgccatctgcggctacttcaaggagcgatggccctccactgctatcatactcatcactccgccaccgatttatgagccagcgagaatccgagacatttatggagttgatgatccttcacgacaagctgaaagaaccaacgaggctgctggctcttatgcacaggcatgcatggctgttgccaaagaattgggtcatccagttatagacatctggacaaagatgcaggaatttccagattggcaaacatctgcattaagtgatggtcttcacttcaccccaactgggaacaagatcctgtttgacgaggtggtgaagacgctagcaagcatcggtttcagcaaggagagcctcccatctgacctccccctctaccatgacattgaccccaaagaccccatgcaagcttttggagcatgaagaagacaccttagtgcatgattagattagtgatgcttgctggtttcaaatgatgtgtccgaagtcaggctctattctgtatggcaacgcttgtgcggcttttccttctggagatggtttttgtgcttgtgcattaataatatgcatatgtattaacgatgccaccacataaacagcaaaatctaataaaagactttttgtctctattttttagt

SEQ ID NO: 822 - DNA, 1033 bp, Secale cereale
agatcagcgctctcgtgaatcctacggcccattccccctgaccctgatcccctcccccttttccgagccttactccaaagcgcaaggcgcctctcgcttacgcccctctccttcttccccgccctccgctccgcccgccgcctgctcgccgtccgatccgccgccccccggtcgtctccatgggtctcctgtccaacaggatcgggaaggagagcctgaaggcgggggatcacatctactcgtggagggccgcgtgggtctacgcgcatcacggaatatatgtgggtgatgataaggtgattcattttaccagaggaagggaccaagaggtcggaacaggaacagtcattgattatcttcttgtgagttctggccctaataggagcaccacgccatgcttggtatgcagcagcgaagaagccaccaccgccgcagagacaaatggtgtgacatcctcttgcctcagctgtttcctggcagggggtgccctctaccgtttcgagtatgacgtcaacccggcactcttccttgccaaggtgcgaggagggacctgcacgcttgccgccactgatcccgatgaggtggttgtccgacgtgccaaatacttgctgagcaatggtttcaggtgttacagcctgttcaagaacaactgcgaggactttgcgatatactgcaagactggcctgcttgtggctgagcagggcaatgtcgggctcgggcagagtgggcaggctgtgtccatcatcggcggccctcttgctgccgtggtttcgacccctttccgcctagtaaccacgaacatctatggagtggcggtgatggctgtcggggtgtactgtgtcagcaggtacgcaggtgacattggcaaccgccgagacgtgctgaaagtggaagtggaggacctgactgccgggctcgcaagcggccggattcgtccggcgaacatcagtcagctggccactccggggcaagtccaggttccggcagtgaccacactcgttgctgcttagaatgcagcactggtgttgtaaaa

SEQ ID NO: 823 - DNA, 1238 bp, Secale cereale
gagatcagcggctcgtgaatcctacggcccattccccttggccctgaccctgatcccctccccttttccgttccttactccaaggcggaagcgccttccgcccctctccttcttccccgccctcctctcctctccaccgcctgcttgccgtccgatccgccgccccccggtcgtctccatgggtctcctgtccaacaggatcgggaaggagagcctgaaggcgggggatcacatctactcgtggagggccgcgtgggtctacgcgcatcacggaatatatgtgggcgatgataaggtgattcattttaccagaggaagggaccaagaggtcggaacaggaacagtcattgattatcttctcgtgagctctggccctaataggagcaccacgccatgcttggtatgcagcagcgaagaagccaccaccgctgcagagacaaatggtgtgacatcctcttgcctcagctgtttcctggcagggggcgccctctaccgtttcgagtatgatgtcaacccagcactcttccttgccaaggtgcgaggagggacctgcacgcttgctgccactgatctcgatgaggtggttgtccgacgtgccaaatacttgttgaccaatggtttcaggtgctacagcctgttcaagaacaactgcgaagactttgcgatatactgcaagactggcctgcttgtggctgagcagggcaatgtcgggctcgggcagagtgggcaggctgtgtccatcatcggcggccctcttgctgccgtggtttcgacccctttccgcctagtaaccacgaacatctatggagtggcggtgatggctgtcggggtgtactgtgtcagcaggtacgcaggtgacattggcaaccgccgagacgtgctgaaagtggaagtggaggacctgactgccgggctcgcgagcggccggattcgtccggcgaacatcagtcagctggccactccggggcaagtccaggttccggcagtgaccacactcgttgctgcttagaatgcagcactggtgttgtaaaatatggagatgtatacatcaccatcactactgctatatgtaccaccgaaattcttgttcaaacctgctaaaactgtgccaagagtgaaattccctttcagcgtgtcaagtgttgtatccgctacggtcgtgtatggtttgtcttcagtattgtagagaaggttgaacattggtgtgtggtttgctcgaatttgtatcaagatttccg

SEQ ID NO: 824 - DNA, 1212 bp, Secale cereale
gatcagcggctcgtgaatcctacggcccattccccttggccctgaccctgatcccctccccttttccgttccttactccaaggcggaagcgccttccgcccctctccttcttccccgccctcctctcctctccaccgcctgcttgccgtccgatccgccgccccccggtcgtctccatgggtctcctgtccaacaggatcgggaaggagagcctgaaggcgggggatcacatctactcgtggagggccgcgtgggtctacgcgcatcacggaatatatgtgggcgatgataaggtgattcattttaccagaggaagggaccaagaggtcggaacaggaacagtcattgattatcttctcgtgagctctggccctaataggagcaccacaccatgcttggtatgcagcagcgaagaagccaccaccgccgcagagacaaatggtgtgacatcctcttgcctcagctgtttcctggcagggggcgccctctaccgtttcgagtatgatgtcaacccagcactcttccttgccaaggtgcgaggagggacctgcacgcttgccgccactgatctcgatgaggtggttgtccgacgtgccaaatacttgttgaccaatggtttcaggtgctacagcctgttcaagaacaactgtgaggactttgcgatatactgcaagactggcctgcttgtggctgagcaaggcaacgtcgggctcgggcagagtggacaggctgtgtccatcatcggcggccctcttgctgctgtggtttcgacccctttccgcctagtaaccacgaacatctatggagtggcggtgatggctgtcggggtgtactgtgtcagcaggtacgcaggtgacattggcaaccgccgagacgtgctgaaagtagaagtggaggacctgactgccgggctcgcaagcggccggattcgtcccgcgaacatcagtcagctggccaccccggggcaagtccaggttcccgcagtgaccacactcgttgctgcctagaatgcagcactcatgttgtaaaatatggaggtgtatacatcaccatcactactgagatatgtaccaccgaaatcgttgttcaaacctgctaaaactgtgccaagagtgaaattccctttcagcgtgtcaagtgttgtatctgctacggtcgtgtatggtttgtcttcagtattgtagagaaggttgaacattggtgcgtggtctg

SEQ ID NO: 825 - DNA, 1627 bp, Triticum aestivum
ccccacgatcccctcccactttttcgtgctttactccaaagcgcaaggcgccttctcgcttccgcccctctccttcttcctcgccctcctctccgcccgccgcctgctcgccgtccgatccgccgcctccgtccgtctccatgggtctcctgtccaacaggatcgggaaggagagcctgaaggcgggggatcacatctactcgtggagggccgcgtgggtctacgcgcatcacggaatatatgtgggcgatgataaggtgattcattttaccagaggaagggaccaagaggtcggaacaggaacggtcattgattttcttcttgtgagttctggccctactaggagcaccacgccatgcttggtatgcagcagcgaagaagccaccaccgccgcggagacaaatggtgtgacatcctcttgcctcagctgtttcctggcagggggtgccctctaccgtttcgagtatgacgtcaacccggcacttttccttgccaaagtgcgaggagggacctgcacgcttgccgccactgatcccgacgaggtggttgtccgacgcgccaaatacttgttgaccaatggtttcaggtgctacagcctgttcaagaacaactgcgaggactttgcgatatactgcaagactggtctgcttgtggctgagcagggcaacgtcgggctcgggcagagtgggcaggctgtgtccatcatcggcggccctcttgctgctgtggtttcgacccctttccgcctagtaaccacgaacatctatggagtggcggtgatggctgtcggggtgtactgtgtcagcaggtacgcaggtgacattggcaaccgccgagacgtgctgaaagtggaagtggaggacctgactgccgggctcgcaagcggccggattcgtccggcgaacatcagtcagctggcaactccggggcaagtccaggttccggcagtgaccacactcgttgctgcttagaatgcggcactgatgttgtaaaatatggagatgtatacatcaccatcactactgctatatgtaccaccgaaatcgttgttcaaacctgctaaaactgtgccaagagtgaaattcccattcagcaagagctgtgtgtcgagtgttgtatccgctacggtcgtgtatggtttctctttagtattgtaaagaaggttgaacattggtgtgtggttttcttgaatttgtatcaagatctctactcctgtctatttctggcttctcttttcacttcttggggaaacgtttgcacattgcagacaatatcacctgagcccccaactgatggctttcattctaaacacgcggtacaaataaactgaaacagaaggtttaagaaacacattttcttgtggtcctgtagaactgccaaaacgtcatacattgctttacagagtgattagttatttctaatcaagaaactgagggcaagtctacctaacaatttgaagaaaagtttaaatcttatataaatcctttgagatttccatgttccaactggcctgaagtggctgcatataagtgtatgtataagtggtatatggagtaactgaatttcgggtagctcttttttgtttcctatggacagttgtacctgaatactcgcagcggatttaccc

SEQ ID NO: 826 - DNA, 1369 bp, Brachypodium distachyon
gctagggggtgcaaaccaaaaactcaaccagaacataaaagcccaggttacgcaagcgtgaactgaaatcagcgcctccgtcccgtcgatcccacggtcatcgttcccgtgacgccctcatactttttgttctttacccccaaagcgcaagggaccctttttgcttccgcccctctccttcttccccctcctcgtctccgccgcctcgccatcgatcgaccgcctccggtctcgatgggcctcctgtcgaacaggattggaaaggagagcctgaaggctggggatcacatctactcatggagggccgcgtgggtctacgcgcatcatggaatatatgtgggtgatgacaaggtgatccattttaccagaggaagggaccaagaggtcggaacaggaacagtcatcgattttcttcttgtgagttctggtcctaataggagtagcacaccatgcttggtgtgtagcagcaatgaagtcaccaccgccactgagactggcgtgacatcctcttgcctcagttgttttctagcagggggggctctctaccgtttcgagtatgctgtcaacccagccctttttcttgccaaagctcggggagggacgtgcacccttgccgcaactgatgccaatgaggtggttgtccgccgtgccaactacttgttgagcaatggtttcaggtgctacagcctgttcaagaacaactgtgaggactttgcgatatactgcaaaactggcctccttgtggccgaacaaggtagtgttggccttgggcaaagtggtcaggctgtgtctatcatcggcgggcctcttgctgctgtggtttcaaccccgttccgcctagtaactacgaatgtctatggaatggcagtgatggctgtcggggtgtactgtgtgagccggtatgcagctgacattggaaaccgtcgagatgtgctgaaagtagaagtggaggatctgacagctggacttgcaagcggccggattcgtgcggcaaacgtcagtcagctggtaactccgggacaagtccaagttcctgctgtgaccacactcgttgctgcttagggtgctgtagcactgttgtaaaatctggagatttatatatcagtctgggcctacttctctaccgctatatgtattatttaccaccgaaatcgttgttcaaactctgaaactgtgtcaaagagttaagttttcattcagcaatggttgcatgtagagtgttgtatcaagtatcaactactatcgtgtatttggcttgtccagtgttgtatgaagattgaaaagtgacgtgtggcttgctcgaatttaaaccaagattttgtctcccatcgtctcgtggcatcactttccacttcttgggcagacgttt

SEQ ID NO: 827 - DNA, 1213 bp, Avena sativa
ctccttcctcgccctcctcccctctcttctccgccgcctcgccattcgtccacactacctcccgtctccatgggtctcctgtccaacaggaccgggaaggagaccctgaaggcgggggatcacatatactcctggagggccgcgtgggtctacgcgcatcatggaatatatgttggcgatgataaggtgatccattttaccagaggaagggaccaagaggtcggaactggaacagtcattgattttcttctcgtgagttctggccctactaggagcaccactccatgcttggtatgcagcagcaacgatgccaccgcagccacggaggcaaatggcgtgacgtcctcttgcctcagctgtttcctggcagggggtgccctctaccgtttcgagtatgctgtcaacccggccctcttccttgccaaggcgcgaggagggacgtgcacgcttgcccccactgatcctgatgaggtggtcgtccgacgtgcaaactacttgttgagcaatggattcaggtgctacagcctgttcaagaataactgcgaggactttgcgatatactgcaagactggtctgctagtggctgagcaaggcagcgtcgggctcgggcagagtgggcaggctgtgtccatcatcggcgggcctcttgctgctgtggtttcgacccctttccgcctagtaaccaccaacatctacggaatggcggtgatggctgtcggggtgtactgtgtcagcaggtatgcaggtgacattggcaaccgtcgagacgtgctgaaagtagaggtcgaggacctgacagccggactcgcaagcggccggattcgtccggcgaacatcagtcagctggcaactccagggcaagtccaggctccggttgtgaccacacctgttgctgcttagaatgcagcagtgctgttgtaaaatctggagatgtatacatcaccttcactaccatgtattttaccaccaaatgtgttgttgaaacctgcctgctaaaactgtgccaagagtgaacttcccattcggcaatagctgtattaagagtgttgtgtctactacgatcgtgtatggttttaagctgttgtgtggttttgcttgaccaatattttcgctcccgtctatttctggcatctgcttatacttcctgaacatcaaccatcgacagcagaattgaacagtgtaagatctgttctttttttttctcaagctgtga

SEQ ID NO: 828 - DNA, 3754 bp, Oryza sativa
cgaagcacaaaaccagatatacggggtcccttaactatataaaaccggtcacccgagatccctcgacggttttgacaccggttttatcctacgtggcggctgagtcagcgtgggatccacatgtcatggtgccacctcatctcttccctcttatttcccctcttctccctttctctctctctctcacttttctcagctgacgacggggggagcaaggcggcggcgggaggagcaaggcggggggagaaagatggcgacgcggcggccgcaccaagtccgccagcagaagaggaaggagcagcgcgcggcggcgtcggcgggagaggagggagcggcgccaccactttcaccagcgcccacagcgacagcttgccggcgccgctcgccgcggcgatgacgacgaccgtggatgccacgacggccgccaagtggagaaggaggaaaagaccacggcggtcggccgcgccgcgctgcgagcctgcacgaactcacgtagccccggaggaagaagactctcggtcaagagtcaagacttcgaccaatcgaccaacacgaagcggcaaaggaaacgtcaccgtcgcggcgtcgccgatggagtcgtccgcctcctcctcggccgcggtggcggcggagggggcgccggcgacgggggagcagctggcggtgttctggcacgagggcatggtggcccacgacgccggccgcggcgtgttcgactcgggccgcgacccgggcttcctcgacgtgctcgaccagcacccggagaacgccgaccgcgtccgcaacatggtctccatcctccgccgcggccccatcgcgcgcttcatctcctggcactccggccgccccgcccacgccgccgagctcctctccttccactccgccgaatacatagaggagctcgtgcaagcaaatgccgttggtgccaagaagctgtgtgaaggcactttcttgaaccctggatcctggggtgctgcgcttctggcggctggaacaactttatcagcgatgaagcacatactagatggacatgccaagattgcctatgcgttggtccgcccccctggccatcatgcgcaaccggaccgtgctgatggttactgcttcctgaacaatgctgggcttgcagtgaagctggctctggattcaggacgcagaaaggttgctgttgttgatattgacgtgcactatggaaatggcactgcggagggcttctaccacacagacagcgtgctgacgatctctcttcacatgaagcatggttcatggggtccatcacatccccagagtggctcggtggatgagattggtgaaggcaggggtcttgggtacaatctcaatattcctttgcctaatggcagtggggatgcagggtatgagtatgcgatgaatgaattagttgttccagccatagagaagtttcgtcctgagcttttggtttttgttgttggccaagattctagtacgtttgatcccaatggaagacagtgcttaaccatggatggttatcggaaaattgggcaaataatgagaggcatggctgatcaacacagcaatggtcaaatattgatcgtgcaggaagggggttatcacatcagctattcggcatattgtctgcatgcaacactagaaggtgttctgaatctacaagccccgttgcttgatgatccaatcgcctattatccagaggatgagaaatacaccatgaaagttgtggacatcatgaagaaatgctggaaagaatctattccattcttgaaggacatatagaaatccatttcttttagatgcgagtgcccttgaacctcaatttcatatcagtgcaccgtctattcttatggccttttgactgaaagtacatgcattcattggagcaacattcgagtgcttgttcctttcataaacccctgattcacaagttctcaattcacattggtattgtacatacatcatgtcaaactctaccatcttatatttgtggacctcaattgctgcgcctaataagtaacgctgactaacagatgggctgtttgattatgcaatggggcattggggctacagccacctgtattatataagcgcaccagttccaagtctgaaaccaagtgccaagtctgaattattgtctagcaaggaatgctacctgctgccacatcactcgtcaacttactgcctacagcaatactggaaggtaaatctaaacatcctctgaagaccaagaccaaggggtttcgtagcaaaagctccatcaggattcaggaatcaggactggaagccgccagttgcggggacgtgaaatcggcgtctcgtcaatcctacggccgctccgctcttcccttttcccgtgcttgcactccaaaaacgcaaaaaccgctttcttttgcttccgtccctttccattcgtcctccctccgcctctctcgccatccgccgcggcgccaaccgagtcgatcccccctcccgcccccgccgccatgggcctcctctcgaacaggattgggaaggagaccctgaaggcgggggatcacatctattcgtggagggccgcgtgggtctacgcgcatcacggaatatatgtgggcgatgataaggtgatccattttactagaggaaggggccaggaggtcggaacaggaactttcattgacctcctccttatgagctctggtcctaatacaaacactccatgttcaatatgcaacaatgaaggtgccaccaccaatacggagacaaatggtgtggtatcctcttgcctcaactgcttcctgtcagggggcgccctctaccgtttcgagtatgctgtcaacccagcacttttccttgccaaagcgcgaggagggacgtgcacgcttgccccaactgatccagatgaggttgttgtgcgccgtgccaatcacttgctcagcaatggtttcaggtgctacaacctgttcaagagcaactgtgaggacttcgcgatatactgcaagacaggcctccttgtggcagagcaaggtgtcgtcgggcagagtgggcaggccatctccatcatcggtggacctcttgctgcggtgatttcaaccccattccgcctagtaaccacgaatatctatggaatggcggtgatggcagttggggtgtattgcgccagcaggtacgcagctgacattggcaaccggcgagatgtgctgaaagtggaagtggaggacctgactgctgggctggcgagtggcaggattcgtgccgtggagaacatcagtcagttggttgctccggcagaagcccaaggtctggccgtaaccgcacctgttgctgcttaaagtgcaccactgagatctatacattactccagaccttctgctgctaaatttatggatgtttcgttgtcaaatatcagctgaaattgtgtaccagagtgagcctcccattcagcaatagctgtacaaacaatgaaaaaacttatacgcccgtttctgccatcaactgttatgtgtggcttatctactgttgtataaattatgaacatggaagtgtggtgcttgtcgatttgcaactcaagattgtgacagctctcttattttaggcagtaattccacttcattaggagacgtttgcttgtaagtgggaaatataattcacctgacctgagccaacttgggatgtagaggttaactttcattcatggcctcattgggagttgttgggacacggaaaaactgcaattttgtttgagaattcatataacagcaaagctcataagccattttttcactcg

SEQ ID NO: 829 - DNA, 1455 bp, Setaria italica
atgaaggattccggacaacaaaaatactgttctcttctcaaagcagaaactccaccaggatacttgcttgagccggccaacagcagttacgggtgtcacgcacgccgcaagccaccccttcgcttccgttccgtccctctcatttctccccttgttctctctccctctacgccgcctccgctcgccgtcccaaatcggcccaccggccgcgccaggctccccgtctccatgggtctcctctccaacaggattgggaaggagagcctcaaggcgggggatcacatctactcgtggagggccgcctgggtctacgcgcatcacggaatatatgtgggtgatgataaggtgatccatttcacaagaggaagggaccaggaggttggaacaggaactgtcattgatattattcttgtgagttctgcaccgaaacgaagcgacacgccatgtccggtatgcaccaacgaaggcaatgacagcagcacggagacaaatggcgtagtatcctcttgtctgaactgcttcctgggtgggggtgccctctaccgttttgagtatgcggtcaacccagctctcttccttgccaaagcgcgaggagggacgtgcacgcttgctccctctgaccctgatgaggcggtgatccgccgtgccaagtacttgctgagcaacggtttcaggtgctacaatctgttcaagagcaactgcgaagactttgcaatatactgcaagactggcctccttgtggcggagcggggtgttgttgggcagagcgggcaggccatctccattattggtggacctctcgctgcagtaatctcaaccccgttccgcctggtcaccacaaacatctacggaatggcagtgatggccgtcggggtgtactgtgccagcaggtacgcagccgacattggcaaccgccgcgatgtggtgaaagtggaagtcgaggacctgactgcgggactggcgagcggcaggattcgtgcggtggagaacatcgcccagctggtggttcctgcagaaagcccggcagcagccacaatcgcagcttaaaaatgcagcactgctgttgtaatatctggaagatttacatcagtcgagaccttcattactgccaagtgtatgagttgtttgttctttgtgttcaaatgtgctgaaactctgttgaagtgaggtttccatccggcaatgtctgtatgagtctatcgtgtatcacttgcccagtgttgtgcatcaagattaaaaaaaaatgttgtgtcttgttcgtaatatcgaacttgagttctaaggaaactttgtttataccatgacgcagcttgagaggggtacctttctgccgccagtgaatttagatttttctcacaagcaggaccggactaccgaaggggcttcattctgatagctgaagtttgtgcacgacaacaacctttatttgttgataagtattgttgacactttgcg

SEQ ID NO: 830 - DNA, 1147 bp, Saccharum officinarum
cctacattcccggaacgacccacgcgacgcgctctccttgactcaaacgcgcaagcaacctcctcttcgcttccgaccctctcctctcttctccctctacgccgcttctgctcgccggcccaaatcgactcatcgaccacgcccgccgccaggctcccgtctccatgggtctcctctcgaacaggattgggaaggagagcctcaaggcgggggatcacatctactcctggaggtccgcgtgggtctacgcgcatcacggaatatatgtgggtgatgataaggtgatccattttacaagaagtggccaggaggttggaacaggaactgtcgttgatattcttcttgtgagttctgccccaaagcgaagcaacacgccttgtccggtatgcaccaacgaaatcagtgacaccagcacagagacaaatggggtggtatcctcttgcctcagctgcttcctagctgggggtgccctttaccgtttcgagtatgcagtcaacccagcgctcttccttgccaaagcacgaggaggaacgtgcaccctcgcgcactctgatcctgacgatacggtgattcgccgtgcgaagtacttgctgaacaatgggttcaggtgctacaatctgttcaagagcaactgcgaggactttgcgatatactgcaagactggccttcttgtggctgaacgcggtgttgttgggcagagcgggcaggctatctccatcattggtggacctcttgccgcagtggtctcaaccccgttccgcttggttaccacaaatatctatggaatggcagtgatggccgtcggggtgtactgtgcaagcaggtatgcagctgatattggcaaccgccgtgacgtggtgaaagtggaagtagaagacctgacggccggattggccagcggcaggatacgtgctgtggagaacatcgctcagctggtggctccggcggcagaaagcccagccacggccacactggctgcttaatattgttgttgtgcgtcagtcaacgtgtttactatttctttggttcattggttcagaatccgcttaaactctgttgaagtgagctttccattcggcaatgtctgtacgaatctcgatcgtgtttgtattatgtttcaaagataaaaatgtgactgttgtcccgt

SEQ ID NO: 831 - DNA, 1531 bp, Sorghum bicolor
ccattttgtccttccgttactcaaacgcgcaagccacctcctcttcgcttccgtccctctcctcttctcttctcttctctctccctcctccgccgcttctgttcccggctcaaatcgactcatcgaccgcgcccgccggcaggctccccccgtcgccatgggtctcctctcaaacaggattgggaaggagagcctcaaggcgggagatcacatctactcctggagggccgcgtgggtctacgcgcatcacggaatatatatgggtgatgataaggtgatccattttacaagaggaagtggccaggaggttggaacaggaactgtcgttgatattcttcttgtgagttctgccccaaaacgaagcaacacgccttgcccggtatgcaccaacgaaaccagtgataccagcacagagacaaacggcgtggtatcctcttgcctcagctgcttcctagctgggggtgctctttaccgttttgagtatgcagtcaacccagcgctcttccttgccaaagcgcgaggaggaacgtgcactctcgcgtgctctgatcctgacgatacggtgattcgccgtgcgaagtacttgctgaacaatggtttcaggtgctacaatctgttcaagagcaactgcgaggactttgcgatatactgcaagactggccttcttgtggctgagcgcggtgttgttgggcagagcgggcaggctatctccatcatcggtggacctctcgccgcagtggtctcaaccccgttccgcttggttaccacaaatatctatggaatggcagtgatggccgtcggggtgtactgtgcaagcaggtatgcagctgatattggcaatcgccgtgacgtggtgaaagtggaagtcgaggacctgacggccggactggccagtggcaggatacgtgctgtggagaacatcgcccagctgatggctccggcagcagaaagcccggccacggccacggccacactggctgcttaaaatgtaacattgttgtgacatctcgagggacgagggatgtgcgtcacagcgtcagtcaacatgtttaggtttacaattgtgttggttcattgtgttcagaatccgcttaaactctgagttcattgtgttcagaatctgcttaaactgtgttgaagtgagctttccattcggcaatgtctgtacgaagctcgatcgtgtatgtcttgtaagtgttgtatttcaaagataaaaatgtgactgttgtgcgtcttgtgctggtattattatcgaacttgacgtctaaagaaacttggttgtttacactatgtatgacagcttcagaaaggtcattctccgccgtcagtgatttagatctgtatcataaggacctgaccacctgaagcactctcatccgatggtagatgaaacttgtgtacctatgtcaaacttctgttaagatgtgagttgctgagcatgttacagtaggaaaaaaaaaggcactttagagtttcctggatcatgggacatgggccagttaacctcatatcaacaggtgaaggtatattt

SEQ ID NO: 832 - DNA, 1454 bp, Panicum virgatum
gtactctctcaagaactccacaagaacttcctcgaccttaatccttgagccagccagcagcagttacgcgtgagatcagcgtctcgtgcatcctacggccacccgcttttcccattttgtcctttactcaaaagcgcaagccacctcctcgcttccgtccctttccatcctctcctcttcgctctccctctacgccgcctccgctcgccgtccagatcggctcaccggccgcgccaggctcccatctccatgggtctcctctctaacaggattgggaaggagagcctcaaggcgggggatcacatctactcgtggaggtccgcctgggtctacgcgcatcacggaatatatgtgggtgatgataaggtgattcattttacaagaggaagggaccaggaggttggaacaggaactgtcattgatattcttcttgtgagttctgcacctaaacgaagcgacacgccatgtccggtatgcaccaacgaagacaatgacaccagcatggagacaaatggcgtggtatcctcttgcctcaactgcttcctggctgggggtgccctttaccgttttgattacgcagtcaacccagctctcttccttgccaaagcgcgaggaggaacgtgcacactcgctacctctgaccccgacgaagcagtggtccgccgtgccaaatacttgctgagtaatggtttcaggtgctacaacctattcaagagcaactgtgaggacttcgcaatatactgcaagactggcctccttgtggcggagcggggtgttgttgggcagagcgggcaggccatctcgatcattggtggacctctcgctgcagtgatctcaacgccgttccgcctggtgaccacaaacatctatggaatggcggtgatggccgtcggggtgtactgcgccagcaggtacgcggctgacattggcaaccgtcgtgatgtggtgaaagtggaagtcgaggacctgacagcaggcctggccagcggcaggatccgtgcggtggagaaccagctggtggttccaccagaaagcccggctgcctaaaatgcagcattgcttctgtaacatctgcaagatttacatcggccgagacctttactgctgctaagtgtatgaattgtttgttcgttgtggttaaaaatcttctgaaactctgttgaagtgaggtttccgttcggaaatgtctgtatgagtatcgtgtatggcttgtccagtgttgtgtatcaagataaaattactgttgtgtgtcgcgtcgtaatatcgaacttggcttctaaagaaccgtgtggatatttagatttttctcatataagaagaggatctgagttgcttggacacttgattctgatggtagctcaaagcctgaaacatttgtacgcaaacataattgctcttctcgaatacgcaggagagtagtgtctcattgtatcaagaccatgtttggttccaaa

SEQ ID NO: 833 - DNA, 1177 bp, Panicum virgatum
ccatcctctcctcttcgctctccctctacgccgcctccgctcgccgtccagatcggctcaccggccgcgccaggctcccatctccatgggtctcctctctaacaggattgggaaggagagcctcaaggcgggggatcacatctactcgtggaggtccgcctgggtctacgcgcatcacggaatatatgtgggtgatgataaggtgattcattttacaagaggaagggaccaggaggttggaacaggaactgtcattgatattcttcttgtgagttctgcacctaaacgaagcgacacgccatgtccggtatgcaccaacgaagacaatgacaccagcatggagacaaatggcgtggtatcctcttgcctcaactgcttcctggctgggggtgccctttaccgttttgattacgcagtcaacccagctctcttccttgccaaagcgcgaggaggaacgtgcacactcgctacctctgaccccgacgaagcagtggtccgccgtgccaaatacttgctgagtaatggtttcaggtgctacaacctattcaagagcaactgtgaggacttcgcaatatactgcaagactggcctccttgtggcggagcggggtgttgttgggcagagcgggcaggccatctcgatcattggtggacctctcgctgcagtgatctcaacgccgttccgcctggtgaccacaaacatctatggaatggcggtgatggccgtcggggtgtactgcgccagcaggtacgcggctgacattggcaaccgtcgtgatgtggtgaaagtggaagtcgaggacctgacagcaggcctggccagcggcaggatccgtgcggtggagaaccagctggtggttccaccagaaagcccggctgcctaaaatgcagcattgcttctgtaacatctgcaagatttacatcggccgagacctttactgctgctaagtgtatgaattgtttgttcgttgtggttaaaaatcttctgaaactctgttgaagtgaggtttccgttcggaaatgtctgtatgagtatcgtgtatggcttgtccagtgttgtgtatcaagataaaattactgttgtgtgtcgcgtcgtaatatcgaacttggcttctaaagaaccgtgtggatatttagatttttctcatataagaagaggatctgagttgcttggacac

SEQ ID NO: 834 - DNA, 2121 bp, Triticum aestivum
cattccctggctatttaaggcctcccatcccctccttccttttccttcctcccatcggcacgcccatcccgctcctctcataatcctgagagtttcttcttttgttttatttttctttcttggtaggagtaacaatagttttggctctcctcctttctctctccctgtatccaaggagagaaatccagaggcgaagcttcagggtttgtaaattttccggatctaatcaactaaccaaaaaaacccaaaaaaggaaccatgagccacttcgccgccatgaagagccccgtcccggtcgccgccgccgccgccaccgacgcgaagagcccgctcttctgccccaagccgcgccgcccggtcgcgcccctccggtgccaccagagtagccactccgacgcgggcgccggcatggatctgctcgacctcctcctgtcaaagggcgatgagagcaatctttcggcggcgtccccgcagccgccgttgttctgtggctcgcctccgcggcgggcctcgaacccggtggtccacgacagccggttcggcatggactgcccgtccagtcccctgccgtggtggccggtgatgtcgccggtcacgccagcgccggtggtggtccgtcctaccccacgcccggcgggaccaccgatgtcgccccgttcctcggctgggtgcgctcgcgtgttccagccagccgtccgcgttgagggttttgactgcctcgacggtggccgtagcggccgtggccatggcatcgccgccatggtctagatgcacatacaacatcgaataaccaggaaatcttctcccctcagtagtgcaaaagcttggagggagagagatgagagtgaggagatgagtgagaggagcttaagtccaaaatttaacccctaaaaactatataatccatcaatcaaatcccataagtataatgagtctaggtaattttaccacaaatctttttgtatgtaaataaatttcaggttcagatgcaggtgcccttcatgtaaatttgggagctctagtttggggggacggggtagaagaaatctagaaggggggatctgggacagagggcacgagaaacacgaagtttagccctctttgtatgaatcaattttttcatgagtccctttgccttccttctggattagtcattcaattaggttggagggaggggttgggaattagttaggtacctgtcctagttcatctgtcatcatgcttatttttggtttatgatggaattgtttttgtccatgcaaccaagaaatccagggccagcaaggccatggagatgtgtacaaaagagtggctaccagaagagaagagagagcagctaggtttaagtcaagtcaatgagtgagttgtgtgagaggcatgaatgatgtattcctgatatcgttttctctgtatatgtaatatatcgtttcattgaagcaatatgtgtaatatctcatgccatgattatcaccagcccttgtgacatcttttattttatggattttttcgtcccctctcattttcttggtggttggttgattgaatcgtatggagccccatcacaacacatggtttccatgtgctgaagcaacacgtaggtgataaggatggtgactagccaatgactaacgcaaaagagcctgcctgagtggctaataatctcaagctggctcatggggatttgaagggccaaagatgaaataccatggtttttcttgtggccttcaccccatatgtccttttctttgagatgtgctatgtggtactagtactgaatcttttgtgttgaatccactggatttattggggcagtcaatcaatcaaccaagttgttgacgcagatgctctgccagctgcaacggtgaacaagttgtactatttaccaccagtaaaatgcaggcagagaaagcatgcagcacacgttcttatctttacctgctgcgagtcaaaatccacatgctttgtggcgtcttgtgcctgccacaaggtgagacgtagatgcagtgatctcacctcaaaaggtgtgaagctgagagggaaaagtagacaggaggatgcaagcaaggggcatggcaacttgagtgcacttgaggacagattcaacgcaggatttcaccggaa

SEQ ID NO: 835 - DNA, 1537 bp, Secale cereale
gctcctctcataatcctgagattttcttcttttgttttatttttctttcttggtaggagtaacaatagttttggctctcctcctttctctctccctgtatccaaggagagaaatccagaggcgaagcttcagggttgtaaattttccggatctaatcaactaaccaaaaaaaccaaaaagaaaccatgagccacttcgccgccatgaagagccccgtcccggtcgccgccgctgccgccaccgacgcgaagagcccgctcttttgccccaagccgcgccgcccggtcgcgcccctccggtgccaccagagcagcaactccgacgtgggcgccggcatggatctgctcgacctcctcctgtcaaagggcgacgagagcaacctttcagcagcgtccccgcagccgccgttgttctgtggctcgccgccgcggcgggcctcgaacccggtggtccacgacagccggttcggcgtggactgtccatccagtcccctgccgtggtggccggtgatgtcgccggtcatgccagcgccggtggtggtccgtcccaccccacgcccggcggggccaccgatgtcgccccgttcctcggccggatgcgctcgcgtgttccagccagccgtccgcgttgagggttttgactgcctcgacggtggccgtagcggccgtggccatggcatcgccgccatggtctagatgcacatacaacatcgaataaccaggaaatcttctctcctcggtagtgcaaaagctttggagggagggaagatgagagtgaggagatgagtgagaggagcttaagtccaaaatttaacccctaaaaactatataatccaccaatcaaatcccataagtataatgagtctaggtaattttaccacaaatctttttgtatgtaaataaatttcaggttcagatgcaggtgcccttcttgtaaatttgggagctctagtttgaggggatgggtagaaatctagagggttggatcagggacagagggcacaagaaacacaaagtttagccctcttgtatgaatcaattttttcatgagtccctttgccttccttctggattagtcattcaattaggttggagggagggagaggttgggaattagttaggtacctgtcctagttcatctgtcatcatgcttatttttggtttatgatggaattgtttttgtccatgcaaccaagaaatccaaggccaagcaaggccatggagatgtgtacaaaagagtggctacaagaagatcagagagagagagagcagctaggtttaagtcaagtcaatgagtgagttgtgtgagaggcatgaatgatgtattcgtgatatcgttttctctgtatatgtaatatatatcgtttcattgaagcaatatgtgcaatatctcatgccatgattatcacaagcccttgtgatatctttcatttttggatttccccccacctctcaatctcttggtgggtggttgaatcgtatgtagccccatcacaacacatggtttccatgtgctcaagcaacacgtaggtgataag

SEQ ID NO: 836 - DNA, 1352 bp, Secale cereale
tcaggttttatttttctttcttggtaggagtaacaatagttttggctctcctcctttctctctccctgtatccaaggagagaaatccagaggcgaagcttcagggttgtaaattttccggatctaatcaactaaccaaaaaaacaaaaagaaaccatgagccacttcgccgccatgaagagccccgtcccggtcgccgctgctgccgccaccgacgcgaagagcccgctcttttgccccaagcctcgccgcccggtcgcgcccctccggtgccaccagagcaccaactccgacgtgggcgccggcatggatctgctcgacctcctcctgtcaaagggcgacgagagcaacctttcagcagcgtccccgcagccgccgttgttctgtggctcgccgccgcggcgggcctcgaacccggtggtccacgacagccggttcggcgtggactgtccatccagtcccctgccgtggtggccggtgatgtcgccggtcacgccagcgccggtggtggtccgtcccacgccacgcccggcggggccaccgatgtcgccccgttcctcggccggatgcgctcgcgtgttccagccagccgtccgcgttgagggttttgactgcctcgacggtggccgtagcggccgtggccatggcatcgccgccatggtctagatgcacatacaacatcgaataaccaggaaatcttctctcctcagtagtgcaaaagctttggagggagggaagatgagagtgaggagatgagtgagaggagcttaagtccaaaatttaacacctaaaaactatataatccaccaatcaaatcccataagtataatgagtctaggtaattttaccacaaatctttttgtatgtaaataaatttcaggttcagatgcaggtgcccttcttgtaaatttgggagctctagtttgaggggatgggtagaaatctagagggttggatcagggacagagggcacaagaaacacaaagtttagccctcttgtatgaatcaattttttcatgagtccctttgccttccttctggattagtcattcaattaggttggagggagggagaggttgggaattagttaggtacctgtcctagttcatctgtcatcatgcttatttttggtttatgatggaattgtttttgtccatgcaaccaagaaatccaaggccaagcaaggccatggagatgtgtacaaaagagtggctacaagaagatcagagagagagagcagctaggtttaagtcaagtcaatgagtgagttgtgtgagaggcatgaatgatgtattcgtgatatcgttttctctgtatatgtaatatatcgtttcattggagtaatatgtgtaa

SEQ ID NO: 837 - DNA, 1379 bp, Secale cereale
gactcgcccatcccgctcctctcataatcctgagattttcttcttttgttttatttttctttcttggtaggagtaacaatagttttggctctcctcctttctctctccctgtatccaaggagagaaatccagaggcgaagcttcagggttgtaaattttccggatctaatcaactaaccaaaaaaccaaaaagaaaccatgagccacttcgccgccatgaagagccccgtcccggtcgccgccgctgccgccaccgacgcgaagagcccgctcttttgccccaagcctcgccgcccggtcgcgcccctccggtgccaccagagcaccaactccgacgtgggcgccggcatggatctgctcgacctcctcctgtcaaagggtgacgagagcaacctttcagcagcgtccccacagccgccgttgttctgtggctcgccgccgcggcgggcctcgaacccggtggtccacgacagccggttcggcgtggactgtccatccagtcccctgccgtggtggccggtgatgtcgccggtcacggcagcgccggtggtggtccgtcccaccccacgcccggtgggaccaccgatgtcgccccgttcctcggccggatgcgctcgcgtgttccagccagccgtccgcgttgagggttttgactgcctcgacggtggccgtagcggccgtggccatggcatcgccgccatggtctagatgcacatacaacatcgaataaccaggaaatcttctctcctcggtagtgcaaaagctttggagggagagaagatgagagcgaggagatgagtgagaggagcttaagtccaaaatttaacccctaaaaactatataatccaccaatcaaatcccataagtataatgagtctaggtaattttaccacaaatctttttgtatgtaaataaatttcaggttcagatgcaggtgcccttcttgtaaatttgggagctctagtttgaggggatgggtagaaatctagagggttggatcagggacagagggcacaagaaacacaaagtttagccctcttgtgtgaatcaattttttcatgagtccctatgccttccttctggattagtcattcaattaggttggagggagggagaggttgggaattagttaggtacctgtcctagttcatctgtcatcatgcttatttttggtttatgatggaattgttttgtccatgcaaccaagaaatccagggccaagcaaggccatggagatgtgtacaaaagagtggctacaagaagatcagagagagagagagcagctaggtttaagtcaagtcaatgagtgagttgtgtgagaggcatgaatgatgtattcgtgatatcgttttctctgtatatgtaatatatatcgtttc

SEQ ID NO: 838 - DNA, 2161 bp, Triticum aestivum
cgcccatcccgctcctctcataatcctgagagtttcttcttttgttttatttttctttcttggtaggagtaacaatagttttggctctcctcctttctctctccctgtatccaaggagagaaatccagaggcgaagcttcagggtttgtaaattttccggatctaatcaactaaccaaaaaaacccaaaaaagaaaccatgagccacttcgccgccatgaagagccccgtcccggtcgccgccgctgccgccaccgacgcgaagagcccgctcttctgccccaagccgcgccgcccggtcgcgcccctccggtgccaccagagcagccactccgacgcgggcgccggcatggatctgctcgacctcctcctgtcaaagggcgacgagagcaatctttcggcggcgtccccgcagccgccgctgttctgtggctcgcctccgcggcgggcttcgaacccggtggtccacgacagccggttcggcatggactgcccgtccagtcccctgccggtcacgccagcgccggtggtggtccgtcccaccccacgcccggcgggaccgccgatatcgccccgttcctcggctgggtgcgctcgcgtgttccagccagccgtccgcgtcgagggttttgactgcctcgacggtggccgtagcggccgtggccatggcatcgccgccatggtctagatgcacatacaacatcgaataaccaggaaatcttctcccctcagtagtgcaaaagctttggagggagagagatgagagtgaggaggagatgagtgagaggagcttaagtccaaaatttaacccctaaaaactatataatccatcagtcaaatcccataagtataatgagtctaggtaattttaccacaaatctttttgtatgtaaataaatttcaggttcagatgcaggtgcccttcttgtaaatttgggagctctagtttgggggggatggggtagaagaaatctagagggcggggatcagggacagagggcacaagaaacacaaagtttagccctcttgtatgaatcatttttttcatgagtccctttgccttccttctggattagtcattcaattaggttggagggagggaggggttgggaattagttaggtacctgtcctagttcatctgtcatcatgcttatttttggtttatgatggaattgtttttgtccatgcaaccaagaaatccaaggccaccaaggccatggagatgtgtacaaaagagtggctacaagaagagaagagagagcagctaggtttaagtcaagtcaatgagtgagttgtgtgaaaggcatgaatgatgtattcgtggtatcgttttctctgtatatgtaatatatcgtttcattgaagcaatatgtgtaatatctcatgccatgattatcaccagcccttgtgatatcttttatttttggaattttcctcacctctcaatatcttggtggttggttgaattgtagccccatcacaacacatggtatccatgtgctcaagcaacacgtaggtgataaggatggtgactagccaatgactaatgcaaaagagcccggctgagtggctaataatctcaagctggctcatggggatctgaagggccaaagataaaataccatgtttttccttgtggccttcaccccatatgtccttttctttgagatgtagatgtggtacgtactgaatcttttgtgttgaatccactggatttattggggcggtcaatcaatcaaacaagttgttgacgcagatgctctgccaagagctgcaacggtgaacaagttgcactatttaccaccagtaaaatacaggcagaaaaagcatgcagcacagcacacgttcttatctttacctgccgcgagtcaaaatccacatgctttgtggcgtcttgtgcctgccacaaggtgagacgtagatgcagtgatctcacctcaaaaggtgtgaagctgagagggaaaagtagacaggaggatgcaagcaaggggcatggcaacttgagtgcacttgaggacagattcaaacgcaggatttcaccggaagtaaagtaatctttgtttgaatctcaggccaggccttttcaaaaggagaatatatagtaggagtagaccctgaagatgctggagagaatttgtttatgtctcagcatgactcaaat

SEQ ID NO: 839 - DNA, 1405 bp, Avena sativa
tggcatatcgcatccggctcctctcataatctttgagattttctttgttttcttttttctttcttggtaggagtaacaatagtttcggtcctcctcctttgtctctccctctatccaaggagagaaatcaatccagaggcaaagcttcaggttctgtaaattttccggatctaatcgactaaccaaaaaaaccaaaaaagaagccatgagccacttcgccgccatgaagagccctgtcccggtcgccgccgccgccaccgacgcgaagagcccgctgttctgccccaagccgaggcgccccgtcgcgcctctccgttgccaccagagcgacgccggcatggatctgctcgacctcctcctgtcaaagggcgaggagagcagtctgtcggcagcgtccccgcagccaccgctgttctgcggctcgccgccgcggcgcgcctcgaatccggtggtccacgacagccggttcggcatggactgcccgggcagtcccatgccgtggtggcctgtgatgtcgccggccacgccggcgcccgtggcggtccgccctacgccacgcccagcgccgaccccgatggcatccccgcgctccgcggcagggtgtgctcgcgtgttccagccagccgtccgcgttgagggttttgactgcctcgacggtggccgtagcggccgtggccatggcatcgccgccatggtctagatgcacatacaacatcgaataaccaggaaatctttctccctcaacagtgcaaaagctttgaggggagagtgaggagatgagtcgagagaggaaatttaaccccctaaaacctatataaatccatccaaatccaatccaatccaatcccaccacaagtataatgagtttaggtgattttaccacaaatctttttgtatgtaaataaatttcaggttcaggtgcccgtcatgtaaatttggggagctctagttcagggggaatcgggtagaaatctagagggaggggtcagggacaagggcaaaagaaaaacacaagtttagccctttttgatgaatcaatttcttcatgctgtccctttgccttccttttggattagccattcaattaggtttgggtgagggagggttggggattagtagttaggtggtacctgtcctagttggttcgtcatgatgcttagtatttttggttttcgatggaattgttttttgtccatgcaaccaagaaatcccaaggccaaggccatagagatgtgtacaaaagagtggctacaactacaagaagagagcagctaggtttaagtctcgagtcaatgagttgagttatgtgtgagagaaagagaggcatgaatgatgtatttgtgatatctttctcttcgtaaatgtaatatattgttcgattctcaatgaagcaacatatgtatga

SEQ ID NO: 840 - DNA, 1440 bp, Triticum aestivum
aggggctggggaggtactggggcgtgggcggcaggaggtgcgggtcgtgccgggggtcgccggcggcggtgcactgccggacgtgcgatgggggcagtggggacggggcgtacctgtgcgcgggctgtggcgaggggcacgcgcgggcggggcacgagagggtgtgggtctgcgaggtgtgcgagctcgcgccggccgcggtcacctgcaaggccgacgccgccgcgctctgcgccgcctgcgacgccgacatccaccacgccaacccgctcgcgcgccgccacgagcgcgtccccgtgcagcccatcgggtcctcgtcacccgaggggcaggagcaggagcaggatgcgttcgtgatgtcgttcggcggctcggtcgacggggagaagcagcagaaccccgtggtgaacctgaacgacgctctggaggccggcgccggcgggaaggagaacgtgaagctggacttcctgttcgcggacatgatggaccctttcttcggctccgagctcccgcgcttcccgcacgccgacagcgttgtccccagcggcggcgcggtggagctggacttcggtggcgtcgccgcccccgtcgtcgtctccaacccgtcctacagctcctacacggcggcgtcgctcggtggaagtggctcgtcgtcggaggtcggcttggtgccggacgcgatctgtggccgaggcggcggcatcatcgagctggacttcgcacagtccaaggccgcgtacctgccctacacccccacaccaagccacagtactgtctcctcggtggatgttgggtcggtgccggagcggagcgacagcgccgtcgcggcggcgacgccggcgacgggggaggggagggaggcgcgtctgatgcggtaccgcgagaagcgcaagaaccggcggttcgagaagaccatccggtacgcgtcccggaaggcctacgccgagagcaggccgcgcgtcaagggccgcttcgccaagcgcgccgacgacgcggacaccgacgccgtcgcggcggccacgatcaccacgccggggccatgcgtgctcgacttcggcagctacggcgtcgtgcccaccttctgaggcggcgcctaatttcgtgtccatttcctctggcgagcgtgccggctgggtgcctaattaaatccggcacggcatggccggcacgagcgcgccgacgtgcatgcgtcgcacgtcgtgttccctcttgtatgattgcatgtaatgtttctcgagctggctgatcgctggctcgagtgtagtatactactctactcgacagacacgcacgcacgcacgcatgttttgctagaactagaataatacagatagttctagttgactagtctactacctgtacccttttctgggctagcttgatggcaaattaggctagggcaatgtaacgtgtttgctggaacagcttagttctagtttc

SEQ ID NO: 841 - DNA, 1071 bp, Pseudoroegneria spicata
  misc_feature (636)..(636): n is a, c, g, or t
  misc_feature (1058)..(1059): n is a, c, g, or t
gtcgtatcttgcttgctgctttgcttcgaagtgttgctactggtggtggtgtggagcgcgatggagctgcagggattggggaggtactggggcgtgggcgggaggaggtgcgggtcgtgccgggcgtcgccggcggcggtgcactgccggacgtgcggcgggggcggcggggacggggcgtacttgtgcgcgggctgcgactcggggcacgcgcgggcggggcacgtgagggtgtgggtctgcgaggtgtgcgagctcgcgccggccgcggtcacctgcaaggccgacgccgccgcgctctgcgccgcctgcgacgccgacatccaccacgccaacccgctcgcgcgccgccacgagcgcgtccccgtgcagcccatcgggtcctcgtcccccgaggggcaggagcaggatgcgttcgtgatgtcgttcggcggcgcggtcgacggggagaagcaggaccccgtggtgaaccttaacgacgctctggaagtcggcggcggcgggaaggacaacgtgaagcttgacttcctgttcgcggacatgatggaccctttcttcggctccgagctcccgcgcttcccgcacgccgacagcgttgtccccagcggcggcgcggtggaactggacttcggtggngtcgcagctgccgccgccgtcgtctccaacccgtcctacagctcctacacggcggcgtctctcggtggtggaagtggctcgtcgtcggaggtcggcttggtgccggacgcgatctgtggccgaggcggcggcatcatcgagctggacttcgcacagtccaaggccgcgtacctgccgtacacccccacaccaagccacagtactgtctcttcggtggatgttgggtcggtgccggagcggagcgacagcgccgtcgcggcggctacgccggcgacaggggaggggagggaagcgcgtctgatgcggtaccgcgagaagcgcaagaaccggcggttcgagaagaccatccggtacgcgtcccggaaggcctacgccgagagccggccgcgcgtcaagggccgcttcgccaagcgcgccgacgnngccgacgccgac

SEQ ID NO: 842 - DNA, 717 bp, Secale cereale
tcaggttccttccttctactcttggcgtcagcacccatctcccaagttcatccaccatgggcgactcatcctcggcttcctacatcagaatggtgcaccatctgatagagaagtgcatttgcttcaacctgaacaaggaggggtgcatggaggccctggagaagcatgccaagatcaaccctgtcgtcacttccactgtgtggaaagagctggagaaggagaacaaggagttcttcgagtcatacaacagggaccgcgtggagcggaacatcgaggcggcgacgatggagcgaatccagaagatgctctccgacgcggctgcctccaagagctccgacgacgagggctagaagaaggctgcttcttatctccaagctcatgcgcatgcatcacctctagctaattaattgtatgaatatcatgccttccgttaattggatccattatgtctaggaggatcgaatttattaattgcacctagctcataacagaccagtagcttgaaaccatgcatgcatgcagtacgatcgactacaaggactggcaagcaagcattttagtgtttgtgtggacgtgtacatatacaaatcactgcatggaatattcaagaggaccctacgtacggccctgggtcttcaggtgctaactctagctctaatcttatcgctgctgatcctttagcgaccacgtggcagtgagtaagtgtatatgcgccag

SEQ ID NO: 843 - DNA, 762 bp, Triticum aestivum
ctaccaccactctatcagtctatcccgttggttctacttggcgtcagcacggcacctgccttccaagttcatccaccatgggcgactcatcctcggcttcctacatcagaatggtgcaccatctgatagagaagtgcatttgcttcaacctcaacaaggaggggtgcatggaggccctggagaagcatgccaagatcaacccggtcgtcactgccactgtgtggaaagagctggagaaggagaacaaggagttcttcgagtcttacaacagggaccgcgtggagcggaacatcgaggcggcgacgatggagcggatccagaagatgctctccgacgcggctgcctccaagacctccgacgacgatgagggctagaaggctgctgcttatgtccaagctcatgcgcatgcatcacctctagctaattaattgtatgaatagcatgtcttccgttaattggatccattatgtctaggaggatcgaatttattaattgcacctatctcataacagaccagtagcttgaaaccatgcatgcatgcagtacgatcgactacaaggactggcaagcaagcattttagtgtttgtgtggacgtgtacatatacaaatcactgcatggaatattcaagaggaccctacgtacggccctgggtcttcaggtgctagctctagctctaatcttatcactgctcatcctttagcgaccacgtggcagtgagtaagtgtatatgcgtgtggtggtgtctacacgccgatcatat

SEQ ID NO: 844 - DNA, 823 bp, Triticum aestivum
tgggtacagctaccaccactctatcagtctatcccgttggttctactcggcgtcagcacggcacctgccttccaagttcatccgccatgggcgactcatcctcggcttcctacatcagaatggtgcaccatctgatagagaagtgcatttgcttcaacctcaacaaggaggggtgcatggaggccctggagaagcatgccaagatcaacccggtcgtcactgccactgtgtggaaagagctggagaaggagaacaaggagttcttcgagtcttacaacagggaccgcgtggagcggaacatcgaggcggcgacgatggagcggatccagaagatgctctccgacgcggctgcctccaagacctccgacgacgacgagggctagaaggctgctgcttatgtccaagctcatgcgcatgcatcaccttccagctaattaattgtatgaatatcatgtcttccgttaattggatccattatgtctaggaggatcgaatttattaattgcacctagctcataacagaccggtagcttgaaaccatgcatgcatgcagtacgatcgactacaaggactggcaagcaagcattttagtgtttgtgtggacgtgtacatatacaaatcactgcatggaatattcaagaggaccctacgtacggccccgggtcttcaggtgccagctctaatcttatcactgctgatcctttcgcgaccacgtggcaacgagtaagagtatatgcgccagtggtggcgtctacacgccgatcgatcatttatttattttttgtcatggttcgaaaaatatatacaaaaaggttattctcca

SEQ ID NO: 845 - DNA, 848 bp, Setaria italica
tgaggaggcggtgcccacgtggcttgctccacgtccccctccccccattcccctatttctatcgcctcgccggtggtcgttgcagctttgcagggacacacacagacagtacacacacaggccttcttctacccctcggcgactgggtgctagctcaacagcagcttaactgatctaaagcttttcttcaagtaaagccctagctggtagtgtcctactcagctctcaccatgggcgattcctcatcctcatcagcatcttacatcagaatggttcaccatctgatagagaagtgcatctgcttcaacctgaacaaggaagagtgcatggacgcgctggaaaagcatgccaacgtcaaccctgtaatcacttccaccgtgtggaaggagctggagaaggagaacaaggagttcttcgagacgtacaacaaggaccgcgtggagcggaacatcgaggcggagacgatgcagcggatccagaagatgctcgccgaggcggcggcctccaagacctccgacgacgacgagggctagtagctgtggtcagctaaactagggctatagatagctcctccattagctccatccatccatgtgggacaaagcttacacaccgtacctcacgtgagagttgagaccattctatatatatcttaatagctagctattagcttacttattagctgccaataataatatgccttttgcgagaacaccatgcatgcatgtgtcgaaaaatgcttaagattatattaattaggaggtcatcaagatcaaactatgtttaattcatgtatgtatatgtatatatctattttatgtacagaagacgatgaatattcaacccat

SEQ ID NO: 846 - DNA, 887 bp, Oryza sativa
atttctatctcctctcttcttcttcttcttcttcccccatagtttagatagataagtaagcagtgagctacctagctagctagctaacagtgagctgaatcagcagcggctcctgtctcctggagcttgctgatccagtagtccagtactactctgccattagctaagctagctggagcttaattagtggtgatctctgtctctctcaagctaggcgccatgggagactcatcatcctcagcttcgtacatcagaatggttcaccacctgatagagaagtgcatttgcttcaacctgaacaaggaggagtgcatggaggccctggagaagcatgccaacatcaaccctgtcgtcacttccacagtatggaaggagctggagaaggagaacaaggagttcttcgagacctacaacaaggacagggcggagcgcaacatcgaggcggagacgatgcagcggatccagaagatgctctccgacgccgcggcatccaagggctccgacgacgacgacgacgacgagagctagctctagctaagctatagctatagctagagttcatgactagctcttcacatgagctctctagctagctagcttgcttgtttgatttggctccatcccattgagagctctttttcaatcctcgtattaatataaatgtgccgtaagcatgcatcatatatagattagctagccagctagctgccacaaaattaaatcatgaacatgtagttgtgtgtagtatgttattagcacaagaaatcatgtactaggtgtcatgtactgtttagtatatatgtgcatcttatgtatgcaaacatgaatgcatgcgtggaatattcaggatatggaagattgtcttcatgcaccttgcgatctacagg

SEQ ID NO: 847 - DNA, 2361 bp, Panicum virgatum
tgaggaggcggtgcccacgtggcatgctccacgtccccctctccccattcccctatttctatcgcctcgccggtggtcgttacggccggggcaggcgcgttctactgcccctcgactgggtgctagctcaacagcagttaaactctgaagctttatctattattttctccaaagccataaactctggtggtatcctactcagctcaccatgggcgactcctcctcttcctcagcatcttacatcagaatggttcaccatctaatagagaagtgcatctgcttcaacctgaacaaggaagagtgcatggatgccctggagaagcatgccaagatcaaccctgtcatcacttccactgtgtggaaggagctggagaaggagaacaaggagttcttcgagacatacaacagggaccgcgccgagcggaacatcgaggcggagacgatgcagcggatccagaagatgctagccgaggcggcggcctccaagacctccgatgacgagagctagctagccagcagccagctagctaactagagctagatcagcgcgtgcatggcctcacgtccacttaattccgatccccattaattagctccgttgggagaagccttacacaccggccgtacctcacgtgagaccattattctatatatagcttaattagttactagcttacttaattagctaccaaaaataatggtggtatgccttttgcaagaacaccatgcatgcatgtgtcgtgtttaattaaggttaggtacggtgatcatcaagaaaaactatctttaattcatgtatgtatatatatcagtatatgtattcatgtacaaagaggatgcatattaattcgacctacatataggagtacacacaaagatctccacaggcctgcaaaggtgcatggatgtagtaataagcaagtaagcaggcaaagctggtaggcttatcattccggtaatccttttccgacacgtggcggccggcgcgcgtacccgtcagtgatgacgtgtcgccgatcggcgatgctacttgctggcggctccgctcgaggggatagctcggtgctgctcgccttgtcgtcttccaaccccctcctcccagtagctagctagcgtagtgctggtctttcacgtgacgaggtccgggccgggcgcgcgcgatcgatcggctggatcttagggtttctcgccgtcgttctgggcccccgctttgtagggatccctcgccgtcgtttcggcccggcggggcccccgccggcgacgcgacccactgacctggacgtctgcggctgccgcgcctctccacagggtatccgtcgacgccagccgcggtcggccggccgctcgtgagggcgacgccagtcacgccaccaccgctgtcccgctcgagctacagtgcgcgcggcagggcagggcaggccggcattaatggcacagcgcaggagggatttgagctttgcaggtcgcaatcccatctcgtgatgaggtcgtgacaacgagagggatcgggaatgtcgtgcgatcgaccgggcggcccatcagggcctggtcggtgtcgtgggcctctcgcaggggcgtggcccagggatgtccctacttggggccattattagtaggaaggttgcatcaaagcgttcagtccaaatatggcccgttggccgttggcccatgaacctcaaattgttcagaattgtagcagttgatttattagacaaatgaaataaactcgtccagtgtcatttggaagttatttacgaaatcaataaggcatgtacgtactaaaaaacattaaaagtgccatcccagcattacaagatggcaacaacttcagaagcattattttcatttacaatactatctgaaggccaggcacaggaccctgtatgtcgttgctctggggaaccggttgatctgcaagtggatacttaggccttagcgttcaagattgctttttctaccaatacagcttggattgtactaaataattaaccttgtgagttgccaaccttatcatcataattcataaccacatgctgctttaggcctacatttgaatttgtcaaagtcgctacgaaaacctcgaggtcatctctgcaatgtcaaccactgcaagaggaatagaattgttcgggtgatccgtggatgcctgtgttgaccttcaaacaagcagctaagagttaatacaggtcgtcgtttactagctgtacagttagcactatacttacccccgatcagaaagagtaaaccttgggtttaactactgtgggcgttatctctgatcgtcgtgccaccagttgttcacgtttcacggtgccggagagtatatggtcaaatgtatgatagtatgagcaatgcaaagtc

SEQ ID NO: 848 - DNA, 755 bp, Panicum virgatum
  misc_feature (663)..(663): n is a, c, g, or t
cgttctactgcccctcgactgggtgctagctcaacagcagctaaactctgaagctttatctattattttctccaaagccataaactctggtggtatcctactcagctcaccatgggcgactcctcctcttcctcagcatcttacatcagaatggttcaccatctaatagagaagtgcatctgcttcaacctgaacaaggaagagtgcatggatgccctggagaagcatgccaagatcaaccctgtcatcacttccactgtgtggaaggagctggagaaggagaacaaggagttcttcgagacatacaacagggaccgcgcggagcggaacatcgaagcggagacgatgcagcggatccagaagatgctagccgaggcggcggcctccaagacctccgatgacgagagctagctagccagcagccagctagctaactagagctagatcagcgcgtgcatggcctcacgtccactacacaacagcttccgatccccattaattagctccgttgggagaagccttacacaccggccgtacctcacgtgagaccattattctatatatagcttaattagttactagcttacttaattagctaccaaaaataatggtggtatgccttttgcaagaacaccatgcatgcatgtgtcgtgtttaattaangttaggtacggtgatcatcaagaaaaactatctttaattcatgtatgtatatatatcagtatatgtattcatgtacaaagaggatgcatatt

SEQ ID NO: 849 - DNA, 677 bp, Cynodon dactylon
tcttctgtcctgaacaagggtgtcttcagtcctaggcttccttccacaactcctacatatcttgcctgggagcagcgctgcttcgttgttttgaagcttctctcctttctgcccgttagatattgacagtagcagtgtagcactcatcagctcaccatgggcgactcctcatcgtcggcttcttacatcagaatggttcaccatctgatagagaagtgcatctgcttcaacctgaacaaggaagagtgcatggacgccctggagaagcatgctaacatcaaccctgtcatcacttccacagtgtggaaggagctggagaaggagaacaaggagttcttcgagacgtacaacaaggaccgtgtggagcggaacattgaagaagagacgatgcagcggatccaaaagatgctctctgaggccgctgcctccaaaaccgacgacgacgaggaggagggttagctatgctcttcaattggctccatacggttacaaactggatcttgagccccatagcgccttaagttactcaagtatataactagctagctattacctacctctaattcagttaccagtagtgtcgttattactgtcagaatcatgcatgcatgtggtgtacgtaagattaggaaacctttattatatttgaattcatgtatatatgtatgtatgcatgg

SEQ ID NO: 850 - DNA, 873 bp, Panicum virgatum
ccccggctacctcccggccaatgaggaggcggtgcccacgtggcatgctccacgtccccctctccccattcccctatttctatcgcctcgccggttgtcgttgcagcttgcgcaggcgcgttctactgcccctcaagagcagctaaactctgaagctttagtggattgattttctccaaagccctaaactctggtggtatcctactcagctcaccatgggcgactcctcatcctcagcatcttacatcaggatggttcaccatctgatagagaagtgcatctgcttcaatctgaacaaggaagagtgcatggatgccctggagaagcatgccaagatcaatcctgtcatcacttccactgtgtggaaggagctggagaaggagaacaaggagttcttcgagacgtacaacagggaccgcgcggagcggaacatcgaggcggagacgatgcagcggatccagaagatgctcgccgaggcggcggcctccaagacctccgatgacgagagctagctagcagccagcagccagtgcagctagctgatgactagatctatagatcagcccgtgcatggcctcatgtccactgcacaacagctccccgttagctcgtgaggccattattccataaatagcttagctactagcttacttaattagctaccaaaaataacgatatgcctccatgcatgcatgtgccgtgtgtttaattaaggttaggtggccatcaagaaacttatgtttaattcatgtatgtgtatatatcagtatatgtgtattcatgtacaaagaggatgcatattattcaacctacatatatataggagtacacacacaaggatctccacaggtgacaggcctgcaaataattaaa

SEQ ID NO: 851 - DNA, 1067 bp, Sorghum bicolor
ggcgcacacacacgggtcatcttctagctactacccctagactggccgggtgttagctagctcagcaacagctagagcttttcctcaaagccctagctggtgtgctttgctactggtcaattaggtcaccatgggcgactcctcatcatcagcatcttacatcagaatggttcaccatatgatagagaagtgcatctgcttcaacctgaacaaggaagagtgcatggatgcactggagaagcatgccaacgtcaaccctgtcgtcactgccactgtgtggaaggagctggagaaggagaacaaggagttcttcgagacgtacaacaaggagcgcgaggaacgcaacatcatcgaggcggagacgatggagcggatccagaagatgctctccgaggcggcggcctccaagagctccgacgacgacgacgacgatggctagctagctagccctcgatccattagctctagagctatagatctcatcagctccctgcatggactctcatcactcatgtacgcaccagctcctcccattagctccgatcctctccatgggagcacgaccctccccgtaccgtacgtaccgtcatatatgagaccattctatggctaacttgcttattagccactaatcaacaacataacatgcatctgcaaggaccatgtgcatgcatgatgtgtgtagtacgtctggttattaggaccagaaaaaaaaaatgctttgtattacgatgtactcgtgtagaaagatgcatatatattcgaccaatatatacatactcagaatctacacatgcccctgtagggtactagggtgatgtaagcaaagtagccaggcttatcattgactgtaatcctttcgcgacacgtggcggctggtgcgcgtatccatcagtgatgacctgtagctggccggggctgctacttgccggcagctcctccttgccggatagccggtgcttcttggcttgttgtggatcgctttgtattaagtaaatttgctgtacaatatccttcaatgctggtatttctggatggatcctacataatattgtctttactagaag

SEQ ID NO: 852 - DNA, 771 bp, Brachypodium distachyon
tcatcgcttgccttcgttgcctacagacttctcacttctcagctcagctcagctcagctcagctcttcttcttcttcttcttcgcagcccatttcacgccatgggagactcctcgtcagcttcctacataagaatggtccaccatctgatagagaagtgcatttgcttcaacctgaacaaggaggagtgcatagaggccctggagaagcatgccagcatcaaccctgtcgtcacttccactgtgtggaaagagctggagaaggagaacagggagttcttcgagacgtaccagaaagaccgcgcggagcggaagatcgaggcggagacgatgcagcgggtccagaagatgctctcggatgcggctgcctcgaggacctccgacgacgacgacgacggctagagctagctagctggctatatagctgctagttatctcgagctcatgcatatctctaattgtatcatgtgtcttatgttaattggctttatatgtgtttagggcatcgaattatcgtatctacctaataacagataagtatgattggtggcttaattgcactagctagcagcataccttaaaaccatgcatctcgtactgtatagctaagctagaagtggggaagctggctagcaagcctttcggtgtatatatatgtatgtacgttcgttaagtttgtgtgtgtataactgtatatacacatctcgatgtgcatatggaatattcaagtggacctacaaacggtctacaggttctctaaccttatcattgct

SEQ ID NO: 853 - DNA, 744 bp, Zea mays
gagagctagcccggccgagagctagcgagatgtggggtcggaaaaatctccccggcagcctcccggccaatgaggaggcggcgcccacgtggcatgctccacgtccccctccccccattcccctatttctatctcctcgccggtggtcgttgcagcttattggtggcagtggcgcacacagacaccacacgggttcatcttctagctcccctagattgcccggacggggtactggccaccagttcaccatgggcgactcctcgtcgtcatcggcagcctacatcaaaatggttcaccatatgatagagaagtgcatctgcttcaacctgagcaaggaagagtgcatggacgcgctggagaagcatgccaacgtcaagcctgtcgtcacttccacggtgtggaaggagctagagaaagagaacaaggagttcttcgagacgtacaacaaggaccgcgaggagcggaaggtggaggcggagacgatggcgcggatcgagaagatgctctccgaggcggcggcctccaagagctccgacgacgaaggctagctagctatagcacgcgatccgttagcttagctagctctctagagctatagatcatgcagctccgacgatcctctccatgcatgggaattgggagctagccttctcgtacgtacatgagaccattctatttaattagctgcctatatttatatcttgctacatacctagctagtacaacataacacgccgccactgc

SEQ ID NO: 854 - DNA, 835 bp, Pseudoroegneria spicata
cggccatccgggggcacccgctctgggccgacgccacccaccaggaaatcgaccacgcgctcgagggcctcgagaagtacatcatgaccaagctgttcgaccgcaccttcgcggcgtcgcccgaggacgcggcggccgacgccgaggtctccgagaagattggcctcctgcagcgctttgtcaggcctcatcacctcgacatacccaaggtcctcaacaacgaggcttcgtggctgattgcagttaaagaactacagaagattaattccttcaaatcaccgcgggataagcttctctgtatgatgagctgttgccaagtcatcaataacttgctgctaaacgtgtccatgacaaatgaccgaacaccatctggggctgatgagttccttcccattctcatttatattaccatcaaggccaatcctcctcagctgcacccaaatctgaagtttgttcagctcttcagaagagaaactaagcttgtttcagaagtcgaatactatctcacaaacctcatttcagcaaagatgtttataattaatgttaatagccactcgctatccatggaagaaagtgagtttcagaagcatatggaatctgcaaaactaggtactcaaatgtctgttgctagccctagcagtccacaagggttggctatatcaacgaggggattgcagaagcaaattgatgcagaaggttccagattccctttcatggactcggaaactgaaaatttgacgccagcagaactcaagcagttacatgggctctacaggaagacagtgaccagatatacactgttgtctaaagccttaagaaagttatccatagatga

SEQ ID NO: 855 - DNA, 967 bp, Secale cereale
gactcaaaattccaaatctctctcgctgcgggcgggcggcgatggagagccccacatcggcggcgtcgcgggtggacttctacggcttcctcgaccgcatgcgccgcccggaggccgccgtcctcttccgctccatcaagagcttcctcgcctccctctccctcgaggagcccagcgccgaggccgacggcgccagggtccaggccttcttcgcggagatggaggcggccatcaggagccaccccctctgggccgacgccacccaccaggagatcgaccacgcgctcgagggcctcgagaagtacatcatgaccaagctgttcgaccgcaccttcgcggcgtcgccggaggacgcggcggccgacgccgaggtctccgagaagattggcctcctgcagcgctttgtcaggccccatcacctcgacatacccaaggtcctcaacaacgaggcttcctggctgattgcagttaaagaactacagaagattaattcattcaagtcgccgcgggataagcttctctgtatgatgagctgttgccaagtcatcaataacctgctgctaaacgtgtccatgacaaatgaccgaacgccatctggggctgatgagttccttcccattctcatttacattaccatcaaggccaatcctcctcagctgcactcaaatctgaagtttgttcaactcttcagaagagaaactaagcttgtttcagaagtcgaatactatctcacaaacctcatttcagcaaagatgtttataattaatgttgatggccactcgctatccatggaagaaagtgagtttcagaagcatatggaatctgcaaaactaggtactcaaatgtctgttgctggccctagtagtccacaagggttggctacatctacgagcggattacagaatcagattgatgcagaaggttccagattccctttcatggactcggaaactgaaaatctgacgcc

SEQ ID NO: 856 - DNA, 2266 bp, Panicum virgatum
gtaatcgcgcggaacctcttctactgttcggggcagcactgtactagcagaggattgtgacccaaaccgtccccacttcagcgagtcagcgtaactgtgaaccgactggtcagactcagacggatccgccgacgcgcccgcacgcggacaccacaaggcaatcgccggcggcggcgtgcgaagttgcgatggagagccccacgtcggcggcgtcgcgtccggacttctacgacttcctcgaccgcatgcgccgcccagccgccgccgatctctttcgttcgatcaagagcttcctcgtgtccttctccttccacgaacccaacactgaggaggacggcagcaaggtacaggccttcttcactgagatggagggcgccatcagggaccacccgctctgggccaacgccaccaaccaggaaatcgaccacgcgatcgagggccttgagaagtacatcatgacaaaaatgttcgatcgcactttcggggcctcatcagaggatgccattaccgacatggagatctcagagaagattagtctactgcagcagtttgttaagcctcatcacttggatatacctaaggttctgcataatgaggcctcgtggctgcttgcagtgaaagagttgcaaaagataaattcgttcaaagcaccacgtgagaaacttctatgcatcatgagctgctgtcaagtcatcaataatttgcttctgaacatatcgatgtcaaatgatcgaacactgtctggggctgatgagttccttcctattcttatctatattactatcaaggccaatcctcctcagctgcactcaaatctaaagtttgttcagctctttagaagggaaacgaagctagtttcagaagtcgaatattatctgacaaacctcatttcagcaaagatgtttataatagatgttaatgctcgctcactatcaatggaagaaagtgagtttcagaagcatatggaatcggcaagactagctactaaaatatctgtggctagccctagtagctcacaggggcttcctacatatacaagggcacataaggaggaaactgatctagcaggctgcagattcccattcatggactcagaaactgaaagtttgagtccaggggaagtcaaacaattgcatgacctgtacaggcaagttgtcaccagatatacactgctatctaaagctttaagaaagttatccatagatgaggatcagctccttagttcagtagatgattcatgaagtgatgtgaagatgtaaagatggtagcatcaatcataaacagcctccatatccaaattactcatgcacgtgtacagtggagtaaatttgtgtgcaacctcgtttccattggttgcaatctcgtaggaaaaggaatgaggtcttgcagtcaatgcatgtaagaaaggctccagcaagtccaatgcaacaggtatgatcatcttgggcatgtctgtctgtcttttcaaacacttgagggcagtcctttttgcaatcactttgcagttctgatgctttctggtatgcttatttgttagggcggcctgcactacatgtgagttgagcatattacgcatggctactgctgcttgctgctgtttttgctgatcttgtttctcaccctgcagattgtcttatttcactactgttgtaacatgcgttggacttgggcatagttaggccgtgacttgtacgtcagttgacgatccttattattctcctggtccttccaacattggtcctattgaaactggaaattgaccattacacaacatattatctgagttatcaacttctaaatggtgtacaatctgccaccggacgtgttacaattttggcattgacggcttcctgcaatgaagaatgtgaattctaacctaaatgaagggcagaagaccatttctggggaacttggctttgaagatggagtaacaagctgggataattctgaaactcatcatgctgtacaactatgcttgttgattcccgacgttctttagtttgtgttgagccttgaggtttgagagtcgttagtgttggaaagggtgcaagcacgtacaatttgcatgttgcggatgcatactggggaagctaacctaggaaataccttgctggggtcgggccctgatcaaactcagttagacgttatgctaagggaaatgaataattcgtgtgaaatggtgtcaaaattgaaggttggaggatgatgagagcagttccatgtaattcccgtttggttaaaacagttgatgtatttttgtacaaaa

SEQ ID NO: 857 - DNA, 1983 bp, Triticum aestivum
ggacaaggcaaccagccgagccgggcggggtccatctccctcacgagctcccccaaagtcctctctccactactgcgctgcgcacacacagaccaatcagtcgaccgacaatggcggttcccacgccgcagcgccgtctcctggcggccgccatggccctgctcctcgccctcgcctcgtccggcgccggcgccgtcgccttcgcggggccgatcaagacggtggtggtggtggtgatggagaaccggtcgttcgaccacatgctggggtggatgaagcggctgaacccggccatcgacggcgtgacgggcgccgagtggaacccggccaacgcgtcggacccggcggcggggccgcgcgtctacttcggcgacggcgcgcagttcgtggacccggacccgggccactcgtaccaggagatccggcagcagatcttcgggtccgacgacgcgtccggcccgccgcggatgaacgggttcgtgcagcaggcgcggtccatcggcggcggcaacatgacggacgccgtgatgaacgggttcgcgcccgacagcgtggccgtgtaccgggagctggtggcgcagttcgcggtgtgcgaccggtggttcgcgtccgtgccgtcgtccacccagcccaaccgcctcttcgtccactccggcacctccggcggcgccaccagcaacaacccggagttgctagccaaggggtacccgcagaggaccatcttcgacaacgtgcacgacgcgggcctctccttcggcgtctacttccaggacgtgcccgcggtgctcttctaccgcaacctccgcaagctcaagtacatcctcaacttccaccccttccacaacgcgttccgggaccacgcccgccgtggctccctccccaactatgccgtcatcgagcagcactacatggactccaaggaccaccccgccaacgacgaccacccctcccacgatgtctaccagggccagatgtttgtcaaggagatctacgagacgctccgcgccagcccccagtggaatgagacgctcatggtcctcacttacgacgagcatggtgggttcttcgaccatgtgcccacccctgtcgatggtgtgccgagccccgatgacatcgtcggcccgcccccgtacaacttcacgttcaacagattgggggtgcgtgtcccggccatcttgatctctccatggattgagaaggggacagttatgcatgggccgaatggaagtccaaccccgacgtcgcaatttgagcattcttcgattccggcaaccgtgaagaagctgttcaatctgccacaggatttcctgacaaaaagggacgcgtgggctgggaccttcgaaggtgtcgtgcaaaccagaactgaaccgaggacagactgcccagagcaactcccgacgccgacgaggatccggcagacggaggcgaacgaggaggcgaagctgagctcgttccagcaggagatcgtgcagctggcggcggtgctgaacggcgaccaccagctaagcagcctgcaggagaggatcagggagaggatgaacgtgagggaaggcacctcctacatgaggagcgccgtgcggcgcttcttcgaggccggcatgtcggccaagaggatgggcctcgccgacgacgagcagatcgtcaagatgaggccctcccttaccaccagaatgacctcctcccctgcagatcaagatgatagtccgtagagagcaacgatgcatacatacataggatgaagattgatgttggaattaccaaaattcttagtactacacatacatacatagaagatcgatcgagcagagtagcgtagccagtacgatatggtgtgctcgtgctacattacatggaatggaagtgatgtatgatggatggattgccgcgtgactccgtgtatgtgcattcgatccaatggtcggcctagaagagaactgcacaaggaagtccatcgatccgtgcagcaacctgcatgccgttttg

SEQ ID NO: 858 - DNA, 2005 bp, Triticum aestivum
gtccatctccctcacgagctcccccaaaatcctccgctctccgctactgcgctgcgcacagagatcaatcagtcgaccgacaatggcggttcccacgccgcagcgccgtctcctggcggccgccatggccctgctcctcgtgctcgcctcgtccggcgcggtggcgcgcgcggggatgagcgggccgatcaagacggtggtggtggtggtgatggagaaccggtcgttcgaccacatgctggggtggatgaagcggctgaacccggcgatcgacggcgtgacgggcgccgagtggaacccggccaacgcgtcggacccgtcggcggggccgcgggtctacttcggcgacggcgcgcagttcgtggacccggacccggggcactcgtaccaggagatccggcagcagatcttcggctccgacgacgccacgggaccgccgcggatgaacgggttcgtgcagcaggcgcggtccatcggcggggggaacatgacggacgccgtgatgaacgggttcgcgcccgacagcgtggccgtgtaccgggagctggtggcgcagttcgcggtgtgcgaccggtggttcgcgtccgtgccgtcgtccacccagcccaaccgcctcttcgtccactccggcacctccggcggcgccaccagcaacaacccagagttgctagccaaggggtacccgcagaggaccatcttcgacaacgtgcacgacgcgggcctctccttcggcgtctacttccaggacgtgccggcggtgctcttctaccgcaacctgcgcaagctcaagtacatcctcaacttccaccccttccacaacgcgttcagggaccacgcccaccgcggctccctccccaactacgccgtcatcgagcagcactacatggactccaaggaccaccccgccaacgacgaccacccctcccacgacgtctaccagggccagatgttcgtcaaggagatctacgagacgctccgcgccagcccccagtggaacgagacgctcatggtcctcacctacgacgagcatggtgggttcttcgaccatgtgcccacccctgtcgatggtgtgcctagccccgacgacatcgtcggcccgccgccgtacaacttcacgttcaacaggttaggggtgcgcgtcccggccatcttgatctctccatggatcgagaagggaacagttatgcatgggccgaatggaagtccaaccccgacgtcgcaattcgagcattcttcgatccccgcaaccgtgaagaagttgttcaatctgccacaggatttcctgaccaaaagggacgcatgggctgggaccttcgaaggcgtcgtgcaaaccagaactgaaccgaggacagactgcccagagcaactcccgacgccgacgaggatccggcagacggaggcgaacgaggaggcgaagctgagctcgttccagcaggagatcgtgcagctggctgcggtgctgaacggcgaccaccagctaagcagcctgcaggagaggatcagggagaggatgaacgtgagggaaggcacctcctacatgaggagcgccgtgcggcgcttcttcgaggccggcatgtcggccaagaggatgggcctcgccgacgacgagcagatcgtcaagatgaggccctcccttaccaccagaatgacctcctcccctgcagatcaagatgatagtccgtagagggcacagaccgacgcatacataccatacataggatgaagattgatgttgggattaccaaaattcctagtactacacatacatagaagatcgatcgaccagagtagcgtagccagtacgatatggtgtgctcgtgctacagtacatggaatggaagtgatgtaaggatggatggatgaatttggtatccatgtatgtgcatgccggccaatggtcggcctagaaagagagactgcacaaggaagtccatggacccatgcagcatctgtatgctgtttatgaatcgtcatcaagcagggccaatatatagttcatccgacc

SEQ ID NO: 859 - DNA, 1893 bp, Secale cereale
atcgatcgaccgacaatggcggttcccacgccgcagcgccgtctcctggcgctgctcctcgtcctcgcctcgtccggcgcggtggcgcgtgcggggccgatcaagacggtggtggtggtggtgatggagaaccggtcgttcgaccacatgctggggtggatgaagcggctgaacccggcgatcgacggcgtgacgggcgccgagtggaacccggcgaacgcgtcggacccggcggcggggccgcgcgtctacttcggcgacggcgcgcagttcgtggacccggacccgggccactcgtaccaggagatccggcagcagatcttcggctccgacgacgcgtccggcccgccgcggatgaacgggttcgtgcagcaggcgacctccatcggcggcggcaacatgacggaggcggtgatgaacgggttcgcgcccgacagcgtggccgtgtaccgggagctggtggcgcagttcgccgtgtgcgaccggtggttcgcgtccgtgccgtcgtccacccagcccaaccgcctcttcgtccactccggcacctccggcggcgccaccagcaacaaccccgagttgctggccagggggtacccgcagaggacgatcttcgacaacgtgcacgacgcgggcctctcgttcggggtctacttccaggacgtgcccgcggtgctcttctaccgcaacctgcgcaagctcaagtacatcctcaacttccaccccttccacaacgcgttccgggaccacgcccgccgcggctccctccccaactacgccgtcatcgagcagcactacatggactccaaggaccaccccgccaacgacgaccacccctcccacgacgtctaccagggccagatgttcgtcaaggagatctacgagacgctccgcgccagcccccagtggaacgagacgctcatggtcctcacctatgatgagcatggtgggttcttcgaccatgtgcccacgcccgttgacggcgtgcctagccccgatgacattgttggcccgccaccgtacaacttcacgttcaacaggttgggggtgcgcgtcccggccatcttgatctctccatggattgagaagggaacagttgtccatgggccgaacggaagcccaactccgacatcacaatacgagcattcgtcgatccctgcaaccgtgaagaagctgttcaatctgccacaggatttccttaccaaaagggacgcttgggccggaaccttcgaaggagtcgtgcaaaccagaactgaaccaaggacagactgcccagagcaactcccgatgccgacgaggatccggcagacggaggcgaacgacgaggcgaagctgagctcgttccagcaggagatcgtgcagctggcggcggtgctgaacggcgaccaccagctgagcagcctgcaggagaggatcagggagaggatgaacgtgagggaaggcacctcctacatgaggtcggccgtgcggcgcttcttcgaggccggcatgtcggccaagaggatgggcctcgccgacgacgagcagatcgtcaagatgagaccctccctcaccacccggacctcctcctctgtccaagatgatcgtccgtagagtgcatacatacatacatacacaggaaattcaaaaaatgttgggaacaaaatttactagtactactacatatagaagatcagctagcgtagcctagccaggaccatactgtgtgctcgtgctatatgggatggaagtgctgtaggatggatggattcggcaatacatgggctgtagtaaaaccaaacatttatacggtatacaagcaatgcagcattgccccaataaaaaaaaaaaaaaaaaaaaagaaaaactactctgtgtatacaccactctctcgtagacgacgcgacgacgacacac

SEQ ID NO: 860 - DNA, 2004 bp, Brachypodium distachyon
ccatcacgagctctcctcttcctctcctcttcctctcctctcccctccccccaatccccagcaatctcaaacccagcgaaatcaaatccatcgccaatggcggctccccctcgcggcccccggcgccggccgcgaccccataccctccccgccgccgccatcctcgtcctaagcctcctcctcctctcaccaccatcctcctcctcctcggcggcggcggggccgacgagcccgatcaagacggtggtggtggtggtaatggagaaccgctccttcgaccacatgctggggtggatgaaatccctgaacccggccatcgacggcgtcacgggggccgaatggaacccggcgaacgcctccgacccgtcctccccgcgggtctacttccgcgacggcgcgcagtacgtggacccggacccgggccactcgtaccaggagatccgccagcaggtgttcggctccgacgacgcctccggccccgccaagatgaacgggttcgtgcagcaggccacctccatcggtggcggcaacatgaccgacgccgtcatgcacggctacaagcccgacgccgtcgccgtctacaaggagctcgtgtcccagttcgccgtctgcgaccgatggttcgcgtccgtcccctcgtcgacccagcctaaccgcctcttcgtccactccggtacctccggcggcgccaccagcaacaacccagagttgcttgccgagggttacccgcagaggacgatcttcgacaacatctacgacgctggcctctccttcggcgtctacttccaggacgtgccggcggtgctcttctaccgcaacctccgcaagatcaagtacctcctcaagttccacccgttccacaacacgttccgcgaccacgcccagagcggcaacctgccaaactacgccgtcgtggagcagcattacatggactccaagagccacccggccaacgacgaccacccttcccacgacgtctaccagggccagatgttcatcaaggagatctacgagaccctgcgtgccagcccccagtggaacgagacgctcatggtcatcacctacgacgagcatggcgggttcttcgaccatgtgccgactcctgtcgataacgtgcccagccctgacggcattgttggtcctccgccttataacttcgagttcaacaggttgggggtgcgcgtcccgaccatcttcatctccccgtggatcgagaagggaactgttgtccatgggccaaatggaagtccaaccccgaattcacagtacgagcactcgtccatccctgcaaccgtgaagaaacttttcaatctgccgcaggatttcctgactagaagggatgcatgggctgggaccttcgagagtgtcgtgaaaaccagaactgaaccaaggacagattgcccagagacacttccgatgccgacgaggatacggcagacggacgcgaacgaggaggcgaagctgagctcgttccagcaggagatcgtgcagctggcggcggtgctcaacggcgaccaccagctgacgagcctgcaggagaggatcagggacaggatgaacgtcagggaaggcaccgcctacatgaggcgcgccgtgaggcgcttcttcgaggccggcttgtcggccaagaggatgggcgttgccaacgacgagcagatcgtcaagatgaggccctcgctcaccaccaggacctcctccgacatcgatcaggaacacccgtagaagaaaaagaagcatatatttatagaaattgatggttggaaattgctactgctgctactacatatagaaagatataggctagccagtacggcgtgctcgcgctagattggattggattggaagtgctgttgctattaggatggatggattggggtatacatgagccgtgtaaagaaacattctttggtatacaagcaaggcaacgcatgcattgtgacgtactctgttttgtctctcagcatgttcagctcagcaatgtctcttgctgtccgcgacccaaaa

SEQ ID NO: 861 - DNA, 1896 bp, Setaria italica
ccattgtctattcccgtcacgagcgaagcgagctctacccgtccacacccacactccctccccaatcctcctcctccccactgcgcactgtcgtgtcgcagcagacacaggaacaaccgaacaagcaatggcgggccgcacgtgcagcgcccgccgccgctcaccgagcctcggcaccgccgccgtgctcctcctcctcctccttctcgccgcctggccgccgcgcctgcatgcggcggggcccatcaagacggtggtggtggtggtgatggagaaccgttccttcgaccacatgctgggttggatgaagcgtctgaacccggagatcgacggcgtgacgggcgcggagtggaacccggcgaacacgacggaccctggcgcggggcgcgtctacttcggggagggggcgcagtacgtggaccctgacccgggccactcgttccaggagatccggcagcagatcttcggctccgacgacgcgtcgggcccggcgaggatggacggcttcgtgcagcaggcgcggtcgctgggcgggaacatgaccgacgccgtcatgcacggcttcgcgccagacagcgtcgccgtctaccgggagctcgtcgcccagttcgccgtctgcgacaggtggttcgcgtcggtgccgtcgtccacgcagcccaaccgcctgttcgtccactccggcacatccggcggcgccaccagcaacaacccgcagctactggcgaagggctacccgcagcggaccatcttcgacaacatccacgacgcgggcctgtcgttcggcgtctacttccaggacgtgccggcggtgctcttctaccgcaacctgcgcaagctcaagtacctgctcgacttccacccgttccacccgaccttccgcgaccacgcccgccggggctccctccccaactacgccgtcatcgagcagcactacctcgactccaagctcgaccccgccaacgacgaccacccctcccacgacgtctaccagggccagatgttcgtcaaggagatctacgagacgctccgcgccagcccgcagtggaaccagacgctcatggtcctcacctacgacgagcacggagggttcttcgaccacgtccccacccccgtcaatggcgtcccgagccccgacggcatcgtcggtccgccgccgtacaacttcaccttcgaccggctcggagtgcgtgttccggccatcctcatctccccatggatcgaaaagggaacagttgtccatgggccaaatggaccgacgcaaacatcgcaatacgagcactcatcgatccctgccacggtgaagaagctcttcgacctgccgcaagatttcctgacgaaaagagacgcctgggctgggaccttcgagagcgtcgtgcagacaagaaccgagcccaggacggactgcccagagcaactcccgatgccgacgaggatcaggcaaaccgaggcgaacgaggaggcgaagctgagcgagttccagcaggagatcatccagctcgcctcggtcctcaacggggaccatgagctcaccagcctgcaggacaggatccgggacaagatgaatgtcagggaaggcatcgcctacatgaggggcgctgtgaagcgctatttcgaggccggcatgtcggccaagcggatgggcgtcgacgacgagcagatcgtcaagatgaggccctccctcaccaccaggattgaacgtccatagagacagtgagaaaaatcaaaatgaaatcatatacagtagaaattaaattgatgatgtcaagggtcgcattacatacaggtcaaagagccagcacaatcggttaggatgtgctcgtgctaggtcaaattattcatgggctgtacaaacaaatgttagcttgctataaagatttgtgttgtgcttggtaatat

SEQ ID NO: 862 - DNA, 2048 bp, Panicum virgatum
ttgccttgaaaatatcgtgttctctcaatgtctcgtacggtcgatcggtgtgcatgggtgtgacagtccatagctgtggagtgtggaccctgtccacatggttgtatgcccgtccgatccgtccacaacaggacaaccgtggcgtccaataaaacgccacgccaggcacagcaccgccaccgccaggcaccacccacaggggggtccatcacgggcgagctacccggccacaccctccacgatctctccccaatcctcctcctccccactccagtgcgcacgcacagtcgcagcaggtcgagggaagaacaaccaaggaaaggaaaggaacaacaatggcggtccgccgccgcagcacgtgcagcgcccgggcgccgagcctaccggtagcggcggtggtcttccagttcctcctcctggcggccgcgccggcgtgccttgaggccgggggcccgatcaagacggtggtggtggtggtgatggagaaccgttccttcgaccacatgctggggtggatgaagcggctgaacccggagatcgacggcgtgacgggcgcggagtggaacccggccaacacgacggacccggcggcggggcgcgtctacttcggggagggcgcgcagtacgtggacccggacccggggcactcgttccaggagatccggcagcagatcttcggctccgacgacgcgtccggccccgcccggatggacggcttcgtgcagcaggcgcgctcgctggggggcaacatgaccgacgccgtcatgcacggcttcgcgcccgacagcgtcgccgtctaccgcgagctcgtcgcccagttcgccgtctgcgaccgctggttcgcctccgtgccctcgtccacgcagcccaaccggctgttcgtccactccggcacatccggcggcgccaccagcaacaacccgcagctgctggccaagggttaccctcagcggaccatcttcgacaacatccacgacgcgggcctgtcgttcggcgtctacttccaggacgtgccggcggtgctcttctaccgcaacctgcgcaagctcaagtacctgctcgacttccaccccttccaccccagcttccgcgaccacgccagccggggatccctccccaactacgccgtcatcgagcagcactacctcgactccaagctcgacccggccaacgacgaccacccctcccacgacgtctaccagggccagatgttcgtcaaggagatctacgagacgctgcgcgcaagcccgcagtggaacgagacgctcatggtcctcacctacgacgagcacgggggcttcttcgaccacgtccccacgcccgtccacggcgtccccagccccgacggcatcgtcggaccgccgccctacaacttcaccttcgaccgcctcggagtgcgcgtcccggccatcctcatctccccatggatcgaaaagggaacagttatccatgggccgaatggaccgacgccaacgtcgcagtacgagcactcgtcgatccctgccacggtgaagaagctcttcgacctgccgcaggatttcctgacgaaaagagacgcgtgggcaggcaccttcgagagcgtcgtgcagacaagaaccgagcccaggacggactgcccagagcagctcccgatgccgacgaggatccggcagacggaggcgaacgaggaggccaagctgagcgagttccagcaggagatcatccagctcgcgtcggtgctcaacggggaccatgagctcaccagcctgcaggacaggatccgggacaagatgaacgtcagggaaggcatcgcctacatgcggggcgccgtgaagcgcttcttcgaggccggcatgtcggccaagcggatgggcgtcgacgacgagcagatcgtcaagatgaggccttccctcaccaccaggattgaacgtccatagacacagtagtgtgacaaaaaattaaaagcacatatatattactgtagaaattaagttgccgatatatggcaaagattacattacaaatatatatatattagctctattgagtatctgggttggaataagcta

SEQ ID NO: 863 - DNA, 1697 bp, Panicum virgatum
gaacaacaacaacaacaatggcggcggtccgcctccgccgcacgtgcagcgccggccggcggccgaggctaccggcggccgtgctcctcgtcctcgtcctcctcgccgcgccgccgtgccttcaggccggtggcccgatcaagacggtggtggtggtggtgatggagaaccgttccttcgaccacatgctggggtggatgaagcggctgaacccggagatcgacggcgtgacgggcgccgagtggaacccggtcaacacgacggacccggcggcggggcgcgtctacttcggggagggggcgcagtacgtggacccggacccggggcactcgttccaggagatccggcagcagatcttcggctccgacgacgcgtccggccccgcccggatggacggcttcgtgcagcaggcgcgctcgctggggggcaacatgaccgacgccgtcatgcacggcttcgcgcccgacagcgtcgccgtctaccgcgagctcgtcgcccagttcgccgtctgcgaccgctggttcgcctccgtgccctcgtccacgcagcccaaccggctgttcgtccactccggcacatccggcggcgccaccagcaacaacccgcagctgctggccaagggttaccctcagcggaccatcttcgacaacatccacgacgcgggcctgtcgttcggcgtctacttccaggacgtgccggcggtgctcttctaccgcaacctgcgcaagctcaagtacctgctcgacttccaccccttccaccccagcttccgcgaccacgccagccggggatccctccccaactacgccgtcatcgagcagcactacctcgactccaagctcgacccggccaacgacgaccacccctcccacgacgtctaccagggccagatgttcgtcaaggagatctacgagacgctgcgcgcaagcccgcagtggaacgagacgctcatggtcctcacctacgacgagcacgggggcttcttcgaccacgtccccacgcccgtccacggcgtccccagccccgacggcatcgtcggaccgccgccctacaacttcaccttcgaccgcctcggagtgcgcgtcccggccatcctcatctccccatggatcgaaaagggaacagttatccatgggccgaatggaccgacgccaacgtcgcagtacgagcactcgtcgatccctgccacggtgaagaagctcttcgacctgccgcaggatttcctgacgaaaagagacgcgtgggcaggcaccttcgagagcgtcgtgcagacaagaaccgagcccaggacggactgcccagagcagctcccgatgccgacgaggatccggcagacggaggcgaacgaggaggccaagctgagcgagttccagcaagagatcatccagctcgcgtcggtgctcaacggggaccatgagctcaccagcctgcaggacaggatccgggacaagatgaacgtcagggaaggcatcgcctacatgcggggcgccgtgaagcgcttcttcgaggccggcatgtcggccaagcggatgggcgtcgacgacgagcagatcgtcaagatgaggccttccctcaccaccaggattgaacgtccatagacacagtagtgtgacaagaaattaaaagcacatatatactactgtagaaattaagttgcctatatatggcaaaagattacattacaaatatatatatat

SEQ ID NO: 864 - DNA, 1974 bp, Oryza sativa
caagccacgccaccaacgcggaggggtccatcacgagctcccctccccacacaccacctcactcccactacgagagaggaggaagctcgcaatcatcgaatcaatggcggttcgccgccggcgacccggccccgtggcggccgccgtgctgctgctactcgcggtggcgacccaggcggcggcgagcccgataaagacggtggtggtggtggtgatggagaaccggtcgttcgaccacatgctggggtggatgaagcggctgaacccggagatcgacggcgtgaccggcggcgagtggaacccgacgaacgccagcgacccgtcgtcggggcgcgtctacttcggcgagggcgccgagtacgtggacccagacccgggccactcgttccaggagatccggcagcagatattcgggtcggacgacgcgtcggggccggcgaggatggacggcttcgtgcagcaggcgcggtcgctgggggacaacatgacggcggccgtcatgaacggcttctcgccggacagcgtcgccgtgtaccgggagctcgtcggggagttcgcggtgttcgaccggtggttcgcgtccgtgccgtcgtcgacgcagcccaaccgactgttcgtgcactccgccacatccggcggcgccaccagcaacaacccagagctgctggcgaagggctacccgcagcgtacaatcttcgacaacgtgcacgacgccgggctgtcgttcggggtctactaccaggacgtgccggcggtgctcttctaccgcaacctgcggaagctcaagtacctgaccaagttccacccgttccacggcgcgttccgcgaccacgccgcccgcggctccctcccaaactacgccgtggtggagcagcactacatggactccaagtcccacccggccaacgacgaccacccgtcgcacgacgtcttccagggccagatgctcgtcaaggaggtgtacgagacgctccgcgccagcccgcagtggaaccagacgctcatggtcgtcacctacgacgagcacggcggcttctacgaccatgtccccacccccgtcaccggcgtccccagccccgacggcatcgtcggcccgccgccgtataacttcgcctttgatcgcctcggcgtccgtgtcccagccatcgtcatctccccctggatcaacaagggtacagttgttcatgggccaaacgggagcccaaccgcgacgtcggagtacgagcactcgtccatccccgcgaccgtgaagaaactcttcgatctgccacaggatttcctgactaaaagggacgcctgggctggaacgtttgagagtgtcgtgcaaggcagaactgagccaaggacggattgcccagagcaactcccaatgccgatgaggatacggctgacggaggcgaacgaggaggcgaagctgagtgagttccagcaggagctggttcagctggcgtcggtgctcaacggggaccaccagctgagcagcctgcaggacacgatcagggacaggatgaacgtcagggaaggcatcgcgtacatgcggggcgctgtaaagcgcttcttcgagaccggcatgtcagccaagaggatgggcgtcgacgacgagcagatcgtcaagatgaggccatcgctcaccaccaggacatcccctgcgatcgagcaaccatagaaatagaaacaagagcaatagaagcaaataaggatacaggtttattttatatgctgaaaaagaaaaaaaatcatggtgcttgcatatatgtagcagagccagcaaggagtgctttgttctagaattagttgagatctctcatggatcgatctatatacatggccgggctgtactgtacaaattgatgaaacgttaattattggcttagtatacagatcgatcgattgcagtgcacttggcattttagcaatataaattctctttctgacagaataaaaactactctgctctacacgaggagcaaaacc

SEQ ID NO: 865 - DNA, 2114 bp, Sorghum bicolor
gcacccatccaccacgggcatagtggaccgcgtccatgcgttccatccgcaagcagacaaccgtcacctccccactccgcacccaataaaacgccacgccaccacccggggtccatccaacactcacgagcacgagctcccaacccagaggccgccgtcctcacactccctccctccccgaccccaccacttggtcgcagtcgcagtgagcgaacaagcaagcaacaatggcggcggctcgagcccggccgccgccggttgccgcgctcctcctcctcgtcctcctcctaaccggcgcggcgggatcgtcgacgacgacatcaacgacgagccccatcaagacggtggtggtgctggtgatggagaaccggtcgttcgaccacatgcttggttggatgaagcggctgaaccccgagatcgacggcgtgacgggccgggagtggaacccggccaacacgtcggacccgtcgtcggggcgcgtctacttcggcgacggcgcggcgtacgtggacccggacccgggccactcgttccaggagatccggcagcagatcttcggctccgacgacgcgtccggcccggcccggatggacggcttcgtgcagcaggcggcgtccatcggcggcggcaacatgaccgacgccgtcatgcacggcttcgcccccgacagcgtcgccgtgtaccgcgagctggtgtcgcagttcgccgtctgcgaccggtggttcgcgtccgtgccgtcgtccacgcagcccaacaggttgttcgtccactccggaacgtccggcggcgccaccagcaacaacccgacgctgctggcggaggggtacccgcagcggaccatcttcgacaacctgcacgacgccgggctgtccttcggcgtctacttccaggacgtccccgcggtgctcttctaccggaacctccggaagctcaagtacctgctggacttccacccgctccgcccgtccttcgccgaccacgcccgccgtggcgtcctccccaactacgccgtcatcgagcagcactacctggactcgaagctggacccggccaacgacgaccacccgtcgcacgacgtgtaccagggccagatgctcgtcaagtacgtctacgagacgctgcgcgcgtccccgcagtggaaccagacgctgctcgtcatcacctacgacgagcacggcggcttcttcgaccacgtccccacgcccgtcgccggcgtgcccagccccgacggcatcgtcggcccaccgccatacaacttcaccttcgaccgactcggcgtccgcgtccctgccatcctcgtgtcaccctggatcgacaaggggaccgtcgtccacgctccgaccggaccgacgccgacgtcgcagtacgagcactcgtccatcccggccacggtgaagaagatcttcaacctgccgcagggtttcctgacgaagcgggacgcgtgggcggggacgtttgagggcgtcgtgcagaagaggaccgagccacggacggactgccccgagcagctgccgacgccgacgaggatcaggcagacggaggccgacgaggaggccaagctcagcgagttccagcaggagatcatccagctcgcgtccgtgctcaacggggaccaccagctggccagcttgcaggacaggatcagggacgaaatgaacgtcagggaaggcatcgactacatgaaggccgccgtcaagcgctacttcgaggccggcgcgtccgccaggcggatgggcgtcgacggcgagcagatcgtcaagatgaggccatccctcaccaccaggatccagcgcccatagagacagatcaaattaaagcatatataggaattattggactggtcattgtgttcagaaattaaattggattccatatatacggatcacagtcaattaggatgtgcccgtgccctgtgctagatcaaaacatgggtgtgctgtacaaatgaatgctaattggtttggaaatacatacagattcgcactgtgcttggcagtactactgccaagagaggattattgtcccaaatcgttgaatgcacttataaaaggttcacctgcttttagcaaatactctacgtacggtgtccaaatgaaacgaagtttcaaattttg

SEQ ID NO: 866 - DNA, 2508 bp, Secale cereale
ccgccacccaccccccctcaacccccctcctcctccacgcgcggcgcggccctcgtctccgccctctcctcgtcgcggcgaatcgatcgtgctcctcccgtccgccgtctcgggtttttgaggagtgcagggttgtataataccgaggctcagttgtttgcatctgcatagaggagtttctgtttgtaacctgactacactgttcaatgggttccaagaggagttgtcttctgatcacttactctccggagatagtagatggcgtgcctttgtatgtgtcatctaattgcctgcctgttaaagcttccaagtatgaacctgctggtcattctttccatgcggtggcactgaagctccgtggtcttgatgagaaagaagacactgaaactgatgatcgtagtgtgtcgtcagatgacaagagccaagatttttctgctggttcagataacttcagcagcaaaggaaagaagaagtctggttctggaagtcaacaacaagatcactatgcattgcttggattgggcaacttgcggttcttggccaccgaagatcagattcgcaagagttaccgtgacatggctcttaaacatcatccagacaagcaggctgctcttcttctccatgagacaacagaggcagcaaagcaagcaaagaaggatgagatagagagccatttcaaggccatacaggaagcttatgaagtcctcatggatcctaccaagagaaggatttttgactcaactgatgagtttgatgatgatatcccaactgactgtgcaccgcaagacttcttcaaggtctttggaccagccttcatgaggaatggccgatggtctgttacccagccgattccttctttgggagacgattctactcctgttgtggatgttgaccagttctacaatttctggtataacttcaagagttggagggaatttccacatgaagatgagtatgacttggagcaagctgagtctcgtgaacacaagagatggatggagaggcagaatgcgaagatacaagagaaggccaaaaaggtagagtacacgcgagtacgtaatcttgttgacaatgcgtacaggaaagacccaaggatccagaggagaaaggagcaggagaaggctgagaaacagaggagaaaggaggcaaaatacatggccaagaaactgcaggaggaggaagctgcaagggctgcagaagaggaaaagaagaggaaagaagaggaggcgaagatagccgccgcagctgctgacattcggaagaagttgaaggaaaaggagaagaagttgctacgcaaagagaaatctcgtctgcgcacgcttgtggatccggtagttaaagagtcccacttcagtctgtcacaggaggatgttgaaacagtatgcacatcacatgacgttcaacagttgaagaaactctgtgatattatggaggacaaggatacagctgaaaaggccaggttgctgagaggtgcactgaacaaagaagataactcctcgaatacctcaaaagaggagaaaattcatgccaatggtgtggtgggttctgctccaaaatccacagtcccacaaggccctccaaaatccacagccccacaagtcattacactaggcaactgtgagaaaaaagagaaacaatggggaaaggaagagattgaattgcttaggaaagctacgctgaaatttccgaagggaactaacaagaggtgggaggttatttcagagtttcttggtactggtagatcaactgaagagattctgaaggccacgaaaaccgttcttctgcagaagccagactctgctaaagcttttgactcgttccttgagaaacgcaaagcagctccatctattgtatcgcctctttccacaagagatgagacggctggtggctcaactgtgggagctggcactgaaccatccaaggccgctgaacaacctgctgccagcagcagtcagacagctaatgagaaaactggtgctgatcctgtccctgaagaagcaccttctgcaacagatccagatgcctggtcagaggcccaggtgctggcccttgttcaagctttgaaggcgtttcccaaggatgcaaaccaaagatgggagcgagtagctgcttctgtccctggtaaaacagtggtgcagtgcaagaaaaaggttacctcaatgaggtcgaacttccggaccaagaaggcggagtagaaacacatcaccaatgaggccacacaagaacaaagattggtcgattgccttttgaagacccgagggcttgcttgctgctgactttctggatggtggagacgaggcttggtcgtcgagacccagctggtttgttaccaggagcgagtcctgaagtcgctgatgatcgaggcacctatcgagagagagagagagagagggagagaaagatagaagcttagatactaaattttgagttatggagaattgcctacctacctaccttatgatttatcgcgatgatgttattccacctgatgcatacagtatacttata

SEQ ID NO: 867 - DNA, 2492 bp, Secale cereale
gtctcgggtttttgaggagtgcagggttgtataataccgaggcccagttgtttgcatctgcatagaggagtttctgtttgtaacctgactaaactgttcaatgggttccaagaggagttgtcttctgatcacttactctcctgagatagtagatggcgtgcctttgtatgtgtcatctaattgcctgcctgttaaagcttccaagtatgaacctgctggccattctttccatgcggtggcactgaagctccgtggtcttgatgagaaagaagaaactgaaactgatgatcgtagtgtgtcgtcagatgacaagagccaagatttttctgctggttcagataacttcagcagcaaaggaaagaagaagtctggttctggaagtcaacaacaagatcactatgcattgcttggattgggcaacttgcggttcttggccaccgaagatcagattcgcaagagttaccgtgacatggctcttaaacatcatccagacaagcaggctgctcttcttctccatgagacaacagaggcagcaaagcaagcaaagaaggatgagatagagagccatttcaaggccatacaggaagcttatgaagtcctcatggatcctaccaagagaaggatttttgactcaactgatgagtttgatgatgatatcccaactgactgtgcaccgcaagacttcttcaaggtctttggaccagccttcatgaggaatggccgatggtctgttacccagccgattccttctttgggagacgatgctactcctgttgtggatgttgaccagttctacaatttctggtataacttcaagagttggagggaatttccacatgaagatgagtatgacttggagcaagctgagtctcgtgaacacaagagatggatggagaggcagaatgcgaagatacaagagaaggccaaaaaggtagagtacacgcgagtacgtaatcttgttgacaatgcgtacaggaaagacccaaggatccagaggagaaaggagcaggagaaggctgagaaacagaggagaaaggaggcaaaatacatggccaagaaactgcaggaggaggaagctgcaagggctgcagaagaggaaaagaagaggaaagaagaggaggcgaagatagccgccgcagctgctgacattcggaagaagttgaaggaaaaggagaagaagttgctacgcaaagagaaatctcgtctgcgcacgcttgtggatccggtagttaaagagtcccacttcagtctgtcacaggaggatgttgaaacagtatgcacatcacatgacgttcaacagttgaagaaactctgtgatattatggaggacaaggatacagctgaaaaggccaggttgctgagaggtgcactgaacaaagaagataactcctcgaatacctcaaaagaagagaaaattcatgccaatggtgtggtgggttctgctccaaaatccacagtcccacaaggccctccaaaatccacagccccacaagtcattacactaggcaactgtgagaaaaaagagaaacaatggggaaaggaagagattgaattgcttaggaaagctacgctgaagtttccgaagggaactaacaagaggtgggaggttatttcagagtttcttggtactggtagatcaactgaagagattctgaaggccacgaaaaccgttcttctgcagaagccagactctgctaaagcttttgactcgttccttgagaaacgcaaagcagctccatctattgtatcgcctctttccacaagagatgagacggctggtggctcaactgtgggagctggcactgaaccatccaaggccgctgaacaacctgctgccagcagcagtcagacagctaatgagaaaactggtgctgatcctgtccctgaagaagcaccttctgcaacagatccagatgcctggtcagaggcccaggtgctggcccttgttcaagctttgaaggcgtttcccaaggatgcaaaccaaagatgggagcgagtagctgcttctgtccctggtaaaacagtggtgcagtgcaagaaaaaggttacctcaatgaggtcgaacttccggaccaagaaggcggagtagaaacacatcaccactgaggccacacaagaacaaagattggtcgattgccttttgaagacccgagggcttgcttgctgctgactttctggatggtggagacgaggcttggtcgtcgagacccagctggtttgttaccaggagcgagtcctgaagtcgctgatgatcgaggcacctatcgagggagagagagagagggagagaaagatagaagcttagatcaaaattttgagttatggaaaaacttacctacctacctaccttatgatttatcgcgatgatgttattccacctgatgcatacagtatacttatatcctgatgcctgctattggttacgaatttactatgctgatgttattcttgttacgctagtcgtcttcgttaagatatctggtggtatacag

SEQ ID NO: 868 - DNA, 2616 bp, Triticum aestivum
attgtataatactgaggctcagttgtttgcatctggattgaggagtttctgtttgtaacctgactacactgttcaatgggttctaagaggacttgtcttctgatcacttactctccggagatagtagatggcgtgcctttgtatgtgtcatctaattgcctgcctgtaaaagcttccaagtatgaacctgctggtcattctttccatgcggtcgcactgaagctccgtggtcttgatgagaaagaagacactgaaactgatgatcgtagtgtgtcatcagatgacaagagccaagatttttctgctggttcagataacttcagcagcaaaggaaagaagaagtctggttctggaagtcaacaacaagatcactatgcattgcttggattgggcaacttgcggttcttggccaccgaagatcagattcggaagagttaccgtgacatggctcttaaacatcatccagacaagcaggctgctcttcttctccatgagacaacagaggcagcaaagcaagcaaagaaggatgagatagagagccatttcaaggccatacaggaagcttacgaggtcctcatggatcctaccaagagaaggatttttgactcaactgatgagtttgatgatgatatcccaactgactgtgcaccgcaagacttctttaaggtcttcggaccagccttcatgaggaatggccgatggtctgttacccagccgattccttctttgggagatgatgctactcctgtagtggatgttgaccagttctacaatttctggtataacttcaagagttggagggaatttccacatgaagatgagtatgacttggagcaagctgagtctcgtgaacacaagagatggatggagaggcagaatgcgaagatacaagagaaggccaaaaaggtagagtatacgcgagtacgtaatcttgttgacaatgcgtacaggaaagacccaaggatccagaggagaaaggagcaggagaaggctgagaaacagaggagaaaggaggcaaaatacatggccaagaaactgcaggaggaggaagctgcaagggctgcagaagaggaaaggaagaggaaagaagaggaggcgaagatagccgcagcagctgctgacattcgaaagaagttgaaggaaaaggagaagaagttgctacgcaaagagaaaaatcgcctgcgcgcacttgtgggtcaggtaattcaggagtcccacttcagtctgtcaaaggaggatgttgaaacagtatgcacatcacatgattttgaacagttgaagaaactctgtgatattatggaggacaaggatacagctgaaaaggccaggttgctgagaggtgcactgagcaaagaagaaaactcctcgaatacctcacaagaagagaaaattcatgccaatggtgtggcggattctactccaaaatccactgtcccacaaggcactccaaaatccacagccccacaagtcattacactaggcaactatgagaaaaaagagaaagagtggggaaaggaagaggttgaattgcttaggaaagctatacataagtatccgaagggaactaacaagaggtgggaggttatttcagagtttattggtactggtagatctgctgacgagattttgaaggccacgaaaaccattcttctgcagaagccagactctgctaaagcttttgactcgttccttgagaaacgcaaagcagctccatctattgtatcgcctctttccacaagagatgagacggctggtggttcaactgtgggaactggcactgaaccatccaaggcggctgaacaacctgctgccagcagcagtcagacagctaaggagaaaattggtgctgatcctgtcctggaagaagcaccttctgcaacagatccagatgcctggtcagaggcccaggtgctggcccttgttcaagctttgaaggcgtttcccaaggatgcaaaccaaagatgggagcgagtagctgctgctgtccctggtaaaacagtggtgcagtgcaagaaaaaggttgcgtcaatgaggacgaacttccggaccaagaaggcggagtagaagcagatcaccactgaggccacacaagaagaagattggtcgattgccttttgaagaccctggggctcgcttgctggtgactttctggatggtggagacgaggcttcgtcgtcaagacccagctggtttgttgccaggagcgagtcgagtccctgaagtcgctgatgatcgaggcagctattgagagagagagggagagaaagatagatgcttagatcaaaattttgagtaatggaaaattacctggctacctaccttatgatttatcgcgatgatgttccccctgcatacagtatacttctagctgatgcctgctatattggttatgaatttatatgctgacgttattcttgttacgctagtcatcgttaagattgtggaagttgagtatcagtttcgctatgttgttctcttgatgtcttgctgctttagctcatgattttaatcttgtgtctacctagacagatggcgacagtaattatttgttgctgcaaaaaagcacaggcaaagggctggctgtcatatgttgtgctcagaagacatttccactgc

SEQ ID NO: 869 - DNA, 3085 bp, Brachypodium distachyon
cctcccaagtcccaaccctaacccctgtctcgctctcccggccaggccctcctcccctggcggcgctccccctccctcttgacggccgcgcgatcctccgctctacttcttctacctcctcctcctaaccttcctcctgctcttaccttccccgagctccaatctgccgcccgcagctgcaagcttagcgtagccggcgacgcctcacacgtcttacgcgcgaacacgtattccttcgcggcgccgccatcgccgctcctgttctatctcgtcacgacatcaggttcctgctgtctcgatcccgtccgtgaaattagacatccgatttcgaggttgtataatactgacgctcagctatattatctgaacagaggggattctgttaataactgtactacagtgatcaatgggttcaaagaggagttgtcttttgatcacttactctcctgagattacagatggcatacctttgtatgtgtcatctaattgcctgcctgtaaaagcttccaaatatgaacctgccggtcattcgttccatgctgtggcattgaagctccgtggtcttgatgagaaagaagacacagaaactgatgatcgtagtgtttcatcagatgacaagagccaagatttttctgctgcttctgatacctttagcagcaaaggaaagaagaagtctgcatctggaagtcaacaacaagatcactatgcattgcttgggttgggtaatttgcgattcttggccactgaagatcagattcggaagagttaccgtgacatggctcttaaacatcatccagataagcaggctgctctccttcttcatgaggtaacagaggaggcaaagcaagctaagaaggatgagatagagagccatttcaaggccattcaggaagcttatgaggtcctcatggatcctacaaaaagaaggatttttgactcaactgatgagtttgatgatgatatcccgacagactgcgcccctcaagacttcttcaaggtttttggcccagccttcatgagaaatgggagatggtctgttacccagcctattccttctttgggagatgataccactcctgtagcggacgttgaccaattctacaatttctggtataacttcaagagttggagggaatttccacatgaagatgagtatgatctggagcaagctgagtctcgcgaacataagagatggatggagaggcagaatgcaaagatacaagagaaagcaaaaaaggtagagtatgcacgagtcaggaatctcgttgacaatgctttcaagaaagatccccgaatccagaggagaaaggaggaggaaaaggctgagaaacagaggagaagagaggcaaaatacatggccaagagattgcaggaggaggaagctgcaagggctgcagaagaggaaagaaagaggaaagaagaggaagctaagaaggctgcagaagctgctctcaatcaaaagaagttgagggaaaaggagaagaaactgctacgcaaagagaaatctcgtcttcgcgctcttatggcacctgtcgttgcagataaccaatttaatctgtcacaggatgatgtcgaaacagcatgcacatcacttgatatagaacagctgaagaaactctgtgataacatggaggataaggatacaactgaaaaggcgaggttactgagaggtgcattgagtaaagaaagctccccaaatacttcaaaagaaaagattcaagcaaatggcgtggagggttctactccaaaacccatgcccatgggtggaaaagtcccacagggcaatgcactaagcggctatgagaaaaaagaaagaccgtggggaaaagaagaggttgaaatgcttaggaaggcgacacagaagtatccgaagggaacttcaaggagatgggaggttgtttcagagtttattggaactggtagatccgttgaagagattctgaaggccacaaaaaccgttcttctgcagaagccagactcagctaaagcttttgactcgttccttgagaaacgcaaaccagctccgtccattgtatcgcctctttccacaagagatgagacagttgtgttgcaagctgtgggagctggaactgaaccatccaaggctgctgctgcggaacctgctgctgcacaacctgctgctgctagcagtcagacagctaatgagaaaactggtgctgatccagtaccagatgaagcaccttccgccacagatcaagatgcctggtcagaggcccaggtgctggccctggttcaagctttgaaggcttttcccaaggatgcaagtcaaagatgggagagggtagctgctgctgtcccaggtaaaacagtggtgcagtgcaagaaaaaggtggcggcaatgaggtcgaatttccggaccaagaaaggtgcggagtagaagagacaggccaccatcagaattacatttatccgattagtacctgagagaagcaagtctttgaacagcattattcttatagatctgagcatcatgggtggcgcaaatctctgctgacggttttgctgacaaacctaggcgcctcccatggtaactataattttgtcgtggagctctgtacgaactctcattcattcttatgccactgtcagcgttttgcttatgcaagttatatcgaggtgattagcgcattgctttctagctcattactggttgcttctagttcttcattatacacgtataggtgatctccctggttgcttttacttatgacatatccctgctttcttctgcaatatcgaaattgtttgcggtcggtctttgatatgcactattgccatgtgtgccgtctactctcatctagattttgcaatacagatcgagtcgggtggaaaggcaaaggctttttgtccactttagccaaaacaccgtcataccactgacaatttgtaacaaacgtgtactgttctgaattcacgcccgtaagtcattggatgacttgttttgcatatgtttttgtggttcagttcgtattaatgctaaattgcacagcagtagtagatggcaactccattgtggttatgcttctatacctatgcgttgcaggtgcattttgatctcaatcat

SEQ ID NO: 870 - DNA, 2721 bp, Setaria italica
gacgccctcatcccgcggccgttcctacgcgtcgcagccgccgtccccgtgctctcccgcggccagcatcacgccgccgccttccgtcgagccggcgtgcgagatccgtccgggcccggttccttctctcttctatcggttgtatcagttgtttatcttgactcaggagttctgttaaagaactcgacattgtcgctcatatggagccccagaagagttgtcttctgatcacttactcccaggagatcgtagatggggtgcctttgtatgtttcatccaactgcctgcccatgaaagctttgaaatatgaacctgctggtcattcattccatgctgcggcaatgaagcttcttggtcttggggagcaagaagacacagaaactgatgatcgcagcgtttcatcagatgacaagagccaagattttaatactgcctctgatacctttagcagcaaagggaagaagaagtcttctggcagtcaacaacaggatcactatgcattgcttgggttaggacacttgaggttcttggccactgaagatcagattcggaagagttaccgtgatatggccctcaaacatcatccagataagcaggctgctctgattcttgcagagacaacagaggaggcaaagcaagcaaaaaaggatgagatagagagcaatttcaaggccattcaggaggcctatgaagtcctcatagacccgactaagaggaggatttacgactcaacagatgagtttgatgatgatgtcccgacagactgtgccccacaggacttcttcaaggtctttggcccagccttcatgagaaacggacgctggtctgttacccagcctattccttctcttggagatgatgctactcctgtacaggaagttgacaagttctacaatttctggtacaacttcaagagttggagggaatttccagatgatgatgaatatgatttggagcaagctgaatctcgtgaacataagaggtggatggagaggcagaacgccaaactacaagagaaggccaaaaaggctgagtatgcacgagtgcgtactcttgttgacaatgcttacaagaaagacccaaggatccagaggaggaaggatgaggagaaggctgagaagcagagaagaaaggaggcaaagtatttggcaaagaaacagcaggaggaggaagcagcaagagctgctgaagaggaaaggaaaaggaaagaagaggaggctaagaaagctgcggaagctgcactcaatcagaagaagttgaaggagaaagagaagaagctgctgcgcaaagagaaaacccgtctgcgcactcttgcagcacctgtagttgcagagagcaactttggtctgtcagatgaggatgttgaaacagcatgtgcctcacttgatatggaacagctcaagaaactctgtgacagtatggagggtaaggatgcagctgaaaaggccaagttgctgagcagtgcacttaataaagaaagttcctcaaaggaagcaaagaaaagtgatgcaaacggtgtggagggttctgctccaaaatccaactctacaggaggaaaagtgacacaaggcagcagcttattgaacagctatgagaaaaaagagagaccatggggaaaggaagaggttgaattgcttaggaaggcaatccagaagtatcctaagggaacttcacgtagatgggaggttgtttctgagtttattgggacaggcagatctgttgaagagattctcaaggccacaaagactgttcttctgcagaagccagattcaacaaaagcttttgactctttccttgagaagcgcaaaccagccccaaccattgcttcaccactttcaaccagagatgaaacagttagttcgtcaactgatggagctgggactgcttcatccaagacggcggcacagcctgctagcagccagccagccaatgggaaagcagctgctgatcctgttccagatgctgcaccttctgtgactgatccagaggcctggtcagagacgcaagttctggctctcgtccaagctttgaaggcttttcctaaggatgcaagccaaagatgggagcgtgtggctgctgctgtcccgggtaagactgtagtccagtgcaagaaaaaggttgccgcaatgagggagaatttccggagcaagaaaagcggggagtagtgtcattgcctcacctaagtacattttgcgaggaagattgtctctatggaaatatttatataccgagcattgcagctggtggcctctgccagaggttttgcatgatgaacctcttaccccaccagagtggtgagaataattttgttctggagctgtgacaactctaatttatcctgccagcgttgtcattttgcttagtagcaatcaagtttggggcagccggagaggaggatacgccattgaagctcatctactgttgatggactaatgattggccttttttagcagtggtacgcatgggttttgtttcggctggctcctgggttgtctatgcttgttggaagccattggaatattgccttgcaatatgcaatggtgtagtgatatggttcggcctggctgagtaaaaatgtagagaatcacatgggtttttgtttatcaactaagatagaaatatttgttacatcgtgagacctgttattgaagtgagcattattttgcctgaccacatttttgtattttgtcgtcctatgataatagtcttttatctggcaag

SEQ ID NO: 871 - DNA, 1371 bp, Triticum aestivum
gcaagttgtgcacgaggagggcgtgcggcatcggccaactgcagcgcagcggcgccggcggatcttctctccccgcgccgtcccggagtgctccgtccgtgccagtaagcaaaacctacaggattagaagaagccacaatggaaggaagcatcagcggtccgtcagagaaaagggttgccgtggtgaccggagggaaccgggggatggggctggagatatgccggcagcttgcggggcacgggctcgccgtcgtcttgacggcgagggacgacaagaggggcgctgaggcagccgaaacgctccgggaggaggggctatcggacgtcgcgtttcatcagctggagatcagcgagcccgccagtgccgctcgtctggctgctttcgtaaagaagaagttcggcaagcttgacatactggtcaacaatgccggagtgctcggggtgaccacggacgtcggcgacccggcgacccttcaggaaacgcttgcaggcaaggatgggatggagagagccgaatggctgaggcaacggaccacacagaccacccaggatgcagaggactgcctgaggatcaactaccacggcaacaagaccgtcacggaagccctcctcccgctcctccgatcatcctccgacggcagaatcgtcaacgtaacctcagcctgggggctgctcaggtatttcagcggcgacgagctccggcgggagctggacgacgtcgcaaacctcacgacgcagcggctcgacgagatgtcggacctgttcctcgaggacctgggcaagggcaatggcgcgctggagcgccgcgggtggccggccgacccggtctacgcggcctacatggcgtccaaggcgctggtgtgcgcctacaccagggtgatcgccagggaggagggcgccgcgctgcgggtcaactgcgtgcaccccggctacgtcctcaccgggatgaacgactacaccggcgtcctcacggccgcggagggcgccgccgccgcggttgcagttgcactggcggagaaggggggcgtcaccggcgcctacttcgaccgcactgaactgggagcgtcctttgtgtgatttctccgtggagcagttgttagctggatatcgttttcaataaagtgcaatctactacatatgtcatgagttggtccagatatctagaattatgtgttgttcatttttctctctctcagaactactggctctgttcgctattataagatgtttaactttttctatattggatgtgtgtagacacgttttagtatttcagtctgtatgtagtttatattgaaatattcaaaacattttataataagtgaatggagagagtagaatatttccaatgtcaaggtaaatctcttgaaa

SEQ ID NO: 872 - DNA, 1312 bp, Pseudoroegneria spicata
  misc_feature (4)..(4): n is a, c, g, or t
  misc_feature (7)..(9): n is a, c, g, or t
aagncgnnnacgagaaggagggcgtgcggcatcgaccaactgcagcgcagcggcgccggcacttctctctccccgcgccgtcccggtgggagtcctccgcccgtgccagattcagaaacaaaatcagcaggacgagaagaagccacaatggaaggaagcatccgcggcccatcagagaaaagggtcgccgtggtgaccggagggaaccgagggatggggctggagacatgccggcagcttgcggcgcacgggctcaccgtcgtcttgacggcgagggacgagaagaggggcgcagaggcagccgaaaagctccgggaggaggggctatcggacgttgtgtttcatcagctggaggtcagcgagcccggcagtgccgctcgtctggctgctttcatcaaggacaagttcggcaagctcgacatactggtcaacaatgccggagtgctcggggtgaccacggacgtcggtgacccggaaacccttcaggaaacgcttgcaggcatggatgggatggagagagccgaatggctgaggcagcggaccacgcagaccacccaggatgcacaggactgcctaaggatcaactaccacggcaacaagaccgtcacggaagccctcctcccgctcctgcgctcctcctccgacggcagaatcgtcaacgtaacctcagcatgggggctgctcaggtatttcagcggcgacgagctccggcaggagctggacgacgtcgacaacctcacgacgcagcggctcgacgatatgtcggccctgttcctcgaggacctgggcaagggcaatggcgcgctggagcgccgcgggtggccggccgacccggtgtacgcggcctacatggcgtccaaggcgctggtgtgcgcctacaccagggtcctcgccagggagaacgctgcgttgcgggtcaactgcgtgcaccccggctacgtcctcaccgggatgaacgactacaccggcgtcctcacggccgcggagggcgccgccgccgctgtcgcagttgcactcacggagaaggggggcgtcaccggcgcctacttcgaccgcactgaactgggagcgtcttttgtgtgatttctccgtggagcagttgttagctggatatctttttcaataaagtgcaatctacttaatattatacggagtacttgatctttgcaataacacaatgtcatgagttggtccagatatctagaattatgttttgttcattttttctctctcaaaactactccctttgttgactattataagatgtttaacttttttccaaatcaaatgtatgtaaacacgttttagtcta

SEQ ID NO: 873 - DNA, 1334 bp, Secale cereale
aagcaacatcggccatcttttccaactgcagaggcaaagttgtgcacgagaaggagggcgtgcggcatttcctccaccaactgcagcgcagcggcgccggcgccggcgcatcttccctccccgcgccgtcccgtccgtgccagctgaaaacttacagctacaggactagaagaagccacaatggaaggaagcaccaacagcccatcagacaaaagggtcgccgtggtgaccggagggaaccgggggatggggctggagatatgccggcagcttgcgacgcacgggctcaccgtcgtgttgacggcgagggacgagaggaggggcgctgaggcagccgaaaagctccgggaggaggggctattagatgttctgtttcatcagttggagatcagcgagccggccagtgccactcatctggctgctttcatcaaggacaagtttggccagcttgacatactggtcaacaatgccggagtgctcggggtgaccacggacgtcggcgacccggcaacccttcaggagacgctcgcgggcaaggatgggatggagagagccgaatggctgaggcagcggaccacgcagaccaccaaggatgcagaggactgcctgaggatcaactaccacggcaacaagaccgtcacggaagccctcctcccgctcctccggtcctcccccgacggcagaatcgtcaacgtaacctcggcctgggggctgctcaggtatttcagcggcgacgagctccggcgggagctggacgacgtcgccaacctcacgacgcggcggctggacgagatgtcggccctgttcctcgaggacctggccaagggcgatggcgcgctggagcgccgcgggtggccggccgacccggtgtacgccgcctacatggcgtccaaggcgctggtgtgcgcctacaccagggtgatcgccagggaggaggagggggcgctgcgtgtcaactgcgtgcaccccggctacgtcctcaccgggatgaacgactacaccggcgtcctcacggccgcggagggcgccgccgccgcggttgcagttgcgctcgcggagaaggggggcgtcaccggcgcctacttcgaccgcactgaactgggagcgtcctttgtgtgatttctccgtggagcatttgttggctggatatcgtgttcaacaaagttcaatctacttaatattacttgatctttgcaataacacaatgtcatgaattggttcagatatctagagactagaattatgttttgttcacttttcttttctctccgaactactctctccattcactattataagttctaacttttttataaatcggatatatgtagaca

SEQ ID NO: 874 - DNA, 1441 bp, Secale cereale
gactgtaagcaagatcggccatcttttccaagtgcagaggcaaagttgtgcacgagaaggagggcgtgcggcatttcctccaccaactgcagcgcagcggcgccggcgcatcttctctccccgcgccgtcccgtccgtgccagctaaaaccttacagctacaggactagaagaagccacgatggaaggaagcaccaacagcccatcagacaaaagggtcgccgtggtgaccggagggaaccgggggatggggctggagatatgccggcagcttgcgacgcacgggctcgccgtcgtcttgacggcgagggacaagaggaggggcgctgaggcagccgaaaagctccgggaggaggggctatcggacgtcctgtttcatcagctggacatcagcgagccggccagtgccgctcatctggctgctttcataaaggacaagtttggccagcttgacatattggtcaacaatgccggagtgctcggggtgactacggacgtgggtgacccggcaacccttcaggagacgctcgcgggcaaggatgggatggagagagccgaatggctgaggcaacggaccacgcagaccgcccaggatgcagaggactgcctgaggatcaactaccacggcaacaagaccgtcacggaagccctcctcccgctcctccggtcctcccccgacggcagaatcgtcaacgtaacctcggcctgggggctgctcaggtatttcagcggcgacgagctccggcgggagctggacgacgccgcaaacctcacgacgcggcggctggacgagatgtcggccctgttcctcgaggacctgggcaagggcgatggtgcgctggagcgccgcgggtggccggccgacccggtctacgcggcctacatggcgtccaaggcgctggtgtgcgcctacaccagggtcctcgccagggaggaggagggggcgctgcgtgtcaactgcgtgcaccccggctacgtcctcaccgggatgaacgactacaccggcgtcctcacggccgcggagggcgccgccgccgcggttgcagttgcattagcggagaaggggggcgtcaccggcgcctacttcgatcgcactgaactcagagcgtcctttgtgtgatttctccgtggagcagttgctagctggatatcgtgttcaacaaagtgcaatctacttaatactgttgtacttgatctttgcaataacacaatgtcatgaattggttcagatatctagagactagaattatgttttgttcacttttcttttctctctgaactacattcactattataagttctaacttttttataaatcggatatatgtagacacgtttcagtgtgtttgttctctcatttcagtttgtatgcagttcgtattgaaaataaaccatttttagtaatagtgaatggagagagtagaattatttcccaatgtaac

SEQ ID NO: 875 - DNA, 1324 bp, Secale cereale
aagcaacatcggccatcttttccaagtgcagaggcaaagttgtgcacgagaaggagggcgtgcggcatcgaccaactgcagcgcagcggcgccggcgccggcgcatcttccctccccgcgccgtcccgtccgtgccagctaaaaacttacagctacaggactagaagaagccacaatggaaggaagcaccaacagcccatcaggcaaaagggtcgccgtggtgacaggagggaaccgggggatggggctggagatatgccggcagctggcagcgcacgggctcgccgttgtgttgacggcgagggacgagaagaggggcgctgaggcagccgaaaagctccgggaggaggggctatcggacgtcctgtttcatcagctggacatcagcgagccggccagtgccgctcatctggctgctttcataaaggacaagtttggccagcttgacatattggtcaacaatgccggagtgctcggggtgactacggacgtgggtgacccggcaacccttcaggagacgctcgcgggcaaggatgggatggagagagccgaatggctgaggcagcggaccacgcagaccgcccaggatgcagaggactgcctgaggatcaactaccacggcaacaagaccgtcacggaagcactcctcccgctcctccggtcctcccccgacggcagaatcgtcaacgttacctcagcctgggggctgctcaggcatttcagcggcgacgagctccggcgggagctggacgacgtcgcaaacctcacgacgcggcggctggacgagatgtcggccctgttcctcgaggacctggccaggggcgatggcgcgctggagcgccgcgggtggccggccgacccggtctacgcggcctacatggcgtccaaggcgctggtgtgcgcctacaccagggtgatcgccagggaggaggagggggcgctgcgtgtcaactgcgtgcaccccggctacgtcctcaccgggatgaacgactacaccggcgtgctcacggccgcggagggcgccgccgccgcggttgcagttgcgctcgcggagaaggggggcgtcaccggcgcctacttcgatcgcactgaactcagagcgtcctttgtgtgatttctccgtggagcagttgctagctggatatcgtgttcaacaaagtgcaatctacttaatactgttgtacttgatctttgcaataacacaatgtcatgaattggttcagatatctagagactagaattatgttttgttcacttttcttttctctctgaactacattcactattataagttctaacttttttataaatcggatatatgtag

SEQ ID NO: 876 - DNA, 1134 bp, Secale cereale
cagctgaaaacttacagctacaggactttaagaagccacaatggaaagaagcaccaacagcccatcagacaaaagggtcgccgtggtgaccggagggaaccgggggatagggctggagatatgccggcagcttgcgacgcacgggctcgccgtcgtcttaacggcgagggacgagaagaggggcactgaggcagctgaaatgctccgggaggaggggctatcggatgtcgtgtttcatcagttggagatcagcgagccggccagtgccgctcatctggctgctttcatcaaggacaagtttggcaagcttgacatactggtcaacaatgccggagtgctcggggtgactacggacgtgggtgacccggcaacccttcaggagacgctcgcggacaaggatgggatggagagagccgaatggctgaggcaacggaccacgcagaccacccaggatgcagaggactgcctcagaatcaactaccacggcaacaagaccgtcactgaagccctcctcccgctcctccggtcctcctccgacgggagaattgtcaacgtaacctcagcctgggggctgctcaggtattcagcggcgacgagctccggcggagctggacgacgccgcaaacctcacgacgcggcggctggacgagatgtcggccctgttcctcgaggacctgggcaagggcgatggtgcgctggagcgccgcgggtggccggccgacccggtctacgcgcctacatggcgtccaaggcgctggtgtgcgcctacaccagggtgatcgccagggaggaggagggggcgctgcgtgtcaactgcgtgcaccccggctacgtcctcaccgggatgaacgactacaccggcgtcctcacggccgcggagggcgccgccgccgcggttgcagttgcattggcggagaaggggggcgtcaccggcgcctacttcgatcgcattgaactgggagcgtcctttgtgtgattttctcggtgaagccgttgttagctttgctatatgcttttcagtaatgtgcagcctattaatatcacacatgacctctgcaataacagtgtcaagagccagtccagatatcaagaattatatttgcttcactttttcttttctttctgaactagtac

SEQ ID NO: 877 - DNA, 991 bp, Secale cereale
ccgtgccagctaaaaccttacagctacaggactagaagaagacacaatggaaggaagcaccaacagcccatcagacaaaagggtcgccgtggtgacaggagggaaccgggggatagggctggagatatgccggcagctggcagcgcacgggctcgccgtcgtgttgacggcgagggacgagaaggaaggggacgactgaggcagccgaaaaagctccgggaggaggggctattagatgttctgtttcatcagttggagatcagccagcccgccagtgccgctcatctggctgctttcataaaggacaagtttggccagcttgacatactggtcaacaatgccggagtgctcggggtgaccacggatgtcggcgacccggcaacccttcaggagacgctcgcaggcaaggatgggatggagagagccgaatggctgaggcagcggaccacgcagaccaccaaggatgcagaggactgcctgaggatcaactaccacggcaacaagaccgtcacggaagcactcctcccgctcctccggtcctcctccgacggcagaatcgtcaacgtaacttcggcctgggggctgctcaggtatttcagcggcgacgagctccggcgggagctggacgacgtcgacaacctcacgacgcggcggctggacgagatgtcggccctgttcctcgaggacctgggcaagggcgatggcgcgctggagcgccgcgggtgtccggccgacccggtctacgccgcctacatggcgtccaaggcgctggcgtgcgcctacaccagggtcgatcgccagggagaggagggggcgctgcgtgtcaactgcgtgcaccccggctacgtcctcaccgggatgaacgactacaccggcgtgctcacggccgcggagggcgccgccgccgcggttgcagttgcgctggcggagaagggggctcaccggcgcctacttcgaccgcactgaactgggagcgtcatttctgtgattt

SEQ ID NO: 878 - DNA, 2278 bp, Triticum aestivum
aaaccaccgcttcggtttctgcggccaccacctccgcacacccccggctatcgcggcatcgagggagggtgcttgccgtcgcgccgccgacgcgtagcgcggtgtgaatgaatggtgcggcctcttggccttctcgtggatctgagctgttcctgccggggtggtgaggagtagacggacggacggacggacggacggaccgacgggaggttcccgaaatggcggtttcggccaaggagcgcaagctgagcaggctcggcagtggtaaggcggcaaacggaggaggaggaggaggcgggagcttcggcgcgaggggtggtcaccggtcgcctgcggcggggggacggcggcggctgttcgcggtgttcttcgcgttcctctgcgccggcgcggtcgtcttcggcggggtgcacgccattggagcgtccttccggccggtgctcttgacggcctggccgtcggcgaccctgaacgccctctcctcggagcgccgggtgcagcaagctggaggcaacggtgccggcaccatttcaccgtctgtccaaatccggcatgctgtcgctctgccggaccatcttctcgtaatcctcggtgacggatcattgctgccagctcccgggcacttcgagtgcctgtactccactgccaactcaacgcagctgcgtcgtcgtcccctctcagttgctgccttgccagatggaccaagcctcgtccattgccctgccggaccgtctgggatggctgtgtccctgtcgctgtcccagtcacctccggtgacaccattccaatgggatcagctcgtgtacaccgcacttcttgacagccgggacaactccaccgttgtgtttgccaaagggatgaacctccgtccaggccgtctcggtgtgccatcacggtatgagtgtgtctttggccgggacctgtcaaagccgaagctcgttgtcacctcccctgtggtttctgctgcacaagagacattccggtgtgtgacacctgtccgcattcgccggtacctcaggatgacagctgatggaaacatcaacagaaacagtgctggcaagcctatgctggtctccatcaggactaagggccgggggagctctacactcccctcaatcgcgcaaccagagccacttccaaggtataaccggcatcggcatacaagacatcggcagcagaaggcacactcaatgtgtgtgtgcaccatgctgcgcaaccaagcacggttcttgcgggaatggatcatgtaccactcccatatcggagtgcaacggtggttcatctatgacaacaacagtgatgatggcatcgaggaagtcctcggttccatggatccatccgcatacaatgcaacacgccacttgtggccttggatgaaatctcaggaggctggatttgcacattgtgcactcagggcgcgggagagctgcgagtgggtggggttcatcgacatcgatgagttcctgcacttccctggcaaccaaactctacaagatgtcctccggaattactcaagcaggccaaggattggtgaactcaggactgcatgccacagctttggtccatcaggccggactaagattcctaagaaaggcgtcacaacaggctacacctgccggctggctgcgccggagcggcacaagtcaattgtcaggccagatgcattgaatccatcactgatcaacgtggtgcaccacttccatctgaaggaagggatgaagtatgtgaatgttggccagggagtgatgctgatcaatcactacaaataccaagtctgggaggtgttcaaagaaaagtttgctggccgcgtggcgacctatgttgccgattggcaggacgaggagaatgttggatccagggacagggcgccaggtctagggaccaaaccggtggaacctgaggattggccaagtcggttctgtgaagtatatgacactggtctgaaagattttgtgcacaaagaattcacagatccacagactggaagtcttccatggtagatgggtaagcacggtatttgatccacacaacacacggtacatgacatggagagaaaaacagataacgaaagaagaaacacgaaattaagtttggtggtagagtgggttttgctctttggtatatttttagaccttgttgttaggtttgctgtccgtaatttagaagcatcattttttcactgatcatacagattcttttggtatatctaagagagaaatgattcttttgtagatacaggtaagtaaacagttcactgttgaaagagagaatgcataga

SEQ ID NO: 879 - DNA, 2257 bp, Secale cereale
cggttccttaccttacctttccccttacccccggttctaattcgtcggtctagtcgtagggtaaagtagggtagtcgttgtcttcgtacgttcgcgcggccgacgcgtagcgcggcgtgaatgaatggtgcggcctcttggctttctcgcggatctgagctcttcctgctggggcggtgaggagtagacggacggacgggaggttcccgaaatggcggtgtcggccaaggagcgcaagctgagcaggctcggcagtggtaaggcggcaaacggaggaggagggagcttcggcgcgaggggcggtcaccgctcgccgggggcggggggacggcggcggctgttcgcggtgttcttcgcgttcctctgcgccggcgcggtcgtcttcggcggggtgcacgccattggagcgtccttccggccggtgctcttgacggcctggccttcggcgaccctgaacgccctctcctcggagcgccgggtgcagcaagctggaggcaacggtgccggcaccatttcaccatctgtccaaatccggcatgctgtcgctctgccggaccatgttctcgtagtcctcggtgacggatcattgctaccagctcccgggcacttcgagtgcctgtactccaccgccaactcaacgcagctgcgccgtcgtcccctctcagttgctgccttgccagatggacccagcctcgtgcattgccctgccggaccgtctgggatggctgtgtccctctcgctctcccagtcacctccggtgacaccattccaatgggatcagctcgtgtacacggcgcttcttgacagccgagacaactccaccgttgtgtttgccaaagggatgaacctccgtccaggccggctcggtgtgccatcacggtatgagtgtgtctttggtcgggacctgtcgaagccgaaatttgttgtcacctcccctgtggtgtctgctgcccaggagacattccggtgtgtgacacctgtccgcattcgccggtacctcaggatgacagctgatggaaacatcaataaaaacagtgatggcaagcctatgttggtctccatcaggactaagggccgtgggagctctacactcccctcaatcgcgcaaccagagccgcttcctaggtatacaaggcatcggcatacaaggcatcggcagcagaaggtacactcgatgtgtgtgtgcaccatgctgcgcaatcaagcacggttcttacgggaatggatcatgtaccactcccatatcggagtgcaacggtggttcatctatgacaacaacagcgatgatggcatcgaggaagtcctcggttccatggatccatccgcatacaacgtgacacgccacttgtggccttggatgaaatcccaggaggctggatttgcacattgtgcactcagggcccgtgagagctgcgagtgggtggggttcatcgacatcgatgagttcctgcacttccctggcaaccaaactctgcaggatgtcctccggaattactcaagcaggccaaggattggtgaactcaggactgcatgccacagctttggtccatcaggtcggactaaggttcctaagaagggcgtcacaacaggctacacctgccggctggctgcgccggagcggcacaagtcaattatcaggccagacgcattgaacccatcactgatcaacgtggtgcatcacttccatctgaaggaagggatgaagtatgcgaatgttggccagggagtaatgctgatcaatcactacaaataccaagtctgggaggtgttcaaagaaaagtttgctgggcgtgtggcgacctatgttgccgattggcaggacgaggagaatgtaggatccagggaccgggcgccaggtctagggaccaaaccggtggaaccggaggattggccgcgtcggttctgtgaagtatatgacactggtttgaaagattttgtgcacaaagaattcacagacccacagactggaagtcttccatggtagatggctaagcacggtatttgatccacagcacacggtacatgacatggagagaaaaacagataatgaaagaagaaacacgaaattaagttaggtggtagagtgggttttgctctttggtatatttttagactttgttgttaggttcgctgtccttaatttagaagcatcattttttttcttttcactgatcatactatctaagagagaaatgattcttttgtatatacagataagtaaacagttcacagttgaaagagagaatgcatagagggg

SEQ ID NO: 880 - DNA, 2395 bp, Triticum aestivum
caccgcttcggtttctgcgaccaccacctccgcacccccggcaatcgcggcggcgagggagggagcgtgctcgccgtcgcgccgccgacgcgtagcgcggtgtgaatgaatggtgcggcctctcgtctggcgttctcgtggatctgagctcttcctgctggggtggtgaggagtcgacggacgggcggacgggaggttcccgaaatggcgatatcggcgaaggagcgcaagctgagcaggctcggcagtggtaaggcggtaaacggaggaggaggcgggagcctcggcgcgaggggtggtcaccggccgccgacggcggggggacggcggagactgttcgccgtgttcttcgcgttcctctgcgccggcgcggtcgtcttcggcggggtgcacgccattggagcgtccttccggccggtgctcttgacggcctggccgtccgcgacccttaacgccctctcctcggagcgccgggtgcagcaagctggaggcaacggtgctggcaccgttttagcgtctgtccaaatccggcatgctgtcgctctgccggaccatgttctcgtaatcctcagtgacggatcattgctgccagctcccgggcacttcgagtgcctctactccactgccaactcaacgcagctgcgccgtcgtcccctctcagttgctgccttgccagatggaccaagcctcgtgcattgccctgccggaccgtctgagatggctgtgtccctgtcgctgtcccagtcacctccggtgacaccattccaatgggatcagctcgtgtacaccgcacttcttgacagccgggacaactccaccgttgtgtttgccaaagggatgaacctccgtccaggccgtctcggtgtgccatcacggtatgagtgtgtctttggccgggacctgtcgaagccgaagctcgttgtcacctcccctgtggtttctgctgcgcaggagacattccggtgtgtgacacctgtccgcattcgccggtacctcaggatgacagctgatggaaacatcaacagaaacagtgatggcaagcctatgctggtctccatcaggactaagggccgggggagctctacactcccctcaatcgcgcaaccagagccacttcataggtataacaggcatcggcatacaaggcatcggcagcagaaggtacactcgatgtgtgtgtgcaccatgctgcgcaaccaagcacggttcttgcgggaatggatcatgtaccactcccatatcggagtgcaacggtggttcatctatgacaacaacagcgatgatggcatcgaggaagtcctcggttccatggatccatccacatacaatgtgacacgccacttgtggccttggatgaaatctcaggaggctggatttgcacattgtgcactcagggcgcgggagagctgcgagtgggtggggttcatcgacatcgatgagttcctgcacttccctggcaaccaaactctacaagatgtcctccggaattactcaagcaggccaaggattggtgaactcaggactgcatgccacagctttggtccatcaggtcggactaagattccgaaaaaaggcgtcacgacaggctacacctgccggctggctgcgccggagcggcacaaatcaattgtcaggccagatgcattgaatccatcactgatcaacgtggtgcaccacttccatctgaaggaagggatgaagtatgcgaatgttggccagggagtgatgctgatcaatcactacaaataccaagtctgggaggtgttcaaagagaagtttgctggccgcgtggcgacctatgttgccgattggcaggacgaggagaatgttggatccagggacagggcgccaggtctagggaccaaaccggtggaacctgaggattggccaagtcggttctgtgaagtatatgacactggtctgaaagattttgtgcacaaagaattcacagatccacagactggaagtcttccatggtagatgggtaaggacggcatttgatccgcacagcacacggtacatgatatggagagaaaaacagataacgaaagaagaaacacgaaattaagtttggtggtagagtgggttttgctctttggtatatttttagaccttgttgttaggtttgctgtccttaatttagaagcatcatttttttcactgatcatactatctaagagagaaatgattcttttgtagatacagataagtaaacagctcactgtcgaaagagagaatgcatagattgtttccctgtgttttcgtctaatcctactgtggctgcgagcaactaaaattatagtgcttaatttgttcatccccaatctgaaatctgtcgcaaattccttatggaatgatgccggcaaagatggtgcaccttgcttgatgtaatact

SEQ ID NO: 881 - DNA, 2365 bp, Oryza sativa
cggagcctccgcctcctcgccatttacggcagcaaccgcggcggagagagacgaccgaggagagagagagagagagagagagagagagggagagctccagtggtcgccgccggcgaggaggagcagtgaatggtgcggcgcgtggggttagccggcgctcgtggatcgatctgagcgagaggggagctgctggagacagtggtgcgtgcgtccgcggcatggcgttggcggcgaaggagaggaagctgagtaggcttgggagtaagggcagtggcggaggagggggaggtgggagtttcggggcgagggggcagcgggcgccggcggggacgcagcggcggctgttcgcggcgttcttcgcgttcctcttcgccggcgcggtgctcttcggcgccgcgcacgtcattggagcatccttccggcccgtgctcaagaccgcgtggccgtcggccaccctgaacgccgtgtcgtcggagcgcggcgcgcagcaagccggcatggtcagcgtcgacgccgtgttgccttctgttcatatccagcacgcggttgccttgccggaccatgttctcctgatgctcagagatggctcattgctgccggcttcggggcaatttgagtgcctgtactcccctgtcaactcgtcgcagctgcgtcgccagcccttgtccgtcgctaccttgccggatggacccagcctcgtccattgtcccgccggaccatccagggtcgctgtgtccctctcactggcgcagtcggttccggtggcgccgttgcaatgggatcggctggtgtacactgcacttattgacagcaaggacaactccaccgttgtgtttgcaaaggggatgaacctccgtccgggtcgtctaggtgtgccatcacggtacgagtgtgtctttggccgagacttttcgaagccaaagcttgttgtcacctccccagtggtttctgctgctcaggagatattccggtgtgtgacaccagttcgcattcgccggtacctccggatgactaccggtggcaaaaacagcgtaaacaatgatgacaagcctatgttggtctccatcaggactaagggccggggaagctctacactcccctcaatcgcgcaaccggagccgcttcctcggtacaacaagcattggagacgaaaggcacactcaatgtgtgtctgcaccatgcttcgcaaccaagcacggttcctgcgggaatggatcatctatcactcacgtattggtgtgcagcggtggttcatctatgacaacaacagcgacgatggcattgaggaggtcctcaacaccatggattcatccaggtacaatgtgacacgctatttatggccatggatgaaatctcaggaggctggatttgcacattgtgcactcagggctcgagagagctgtgagtgggtggggttcattgacatagatgagttcctgcacttccctggcaaccaaacactacaagatgtcctccgaaattactctgtcaagccacggatcggtgagctcaggactgcatgccatagttttggtccatcaggccggactaagatcccaaagaaaggtgttacaacaggctacacctgccggctggctgcacctgagcgccataagtcaattgtcaggccagacgcattgaacccatccctcatcaatgtggtgcaccacttccatctgaaggaagggatgaaatatgtgaacattggtcagggtatgatgctgatcaaccactacaaataccaagtctgggaggtgttcaaggataagttctccggacgtgtcgcgacatatgttgctgattggcaggacgaggagaatgttggatcaagggacagggctcctgggcttgggaccaaaccggttgaaccagaggattggccgagacgtttctgtgaagtatatgataacggtttgaaagattttgttcagaaagttttcacagacccacacactggaaatcttccatggtagattggtaaacactgtatttggtcttgcacagcacggcaccacaatacatgacatggagacacagacagggaaagaagaaccaaaaagaaattagatagaagagcgatttgctctttggtatattttttgaattttaaggtcttttgatcttttcttagttcattagaatcatcattttttgttacatatctaagaaggaaatgattcttttgtagataaagataggtagcacaattcattgtaagtttggttggggggagacaatcaatacaatcaatttcttgatttcatttttttttctcaagttgctatatttggctttattttctgttaccatatggataacacaaaactgaaatcacagtgcctgttcagttgttcacctatctgac

SEQ ID NO: 882 - DNA, 2376 bp, Brachypodium distachyon
accaccgcttcggtttcttcggccacctttagcaccatcgaggaattttagagggttggcgagctcgtggttccgttggctgttgtaatgctccgcgccgccgccggcgcgtgggtggtggcagcggccttctcgcggatctgagctgctgctgcggctggggtggtgacggacggacgggctccggcatggcgatgtcggcgaaggagaggaagctgagcaggctcgggagcgggaaggggccgagcggcgcgaggggtggtggccagcagcggacgccgccggcgggttcgcggcggaggctgttcgcggcgttcttcgcgttcctctgcgccggagccgtcctcctaggcggcgcgcacgtcattggcgcgtcgttccggccggtgctcctgacggcgtggccgtcggcgaccctgaacgccgtctcttcagagcgtggagcacagcaagctggaagcggcggtgctgtgttgccgtctgtccaagtccggcatgccgtcgccctgccggaccatgttctcctgattctcagagacgatggatcgttgctgctggcttctcggcagttcgagtgcctgtactctgttgccaactcaacgcagctgcgccagctgccactgtcagtggcctccttgccgggtggacccaacctggtgcattgccctgctggaccggccggggcagccgtgtccctgtcgctgtccgagtggcctccggtagtaccgctcgaatgggaccggctggcatacaccgcactcattgacagccgggataactcgactgttgtgtttgccaaagggatgaacctccgtcctggccgtctcggtgtgccgtcacggtatgagtgtgtcttcggccgggacttgtcaaagccgaagttcgttgtcacctcccctgtggtttctgctgcacaggagaccttccggtgtgtgacacctgcccgaattcgccggtatctcaggatgacatctgatgactatggagccagtaattgcggtgacaagcctatgttggtctctgtcaggactaaggggcgggggagctcaacgctcccctcaatcgcacatccagagccacttcctaggtacaacaggcatcggcgtaacaggcatcggcagcgaaaggcacactcgatgtgtgtatgcaccatgctgcgcaaccaagcacggttcctccgggaatggatcatgtaccactcgcatgtcggtgtgcagcggtggttcatctatgacaacaacagcgatgatgacatcgagcaggtgctcaataccatggatccagccaggtacaatgtgacacgctacttgtggccatggatgaaatctcaggaggctgggtttgcacattgtgcgctcagggcgcgggagagctgcgagtgggtggggttcatcgacattgacgagttcctgcacttccctggcaaccaaactctacaagctgtcctccggaattactcaagccgcccacaaataggtgaactcaggacatcatgccacagctttggtccgtcaggtcgaactaagatacccaggaaaggagttacaacaggttacacctgccggctggctgccccggagcgccacaaatcaattgtcaggccagatgcattgaacccgtcgctcatcaatgtggttcaccacttccatctgaaggaagggatcaagtatgccaacattggtcagggagtgatgctgatcaaccactacaaataccaagtctgggaggtgttcaaggataagttctccgggcgtgtcgccacctatgttgctgattggcaggatgaggagaatgttggatccagggacagggcaccaggtctagggaccaaaccggtcgaaccggaggactggccgagtcggttctgcgaagtttatgacactggtttgaaagactttgtgcataaagaattcacagatccacagactggaaatcttccatggtagatgggtaaagcactacctttcatcaggcatggcacataatatacggcatggcgaaacagacagcaaaagaagaaactgaaaatgagatagcggtagagttacttgcccttggtatatttttagactttcagttgtttttaggtttctgtccttaatttagactcatccatttttttttacacatcaagtccaagagggaaatgattcatttgtagatacagataggtagaacaattcactgttgaaagagacaatgcatagagtgaaatacttgactttgttttgctgagttctgtgttattttactgtcgatctgaaaaacttacattacaatgtttattagctggccaaaaatccgacaagtgcaaacaaattcattatgcagaaggctaccttttttttttttgagactatgcagaaggctacaatt

SEQ ID NO: 883 - DNA, 3892 bp, Sorghum bicolor
cagcaggaagcagccgtgcgaacgcaaccaccgcttcggattcgccggccgccgcttcgcctcgcttcgccttcttcctcgtccacggcaactacacgtggagatattggcggggcgccgatgctccacgactccccgtagcgcgtttgcggatggtgtggcctgtgaggcacgctgccgccgccgcttggggatctggggtgctgctgccggacagtttccggcggttgtgaccggcgccggcgatggcgatgtcggcgaaggagaggaagctgagcaggctcgggagttgtaaggttacttcagcggcaggaagtggtggcggcggcgggggttcccctgccgcaaggggccaccggtcaccggcggcgccgcagcggcgtgtcttcgcggcgctcttcgcgttcctgtgcgccggcgtagtcgtcctcggcggcgtgcacgtcattggagcgtcgttccggccggtgctcaggacggcgtggccgtcggcgaccctgaacgccatttcctctgatgccagagcgcagcaagctggcagcactgccgatgccgtgttgccgtcagtccaaatccagcacgcggttgccttcccggaccgtgttctcctgatcctcaaggacgggtcgtcgctgccagctcctcagcggtttgagtgcttatactcccctgccaactcctcggagctgcgccggcagcccctgttggccgcctccttgccggatggacccagcctcgtccattgccctgccgaaccatctggtgtggatgtctctctgtcactgtccctgtcacctccggtggcgccgctacagtgggacaggcttgtgtacactgctcttgttgacagcagggacaactccaccattgtgttcgccaaggggatgaacctccggccaggccgtttgggtgtggcgtcgaggtatcagtgtgtctttggccgtgacctgtcaaagccaaagcatgtgctcacatcccctgtgatttctgctgcacaagagattttccggtgtgtgacaccagttcgcattcgccggtatctcaggatgacaactaatcccaatggcaatggagacagtgatgacaagcctatgttggtctccatcaggacgaaaggccagagggactctacgctgccatcaatagctgagcctgagccacttcctcggtataacagacatcggcggcaaaaggcacattcaatgtgtgtatgcaccatgcttcgcaaccaggcaaggttcctccgagaatggatcatctaccactcgcatatcggtgtggagcggtggttcatctatgacaacaacagtgatgatgacattgagcaggccctcggtaccatggatccatcaaggtacaatgtgacacgccatctgtggccatggatgaagtctcaagaggctggtttcgcacattgtgctctcagggcccgagagagctgtgagtgggtggggttcatcgacatcgacgagttcttgcacttccctggcaacaagactctacaagatattctccggaactactcaaacaggccacggattggggagctcaggactgcatgccacagctttggtccctcaggtcggacaaaaattcccaagaaaggcgttacaacaggttacacctgccgactcgctgcaccggagcgacacaagtcaattgtcaggccagacgcactaaacccatcactcatcaatgtggtgcaccacttccatctgaaagaaggggtgaggtatgtgaaccttggtcagggtgtgatgctcatcaaccattacaagtatcaagtttgggaggtgttcaaggataagttttctggccgtgtcgcgacctatgttgccgattggcaggacgaggagaatgttggatccagggacagggcaccaggattggggactaagccggtggaaccagaggattggccgcgtcggttctgtgaagtatttgataccggtcttaaagattttgtgcataaagcgttcacagatccagccactggaagtcttccatggtagatgatggggtatacacagacagggaaagaaacacaaaaaagagttaggtagaagagtgatttgctctttggtaaatttagtctcttttcctgttcttagttcttatagaaccatcgatttttttacatatctaagggaaatgattctttgtagatacagataggtagcgcgttcactgtaagttttcttgatgaaagagggaatgaataggatgactacttgactttctttcttctctgatattttattacattgcagtatgctcatacctcgatagatatggtcaccaacactgcgattgtgtacattttttttgcctggataagaatacactataaattctgtaagcacaagctttggttaactggtagattgtgttgaagaaaaggatggtgcaccttccttgcaccttgctgtagtagtggtcctgatcctgaaagaacatttgtcccctcagtgaaaaaccacacagaacattgtgcttttgctgttttttcactttagattttacataatggcaactttatgtgttgagcatctttatctgaaacttgtagcactgggaaagcatcctcttgcatcaaatcagcatgtttccaaggaaaaggaaagaaccagaccaacctccagatcactctcataaccattgttttcttccccatctttggttactgagctttcaaccgttagcccacaaaacctgacacatagatattagataagcacaggctatgaggctagataaaacctattttgctgcatcattgatctttactttgtcatctaaagtccggtgacagggtggcattgcctggaggactggatgaaggtcccagttccttttttacagaaatattcctaggtttatcagggacaggattctcatgctgaagtcaaaagcaaggggaagcaaagaggcacagcctttgcatgcagtatcctattctgagacccacacatgttcctaatgttagtttatctgtagtaatcaaggaaaactatgtatgggccacaatacaaaggctggcacaagtgtgtgcagtgcaccgggttggtggtgccttctcgtgaggttgctgtctgaagatagctccgaaacaggtgagcgtggcttgtagagtaaactacaaatctgagctgcaatttggtaccacgtcagaacagtatttatatatatatactagggctgaaaataaaataacgtccacatgcatggatgaaaaataatggtgaatgatacgatacaataaaatgcatgtatatgtagaggtagacatatgagctgccatgaaacctgggtacttttgcctggaggcttggaaggttcttgcgttggacaggtagcctgaatttctggcaggttcgtaggctggcacacctttctttgtccctcagcctctggcacatcatgctataacaacttctgaaaatgctcctccactatgcaaaccttaatctttcaactgtgcttgattagcttagctactgtgaagaaaagtctgttgccctgtgccaccattgatctctgaaaatgctcctccactatgcaaaccttaatctttcaactgtgcttgattagcttagctactgtgaagaaaagtctgttgccctgtgccaccattgatctctgaaaatgctcctccactataatgcaccctttaatcttgcaactgcatgactgcatgttggagggatcatcatgaggcattgtacaactggacagacctgttgtgttcatgatacagggcaggcaggcagaactgctgcagatccgtgtgtccttacactggctgaatggacttcagatctgcagcgtggattcttctgtctgacaaaactagtcgaccgaatcctttgcattttggtactctgtctagaaa

SEQ ID NO: 884 - DNA, 2316 bp, Setaria italica
ctgcagcagcaggggagtctaaccagcttccttgcggacgcaaccaccgcttcggattcgccggccgccgccgctccgcctcctcgccgctcacggcaaccgaccgcggagagaggcgtcgaggcgtgatgcttcccgccgcccggtagcgcgttgcggatgctgtggcctgtgaggctctctgccgccgcttggggatctgggctgctgctccggccgcggtggtggtgaacggcggcgacaggcgccggcgatggcgatgtcggcgaaggagaggaagctgagcaggctcgggagttgcaagggtagtccggcggcgggaggcagtggaggttcccccgccgcgaggggtcaccggtcgccggcggcggggccgcagcggcgtctgttcgcggcgctcttcgcgttcctgtgcgccggcgtggtcgtcctcggcggcgtgcacgtcattggagcatcgttccggccggtgctcaggacggcgtggccgtcggggacgctgagcgccatttcttctgatgccggagcgcggcaagctggggttggtgcggacaccgtgttgccgtcagtccaaatccggcacgcggttgcctttccggaccgtgttctcctgatcctcaagaacgggtcgtcgctgccagctccggagcagtttgagtgtctgtactcccctgccaattcctcggagctgcgccaccaagccctcttggctgtgtccttgccagatggatccagcgtcgtccattgccctgctgagccatctggtgtggacgtctctctgtccctgtccctgtcacctccagtggcgccgctacaatgggacaggcttgtgtacaccgcacttgttgacagcagggacaactccaccgttgtgttcgctaaggggatgaacctccgtccaggccgtttgggtgtggcgtcacggtatcagtgcgtctttggccgggacctatcgaagccgaagcatgtgctcacctcccctttgatttctgcagcacaggagattttcaggtgtgtgacaccagttcgcattcgccggtacctgaggatgtcaatggatgccaatggcaatggagacagtgatgacaaacctatgttggtctccatcaggactaagggcctgagggattctacacttccctcaattgctgaaccagagccacttcctcggtataagaggcatcgacggcaaaaggcacactcaatgtgtgtatgcaccatgctgcgaaaccaagcaaggttcctccaagaatggatcatctaccactcacatatcggtgtggagcggtggttcatctatgacaacaacagtgatgatgacattgagcaggtcctcaataccatggatccatcaaggtacaatgtgacgcgccatctgtggccatggatgaagtctcaggaggctggttttgcacattgtgctctcagggcccgagagagctgtgagtgggtggggttcatcgatgtcgacgagtttttgcacttccctggcaaccagactctaccagatattctccagaactactcaaacaggccgaggatcggtgagctcaggactgcatgccacagctttggtccatcaggtcggactaaaattcccaagaaaggcgtcacaacaggctacacctgccggctggctgcgccggagcgccacaagtcaattgtcaggccagacgcattaaacccatcacttatcaatgtggtgcaccatttccacctgaaagaaggggtgaggtatgtgaatattggtcagggagtgatgctgatcaaccactacaagtaccaagtttgggaggtgttcaaggacaagttttctgggcgtgtcgcaacctatgttgcagattggcaggatgaggagaatgttggatccagggacagggcaccaggattagggaccaagccggtggaaccagaggattggccgcatcggttctgtgaagtatatgataccggtcttaaagattttgttcataaagctttcacagatccagatactggaagtcttccatggtagataatgggtaatcactgtatttgatctggcacggctcacaattgcccgcatggagatgcacagacagggaaagaaacacaaaaaagagttaggtagaagagtgatttgctctttggtaaatgttagtcttaaggtttttcatgttcttcttttctattagaatcatctatttttttacatatgaattctttgtagatacagataggtagcaggttcactgtaagttttcttgatgaaagaggaaatgaataggatgactacttgactttctttcttcagtggttttacattgctgtgtgctc

SEQ ID NO: 885 - DNA, 3265 bp, Panicum virgatum
gcagcgggagtaagcagcttcctgcgaacgcaaccaccgcttcggattcgccggccgccgctccgtctcctcgccgctcacgaccgccgaccgcggggtgagacgtgggggcgtcgatgcttcctgccgcccggtagcgcgttgcggatgctgtgggccgtgaggctcgctggtgctgccgcttggggatctgggcggcggtggcgatggtgatgtcggcgaaggagaggaagctcagcaggctcgggagttgtaaggttgcgggaggtggcggtggaggttcccccgccgcgaggggtcaccggtcggcggcggcggcggcgtccgcggctgggccgcagcggcgtctgttcgcggcgctcttcgcgttcctgtgcgccggcgtggtcgtcattggcggcgtgcacgtcattggagcatcgttccggccagtactcaggacagcgtggccgtcggggaccctgaacgccatttcctctgatactggagcgcagcaagctgggggcggcgatgacactgtgttgccgtcagtccaaatccagcacgcggttggcttcccggaccgtgttctcctgatcctcaaggacgggtcgtcgctgccagctccggagcgggttgagtgtctgtactcccctgccaattcatcggagctgcgccgccgagccctgttggctgtgtcctcgccagatggatccagcctcgtccattgccctgctgagccatccggtgtggatgtctcactgtcattgtccctgtcacctccggtggcaccgcttcattgggacagacttgtgtacactgcacttgttgacagcagggacaactccactgttgtgttcgccaaggggatgaacctccgtccaggccgtttgggtgtggcatcgcgatatcagtgtgtctttggcagggacttatcaaagccgaagcatgtgctcacctcccctgtgatttctgcagcacaggagattttccggtgtgtgacaccagctcgcattcgccggtatctgaggatgtcaactgatgccagaagaaatggagacactgatgacaagcctatgctggtctccatcaggacgaagggccagagggactctacgcttccctcaatcgccgaacctgagccacttcctcggtacaacaggcatcgacggcaaaaggcacactcaatgtgtgtatgcaccatgctgcgcaaccaagcaaggttcctccgagaatggatcatctaccactcccatattggtgtggagcggtggttcatctatgacaacaacagtgatgatgacattgagcaggtcctcaataccatggatccatcaaggtacaatgtcacgcgccatctgtggccatggatgaagtctcaggaggcaggttttgcacattgtgctctcagggccagagagagctgtgagtgggtggggttcatcgacgtcgacgagttcttgcacttccctggtaaccagactcttgcagatattctccagaactactcaaacaggccacgaatcggtgagctcaggacggcgtgccacagctttggtccatcaggtcggaccaaaattcccaagaaaggtgttacaacaggctacacctgccgactgtctgcacctgagcgccacaagtcaattgtccggccggatgcattaaacccatcactcatcaatgtggtgcaccatttccatctgaaagaaggggcgaggtatgtgaacattggtcagggagtgatgctgatcaaccactacaagtaccaagtttgggaggtgttcaaggataagttttctggccgtgtcgcaacctatgttgcagattggaaggatgaagagaatgtggggtccagagacagggcaccaggattagggaccaagccggtggaaccagaggattggccgagtcggttctgtgaagtttatgataccggtcttaaagattttgtgcataaagctttcacagatccagatactggaagtcttccatggtagatgataggcaatcactgtatttgatctggcatggctcacaatatcctacatggagatgcacatactgggaaagaaacacagaaaagagttaggcagaagagtgatttgctctttggtaaatgttagtctaaggtttttcccgttcttattttcttttataatcatccatttttttacatatctaagagggagagaattcttttgtagatacagataggtagcaggttcactgtaagttttcttgatgaaagatgaaatgaataggatgactacttgactttctttcttcagttattttacatcgctgtgtgctcatactgatgggtaagaaaacactaaatttcagcaccaaattacatggtcactgtctctgcaaatgcaaacaatctttttttttctggagaagattacaatcagttcaggaaccataagctgattaactggcagtttgcggtgtagacaagaattgtgccccatgcttagctcctttctgtagtagtggtcctggaagaatatttagcttctcatttgtcaggaaatcacacccagaacatttttgctttacatttacataatggcaactttatgcttagcatctttacctgtaacttgtagctttgggaaagcatcctctattcctcttgcatcaaatcagtaggtttcttaggataagggaagaaccagatcagcatacagatccctctcaaaaatattgttttattctccatctttggcgacttgttagaggttgggtagtttattataaacctgacacatacataagcatagtctagataaaacctaggttctttccccttttactttattgcctcattgatatactttattgtctaaaggttcattgacaggatggcattgtctggatcaaaggtcccagttctttattttaacacttatccctaggtttatcaggacaggtttctcatagtgaagtcaaaagcaagggcaagcgaacagacataacctttacatttgcaaatatccttcttgcggaaccccaaggctagtccttgtttctgatgttagttttgctgtagtaatcaaggaaagctatgggcaacaatacaaaagctggcagttgtgtggattggtttggtgccttctggtgatgttggcaactggagtaaactacaaatttgagctgcagtttggtaccacatcaggatagtatatatagggctgaagctaatgacctcatgtgtaataatgtggtatacaacaatgcatgtatatagacatatgagctgccatgaatgatacatacctgg

SEQ ID NO: 886 - DNA, 1991 bp, Panicum virgatum
cagcttccttgcgaacgcaaccaccgcttcggattcgccggccgccgctccgtctcctcgccgctcacgaccgccgaccgcggggtgagacgtgggggcgtcgatgcttcctgccgcccggtagcgcgttgcggatgctgtgggccgtgaggctcgctggtgctgccgcttggggatctgggcggcggtggcgatggtgatgtcggcgaaggagaggaagctcagcaggctcgggagttgtaaggttgcgggaggtggcggtggaggttcccccgccgcgaggggtcaccggtcggcggcggcggcggcgtccgcggctgggccgcagcggcgtctgttcgcggcgctcttcgcgttcctgtgcgccggcgtggtcgtcattggcggcgtgcacgtcattggagcatcgttccggccagtactcaggacagcgtggccgtcggggaccctgaacgccatttcctctgatactggagcgcagcaagctgggggcggcgatgacactgtgttgccgtcagtccaaatccagcacgcggttggcttcccggaccgtgttctcctgatcctcaaggacgggtcgtcgctgccagctccggagcgggttgagtgtctgtactcccctgccaattcatcggagctgcgccgccgagccctgttggctgtgtcctcgccagatggatccagcctcgtccattgccctgctgagccatccggtgtggatgtctcactgtcattgtccctgtcacctccggtggcaccgcttcattgggacagacttgtgtacactgcacttgttgacagcagggacaactccactgttgtgtttgccaaggggatgaacctccgtccaggtcgtttgggtgtggcatcgcggtatcagtgcgtctttggccgggacctatcgaagccaaagcatgtgctcacctcccctgtgatttctgcagcacaggagattttccggtgcgtgacaccagctcgcattcgccggtatctgaggatgtcaactgatgccaacagaaatggagacactgatgacaagcctatgctggtctctatcaggacgaagggccagagggactctacacttccctcaattgccgaacctgagccacttcctcggtacaaaaggcatcgacggcaaaaggcacactcaatgtgtgtatgcaccatgctgcgcaaccaagcaaggttcctccgagaatggatcatctaccactcccatattggtgtggagcggtggttcatctatgacaacaacagtgatgatgacattgagcaggtcctcaataccatggatccatcaaggtacaacgtcacgcgccatctgtggccatggatgaagtctcaggaggcaggttttgcacattgtgctctcagggcccgagagagctgtgagtgggtggggttcatcgacgtcgacgagttcttgcacttccctggtaaccagactctagcagatattctccagaactacttaaacaggccacgaatcggtgagctcaggactgcgtgccacagctttggtccgtcaggtcggatcaaaattcccaagaaaggcgttacaacaggctacacctgccggctgtcagcaccggagcgccacaagtcaattgtcaggccggatgcattaaacccatcactcatcaatgtggtgcaccatttccatctgaaagaaggggtgaggtatgtgaacattggtcagggagtgatgctgatcaaccactacaagtaccaagtttgggaggtgttcaaggataagttttctggccgtgtcgcaacctatgttgcagattggaaaggatgaagagaacgtgggatccagagacagggcaccagggattagggaccaagccggtggaaccagaggattggccgagtcggttctgtgaagtttatgataccggtcttaaagattttgtgcataaagctttcacagatccagatactggaagtcttccatggtagatgatactcaatcactgtatttgatc

SEQ ID NO: 887 - DNA, 2507 bp, Panicum virgatum
cggacgtgcccgggccgttagacgcgacgcggccccacctgtttactgtttcaacgggcccacacgtcattccaagccacgcgccgcgcggcggccggcccccgcacaccgacatgtgggccagatggggacgcgctggcccacccgtcaggcgcctggccgcgggtataaacgccccgcttgcccaacaggcaggcgctctgcagcagcgtggaggaagcagcttccttgcgtacgcaaccaccgcttcggattcgccggccgcctccccgtctcctcgccgttcacggccaccgaccgcggggtgagacgcgggggcgccgatgcttcacgccgcccggtagcgagctgcggatgctgtggcccgtgaggctcgctggtgctgccgcttggggatctgggcggcggcggtgaccggcggcgatgtcggcgaaggagaggaagctcagcaggctcgggagttgcaaggttgttgccgttgcgggaggcagcggcggcggcggtttgggttcccccgcggcgaggggtcaccggtcggcggcggcggccgggccgcagcggcgtctgttcgcggcgctcttcgcgttcctgtgcgccggcgtggtcgtcattggcggcgtgcacgtcattggagcatcgttccggccagtactcaggacggcgtggccgtcggggaccctgaacgccatttcctctgatgctggagcgcagcaagctgggggcagcgccgacaccgtgttgccgtcagttcaaatccggcacgcggttggcttcccggatcgtgttctcctgatcctcaaggacgggtcgtcgctgccagctccagagcgggttgagtgtctgtactcccctgccaattcctcggagctgcgtcgccgagcccttctggctgtgtcctcaccagatggatccagcctcgtccattgccctgctgagccatctggtgtggatgtctcactgtcattgtccctgtcacctccagtggtgccgctgcattgggacagacttgtgtacaccgcacttgttgacagcagggacaactccactgttgtgtttgccaaggggatgaacctccgtccaggtcgtttgggtgtggcatcgcggtatcagtgcgtctttggccgggacctatcgaagccaaagcatgtgctcacctcccctgtgatttctgcagcacaggagattttccggtgcgtgacaccagctcgcattcgcaggtatctgaggatgtcaactgatgccaacagaaatggagacactgatgacaagcctatgctggtctctatcaggacgaagggccagagggactctacacttccctcaattgccgaacctgagccacttcctcggtacaaaaggcatcgacggcagaaggcacactcaatgtgtgtatgcaccatgctgcgcaaccaagcaaggttcctccgagaatggatcatctaccactcccatattggtgtggagcggtggttcatctatgacaacaacagtgatgatgacattgagcaggtcctcaataccatggatccatcaaggtacaacgtcacgcgccatctgtggccatggatgaagtctcaggaggcaggttttgcacattgtgctctcagggcccgagagagctgtgagtgggtggggttcatcgacgtcgacgagttcttgcacttccctggtaaccagactctagcagatattctccagaactacttaaacaggccacgaatcggtgagctcaggactgcgtgccacagctttggtccgtcaggtcggatcaaaattcccaagaaaggcgttacaacaggctacacctgccggctgtcagcaccggagcgccacaagtcaattgtcaggccggatgcattaaacccatcactcatcaatgtggtgcaccatttccatctgaaagaaggggtgaggtatgtgaacattggtcagggagtgatgctgatcaaccactacaagtaccaagtttgggaggtgttcaaggataagttttctggccgtgtcgcaacctatgttgcagattggaaggatgaagagaacgtgggatccagagacagggcaccaggattagggaccaagccggtggaaccagaggattggccgagtcggttctgtgaagtctatgataccggtcttaaagattttgtgcataaagctttcacagatccagatactggaagtcttccatggtagatgatactcaatcactgtatttgatctggcatggctcacaatatcctacatggagatgcacatactggaaaagaaacacagaaaagggttaggcagaagagtgatttgctctttggtaaatgttagtctaaggtttttcccgttcttattttcttttataatcatccatttttttacatatctaagagggagagaattcttttgtagatacagattggtagcaggttcactgtaagttttcttgatgaaagatgaaatgaataggataactacttgactttctttcttcagttattttacattgttgtgtgctc

SEQ ID NO: 888 - DNA, 3108 bp, Triticum aestivum
taaagctgaaaacaactccaagtccaagaaaaaagccacctttatctcctcccttcccttgccggctccctccggtccggacggtggtgctcgtgttggcctctgcctcctcttgaggcgcttctccggagcatttgctgctccggctcggagctgctccgagcccagcggctgtgggagcggttggcggcggaggggcgtcgatctcggccggatctcggcgaatgcccgccgcggcgcgctccggtggaccggggcaggccaacattatgatggggaggaggaagttgcaagtggtgaccttggcgatcttgtgtttctggtcatctgctggggcacaaacagtggatttcaagcctgccgacagctacctggttgactgtgggtctgccaagggcacgacggttctcgggagggacttcgctgccgatggggcatctccggtgaccgtgtccacctcccaagatattcttgccggcacctcggccaacggggtgtcctcgtttgacaacccggtgctttaccagaccgcccgcatcttcacgagcccgtcatcctatacttttcctatccagaagcaggggcggcattttgttcgtctctacttctaccccttcatctaccagagttatgatctctccaccgccaagttcaccgtgtcgacccaagatgtgctcctgctcagtgatttccagcagccggacaagacggcgccgctgttcaaggaatactctttgaacatcacccgtgaccagcttgtcatttccttcaagccgtcaaacggaattgcattcatcaacgcaattgaagtggtttctgttccagatgatctcatagctgatgtagccaatatggtcaaccctgtgcagcagtacagcggtttgactacacagtcactggagacggtgtatcgtgtcaacatgggtggtccgaaggtcttcccgaacaatgataccctctcgaggacttggcagaaggatcagaagtacatactgaaccccagtgtgaccaaaactgctcaatatggcaaggctatcaagtacaggaaaggcggggcaactccactgacggccccagatattgtgtacagtacagctacagaattggcggcttcaaacacatccaacgcacttttcaacatgacatggcagtttgatgtggatgcaggcttcagctatctgataagatttcacttctgtgatatagtcagcaaggcactgaaccagctctacttcaatgcatatgtgggaggcttctttgcacagcatgatcttgatctctcagagcaatcggtgaatcaactggctacagctatctatgttgacgtggttctttcttccaatgatgcatctagcaagctcagcatcagtattggtccgtccaccttgaacaatgcattgcctgatgggattctgaatggccttgagattatgaagatgggcagtggctctggttctgctttcactgttgggaataacggttcaaacaaaaagttgcccataattattggctcagtccttggggttgttgggcttctgataattgtccttgttgtggtactgctttgccggaggaagaagaccgacgacaagcagcactccaagacctggatgcctttctctatcaatgggctcacgtctctcagtacaggaagcagaacttcctatggtactacactaacatcaggtctgaatggaagctatggatatcgctttgccttcaatgtgctccaagaagcaacaaacaattttgatgagagctgggtgattggagtcggaggttttgggaaagtctacaagggtgccttgagggatgacacaaaggttgcagtgaagcgaggaaaccccaagtcccagcaaggtctcaatgagttccggacagagatcgagctcctttcacgtctgcgtcaccgccacctggtgtctcttattgggtactgtgatgaaaggaatgagatgatcttggtctatgagtacatggagaacggaaccgtcaagagccacctgtatggttcagacaacccctcactcaactggaagcagcggctggagatctgcattggagcagcaagggggctacactatcttcataccggttctgcaaaggccattatccaccgtgatgtcaagtctgcaaacatcttgcttgatgagaatctcctcgcgaaagtcgccgactttgggctatcaaagactgggcctgagctggatcagactcacgtcagcactgcagtgaagggcagctttgggtacctcgaccctgaatacttccgaaggcagcagctgaccgagaagtcagacgtctactccttcggtgttgtcatgctggaggtgctctgcgcgaggccggtgatcgacccttcactcccgagggaaatggtgaacttggcagagtggggaatgaagtggcagaagagaggggagctgcaccagatcgtcgaccagaagctttccggcgcgatcaggccggactctctgaggaagttcggtgagacggtggagaagtgcctggcagactacggcgtggagcggccgtcgatgggggacgtcctctggaacttggagtatgtcctgcagctccaggatgtggattcttcgaccgtgtcggacgtgaacagcatgaaccggatcgtcgacctgtcgtcgcaggttcagcatgtgggtgccatggagagcatcagcgtgacgatggcggaggacggagctttgcacgagcctgaccacgacctctccgacgtgtcgatgagcagggttttctctcagctgatcaaagccgaggggaggtgaaaacgcgccggatgatctgtagggtaccggtagaggtgtgagcaagccttggatttttcttttcttgttgaagtttacctgagatgtgtcacgtgtaattggttgtttcatcccttgtaattgtactgaactacggtttggatttctgatggccttacctcacccacttctgggggcacacgatttatcagatataggtatcttcttgtatggaatctattcggctctagccatatttatgtactgatgatgatgatccggctaaacgctggattctggaactggtgcactctcttctcttgtggcattaacaaaattatca

SEQ ID NO: 889 - DNA, 3134 bp, Secale cereale
gactatcgaacctagctgttattattccttcccaaggtggcagccagacactccctcccctcgccctcctcttaactcccgtctctctcctctctctccaagcctagcgtttttcttgctccgtaaagctgaaaactcctcccaggtccaggaaaaaagccacctttatctcctcccttcccctgccggctccctccggtgcagacggtggtggtgctggtggtgggctctgcctcctcttgaggcgcttctccggagcatttgctggcccggcccggggctgctcggagcacggcggctgcgggagcggttggcggcggaggggcgtcgatctcggccggatctcggcgaatgcccgccgcggcgcgctccggtggaccggggcaggccaatactatgatggggaggaggaagttgcaagtggtgaccttggcgatcttgtgtttctggtcatctgctggggtctgcaaagcacaaacagtggatttcaagcctgccgataactacctggttgactgtgggtctaccaagggcacgacggttctcgggagggactttgctgccgatggggcatctccggtgaccgtgtccacctcccaagatatccttgccggcacgtcggccaacggggtgtcctcgtttgacaacccggtgctttaccagactgcccgcatcttcacgggcccgtcatcctatacttttcctatccagaagcaggggcggcattttgttcgtctctacttctaccccttcatctaccagagttatgatctctccaccgccaagttcacggtgtcgacccaagatgtgctcctgctcagtgatttccagcagccggacaagacggcgccgctgttcaaggaatactctttgaacatcacccgtgaccagcttgtcatttccttcaagccgtcaaacgggattgcattcatcaacgcaattgaagtggtttctgttccagatgatctcatagccgatgtagccaatatggtcaaccctgtgcagcagtacagtggtttgactacacagtccctggagacggtgtatcgtgtcaacatgggtggtccgaaggtcttcccgagcaatgataccctctcgaggacttggcagaaggatcagaagtacatactgaaccccagtgtgaccaaaactgctgtatatggcaagcctatcaactataggaaaggcggggcaactccactgacggccccagacattgtgtacagtacagctacagaattggcggcttcaaacacatccaacgcgcttttcaacatgacatggcagtttgatgtggatgcaggcttcagctatctgataagatttcacttctgtgatatagtcagcaaggcactgaacgggatagacatcatgcatatgtgggaggcttctttgcacagcatgatcttgatctctcagagcaatcggtgaaccagttggccacagctatctatgttgacgtggttctttcttccaatgatgcatctagcaagctcagcatcagtattggtccatccaccttgaacaatgcattgcctgatgggattctgaatggccttgagattatgaagatgggcagtggctctggttctgctttcactattggagataacagttcaaacaaaaagttgcccataattattggctcagtccttggggttgttgggcttctgataattgtccttgttgtggtactgctttgccggaggaagaagaccgacgacaagcagcactcgaagacctggatgcctttctctatcaacgggctcacgtctctcagtacaggaagcagaacttcctatggtactacactaacatcaggtctgaatggaagctatggataccgctttgccttcaatgtgctccaagaagcaacaaacaattttgatgagagctggtgatgagcgaggttcggaagtccctacaggtgccttgagggatgacacaaaggttgcagtgaagcgaggaaaccccaagtcccagcaaggtctcaatgagttccggacagagatcgagctcctttcacgtctgcgtcaccgccacctggtgtctctgattgggtactgcgatgaaaggaatgagatgatcttggtctacgagtacatggagaacgggaccgtcaagagccacctatatggttcagacaacccctcactcaactggaagcagcgcctggagatctgcattggagcagcaaggggcctacactatcttcatactggttctgcaaaggccattatccaccgtgatgtcaagtctgcaaacatcttgcttgacgagaatctccttgcgaaagtcgcagactttgggctgtcaaagaccgggcctgagctggatcagactcacgttagcactgcagtgaagggtagctttgggtaccttgaccctgaatacttccgaaggcagcagctgaccgagaagtcggacgtctactccttcggcgttgtcatgctggaggtgctctgcgcgaggccggtgatcgacccttcgctcccgagggaaatggtgaacttagcagagtggggaatgaagtggcagaagagaggagagctgcaccagatcgtcgaccagaagctttctggcgctatcaggccggactctctgaggaagttcggtgagacggtggagaagtgcctggcggattacggcgtggagcggccgtcaatgggggacgtcctctggaacttggagtatgtcctgcagctccaggacgcggattcttcgaccgtgtcggacgtgaacagcatgaaccggatcgtcgacctgtcgtcgcaggttcagcatgtgggtgccatggagagcatcagcgtgacgatggcggaggacggagctttgcacgagcctgatcatgacctctccgacgtgtcgatgagcagggttttctcacagctgatcaaagccgaggggaggtgaaaacgcgccggatgatctgtagggtaccggtagatgtgtgagcaagacttggattttttcttttcttgttgaagtttacctgagatgtgtcacgtgtaattggttgtttcacccttgtaattgtgcactgaactacggtttggatttctgatggccttacctttttttttattaaactacctcctttattaattaggctacaatagtagcatctgataact

SEQ ID NO: 890 - DNA, 2903 bp, Brachypodium distachyon
tattagcttaggattatagactgtggacatggtatctcaaacactcttgttctttcaggtcagcaccatgctggggaggaggagaaagttgcaatctgcagccttgctcgttttttatttctgctcatctgcggggataatatgcagagcacagttagatcaattcaagccggctgacagctacctcgttgattgcggctctgctaagggcacgacggtcaccgagaggaacttcgctgccgacggggcgtctccggtgacagtgtccacctctcaagaaattcttgctggcacctcggccaatggggtgtcctctttcgacaactcggcactttaccagacggcgcgcatattcacgagcccgtcgtcctataccttcccgatcaataagcaaggccggcatttcgtccgtctctacttcttccctttcatctaccagagctatgatctctccagcgccaagtttacggtgtcgacccaagatgtgcttctgcttagtgacttccagcagccagacaagactgcaccactgttcaaggaatactctttgaacatcacccgtgacaatcttattatctccttcaagccgtcgaacggaattgccttcatcaatgcaattgaagtggtttcggtcccagacgatctcatagctgatgttgcccagatggtcaaccctgtgcagcagtacagcggtttgtctacgcagtcattggagacggtgtatcgcgtcaatatgggtggtccaaaggtcactgcgaacaatgataccctctcaaggacatggctgagtgatcagaagttcatactgaaccctagtgtgaccaaaaaggttgtttatggcaaggcaatcaagtacaagaatggtggagcaacgccactgactgcccctgatattgtctatggtacagcaacagaattggctgcttcaaatacatccaatgcacttttcaacatgacgtggcagtttgatgtagatgcagggtttagctatttgataagatttcacttctgtgatattgtcagtaaggcacttaaccagctctactttaatgcatatgtggggggtttctttgcacaacatgatcttgatctctcagaacaatcgatgaatcaattggctactgctatctatgttgatgtggttctttcatctaacgatgcatctagcaagctcagcatcagcattggtccatctaccttgaacaacgcattccctgatggcattctaaatggccttgaggttatgaagatgggcagtggctcaggttctgcttttactgttggatcttctggtgcaaagaaaaatctggttgtgattactggttcagtccttggggttattggacttttggtaattatccttgtgctggtactgctttgccggaggaagaagactgatgacaagacacactccaagacttggatgcctttctctattaatggtctcacatctctcagtacaggaagtagaacttcttatggtactactctcacatcaggtctgaatggaagctttggatatcgatttgccttcaatgttctccaagaagcaacaaacaattttgacgagaactgggtcattggagttggaggttttgggaaagtgtacaagggagtgttgagggatgacacgaaggttgcagtgaagcgaggaaaccccaagtctcagcaaggtcttaatgagttccgtacagagattgagctcctttcacgtttgcgtcaccgtcatctggtgtctctgattgggtactgtgatgaaaggaatgagatgatcttggtatatgaatatatggagaatgggaccgtcaaaagccacctatatggttcagacaacccatcgctcaactggaagcagcgcttggagatctgcattggagctgcaagggggttacactatcttcatactggttctgcaaaggccattatccaccgtgatgtcaagtctgcaaacatcttgcttgatgagaatttccttgcaaaagttgctgactttgggctatcaaagactgggcctgagcttgatcaaactcatgtcagcactgcagtgaagggtagctttgggtatcttgaccctgaatattttcgaaggcagcagctgactgagaagtcagatgtctattcctttggcgttgtcatgctggaggtgctttgcgcgaggccggtgattgaccctacactcccgagggaaatggtgaatcaacgcagagtggggaatgaaatggcagaagagaggagagttgcatcagatcgttgatcagagactttccagtacgatcaggccggattctctaaggaagtttggtgaaacagtagagaagtgcctggcagactacggtgtggagcggccgtcgatgggagatgtcctatggaacttggagtatgtcctgcagctccaagatgcagattcttcaacagtatcagacgtgaacagcatgaaccggatcgttgacctctcgtcgcaggttcagcatgtgggtgctcttgagagcatcagcgtgactatggcagaagctggggcttcacacgagcctgaccacgacctttccgatgtgtcgatgagcagggttttctctcagctaatcaaagctgagggaaggtgaaagcatatcagatgatccatccagggcacctatagaagcaagagtatgccttgcaaactagtatttccgtatcacaagcttacttgagataccacgtgtaattggttgtttcatgccatatgattgtactgaaccatggttccattttctctcagctaatcaaagctatatcttgttgttgtatggaatctagtcctattcggttatggcaatgcgtactgatctggcaaaattctggatttctagttgcaattgccccattccagctatatcttgttgtatggaatatattcctatttggtt

SEQ ID NO: 891 - DNA, 3708 bp, Oryza sativa
tacgctaaacaaactgctagtgtgtcggagtggtagttaagaaaaaaaagtttaatcactacagtggcgcaccgtctctctcacctcgccgctgcatcatctcctgctctgctgctgctcgatcgtgtttagctgttattattcctctctagggtggcagccaccctccctctcctccttaactcctctctctctctctctcatctcccccacacggtgcccagccaaacacctccacctccacatctctctctcctctcccccaccctctctgccattcgcttgctttgcttcccaaagcttggagctcgtccaccagcagcaagaagaaggagagctcccttttcgtaccacctcgccgcgtcggctgctccgaatggtggtcggtctccgccggcgcgtctgctgaccgaccgacccggcctgcccgcctgcctgctcggcgtacgttctccgagatcccaccggcggcgggatctcgccgcgggaatgcccgccgcgcggcgctccggcggacggcttacggaggaggtgaacatgatggtggctctgtccgggaggaagaggaggctgcaagccgcaaccatggtggctttgtgtttcttgtcatccatttgcgtttccacagcgcaattcaagcctgccgacaactacctggtggactgcggatcctccaagagcacgacgctcggcacgaggacctttgcggctgacggggctgccccggtgaaggtggacacctccctggaaatccttgccggcacgtcggcgaatggggttgcgtcattcgataactcggcgctttaccagaccgcccgcatcttcacgagcccttcatcgtatactttcccgatccagaagcagggccggcattttgttcgtctctacttcttcgcctttgcctaccagagctatgatctttccactgccaagttcaccgtgtcgacccaagaaatgctcttgcttagtgacttccaacagccagacaagactgcgccattgttcaaggaatactctttgaacatcacccaagacaagctcattatttccttcaagccatcgaatggaatcgcattcatcaatgcgattgaagtggtttcagtcccagatgatctcataggtgatagtgccccgatggtcaaccctatgcagcagtacagcggtttatctacacaaccattggaaacagtgtaccgtgttaacatgggtggaccaaaggtcactgcagacaatgataccctctccaggacctgggtcactgacaaaaagtatttagtgaacccatctgtgactagagaggttaatggggggaaggtcaattatatgaaaggtggaggatcaacaccgctgattgctcctgatattgtttatagcacagctacagaattggcagcttcgaatacaacgaacgcacttttcaacatgacatggcagtttgatgtggattcaggtttcagctacttgataagatttcacttctgtgatatagtcagcaaggcacttaaccaactctatttcaatgcatatgttggcagcttctatgcgcagcatgatattgatctctcaattcaatcaatgaatcagttggctacagctatctatttggatgtggttctttcatcaaatgatgcatctaacaagctcagcatcagtattggtccatccactttgaacaatgcattaccagatgggattctgaatggtcttgaggtcatgaagatgagcagtggctcaggttctgctttcactgttggatcatctggttcaaacaagaatttaggtgtgattattgggtcagtccttggagctgttggtattctgataattgtccttgtcatagtacttctttgccgaaagaaaaagactctggagaagcagcactcaaagacttggatgcctttctctatcaatgggctcacctctctcagtacaggaagtagaacttcttatggtactactctcacatcagggctgaatggaagctatggataccgatttgcctttagcgtgctccaagaagcaacaaacaattttgatgagaactgggttattggcgttggaggttttgggaaggtctacaaaggtgtgctgagggatgacaccaaggttgcagtgaagcgagggaacccgaagtctcagcaaggtctcaatgagttccgtacagagatcgaactcctttcacggctgcggcaccgccatctggtgtccctgattgggtattgtgatgaaaggaatgagatgatcttggtctatgaatatatggaaaaagggactctgaaaagccacctgtatggctcggataacccctcactcaactggaagcagcggttggagatttgcattggagcagcaaggggacttcactaccttcataccggttctgcgaaggctattatccaccgtgatgtcaagtctgcaaacatcttgcttgatgagaatctcctagcaaaggttgctgactttgggctatcaaagactgggcctgagttggaccaaactcatgtcagtactgcagtgaagggtagctttgggtatcttgaccctgaatatttccgaaggcagcaactgactgagaagtcagatgtctactccttcggtgttgttttgctcgaggtgctttgcgcaaggccagtgattgaccctacgctcccaagggagatggtgaatttggcagagtgggggatgaaatggcagaagagaggagagctgcatcagatcgtcgatcagcgagtttctggttcaatcaggccggattctctgaggaagtttggcgaaacagtggagaaatgcctggcggactacggtgtggagcggccatccatgggagatgtcctgtggaacttggagtacgtcctgcagctccaggatgcagattcatcgacagtatcagatgtaaacagcatgaacaggattgtcgaactcccgtcgcaagtccagaacatcggcgccctcgagagcatcagcgtgacaatggcggaagctggagcttcacatgagcctgatcatgacctctccgacgtttccatgagcagggtgttctctcagctaatcaaagctgagggaaggtgaaagacaaactgggtaatctgtagtgtactttgtagaagtgaggaagccctgaaagttgtttcttatttacttcagagatcatatgtaattgttctttctttttttctttctttccttctttctcatgctccatgttctactgaacgatgttttcaaatttgttatggccttattagccatcgtgagcagatagagcttttcttgttttgaatctattctgctctagaacagcgtgtactgctgccctggcaaaatgctggatctggatgtgtgatgttgttgagtagtttccaataacccaattctagattctgtatgcataattgcaaaatatgcagtactcttttgttttcgctgcaatgtttcgatatttaaaattgcattgtgatgtaatcactgctgaaccaatacagtttcgatcacacccttctgcttaagaaagtgcgtctgttcgggcctcctttggattacatgatttttgtaggaatattttttatgcagttccctttttcctttcatgccatttggatcgcagaaacatgttaaaaagaactgatacccggttttctatgaaggtcagttgtttaatatagggttagactaggttacattctcgtcaaaatcgaattcgcaattgac

SEQ ID NO: 892 - DNA, 3110 bp, Setaria italica
ctctcctcctccctctcttctctccacagctgccgccaccttctctggcgccgcatcgtcggcgacctcaccgccggcgacgggacgcagcaagccgggcctcctcgggccaccacattcttgtctcgacgagaggcgtggggagcgtgcctcctcttctccatcaccatctcggtgctggactgctggagtgaaccggagatccgcccgggttccgatccgttctcctcctgctggtcaacatcatgatggctccatcagggaggaagaggccgccagctgcaacgaccttcatcctgctatgcatcttgtcatccttgtgcgtctgcaaagcgcaattcaagcctgcggacagctatcttgttgactgcgggtcccctaagagcaccacggttggccagaggaccttcgcctcagatggtgcatctccggtgaaggtgtccacctcccaggagatcctggctggcacgtccgcgaatggggtggcctctttcgataactcggccctctaccagactgcccgcatcttcaccagcccatcatcctacaccttccctatccagaagcagggtcggcatttcatccgcctctacttcttccctttcacctaccagagctatgatcttgcacttgccaaattcactgtgtcgacccaagatgtgctcctgctaagtgacttccagcagccagacaagactgcaccattgttcaaggagtactctttgaacatcacccgtgacacactggtgatttccttcaagccgtcaaatggaattgcattcatcaatgcaattgaggtggtctctgtcccagatgatctcatcgtcgatgctgcccaaatggtcaaccctatgcagcagtacagtggtttgtctgcacagcctctggagacggtgtatcgggtcaacatgggtggtcccaaggtcactcccgacaatgatactctctcgaggacctgggtgactgatcaaaaatacttgttgaacccaactgtgaccaaaaagtttgcttatggcaaggatgtcaactataagaagggtggtgcaactcagctgacagcccctgatattgtctatggtacagttacagaattggcagcatcaaatacatccaatgcgcttttcaacatgacatggcagtttgatgtggatgctggcttcagctatttgataaggtttcacttctgtgatattgtcagtaaggcacttaaccagctctacttcaatgcatatgttggaggcttctttgcgcaaaataaccttgatctctcagtaatgtctgataatcagttggctacagctacctatatagatgtggttctgtcatcgaatgatgcctccagtaaacttggcatcagcattggcccatcaaccttgaacaatgtattgcctgatgggattctgaatgggctcgaggttatgaagataagtactggaggttctgctttcactgttgggtctggcactggaaacaaaaatttgggtgtgattcttggtgcagtccttggaggtgctggactgttgataattattgttgttctggtacttctttgccggaagaaaaagacactggaaaagcaacattcaaagacatggatgcctttctctatcaatgggctcacctctctcagtacaggaagcagaacatcttatggtactactctcacatcagggttgaatggaagctatggataccgctttgccttcagtgtgctccaagaagcaacaaacaattttgatgagaactgggtcattggagttggaggctttgggaaggtctacaagggagtgatgagggatgagaccaaggttgcagtgaagcgtggaaacccgaagtctcagcaaggtctcaacgagttccgtacagagattgagctcctctcacggttgcgccaccgccatttggtgtctctgattgggtactgtgatgaaaggaatgagatgatcttggtctatgaatacatggagaaaggcactctcaagagccatctctatggctctgataatccctcacttaattggaagcagcggctggaggtttgcattggagcagcaaggggactgcactaccttcacactggttctgcaaaggccattatccaccgtgatgtcaagtcggcaaacatcttgcttgatgagaacctccttgcaaaggttgctgactttgggttatcgaagactggacctgagttggaccaaactcatgtcagcacagcagtgaagggcagctttggttatcttgatcctgaatatttccgaaggcaacagctgactgagaagtcagatgtctactcctttggtgttgttctgcttgaggtcctatgtgcaaggccagtgattgatcctacacttccgagggagatggtaaacttggccgagtggggaatgaagtggcagaagagaggagagctgcatcaaatcgtcgatcagagaatctcaggcacaatcaggccagactctttgaggaagtttggcgaaaccgtggagaagtgcctggcggactacggtgtggagcggccgtcaatgggagatgtcctctggaacctggagtacgttctgcagcttcaggatgcagattccacagtctcggatgtgaacagcatgaaccgtattgtggaactcccgtcccaggttcagaacgttggcgcccttgagagtatcagcgtgacaatggcggaagctggagcttcaaatgaccctgatcatgacctctccgacgtgtcgatgagccgggtcttctctcagctaatcaaagctgagggaaggtaaaggtgcatcggcatgagacagcctgtagggtactgatgaagccttcaaagttatctcttgttgaagtttacttgagagatcacgtgtaattgtattttttttctttttgtgctctataattgtactgaatcgcagtcatgattttcttaacagttttagccactgtgagcctgcgcggctacatctttagtagatagcatgtcccagttagttactggtgaagtgctggatgagtgaaaagtgctgcagttatgcgagcaccccatttgacattcacattttgtatgtgctgctcttcaggtcgtgctatctaggtatgttgcaccatttttttcatgtcag

SEQ ID NO: 893 - DNA, 3161 bp, Panicum virgatum
tctctccctctcttctcctcccggcctcccctcccctccctctccctctctctctcttctccctacagccgccaacttttctggcgccgcattgtcggcgatctcaccgccggcgtcgacaggcagcgagccggggtctcctcgcaccaccacattcttgtcttcacgagaggcgtggggagccgtgcctcctcttgcccgccaccatctcggtgctggcgtgctggcgtgaacaggagatccgcccggggccggatccgttctcctcctgctggtcaacatcatgatggctccatcggggaggacgaggccgcaagctgcaacaaccttcatcctgctatgcatcttgtcatcctactgcatctgcaaagcgcaattcaagcctgcagacagctatcttgttgactgcgggtcctccaagagcaccacagttggccagaggaccttcgcctccgatggtgcatctccggtgaaggtgtccacctcccaggagatcctggctggcacttctgcaaatggggtggcctctttcgacaactctgcgctctaccagactgcccgcatcttcaccagcccatcatcctacactttccctatccagaagcagggccggcatttcgtccggctctacttcttccccttcacctatcagagctatgatctttcacttgccaaattcactgtgtcgacccaagatgtgctcctgctaagtgacttccagcagccagacaaaactgcacccttgttcaaggagtactctttgaacatcacccgtgacacactcataatttccttcaagccgtcgaatggaattgcattcatcaatgcaattgaggtggtctctgtcccagatgatctcatcgtcgataatgctcaaatggtcaaccctatgcagcagtacagtggtttgtctacacagccgctagagacggtttatcgggtcaacatgggtggtccgaaggttactcccgacaacgataccctctcgaggacctgggtgacggataaaaagtacttgttgaacccaactatgaccaaacaggctattggcaaggatgtcaactataagaagggtggagcaactcagctgacagcccctgatattgtctatagtacagctacagaattggcagcatcaaatacgtccaatgctcttttcaacatgacatggcagtttgatgtcgatgctggcttcagctatttgataaggtttcacttctgtgatattgtcagtaaggcacttaaccagctctacttcaatgcatatgttggaggtttctctgcgcaaaataatcttgatctctcagtattgtctgataatcagttggctacagctatctatatagatgtggttctttcatcgaatgatgcatccagtaaacttggcatcagtattggcccatcgaccttgaacaatgtattgcccgatgggattctgaatgggcttgaggttatgaagataagtactggaggttctgctttcactgttgggtctggcggtggaaagaaaaatttggctgtgattcttggtgcagtccttgcagctgttggactgttgataatcgttgttgttctgatacttttttgccggaagaaaaagacattggaaaagcagcattcaaagacttggatgcctttctctatcaatgggctcacctctctcagtacaggaagcagaacatcttatggtactactcttacatcagggctgaatggaagctatggataccgctttgccttcagtgtgctccaagaagcaaccaacaatttcgatgagaactgggtcattggagttggaggctttgggaaggtctacaagggagtgctgagggatgagaccaaggttgcagtgaagcgtggaaatccaaagtctcaacaaggtctcaacgagttccgtacagagattgagctcctgtcacggctgcgccaccgccatctggtgtctctgattgggtactgtgatgaaaggaatgagatgatcttggtctatgaatatatggagaaaggcactctcaaaagccatctctatggctctgataacccctcgctaaattggaagcagcggctggaggtttgcattggagcagcaaggggactgcactatcttcacacaggttctgcaaaggccattatccaccgtgatgtcaagtctgcaaacatcttgcttgatgagaatctccttgcaaaggttgctgactttgggctatcaaagacagggcctgagttggaccaaactcatgtcagcactgcagtgaagggcagctttgggtatcttgatcctgaatatttccggaggcagcaactgactgagaagtcagatgtctactcctttggtgttgttttgcttgaggtcctttgtgcaaggcctgtgattgaccctacacttccgagggagatggtgaacttggccgaatggggaatgaaatggcagaagagaggagagctgcatcaaattgttgatcagaggatctctggcacaatcaggccagactctctaaggaagtttggtgaaaccgtggagaagtgcctcgcagactatggtgtggagcggccgtcaatgggagatgtcctatggaacctggagtacgttctgcagcttcaggatgtggattccacagtctcagacgtgaacagcatgaaccgcattgtggaactcccgtcccaggttcagaatgtcggcgcccttgagagtatcagtgtgacaatggcggaagctggagcttcgaatgagcctgatcatgacctctccgacgtgtcgatgagcagggtcttctctcagctaatcaaagccgaaggaaggtaaaggtgcatcagcatgaaacagcttgtagggtactaaggaaaacgttcaaagttctcttgtggaagcttaattgagagatcatctgtaattgtacttcttttctttttgtgctctgtaattgtactgaattgcagtcatggtttttttttacagttctagttactgtgagcctgcgcggctacatctttagtagatagcatgtctcattttcttactggtgaagtgctggatttgtgaaacttaatactgcaagcatgcaagcaccccagcttaacattcgcattttcaatgtgctgctgagttgctcttcatctcttgctatctatgtatgctgttaccacatttttatttcaggtca

SEQ ID NO: 894 - DNA, 3080 bp, Panicum virgatum
cttttctggcgccgcatcgtcggcgatctcaccgccggcctcgacacgcaacgagccggggcctcctcgcaccaccacattcttgtcttcacgagaggcgtggggagccgtgcttccgcttgcccgccaccatctcggcgctggcgtgctggcgtgaaccggagatccgcccggggccggatccgttctcctcctgctggtcaacatcatgatggctccatcagggaggaagaggccgcaagctgcaacaaccttcatcctgctattcatcttgtcatccttttgcatttgcaaagcgcaattcaagcctgcggacagctaccttgttgactgtgggtcctccaagagcaccaccgttggccagatgaccttcgcctctgatggtgcatctccggtgaaggtgtccacctcccaggagatcctggctggcacttctgcaaatggggtggcctcttttgacaactctgcgctgtatcagactgcccgcatcttcaccagcccatcatcctacactttccctatccagaagcagggccggcacttcgtccggctctacttcttccccttcacctatcagagctatgatctttcactcgccaaattcactgtgtcgacccaagatgtgctcctgctaaatgacttccagcagccagacaaaactgcacccttgttcaaggagtactctttgaacatcacccgtgacacactcgtgatttccttcaagccgtcgaatggaattgcattcatcaatgcaattgaggtggtctctgtcccagatgatctcatcgtcgatgctgcccaaatggtcaaccctgtgcagcagtacagtggtttgtctacacagccgctagagacggtttatcgggtcaacatgggtggtccgaaggtcactcctgacaacgataccctctcgaggacctgggtgaccgataaaaaatacttgttgaacccaaccgtgaccaaacaggttgttggcaatgtcaactataagaagggtggagcaactcagctgacagcccctgatattgtctatggtacagctgcagaattggcagcatcaaatacgtccaatgctcttttcaacatgacatggcagtttgatgtggatgctggcttcagttatttgataaggtttcacttctgtgatattgtcagtaaggcacttaaccagctctacttcaatgcatatgttggaggtttctctgcgcaaaataatctcgatctctcagtaatgtctgataatcagttggctacagctatctatatagatgtggttctttcatcgaatgatgcatccagtaaacttagtatcagtattggcccatcaaccttgaacaatgtattgcccgatgggattctgaatgggcttgaggttatgaagataagtactggaggttctgctttcactgttgggtctggcggtggaaacaaaaatttgggtgtggttcttggtgcagtccttggagctgttggactgttgatactcgttgttgttctgatacttttttgccggaagaaaaagacattggaaaagcagcattcaaagacttggatgcctttctctatcaatgggctcacctctctcagtacaggaagtagaacatcttatggtactactcttacatcagggctgaatggaagctatggataccgctttgccttcagtgtgctccaagaagcaactaacaatttcgatgagaactgggtcattggagttggaggctttgggaaggtctacaagggagtgctgagggatgagaccaaggttgcagtgaagcgtggaaatccgaagtctcaacaaggtctcaacgagttccgtacagagattgagctcctgtcacggctgcgccaccgccatctggtgtctctgattgggtactgtgatgaaaggaatgagatgatcttggtctatgaatatatggagaaaggcactctcaagagccatctctatggctctgataacccctcgctaaattggaagcagcggctggaggtttgcattggagcagcaaggggactgcactatcttcacacaggttctgcaaaggccattatccatcgtgatgtcaagtctgcaaacatcttgcttgatgagaatctccttgcaaaggttgctgactttgggctatcaaagacagggcctgagttggaccaaactcatgtcagcactgcagtgaagggcagctttgggtatcttgatcctgaatatttccggaggcagcaactgactgagaagtcagatgtctactcctttggtgttgttttgcttgaggtcctttgtgcaaggcctgtgattgaccctacacttccgagggagatggtgaacttggccgaatggggaatgaagtggcagaagagaggagagctgcatcaaatcgttgatcagaggatctcaggcacaatcaggccagactctctaaggaagtttggtgaaaccgtggagaagtgcctggcagactatggtgtggagcggccgtcgatgggagacgtcctctggaacctggaatacgttctacagcttcaggatgcggattccacggtctcagacgtgaacagcatgaaccgcattgtggaactcccgtcacaggttcagaatgtcggcgcccttgagagtatcagtgtgacaatggcggaagctggagcttcaaatgagcctgatcatgacctatccgacgtgtctatgagcagggtcttctctcagctaatcaaagccgaaggaaggtaaaggtgcatcagcatgagatgtagctctgtaattgtactgaagtacagaggaaaccttcaaagttctcttgttgaagcttaattgagagatcatctttaattgtacttttttctttctttttgtgctctgtaattgtactgaattgcagtcatgatttttttttacagttctagctactgtgagcctgcctggctacatctttagtagatagcatgtctcattttcttactggcgaagtgctggatttgtgaaacttaatgctgcaagaatgcaagcaccccagcttaacattcgcattttctatgtgctgctgagctgctcttcatctcttgctatctatgtatgctgttaccac

SEQ ID NO: 895 - DNA, 3033 bp, Pennisetum glaucum
gctgccaccttctgtggcgccgcatcattggcgacctcaccgccggcgacgtgacgcaacaagccggggcttcctcgggccaccacattcttgtaccgacgagaggtgtggggagcgtgcctcctctctccaccaccatctcggtgctggactgctggagtgaaccggagatccgcccgggttccgatccgttctcctcctgctggtcaacatcatgatggtcccaacggggaggaagaggccgccagctgcaacgaccttcatcctgctatgcatcctgtcatccttttgcgtctgcaaagggcagttcaagcctgcagacagctatcttgttgactgcgggtcctctaagagcactacggttggccagaggaccttcgcctctgatggtgcatctccggtgaaggtgaccacctcccaggacatcctggctggcacgtccgcgaatggggtggcctcctttgataactcagcgctctaccagactgcccgcatcttcaccagcccatcatcctacactttccctatccagaagcaggggcggcatttcgtccggttctacttcttccccttcacataccagagctatgatctttcacttgccaaattcactgtatcgacccaagatgtgctcctgctaagtgacttccagcagccagacaagaccgcaccgttgttcaaggagtactctttgaacatcaaccgagacacactcgtaatttccttcaagccatccaatggaattgcattcatcaatgcaattgaggtagtctctgtcccagatgatctcattgccgatgctgcccaaatggtcaaccctatgcagcagtacactggtttgtctgcacagccactggagacggtgtatcgggtcaacatgggtggtcccaaggtcacccccgacaatgatactctctctcggtcctgggtgaacgatcaaaaatacttgttgaacccaactgtgaccgacacagttcgatatgggaagcctgtcaactataagaagggtggtgcaactcagctgacggcccctgatattgtctatagtacagccacagaattggcggcatcaaatacatccaatgcacttttcaacatgacatggcagtttgatgtggatgctggctttagctatttgataaggtttcacttctgtgatattgtcagtaaggcacttaacgagctctacttcactgcatatgttggagccttctctgctcaaagtaacattgatctctcagtaatgtctgagaatcacttggctacagctgcctatatagatgtggttctgtcatccaatgatgcctccagtaaacttggcatcagcattggcccatcaaccttgaacaatgtattgcctaaggggattctcaacgggcttgaggttatgaagataagtacaggaggttctgctttcactgttgggtccggcagtggaaacaaaaatttgggtgtgattcttggtgcagctcttggaggtgttggactgttgataatcattgttgttctggtacttctttgccggaagaaaaagacactagaaaagcagcactcaaagacttggatgcctttctctatcaatgggctcacctctctcagcacaggaagcagaacatcttatggtactactctcacgtcagggttgaatggaagctatgggtaccgatttgccttcagtgtgctccaagaagcaacaaacaatttcgatgagaactgggtaattggagttggaggctttgggaaggtttacaagggagtgctgagggatgagaccaaggttgcagtgaagcgtggaaacccgaaatctcagcaaggtctcaatgagttccgtacagagattgagctcctctcacggctgcgccaccgccatttggtgtcactgattgggtactgtgatgaaaggaatgagatgatcttggtttatgaatatatggagaaaggcactctgaagtgccatctttatggctcggataatccctcgctcaattggaagcagagactggaggtttgcattggagcagccaggggactgcactaccttcacactggttctgcaaaggccattatccaccgtgatgtcaagtctgcaaacattttgcttgatgagaacctccttgcaaaggttgctgactttgggttatcaaagacagggcctgagttggaccaaactcatgtcagcactgcagtgaagggcagctttgggtatcttgatcctgaatatttccggaggcaacagctgactgagaagtcagatgtctactcctttggtgttgttttgcttgaggtcctttgtgcaaggccagtgattgaccctacacttccgagggagatggtgaacttggctgagtggggaatgaagtggcagaagagaggagagctgcatcaaatcgttgatcagagaatctcaggcacaatcaggccagactctttgaggaagtttggcgaaacggtggagaagtgcctggcggactacggtgtggagcggccttcgatgggagatgtcctctggaacctggagtatgttctgcagcttcaggatgcagattccacggtctcggatgtgaacagcatgaaccgtattgtggaactaccgtcccaggttcagaacgttggcgcccttgagagcatcagtgtgacaatggccgaagctggagcttcaaatgagcctgatcatgacctctccgacgtgtcgatgagccgggtcttctctcagctaatcaaagctgagggaaggtaaatgtgcatcggcatgagacagcctgtagggtactgatgaagccttcaaagttatttcttgttgaagtttacttgagagatgtgtaattgtttttttctttttgtgctcgataattgtactgaatcgcagtcatgatcttttttttttacagttttagccactggtgagtctgcgtggctacatgactacatctttagtagatagcatgtctcagtttgttcctggtgaagtgctggatgagtgaaaagtgctgcagttatgcgagcaccccatttaacatattttgtatgtgctgc

SEQ ID NO: 896 - DNA, 2427 bp, Secale cereale
ggggcggcattttgttcgtctctacttctaccccttcatctaccagagttatgatctctccaccgccaagttcacggtgtcgacccaagatgtgctcctgctcagtgatttccagcagccggacaagacggcgccgctgttcaaggaatactctttgaacatcacccgtgaccagcttgtcatttccttcaagccgtcaaacgggattgcattcatcaacgcaattgaagtggtttctgttccagatgatctcatagccgatgtagccaatatggtcaaccctgtgcagcagtacagtggtttgactacacagtccctggagacggtgtatcgtgtcaacatgggtggtccgaaggtcttcccgagcaatgataccctctcgaggacttggcagaaggatcagaagtacatactgaaccccagtgtgaccaaaactgctgtatatggcaagcctatcaactataggaaaggcggggcaactccactgacggccccagacattgtgtacagtacagctacagaattggcggcttcaaacacatccaacgcgcttttcaacatgacatggcagtttgatgtggatgcaggcttcagctatctgataagatttcacttctgtgatatagtcagcaaggcactgaaccagctctacttcaatgcatatgtgggaggcttctttgcacagcatgatcttgatctctcagagcaatcggtgaatcagttggccacagctatctatgttgacgtggttctttcttccaatgatgcatctagcaagctcagcatcagtattggtccatccaccttgaacaatgcattgcctgatgggattctgaatggccttgagattatgaagatgggcagtggctctggttctgctttcactattggagataacggttcaaacaaaaagttgcccataattattggctcagtccttggggttgttgggcttctgataattgtccttgttgtggtactgctttgccggaggaagaagaccgacgacaagcagcactcgaagacctggatgcctttctctatcaacgggctcacgtctctcagtacaggaagcagaacttcctatggtactacactaacatcaggtctgaatggaagctatggataccgctttgccttcaatgtgctccaagaagcaacaaacaattttgatgagagctgggtgattggagtcggaggttttgggaaagtctacaagggtgccttgagggatgacacaaaggttgcagtgaagcgaggaaaccccaagtcccagcaaggtctcaatgagttccggacagagatcgagctcctttcacgtctgcgtcaccgccacctggtgtctctgattgggtactgcgatgaaaggaatgagatgatcttggtctacgagtacatggagaacgggaccgtcaagagccacctatatggttcagacaacccctcactcaactggaagcagcgcctggagatctgcattggagcagcaaggggcctacactatcttcatactggttctgcaaaggccattatccaccgtgatgtcaagtctgcaaacatcttgcttgacgagaatctccttgcgaaagtcgcagactttgggctgtcaaagaccgggcctgagctggatcagactcacgtcagcactgcagtgaagggtagctttgggtaccttgaccctgaatacttccgaaggcagcagctgaccgagaagtcggacgtctactccttcggcgttgtcatgctggaggtgctctgcgcgaggccggtgatcgacccttcgctcccgagggaaatggtgaacttagcagagtggggaatgaagtggcagaagagaggagagctgcaccagatcgtcgaccagaagctttctggcgctatcaggccggactctctgaggaagttcggtgagacggtggagaagtgcctggcggattacggcgtggagcggccgtcaatgggggacgtcctctggaacttggagtatgtcctgcagctccaggacgcggattcttcgaccgtgtcggacgtgaacagcatgaaccggatcgtcgacctgtcgtcgcaggttcagcatgtgggtgccatggagagcatcagcgtgacgatggcggaggacggagctttgcacgagcctgatcatgacctctccgacgtgtcgatgagcagggttttctcacagctgatcaaagccgaggggaggtgaaaacgcgccggatgatctgtagggtactggtagatgtgtgagcaagacttggattttttcttttcttgttgaagtttacctgagatgtgtcacgtgtaattggttgtttcaccccttgtaattgtgcactgaactacggtttggatttctgatggccttaccttttttttttgataaacacctcctttattaattggctacaatagtagcatctgatacaa

SEQ ID NO: 897 - DNA, 3372 bp, Zea mays
cattctctgagttctctctcctctccccaccttctctctcctctccccacgaaccgcgccaccttttctgacgccgcatcatcggcgacttcatcgccgtcgacaagacgcatcaaggcagtgcctgctactcccgcctccgcattcttgccccacggagcgtgctcctgctctcggccgccgtcctggtgctgaacagctgacacagccggagagatccgcccggcctcggatccgtttcttctcctgctggtgccttggtgatgctgatgcggactcgggactcctacggagagctgaggtgaccttgttgagtgtgcccttacccagcgccgcctgcctccgagccgagatctcctccgcgcaccccggcattctctctctctgtctctggtgccgacgaccgcgcggccgaccccgccctacgccaggtgctcaggtctccatcttcgggaccttcgccggcgacgagcacccgcccaggtcaacatcatgatggctactttggggaggaagaagcggcaagccgcaacaaccttcatcgtgctttgcatcttgtcatccttctacatctgcaaagcgcagttcacgcctgcggacagctaccttgttgactgtgggtcctccaagagcacaatggttggccagaggaccttcacagcggatggcgcatctccggtgaaggtgtccacctcccaggatatacttgcgggcacctcagcaaacggggtggcctcttttgataactcggcgctgtaccagactgcccggatcttcaccgggccatcatcctacactttccctatccagaagcagggccggcatttcgtccggttttacttcttccccttcacctaccagagctatgatctttcacttgccaaatttactgtgtccacccaagatgttctcctgcttagtgacttccagcaaccagacaagaccgcacccttgttcaaggaatactcactgaatatcacccgcgacacgctcgtgatttccttcaagccgtcaaatggaattgcatttgtcaacgcaattgaggtggtctctgtcccagatgatctcatcaccgatgatgcacaaatggtcaaccctgtccagcagtacagtggtttgtctacacagccactggagacagtatatcgggttaacatgggtggtccgaaggtcactcctgacaatgataccctctcgaggacctgggtgactgatctaaagtacttgttgaacccatctgtgaccaaacaggttaattatggcaagcgtgtcaactataagaagggtggaggtggagctactcagctgtcagcccctgatattgtctatggcacagctacagagttggcagcgacaaatacatccaatgctcttttcaacatgacatggcagtttgatgtggatgctggcttcagctatttggtaaggtttcacttctgtgatattgtcagcaaggcacttaaccagctctacttcaatgcatatgttggaggcttttatgcacagaataatcttgatctgtcagcaatgtctgatagtcagttagctacacctatatatatagatgtggttctttcatctaatgatgcatccagcaaacttagcatcagcattggcccatcggtcttgaacaatgtattgcccgacgggattctgaatgggcttgaggttatgaagataagtaccggaggttctgctttcactgtcgggtctggcagtggaaacaaaaaatggggtgtgattcttggcgcagccctcggaggtgttggactgtttataattgttgttgttcttgtacttctttgccggaggaaaaagaccctggaaaagcagcattcaaagacctggatgcctttctctatcaatgggctcacctctctcagcacaggaagcagaacgtcttatggtactactctcacatcagggctgaatggaagctatggataccgttttgccttcagtgtgctccaagaagcaacaaacaatttcgacgagaactgggtcattggagttggaggctttggaaaggtctacaagggggtgatgagggatgagagcaaggttgcagtgaagcgtggaaacccaaagtctcagcaaggtctcaacgagttccgtacagagattgagctcctctcacgtctgcgccaccgccatttggtgtctctgattgggtactgtgatgaaaggaacgaaatgatcctggtctacgagtacatggagaaaggcactctcaagagccatctctatggctccgataacccctcgctcaattggaagcagaggctggaggtttgcatcggagcagcaagggggttgcactaccttcacactggatctgcgaaggccatcatccatcgtgatgtcaagtccgcaaacatcttgctcgacgagaacctcctcgccaaggtcgctgactttgggctatccaagactgggcctgagctcgaccaaactcatgtcagcactgcagtgaagggcagcttcgggtacctcgatcctgaatatttccggaggcagcagctgaccgagaagtcggatgtctactctttcggtgttgttttgcttgaggttctttgtgcaaggccagtgatcgaccccacgctgccgagggagatggtgaacctggccgagtgggggatgaagtggcagaagagaggagagctgcaccagatcatcgatcagaggatctcgggcacaatcaggccggactctctgaggaagtttggcgagaccgtggagaagtgcctggcagactacggcgtggagcggccgtcgatgggagacgtcctctggaacctggagtacgttctgcagcttcaggacgccgattcgacggtctcggatgtgaacagcatgaaccgtatcgtggaactcccgtcacaggtccagaacgtcggggccctcgagagcatcagcgtgacgatggcagaagccggagcgtcaaacgagcctgaccacgacctctccgatgtgtccatgagccgcgtcttctctcagctgatcaaggccgaggggaggtaaatgtgcgtgacgcagcctgtagggtgtgggtggtggggaggaagccttcaaagtcatctcttgctgaagtttacgtgagagagatcatgtgtgattttttttcttcttttcgtctacaaatgtactactgaagtgaactatggtttcgagttacagttttagccattgtgagcctgtgcggctacaaatttcgtagatagcacatttcgagtttgaatttgttactgggcgttgaataatattcccctaaccgtagaagcctctcactatcctcgaaacaggaggagcacacactcacaatcgtagttgctactgttgtatccacagggaacaactactatgcaaacagcc

SEQ ID NO: 898 - DNA, 3666 bp, Sorghum bicolor
tctccctccctctccatcatctctttcctctctcccacaaaccgcgccaccttttctggcgccgcatcatcggcgacttcagcgccggcgccaaccgccaagacaccacaagacagtgctttctacccccacctccgcattcttgagcgtgctcctgctttcggccgccgtcttggtgctggacaaccgacacggccggagagatccgcgcggactcggatccgtttttcttctcctgctggtggtgatcgatgctgaagcggacgctaatagagagctgaggtggctcatccctgcgccgcctgcatccgagccgagatctcctccgcgcaccccggcattgattctcccgtgccgctagcccgcgctcagactgtctctggtgcagacggactgcgccgtcctacgccaggtgcgcaggtctccatcttcgggaccttcgccggcgacgagcacccgcacaggtcaacatcatgatggctactttggggaggaagaagtggcaagctgtaacaaccttcatcgtgctatgcatcttgtcatccatttgcatctgcaaagcgcaattcaagcctgcggacagctaccttgttgattgtgggtcctccaagagcacaatggttggccagaggacctttgcagcggatggtgcatctccggtgaaggtgtccacctcccaggatatactcgcgggcacctcagcaaatggggtggcctctttcgataactcggcgctgtaccagactgcccgtatcttcaccgggccgtcgtcctacactttccctatccagaagcagggccggcatttcgttcggttctacttcttccccttcacctaccagagctatgatctttcacttgccaaatttactgtgtccacccaagatgttctcctgcttagtgacttccagcaaccagacaagaccgcacccttgttcaaggagtactccctgaatatcacccgcgacacgctcgtgatttccttcaagccatccaatggaattgcatttgtcaacgcaattgaggtgatctctgtcccagatgatctcattgctgataatgcacaaatggtcaaccctgtccagcagtacactggtttgtcgacacagccactggagacagtgtatcgggttaacatgggtggtccgaaggtcactcctgacaatgataccctctcgaggacctgggtgactgatggaaagtacttgttgaacccagctgtgacaaaaaatgttttgtatggcaaggatgtcaactataagaagggtctagcaactcagctgacagcccctgatattgtctatggtacagctacagagttggcagcatcatcaaatacatccaatgctgttttcaacatgacatggcagtttgatgtggatgctggcttcagctatttggttaggtttcacttctgtgatattgtcagtaaggcacttaaccagctctacttcaatgcatatgttggaggcttctctgcgcagactaatcttgatctctcaacaatgtctgaaagtcagttggctacacctgtctatatagatgtggttctttcatcaaatgatgcatccagcaaacttggcatcagcattggcccatcgaccttggacaatgtattgactgacgggattctgaatgggcttgaggttatgaagataagtactggaggttctgctttcactgttgggtctggcagtggaaacaaaaattggggtgtgattcttggtgctgcccttggaggtgttggtctgtttataattgttgttgttcttgtgcttctttgccggaggaaaaagactctggaaaagcagcattcaaagacctggatgcctttctcaatcaatgggctcacctctctcagcacaggaagcagaacatcttatggtactactctcacatcagggctgaatggaagttacggataccgctttgccttcagtgtgctccaagaagcaacaaacaattttgatgagaactgggtcattggagttggaggctttggaaaggtctacaagggagtgatgagggatgagaccaaggttgcagtgaagcgtggaaacccaaagtctcagcaaggtctcaatgagttccgtacagagattgagctcctctcacgtctgcggcaccgccatttggtgtctctgattgggtactgtgacgaaaggaacgaaatgatcttggtctatgagtatatggagaaaggcactctcaagagccatctctatggctctgataatccctcactcaattggaagcagaggctggaggtttgcattggagcagcaagggggttgcactatcttcacactggatctgcaaaggccattatccatcgtgatgtcaagtctgcaaacatcttgcttgatgagaacctcctcgcgaaggttgctgactttgggctatcaaagactgggcctgagctcgaccaaactcatgtcagcactgcggtgaagggcagctttgggtatcttgaccccgaatatttccggaggcagcagctgactgagaaatcagatgtctactcctttggtgtcgttttgcttgaggttctttgtgcaaggccagtgattgaccctacacttcccagggagatggtgaacctggccgagtggggaatgaagtggcagaagagaggagagttgcatcagatcattgaccagagaatctcaggcacgatcaggccagattctctgaggaagtttggcgaaacagtggagaagtgcctggcagactatggtgtggagcggccatcaatgggagacgtcctgtggaacctggagtacgttctgcagcttcaggatgctgattccacagtctcggatgtgaacagcatgaaccgtattgtggaactcccatcacaggttcagaacgtcggcgcccttgagagcatcagtgtgacaatggcagaagctggagcgtcaaacgagcctgatcatgacctctctgatgtgtcgatgagccgggtcttctctcagctgatcaaagccgagggaaggtaaaggtgcatgacacagcctgtaggggtactgaggaaggccaaagtcatctcttgctgaagtttacttgagagatcatgtgtaatttttcttcttcttttcctctacaaatgtactgaactaaggtttgggagttacagttgtagccattgtgagcctgtgcggctacaaattagtagatagcctatttcaaatttcaatctattactgcttactggtgagtgttgaacgtgtgaaacgttgtactgcagtagccatatatgtccgtgtattgatagtctgggtggccttcggcctcgctggttgctttgactgcttggggatcatacatctgaagcagtctataacgcagtatgtttttccccaatcaactagacactatcagcaacgatagctctcctgcctcaaaggacgccattttcggttgcagcatttccataattccattaattccccaaccgatcttctccaatggttacaggtaactgttggtgcatcttttttatcacaaacattggcggtggaagactcaacaatattgaagtttgaaacttgggatactgctgggcaagagagatctaaccaggccaaacacccaagcaagtctcccgcatctacacgttgcgttgcgtgccgagacgaaggcatgtgattgactagggatggaaat

SEQ ID NO: 899 - DNA, 689 bp, Secale cereale
aagaaagcaatccagggcaggagttaggggctgcgatggcgtcggcggcgagcaggaaggcgccgtcgctggtggtggcggcgagcgtgggcgccgtggaggcgctcaaggaccaggcgggcctgtgccgctggggctacccgctccgctcgctctaccgccacgccgccgccgcgcccggggtccgcgccctgtccgcctcgctctccgaggccaccgccgctccccggccggcgcctttgtccgcggaggacgcgaagctgcgcaaggcacaccacctcgtctgctgggggcccaactgaactccttttctccgcttcgtgtccccatcggcacatgagcatacagaagtagctgatgaatgcctgtgtcaatggtgattgtttcgccagagaaagcagaggcgtcattgtgtgcagcgccggtgaaccgctccggcctcggaggaggaggaagggccgtggccggacggttcatcaacgctgcactcaatggcacctttgcgtctcttcatcttgcgtctcgttgcatctaggtagcttccatagacgcaagcaggaatcatggctagtttttgagaccgcgagatccccattatttgtactactaaggtagtagtacgaggcgagagcttggcgatgacgccggttgtactgcagtggagaagtgaccaaacgctgttgtactac

SEQ ID NO: 900 - DNA, 1068 bp, Triticum aestivum
gagcagtaaaccacgggcggcgcagacgcagagagaaagaaagcaatcgagggcaggagctaggggctgcgatggcgtcggcggcgagcaggaaggcgccgtcgctggtggtggcggcgaccgtgggcgccgtggaggcgctcaaggaccaggcgggcctgtgccgctggggctacccgctccgctcgctctaccgccgcgccgccgccgcgcccagggtccgcgccctgtccgcctcgctctccgatgccgccgccgctccccggccggcgcctttgtccgcggaggacgcgaagctgcgcaaggcgcaccacctcgtctgctgggggcccaactgagctcctcttctccgcttcatgtctccatcggcacatgagcatacctgatgaatgcctgtgtcaatggtgattgtttcgccagagaaagcagagacgtcattgcgtgcagcgccggtgaaccgctccggcctcggtggaggaggacggttcatcaacgctatggcgcctttgcgtctcttcctcctcttcgtcttgcccactagtagtatctcgttgcatctggctagcctagcttccgtagacgcaagcttttgaggccgggagatcacccgtcttgtttttgtactagtagtatgatgaggtgtgcgaggcgattacgatggttgtactgcggtggagaggtgaccagcgttgttgtactacagatcgtactatgcttgtgttgtgtcgactacttaccttgccctccctcctttacttttgtcacctggatctcaaatacggtcagagatccatgagctccgtcgagctggcgatggcgtttggggttggacagtagtacatcgcttgctaaactcaactgccagtagtaccgaaatcaaatggacatagctagtagcagtacatagtagtagtacgaactgtactactgctaatgaactttaaatcgttgccatgctgtagtaccaagtcagatggcaatgtttcctcgcgaaaatgcaagatggcaatgtttcagaacttcaaattttacatgatttacaatacgagcaacgcaaagccaagacat

SEQ ID NO: 901 - DNA, 369 bp, Lolium multiflorum
tggctgcgatggcgtcggcggcgagcaggaaggcgccgtcgctggtggtggcggcgagcgtgggcgccgtggaggcgctcaaggaccaggcgggcctctgccgctggggctacccgctccgctcgctctaccgcagcgccgccgccgcgcccaccgtccgcgcgatctccgcctcgctccgtgaggcccggccggcgtcgtcggcggcggaggacacgaagctgcgcaagacccaccacctcgtctgctgggggcccaactgatcagtcccttcttctccgcagcatcgtatagtatagtacaccactgcgtccgtacctggtgaaaatgctcggagcatggatttgcgaattgggatgaaaaaaaaaa

SEQ ID NO: 902 - DNA, 1102 bp, Triticum aestivum
ccgccgccgccgccctcctcctccgtcagcctcgccccggagcagcgcgtcgttggcggcggaggccgtgtaaacccataaagttctgttttaagcgcacatcgaactttatggacatatctcaggagcaacaacaagattttggtgtgctactaaagcagggggctgaaggaagggtatttgtttctacatttgttggacgaaaatgcgtaatcaaagagcgcttttcaaagaagtatcgacacccattgctggactcaaagctgactctaaaacgcttaaatgctgaagctagatgcatgacaaaagcaaggcggcttggtgttcctacaccagttctgtatgctgtggaccctcttccacatacattaacctttgagtatgtggatggcttgtgcgtcaaagatattcttcttggatttgggtcaaatgggataaatgaagaacgtcttaatgacattgccacacagatagggaatgcagttggcaaactacacgatggaggtcttgttcatggtgatttgacaacttcaaatatgatgatcaagaacagcaccaatcaactggttcttattgattttggtctgagctttacatcaactattcctgaggacaaggcagtggacctatatgttcttgagagagccttgatttccatgcattcttcatgtggggatgtgatggagaagatccttgcagcgtaccgaaaagcttcaaggcagtggtgtgccactacgaacaagctagctcaagtcaggcagcggggcagaaaacgaacaatggttgggtaaaacttgacccggagttgctgaatgcaacgaattgaacctgcattaccatccattgtgtgtgttattagtttgcacgtagtggttcagcggaattggctcttgcagaattgaaatggatgtcaagtgaatcatttgtaacactgcttgttgtacttccgttaggaatcatatatctcccaactctttaacttgtgagttttggatgatcgttgtgtatcttagtgaaccgatacgtttactttgttgcggtgcatctggtgaaatgtgaattgatgtaatttattgaaactacaactatgtgtgttctccgc

SEQ ID NO: 903 - DNA, 1085 bp, Secale cereale
ccgccgccgtcgccctcctcttccgtcagcctcgccgcggagcagcgcgtcgttggcggcggaggccgtgtaaacccataaagttctgttttaagcgcacatcgaactttatggacatatctcaggagcaacaacaagattttggtgtgctactaaagcagggggctgaaggaagggtatttctttctacttttgtgggacgaaaatgcgtaatcaaagagcgcttttcaaagaagtaccggcacccattgctggactcaaagctgactctaaaacgcttaaatgctgaagctagatgcatgaccaaagcaagacggcttggtgttcctacaccagttctgtatgctgttgaccctcttccacatacattaacctttgagtatgtggatggcttgtgcgtcaaagacatacttcttggatttgggtcaaatggaataaatgaagaacgtcttaatgacattgccacgcagatagggaatgcagttggcaaactacacgatggaggtcttgttcatggtgatttgacaacttcaaatatgatgatcaagaatagcaccaatcaactggttcttattgattttggtctgagctttacatcaactattcccgaggacaaggcagtggacctatatgttcttgagagagctttgatttctatgcattcttcatgtggggatgtgatggagaagatcctcgcagcgtaccgaaaagcttcaaggcagtggtgcgccactacgaacaagctagctcaagtcaggcagcggggcagaaagcggtcaatggttgggtaaaacttgacccgcagttgctgaatgctacgaattgaacttgcatcaccatccattgtgtgtgttggtttgcacgtaccggtgcagcgaattggctcttgtagaactgaaatggacgtcaaatgaatcatctgtagcagtgcttgttgtacttgttaggaatcttttatctgcacaatatgccccaactctttttaacctgtgagttttggatgattgttgtgtatcgcattgaacataaacatatacgtttacattgttgcagtgcatccgatgaaatgtgaattgatggatggg

SEQ ID NO: 904 - DNA, 1104 bp, Secale cereale
cctaggttctcctggttggccagtagtgcttctgttccctaaagaaagcagcgcttctgttccgaaatccgccgccgccgccgccctcctcttccgtcagcctcgccgcggagcagcgcgtcgttggcggcggaggccgtgtaaacccataaagttctgttttaagcgcacatcgaactttatggacatatctcaggagcaacaacaagattttggtgtgctactaaagcagggggctgaaggaagggtatttctttctacttttgtgggacgaaaatgcgtaatcaaagagcgcttttcaaagaagtaccggcacccattgctggactcaaagctgactctaaaacgcttaaatgctgaagctagatgcatgaccaaagcaagacggcttggtgttcctacaccagttctgtatgctgtggaccctcttccacatacattaacctttgagtatgtggatggcttgtgcgtcaaagacatatttcttggatttgggtcaaatggaataaatgaagaacgtcttaatgacattgccacgcagatagggaatgcagttggcaaactacatgatggaggtcttgttcatggtgatttgacaacttcaaatatgatgatcaagaatagcaccaatcaactggttcttattgattttggtctgagctttacatcaactattcccgaggacaaggcagtggacctatatgttcttgagagagctttgatttctatgcattcttcatgtggggatgtgatggagaagatcctcgcagcgtaccgaaaagcttcaaggcagtggtgcgccactacgaacaagctagctcaagtcaggcagcggggcagaaagcggtcaatggttgggtaaaacttgacccgcagttgctgaatgctacgaattgaacttgcatcaccatccattgtgtgtgttggtttgcacgtaccggtgcagcgaattggctcttgtagaactgaaatggacgtcagatgaatcatctgtagcagtgcttgttgtgcttgttaggaatcttttatctccacaatatgccccaactctttttaacttgtgagtttaggatgattgttgtgtattgcgttgaacataaacat

SEQ ID NO: 905 - DNA, 1005 bp, Secale cereale
ccgtgtaaacccataaagttctgttttaagcgcacatcgaactttatggacatatctcaggagcaacaacaagattttggtgtgctactaaagcagggggctgaaggaagggtatttcttctactttgtgggacgaaaatgcgtaatcaaagagcgcttttcaaagaagtaccggcacccattgctggactcaaagctgactctaaaacgcttaaatgctgaagctagatgcatgaccaaagcaagacggcttggtgttcctacaccagttctgtatgctgtggaccctcttccacatacattaacctttgagtatgtggatggcttgtgcgtcaaagacatacttcttggatttgggtcaaatggaataaatgaagaacgtcttaatgacattgccacgcagatagggaatgcagttggcaaactacacgatggaggtcttgttcatggtgatttgacaacttcaaatatgatgatcaagaatagcaccaatcaactggttcttattgattttggtttgagctttacatcaactattcccgaggacaaggcagtggacctatatgttcttgagagagctttgatttctatgcattcttcatgtggggatgtgatggagaagatcctcgcagcgtaccgaaaagcttcaaggcagtggtgcgccactacgaacaagctagctcaagtcaggcagcgtggcagaaagcggtcaatggttgggtaaaacttgacccgcagttgctgaatgctacgaattgaacttgcatcaccatccattgtgtgtgttggtttgcacgtaccggttcagcgaattggctcttgtagaactgaaatggacgtcagatgaatcatctgtagcagtgcttgttaggaatcttgtatctgcacaatatgccccaactctttttaacctgtgagtttaggatgattgttgtgtattgcgttgaacataaacatgtacgtttacgttgttgctgtgcatccgatgaaatgtgaattgatgga

SEQ ID NO: 906 - DNA, 2671 bp, Brachypodium distachyon
ggcccggcactctgccccgtctcgctgcctgttgccccagttccctcgccgcgcgtcttcctcctcaacctctcgcacgagcgccgccactcgtccctccgcatcccgctacctagcgccccactgccccagcccccattagctcgtcttcctcctcgcgcgggcgcctccacagcagcgttacagttctgttttaattgcacattgaactttatggaatcatctcaggagcaacaagattttggtgtgctactgaagcagggagctgaaggaagggtatttgtttcaacatttgtgggacgaaaatgtgtaaccaaagaacgcttttcaaagaagtaccggcacccattgttggactcaaaattgactcttaagcgcttaaatgctgaagctcgatgcatgacaaaagcaagacggctaggtgttcctacaccagttctgtatgctgtggatcctcttctacatacattaacctttgagtatgtggatggtttgtgcgtgaaagatgtacttcttggatttgggtcgaatgggattaatgaggagcgcctcaatgatattgccacacagatagggaatgcaattggcaaactgcatgatggtggtcttgttcatggcgatttgacgacttcaaatatgatgatcaagaatggcaccaatcaactggttctgattgattttggtctgagctttacatcaactattcccgaggacaaagcagtggacctatatgttcttgagagagctttgatttccatgcattcttcatgtggtgacgtgatggagaagattctctcagcttaccgaaaggcttcaaagcaatggtgctccactacgaacaagctagctcaagttcggcagcggggcagaaaacgagcaatgattggataaaacttgacctggagctgttgaatccaatgaaggttatctcagatgaaccacgctgcaattgtgttagtttacttgtagcgtttgtctggaattggctcttgtaaaatttaaatttaaatggacgtcaagtgaatcggctgtaacagtttttgtttgtacttccgttaggaattctccaatctgtctcaactcctcttctgattaagaattggggggtgattcgttgtgcatcaaagagaacatattcgtttcctttacggcggtgtaacatgcgaatttgaaagttggtgaaaagtcagtgctcgtacgagatgttgaagaaagggcgtgttctcagaaatttgaagttcaaaatcaaaactctgtcccgtctgtgatatataccactatatggagaaatgaattggagcagagccgagaaatttcattctgagaacgaattgaggtccaaaattccactattgatgtggcactacgatggatcatgaaagtagacaaaacttggtggccatgaaaaaaaaaacattcctcgaccttccaagttccaatatattttgatcccccgtttccaaaacccaagcaaaccccttgttctcgccgcttcccctcctgtcccgaccatggcgcccggtgccctagcccgcctcatcatcggccgccgcgcaacaggcccactcctagctcgtcccttcgccgccaaggcccgagcgtcgcggcaggcgccggagccagagcccctgtcggaggaggaggaggacgacttctctggcggcgtggaggccgccccaaccgagggcatcagtaagccgctcgccgatgtcctcagggagctcgggaagagggttcccgactccctcgtgaagacccgcctcgaggacaatggcttcgctctcaaatacatcccatggcacattgttaacaaaattcttaatgtgcatgctccagaatggtccggggaggttcgcaacattatctactcatctgatgggaaatctgtatctgttgtgtatcgtgtaactctccatggaaccgatgcagagatctacagagaggctactggaactgcttctgttcaagatacaggctttggagatcctgttcagaaggctgaaggaatggcttttcgtcgagcttgtgcccgtcttggtcttggacttcacctctatcacgaagatatgtcatagatgcttactgttgattgtttgtggtgtgaacttctgcatgtcttttggttcgcagatgcttgtccttcagtaggctaccctttggtgccggacatgatatgaatgtgccagcatataaaactaagtattttagattgccttgtaggtaactatatgtaagccactaagacagttgatgttctgaactgtatgcttattgtgaaccagcatgttcttccattttctatgtttcttgctcccgcagttttggtggaagtttgatttctgtgttttctgatttgtaatgttctttatctgtataattcattttcttgccagcaggttgcttgctgaggggaaacattctgcatgttattcattgctcctttactaatgtttttgcaagataatcaggatgggttcacagcataaaggatgaaagagtttatttatcgcacaatagtatgaacaccaattgtccaggttggctttgtattgtaagcttgagaggttaatatggtcagcatttcttgttttctttggttattgtacgtaagagcactttatgttcctgaagcatattttactttacgcaatgcccacttttagccagctaa

SEQ ID NO: 907 - DNA, 1518 bp, Oryza sativa
attttattagtacatgattgttacacatattcccgttcatctatagagcaaaggaggcaaattggagttactgggtaactcagactttctaacactgatcatgattttcatgatggtagtatatggctacaattttctcatgaaacttcattcatatttgaaacgagaaacacacaaactatgtacagttcttgtggaagttatgtttggaactacataaatttcgctcgaatttcacacttactagtaggttctaagcacaaaagccaaaaagggttaggaggattaatcaccaaaatcaaggattgtgaaggttcaatgtgcaaatttgccttcgcagttaatcaggtttaggtagggtttcctcctccccttccgcctccgccccagcgccgccgtcgtccccctcctctccggcgaagagccgccgtcgccgccatcaccggagcgagccacggtagcaaccgcaaccaccacaaccatcaccatcctcgtgagccgtcaagttttcgattgaagggcagtagggcacgttatacttatggactcaactcaggaacaacaacaggattttggtgtgctactgaagcagggggcggagggaagggtatttgtttcaacatttgtgggacggaagtgtgtaatcaaagagcggttttcaaagaagtaccgacacccattgttggactcaaagttgactcttaaacgcttaaatgctgaagctcgatgcatgacaaaagcaagaaagcttggtgttcccactccagttctttatgccgtggacccacttctgcatacattaacctttgagtatgtggatggcttatctgtgaaagatatactccttggatttgggtcaaacgggatcaatgaagaacaactcattgacatcgccacacaaataggaaatgcagttggcaaactacatgatggaggccttgttcacggtgatttgaccacttcaaatatgataatcaagaacaacacaaatcaactcgttcttattgattttggtctgagtttcatatcaactattcctgaggacaaagcagtggacttatatgtgcttgagagagcattgatttctatgcattcatcatgtggtgatgtgatggagaagattctcacggcgtacagaaaagcttcaaagcaatggtgcgctactacgaacaagctagctcaagtcaggcaacgtggcagaaagcgaacaatgattggatgaaagttaagctggaacttgctggacaatacagttgctcgaccagatgattcaacactttacattctcattccctcaatatgtactagttcagtggcattgcttcatgtaacatttgaatggaaaggaatcgttaatagtgatgattattttagctttcactatgaatcgcaaaaatattatatctgctaatttagtgtatcagatgctgcgttaaggtgaatggtttatggttgtgaatggcagtgcatgtgatttgagctcattgatccagctaaaagtaaacaacatcatatcat

SEQ ID NO: 908 - DNA, 1541 bp, Panicum virgatum
cggtaatacgaaatcaaccgttagcaagtctggtgcagccacgtgttgtccttccctctgttgctgcttttggcccatgaagcgcttcaatgctgggctgtctcgctcgttcggcggtctgctttgtttacacgtgtacgaatctcagaccggaagttacatacgttatccaccttccggattctcgggcaagaaggcttggacaacttcgaattaggggcggcagttatcagggcgaaagtcgagctccgtattctgttcttttaacggcccatgctcggcccaggacagaacccctaactaatcccttcccttctccccaattcactggacgccggccgccgcaacgccgcgtcctctaccggagaaacgccgaggcgcgtcctctacccgggccgccgcagcaaccgcaaccgcaaccgcaaccgccaccaacaccagcagagtcccccaagctttgtttcaagtgcatgttaaacttcatggatacttctcaggagcaagaacatgattttggtgtactgctgaagcagggggcagaagggagggtatttgcttcaacatttgtgggacgaaaatgtgtaatcaaagagcgcttttcaaagaagtaccggcacccattgttggatgcaaagttgactttaaagcgcttaaatgctgaagctcggtgcatgacaaaagcaagaaggcttggtgttcctaccccagttctttatgctgtggatccacttctacatactttgacctttgagtatgtggatggcttgtctgtcaaggatatacttcttgggtttggttcaaatggggttaatgtggaacgcctgaatgatattgcaacacagataggacatgcgatcgggaaattacatgatggaggccttgtgcatggtgatttgactacgtcaaacatgataatcaagagcagcaacaatcaactggttcttattgattttggtctgagcttcacatcaacaattcctgaggacaaagcggtggacctatatgtgctagagagagctttgatttccatgcattcatcctgtggggatgtgatggagaagatcctggcggcgtacaggaaggcctcgaagcagtggtgctccacccagaacaagctggctcaagttaggcaacggggcaggaagcgcactatggtcggataaaacctgcggcctggataggagtattcacactcgtgcatcaccccatttcgttgctgtgtttgtaagtggctttgcctgccatcgcatctgtacctggaatcaagtgttgggctccctcatttgtatcagaagtagcgttcgttgctctggactgtgcatggttatgatgtttttttcttataaaatgcatcagaggtctatgtgtcactttggtccatcaacttcgaaattatatttctgggttcataaatttgtaatttgtgtcacttaggtccacaagctctaaagtccatttctaggcccataaacttgtaattttgtgtcacctagactaggttcatacccctccatctagcttttatgcattggtattgcacc

SEQ ID NO: 909 - DNA, 1718 bp, Sorghum bicolor
cagattttcatttctgctttcttggccagtttgtccattttttctgtcgtcctttttgttttattgggccgtccatcagttaaaccctaaagcccattccagcgtcgaggattccattgccggtcgccaccatccacacacggcacggcgcatcgctcctcttcatctccaccggaccggcgccggcctcctcccccgcttctcttgcgcgcgccggcctcctccccgcttctctcgcgcgcgccggcactgaaagagaagggcacggagacggaggttcttccccgacgcttcgctctctgtcccggcttcttcggttcttccctggtgcctcgctccccgtcccggcctcctctcaggcgcaccgcccggatccggcatcccgccgtgttcccgttccgcgattcggaacgaggttcccggtacgtggaacgcacccacgttcccgttcccctgctgccaactccgccgcaaccgcaaccgcaaacgcaaccacaacgcctccatccccgtccccgccgcctggagcgataccgaggcgcggcctgccgcgcaagcctgacctggcgcatctaccagcagcagcagcagcctcccgaagctttgtttcaagtggttattaggcttcatggatacgtctcaggagcaagaacaagattttggcgtactgctgaagcagggggcagaagggagggtatttgcttcgacatttgtgggacgaaaatgtgtaatcaaagagcggttttcaaaaaagtaccgacatccattgttggactcgaagttgactctaaagcgcttaaatgctgaagctcggtgcatcacaaaagcaagaaagcttggtgttcctaccccagtactttatgctgtggatccgcttctgcatactttgacctttgagtatgtggatggcttgtctgtcaaggatatacttcttgggtttggttcagatggggttaatgaggaacgcctgaatgatattgccacacagataggaaatgccgtcggcaaactacatgatggaggccttgttcatggtgatttgaccacatcaaacatgataattaagaacagtaactatcaattggttcttattgattttggtctgagtttcacatcaacaattcctgaggacaaagcagtggacctatatgtgctagagagagctttgatttccatgcattcgtcctgtggtgatgtgatggagaaaatcctggcggcgtacagaaaggcttcgaagcagtggtgctccacccagaacaagctggctcaagtgaggcaacggggcaggaagcgcaccatggtcggatgaagtaaaatctgtggcatggaatggctggatgtcattattagaatttagaaagacgaagtgaacggagtattgcaccaccattgggttgcttgctgtatttttgtagtgggtgagtggctttggctgctgtaacgtttgtggatggaaatttggaattacgttgcccaccacccaccagcatttggtcaagagaagtggtagaagttctttatttatttcttgtgcaaaataataactgggagacgtgctggttggttggggtatggttagcctgttactgtttgggccctcaattgatttgatcacggcaaatgtgttgtgttgctagtgctgtgggcaagggtgggccgaatgtgacagtcattggtggtgggtatttcctttatcggacggggaagttggaaatgcg

SEQ ID NO: 910 - DNA, 1127 bp, Panicum virgatum
aatcccttcccttctccccaattcactggacgccggccgccgcaacgccgcgtcctctaccggagaaacgccgaggcgcgtcctctacccgggccgccgcagcaaccgcaaccgcaaccgcaaccgccaccaacaccagcagagtcccccaagctttgtttcaagtgcatgttaaacttcatggatacttctcaggagcaagaacatgattttggtgtactgctgaagcagggggcagaagggagggtatttgcttcaacatttgtgggacgaaaatgtgtaatcaaagagcgcttttcaaagaagtaccggcacccattgttggatgcaaagttgactttaaagcgcttaaatgctgaagctcggtgcatgacaaaagcaagaaggcttggtgttcctaccccagttctttatgctgtggatccacttctacatactttgacctttgagtatgtggatggcttgtctgtcaaggatatacttcttgggtttggttcaaatggggttaatgtggaacgcctgaatgatattgcaacacagataggacatgcgatcgggaaattacatgatggaggccttgtgcatggtgatttgactacgtcaaacatgataatcaagagcagcaacaatcaactggttcttattgattttggtctgagcttcacatcaacaattcctgaggacaaagcggtggacctatatgtgctagagagagctttgatttccatgcattcatcctgtggggatgtgatggagaagatcctggcggcgtacaggaaggcctcgaagcagtggtgctccacccagaacaagctggctcaagttaggcaacggggcaggaagcgcactatggtcggataaaacctgcggcctggataggagtattcacactcgtgcatcaccccatttcgttgctgtgtttgtaagtggctttgcctgccatcgcatctgtacctggaatcaagtgttgggctccctcatttgtatcagaagtagcgttcgttgctctggactgtgcatggttatgatgttttttttcttataaaatgcatcagaggtctatgtgtcactttggtccatcaacttcgaaattatatttctgggttcataaatttgtaatttgtgtc

SEQ ID NO: 911 - DNA, 1824 bp, Zea mays
ggttgggatgttcatgtatatgatctcctataatgccagtaaccaaatgcttcaaaaggctttccaacacagtggagagactatcaatcgaaaaatatcagaagttttcgatatagtttccacctatgatgcacgaatacttctcaaaatttacgtatgatgtcggatgccgtatcagatacggatactcctccgatacttccggatacgtatccgaggctatgaatttaaataaataaaaaaagacggatacaattggacacgtgcgtgataccctgatttcccctgcgcactgcttctccccacggcgcacgcgcaccatctcctgcgcgccgccagtccggcttctcctggctcctgcgcgccgccagccgtcagcccgtcaccgattggagatccttggaaacctgcgcgccgccagcccgtcaccgcttggagacccgctcagccgcgcttccctgcgcgccgccagccgtcgccgatccgtggccgcgtccgccgccgccagctctgaggtcgcgccgtcagccagcccgtctgccgtcgtgaggtactgagcttgttgaggttcatcgctcaaccccgtcgcaaccgcaacgtccatctccccgtcctcgctgcccggaggcctggcacacctcccagtagcagcggcctcccgaagcattgtttcaagtggttattaggcttcatggatatgtctcaagagcaagaacaggattttggcgtactgctgaagcaaggtgcagaagggagggtatttgcttcgacatttgtgggacgaaagtgtgtaatcaaagagcgtttttcaaaaaagtaccgacacccattgttggactcgaagttgactctaaagcgcttaaatgctgaagctcggtgcatgacaaaagcaagaaggcttggtgttcctaccccagtactttatgctgtggatccagttctgcatactttgacctttgagcatgtggatggcttgtctgtcaaggatatacttcttaggtttggttcagatggggtcaatgaggaacgcctgaatgatattgccacacaaataggaaatgccattggcaaactacatgatggaggccttgttcatggtgatttgaccacgtcaaacatgataattaagaacagtaacaatcaattggttcttattgattttgggctgagtttcacttcgacaattcccgaggacaaagcggtggacctatatgtgctagagagagctttgatttccatgcattcgtcctgtggggatgtgatggagaaaatcctggctgcgtacagaaaggcttcgaagcaatggtgctccacccagaacaagctggctcaagtgaggcaacggggcaggaagcgcaccatggtcggatgaatggagaagaagaaaaatatgtggcatggaatggatgtatgttattagaaagaccgtcgtctaaaacgagagtgatgtaccaccattgctgtatttttttagcggtgagtggctttggctgctgtaacgtttgtgaaatctggaaatatgttgcctggctgcaccatttggtcagaactcagaagcagagtgtcgtttcatccggaagtgggagaagttttattcgtttctcatgcatgataactggaagacatggttggggtatggcttgcttgtttgtgccctccattgacatgatcatcatggcaaatgtgttgccagtgttgtgggtgagggtggacccctaccgcacggtggagtgggtggagtggcgataggtcaaagaaacgacaggctgcttctgagatgagtatcttgcatccctagggtttattttaagttgtattgcctct

SEQ ID NO: 912 - DNA, 1704 bp, Panicum virgatum
tagttatcaggccgaaagtcgatctccgcattctgttgttttaacggcccatgcgcggcccaatccagaacccctaactaatccccttcccccaattcactcgacgcgcaacccccgccggccgccgcaccgccgcgtcctctaccggagaaacgccgccgccgcaaccgcaaccgccaccaacaccaacagagtccgccccaagctttgtttcaagtgcatgttagacttcatggatacttctcaggagcaagagaaggattttggtgtactgctgaagcagggggccgaagggagggtatttgcttcaacatttgtgggacgaaaatgtgtaatcaaagagcgcttttcgaagaagtaccggcacccattgttggatgcaaagttgaccctaaagcgcttaaatgctgaagctcggtgcatgacaaaagcaagaaggcttggtgttcctaccccagttctttatgctgtggatccacttctgcatactttgacctttgagtatgtggatggcttgtctgtcaaggatatacttcttgggtttggttcaaatggggttaatgtggaactcctgaatgatattgccacacagataggacatgcaattgggaaattacatgatggaggccttgttcatggtgatttgactacgtcaaacatgataatcaagagcagcaacaatcaactggttcttattgattttggtctgagcttcacatcaacaattccagaggacaaagcggtggacctatatgtgctagagagagctttgatttccatgcattcgtcctgtggggatgtgatcgagaagatcctggtggcgtacaggaaggcctcgaagcagtggtgctccacccagaacaagctggctcaagtgaggcaacggggcaggaagcgcacaatggtgggataaaacctgcggcccggaaattctaaactaagggggcattcaaaaaactcctgcatcaccccatttcgttgctgtgtttttaagcgatcgagtggctttgcctgccatggcatctgtactgtacctggaatcaagtgttgcgctccctcatttgtatcagaagtacgtagcgttgctctggactgtgcattgagagacagacatggttatgctggactctggttgtatgtgctgttattacgtacgtaggcgagcttgtgtgggctttatctgactgcggtcggtagggtgtgaagatgtgacttttagatgcacctccaaccatttttagttcaaaattttgtattactttctcaaaatgggggttggaggtgcagtcatcaagttgcacccctagcggtcggcctcgtaggcgtggcatgctgaaacacgaaggaggaggtgtctcgtctgcactgggcggatgtttggaatggtccgaacgtgctcaacgtgtgttggtgtcttgaaggcaagcagcagcgctcctaaaggaaggaaaggaaggatagatagtagatataggcaggctttccattagtagcaagcatgatgcgatgattgcgtgctcgtcggccgtgggccctggcttgacgaccacgacgacatgctcgatgcctccacggccggtcaatgatggtgtggtctatggagccacctggcctagccggtagccgtcgctgctgcaagtgcaagcaaggcaggaacaaacggctagtaccagtgagtggtccagcatgtgatgtgggcggcgt

SEQ ID NO: 913 - DNA, 2406 bp, Setaria italica
atggcgatgaggagattgacggcggcggccctcactagacgcgcccttcctccgtgccgccgcgctctctgctccggcgcgccgctgggcccggagctggacgcggcggtgcgcgacgtcgtgtgctccgggtccgggagcctcgacgaggtggggagcaggctggaccggctgggcgtggccgtatcgccggccctggtcgggcgcgtgatcgactcgtgcggggagagcggcggcgtcggctcgggcaggaggctcctgcgtttcctggcgtggtgccggtccaaggaccccggggcgttgggggagggagcgctcgatagggcgattggggtgctcgcacgggctggggacctaaccgcgatgcgaattgccattgctgatgtggagaaggatggccgaaggatggctccggagacctttaccaccgtggtcgaggcccttgtcgatgcggggaatgaggatgaggcggtccggctgttcagaggcctggagaggcagaaattgcttcctgagcgcggtgacagtgtcagaggagatggcgtatggtcgagcagccttgccacggttcaggcattgtgtaagaggggccacgcccgcgaggcgcagggtgtggtgtggcaccacaagagcgaactatcggtagagcctatggttagcattgttgaacgtagccttctccatggttggtgcgttcatgggaacgctaaggaggctcggagagtccttgatgagatgaaatctgcaggcgttccgttgggcttgccatcgttcaatgattttctccattgtgtgtgccatagaaacctcaagttcaatccctctgcccttgttccggaggctatggatatattagcagagatgaggtcctatggtgttgccccagctgcttctagcttcaacatattactttcatgtttaggccgagcaagaagagtgaaagaagcttatagaatcttgtacctgatgatagaaggaaaggcagggtgctcacctgactgggttagctactatcttgtgggtagggtcctctatttgactgggagaatcattagagggaaaaggcttgtacatgccatgcttgaaaatggggtgcttccaactgctaagtttttccatggccttataggtgtcctttgtggaactgagcaagttgaccatgctcttgatatgttcagactcatggaaagttgtgagttagtggacactcatatatacgacctccttatagaaaagctttgtaggaatggtagatttgagcttggaagagagctctgggatgatgctacaaagagtggccttgtgttaggatgctcagaggatctgttggatcccttgaagacagaggatcaagaacatgattttggtgtattgctgaagcagggggcagaagggagggtatttgtttcaacatttgtgggacggaaatgtgtaatcaaagagcgcttttcgaagaagtaccggcacccattgttggatgcaaagttgactctaaagcgcttaaatgctgaagctcggtgcatgacaaaagcaagacggcttggtgttcctaccccagttctttatgctgtggatccgcttctgcatactttgacctttgagtatgtggatggcttgtctgtcaaggatatacttcttgggtttggttcaaatggggttaatgaggaacgtctgaatgatattgccacacagatagggaatgcaatcgggaaactacatgatggaggcctggttcatggtgatttgaccacgtcaaacatgataatcaagaacagcaacaatcaattggttcttattgattttggtctgagcttcacatcaacaatccccgaggacaaagcggtggacctatatgtgctagagagagctttgatttcgatgcattcatcctgtggggatgtgatggagaagatcctggcggcgtacagaaagtcttcgaagcagtggtgctccacccagaacaagctggctcaagtgaggcaacggggcaggaagcgcacgatggtcggataaaacctgctgcctggatatatttgaaagaaaggcgatctaaattatgaaccagaagtattcacggctcccgcatgaaccgattccgttgctgtgtttttaagcgaccgatagcggctttgcctgctgtatcatttgtactgcttggaacccaattgcgtcagcgccagaagtagcgttgctctgaactgggcatggttacgtgtattctgctagtctgtgtgtcgtgatctcaccgggctcgtgggcctgataggcttgatgtgggcatgtggtagagggctctcgctgactgtattgggctgtatgtttgaaatggccggagtggcaaagaatgaactctccttcgccgccacggtcattttcacttgcacttgtgtgtgccgtggactcgtg

SEQ ID NO: 914 - DNA, 1025 bp, Saccharum officinarum
ccgccgccgccgcaaccgcaaccgcagcacctccatccccgtccccgccgcccggagcgatcgatataccgaggcgcgacctgccgcagcaagcctgacctggcgcgtctcccagcagcagcagcagcagcctcccggagctttgtttgaagtggttattaggcttcatggatacgtctcaggagcaagaacaagattttggcgtactgctgaagcagggggcagaagggagggtatttgcttcgacatttgtgggacgaaaatgtgtaatcaaagagcggttttcaaaaaagtaccgacacccattgttggactcgaagttgactctaaagcgcttaaatgctgaagctcggtgcatgacaaaagcaagaaggcttggcgttcctaccccagtactttatgctgtagatccacttcttcatactttgacctttgagtatgtggatggcttgtctgtcaaggatatacttcttgggtttggttcagatggggttaatgaggaacacctgaatgatattgccacacagataggaaatgccatcggcaaactacatgatggaggcctcgttcatggtgatttgaccacgtcaaacatgataattaagaacagtaacaatcaattggttcttattgattttggtctgagtgtcacatcaacaattcccgaggacaaagcggtggacctatatgtgctaaagagagctttgatttccatgcattcgtactgtggggatgtgatggagaaaaacctggcggcctacaaaaaggcttcgaaacagtggtgctcgacccagaacaagctggctcaagtgaggcaacggggcaggaagcgcgccatggtcggatgaatgaagaagagaaatctgtggcatggaatggttggatgttattagaaagactatctagacaccgagtattgtagcaccatctggttgcttgctgtatttttggagcggcgggtggctttggctgctgtaccgtttgtggctggagatttggaattacgttgcccaccatcgcatccc

SEQ ID NO: 915 - DNA, 911 bp, Avena sativa
gctctctgtccacctcgccccggagcaacgcgtcgctgacggtggaggccgtgtaaatccgtgaagttccattttgagtgcacattgaactttatggacacatctcaggagcaacaagattttggtgtgctattgaagcagggggctgaaggaagggtatttgtttcgacatttgtggggcaaaaatgcgtaatcaaagaacgcttttcaaagaagtaccggcacccattgttggactcgaggttgactctaaaacgcttgaatgctgaagctcgatgcatgacaaaagcaagacggcttggtgttcctacaccagttctgtatgctgtggaccctattccacatacattaacctttgagtatgtggatggcttgtgcgtgaaagatatacttcttggatttgggtcagacggtattaatgaggaacgtctcaatgacattgccacacagatagggaatgcagttggcaaactacatgatggaggccttgttcatggcgatttaacaacttcaaatatgatgatcaagaacaacaccaatcaactggttcttattgattttggtctgagctttacatcagctattcctgaggacaaagcagtggacctatatgttctggagagagctttgatttccatgcattcttcatgtggggatgtgatggggaagatcctctcagcataccgtaaagcttcaaggcatggtgcgccactacgaacaagctagcgcaagttaggcagcgaggcaggaaacgaaccatgatcgggtaaaacttgaccctggagttgttcaatcctacggtggttgtagcggttcagtgcaattgactctttgtaaaattgaaatggactagtgaatcatctgtaacaatgattgttgttctccattctgataagtactatatattgcgc

SEQ ID NO: 916 - DNA, 1475 bp, Amborella trichopoda
aacaagttcacccgcggagagagcttggagctgtttcgttagcagaccagctagttaaaggccatacaaatggatattgattcaaaagaggaagatggttttcgggtgcttctgaagcagggagcagaagctagagtatttgagtcaaccttcatgggaaggaggtccatcattaaggaaagattctccaagaagtacaggcacccaacccttgattcgaaactgacactgaaacgtttgaatgcggaggcccgttgcatgactaaagcaagaagacttggtgtggccacacctgctctatatgctgtggatcctttgctacacacactcacgtttgagtacattgaaggaccatctgtgaaagatgttcttttagactttggattgactggtgtggtagaggaacgtataaatgatattgctggacagataggaaatgcgataggaaagctacatgatggaggcctggttcatggggacttgacaacttcaaatatgctgcttcaaagtagcacgaataatctggttcttattgacttcggtctcagtttcacttctaccctttctgaggataaagccgtggatttgtacgtacttgagagagctctgatctccatgcattcttcatgcggcaatgtgatggatcggatactggttgcatataggaagtcctcaaagcaatggtgtgcgaccctcaacaagcttgctcaagtgcgacaaagaggccggaagcgcacaatggttggctaaaaaccttgagatatcagggtaatatctacgacaaaaatattgcaccctgatccccttaagcttcaagaggaagtgtattgcattgctggagaaaaagaagttagcttctgattcaaactgatttatgctataacgcttgtatctaatctttcagactgcatgtcttcatatggtgaccatctaaagtgaaactgggagacaaatgggcgacattctcattcatgtaatctattgtaggggattaaacgatgctgcatagatgattttagtaatttttggcatcagagagcgagagagatttcagaatggcttatgctgaggtacatctgcagattttatggaagaaatattaagaaggaaattttacaatagcgctttcaccctctgaagctgttggatcttggggatggctggggtgtgattcctcggcacaaagtctgtctaaatttttgacatacttcgagaggagggataatgaaccccagcaatcaaagtctgcatctgatggctcagaagggttcgttgaaatgctcccaaaataaaagaaacttatacaatgaacaccatttaaagtatgcaataagaccaactccttttggtgaggaggctgctatcagccttgttcattagatgtaaaatcaggcacttgggagtgttgtatttatttggttcctgagctttgtaacgccccttatatctgacaatccatctgagagctaaagata

SEQ ID NO: 917 - DNA, 909 bp, Ananas comosus
taacaaagaattcggtgtactattgaagcagggggcagaagctagggtatttgaatcaatatttgtggggcaaaagtgcatcatcaaagagcgattctcaaagaagtataggcatccgatgctggactcaaagttaactactaaacgattaaatgcggaagctcgctgcatgacaaaagcaagacgacttggtgttcctactccagttttatatgccgtagacccactgttgcatactctgaccttcgaatatgttaatggcccctctgtgaaagaaatactcttagattttggattgaatggtttagttcacgaacgcttggatgacattgccacacaaatggggaatgcaattgggaagctacatgatggaggtctcattcatggtgatctgacgacatcaaatatgattgtcaagagtgggaccaatcagctggtgcttattgattttggtctgagcttcaattcaactctccctgaggataaggcagtggatctgtatgttctagagagagctttgctatctatgcattcatcatgtgggaatgttatggataaaatactctctgcatatagaaaggcttcgatgcaatggtcatccacaatgaacaagcttgctcaagtgagacagcgaggtcgaaagcgtaccatggtaggatgaacgctcttcgtcagaacaaatcgatggatgctaaaacaacccgtgcagacaggttcggacattcagccaacatttgcgcgtgacggcgtttatatgttaggactaccagtgtttcctccggtaaaatgagcagctttgtcagtgacatgttacatctgtttggaatcaattatgcaacaggcatttcttgtaatcgagatgaatcttagttatgacgaaatttttcacaagattcttgttctgcttct

SEQ ID NO: 918 - DNA, 2914 bp, Brachypodium distachyon
cgggccgtctccccttttatcttttttcgcagcagcatccagcccggcccatctcgccgcctcgctcgtcttcctccttgcgcacgcccgacaactccagtaaacgcaagcgccgccgccgccgccggttggtctccccttcgattctctcgctcccgaccgcttctcctctccaccaccccacgaaccgagtcctccctgtagctccctccccgtttcatctcctcaatctcccgaattcgtagctgaggcaaaaatcaaggtagggcggccgccctaccttaccctactgctgggtcctccgccccacgaccatggctttcgctgcttacggtgtcaggggacctctcaagcttgccgtgggtcatggtccatttgcgctggctaacaatcacctctgccgcggttggaggcctccgtcatcttacgccgtttctcgggcgtcgagcgctaatatctccagtaatgcagtgcggcacatggtccgccattcccacttggttgccccgagttcagaaagacggcggtcgaacacgaaagcttcagcggtggatggtagcatcgttgctgaagagaggataactgtattggtgattggtggtggaggaagggagcatgcgctttgttatgctttgaaccgctcgccttcgtgtgaatcagttttatgtgcccctggtaatgttggtattgctcaatccggagacgcgacctgtgtgtcggacctagacatctcctgtagtgatgatgttatatcgttctgccacaagaggagagttggaatggtggtagtgggccctgaagctcctcttgttgcgggtcttgcaaatgatcttgtcaaagctgggataccaacctttggtccttcatcagaggctgcagcattagaaggatcaaaagactttatgaagaagctatgtgataagtataatatcccaaccgctaagtatcgcactttcatggatcctgtggaagctaaacaatatgtcaatgaccaaggagcccctattgttgttaaagctgacggattggctgctggaaagggcgtagttgttgctatgactttggatgaggcatttgaagcaatagactgtatgctggttcaagggtcatttggttctgccggttcacaggtcatcattgaagagtttctagagggtgaagaagcctctttctttgcactggtagatggtgaaaatgctttgcaacttgaatcagcacaggatcataaaagggttggtgatggtgatgttggccctaacacaggtggtatgggtgcatactcccctgcaccaatagtgacagaacagcttaagcgcatggtcatggaaagtataattattccgaccgttaaaggtatggcagctgaaggatgcaagtttgttggtgtattatatgctgggcttatgatagagaagaaatctgggctacctaagcttattgaatacaatgtgcgatttggggatcctgaatgccaggttctgatgatgcgattagaatccgatctcgcacaggttctgctatctgcatgcaaaggagaattaggccaggtttcgctaacctggtcgcctgaaattgcaatggtggttgtgatggcaagtgaaggataccccggctcttacaagaaggggacgataataaaaaacatcagcaatgctgagcaggtttctccagctgttaagatatttcatgctggaacagctttggatggagatggcaaccttgtcgctgttggaggtcgagttctcggtgtcactgcaaagggcaaggacattgaagaagcacgggaaagagcatacgctgcagcagatgttattgactggccagaaggattcttcaggcatgatattggttggagggcactgaaacacaagcagattgctaactgatgatgaggtttttctgaagcaccaaaactacggcgtgcttgtggtgtcaagtgaaataaagagatattagtgtaacagcgcttccgaagcataactgctggagcagtagcatgttcagatttgagcatattttgagcatggcgtggttattaaccttcttgtagtggtcttgtatttttctgaaggcaaagtatctaactcttgaggtgcaatcatgcaatcagctattgggatgaacatgaccatatgaactctgggaagcgttccttatcctcaatcatgtttacgaatttcctgttgagttatttaatcgactgggttaaggacacatctgattccattcagtgacattatacacaaacagaggttcacgccaatgaccacatagctgtacaaggaccaacttcacagtgaccactgagctgtataaggggtgaaaagatacagcgaatagttgatacaaaaatccagtagacgactctgtttgagaacaaccgaggatgcccatctctattgctattggagcattccttggcaacagttctctcagaggtgaacatagcattctctcttgccattgctattttaagaggttggtgctccgaccatttgtcccaatctgcgtgttcaatttacaattgaaacatgtaaaacattcaggtatgctattatcaaaataaaaatagaaaatagagctgcacactggaatgctcacaatagcaaacttttatagtgaccacatatatacatagctgtagaaggggtgaaaaggatgaggcaaatagtgaaagaatccactagatgagctctattggagaacagccgaggctgccgtgcccatctccattgctccggagattccttggcaacagtactctcacaggcgaactgaatgttgtccttttattattattaccattttatgtacctttgctatttcagaccaaaattagtcctccaacaacttgctccgatctgtgtgttgaatttacaattgaaatatgtaaaacattcaagtatgcatcttt

SEQ ID NO: 919 - DNA, 1937 bp, Brachypodium distachyon
gaaggaccatggatttcgctgcttacagtatcaggggccctctcaagcttgcagtcggtcatgatccatatgcgctgtctaataatcacctctgctgcggctggaggcctccggcatcttgcgctgtttctcgggtgtcgagtagtaatatccccagtaatgttgtacgacatgttgtccgtgattctcctcacttgattgctctgaattcagaaagactgcgctcaagcttgaaagcttcagtgttggatggtagcatcgttgcagaagataagataactgtactcgtcattggtggtggaggaagggagcatgcgctttgttatgctttgaaccgtttgccttcttgtgtatctgttttatgtgcccctggtaatgttggtattgctcaatccggagatgcgacctgtgtatcggacttggacatctccagtagtgacgctgttatatcgttctgccacaagagggcagtgggaatggtggtagtgggccctgatgctcctcttgttgcgtgtcttgcaaatgaccttgtcaaagctgggataccaacctttggtccttcatcagagactgcagcactagaaggatcaaaagacttcatgaagaagctgtgtgataagtataatatcccaactgctaagtatcgcacattcatggatcctgtggaagctaaacaatatgtcaaggatcaaggggcccctattgttatcaaagctgatggactggctgctggaaagggcgtcgtcgttgctatgagtttggatgaggcattcgaagcaatagactgtatgctggttgaagggtcatttggttctgctggttcacaggtcatcatcgaagagtatctagagggtgaagaagcctctttctttgcattggtagatggtgaaaatgctttgccacttgaatcagcacaggatcataaaagagttggtgatggtgatgttggtccaaacacgggtggtatgggtgcagactcgcctgcaccaatagtgacagaagagcttaagcgcatggtcatggaaagtataatcatcccaactgttaaaggtatggcagctgaaggacgcaggtttgttggtgtattatatgctgggcttatgatagagaagaaatctgggctgcctaagcttattgaatacaatgtgcgatttggggatcctgaatgccaggttctgatgatgcgattagaatcctatctcgcacaggttctgctatctgcatgcaaaggagaattaggcaaggtttcgataacctggtcgcctgaaattgcaatggtggttgtgatggcaagtgaaggataccccggctcttacaagaaggggactgtaataaaaaatatggacaatgctgagcaggtttctccagctgttaagatattccatgctggaacagctttggatggagacggcaaccttgtggctgttggaggccgagttctcggtgtcactgcaaagagcaaggacatcgaagaagcaagggcaagagcatacgatgcagcagatgctattgactggccagaaggattcttcaggcgtgatatcggttggagggctctgaaacacgagcagatggctaactgctgatgaggtattcctgaagcaccgaaattacggcaagcttttagtgccaagtgaaataaagagataaaagtctaaccgcagttccgaagcataactgttacaacagtagcatgttcaaatttgagcatactttgagcatgccatggctgttaaccttcttgtagctgtcttatgtttttctgaaggcaaagtatctaactcttgaggttgaggtgcaatcgcgcaatcaactattcagatgaacattaccatatgaactctgaaccgttccttatcctcaaatcaactattctgatgaacattatcatgtgcccattgctatttcgagtcaaggttggtgctccaataatttgt

SEQ ID NO: 920 - DNA, 2294 bp, Sorghum bicolor
cgcctcctaggtgatgggccgtcctgggcctttccgcgccctttgttgggctggattactgggtctcagaatcgctgaggcagtgaagccgccttgaacttacgctaccaccgccgcgccgccgccttccacctgcccgaccacccgccgccggctctcctgcctcaccaaacaccgaccccatcgccgtcacggggtcacctgagctccctctcgttccgccttagtcaggacgttggcctgtttcttctgttcttgaggcttactcaactaggttcttctacagcggatcgacattggttgctactacagtacaggagttgttgcttcagccgttcagcgcaatcaagctgccggggcagcttgttttccagaattattggcgggattgagctgagctcccgcgcccccgcgctgatccctctcctgccatggcgtgcgttgcttacagtatcagataccctctcatgctcgctgcaaggcaccgcgctgatgttctggccaaaaatagcttgtgcattggcttgaagtcttcggtgtcttactccgtagctcagcagtggagcagcaattgctcttccgttatgatgcggcatgccacatcccatcgtcacttgattgttagggcttcagcaaggtggcgctctaactcgaaagcttcagcaaccgaagtgggcgctgcttctgatgagaggataactgtattggtcattggtggtggaggccgggagcatgctctttgttatgccttgaaccgttccccatcttgcagtgcagtgctatgtgcccctggtaatgccggtattgctcagtctggggatgcaacttgtatcgcagatttggacatctccagtagtgctgatgttatctcgttctgtcgtgagaggggagtgggaatggttgtagtgggtcctgaagccccacttgttgcgggtcttgtgaatgaccttgtcaaagttgggataccaacctttggcccttcatcagaggctgcagcgttagaaggatcaaaggatttcatgaagaagctatgtgacaagtacaatatcccaacagccaagtatcgcacattcatggatgctgtggaagctaaacaatatgtcaaacatgaaggagcccctattgttgttaaagctgatggactggccgctggaaagggtgtggttgttgcgatgactttggatgaggcattcgaagccatcgactctatgttggttgaaggctcatttggttctgctggttcacgggttatcattgaagaatttctagagggtgaagaagcatctttctttgcattagtagatggtgaaaatgctttgcctcttgaatcagcacaggatcacaaaagagttggtgatggtgatgttggcccaaatactggcggtatgggtgcatactcccctgcaccaatagtgacagatgagctcaagcgcatagtcatggaaagcataattgtccctaccgttaaaggcatggcggctgaagggtgcaagtttgttggtgtattatatgctggacttatgatcgagaagaaatctgggttgcctaagcttattgagtacaatgtaagatttggtgacccagaatgccaggttttgatgatgcgattagaatctgatttggcgcaagttctgttatccgcttgccggggaggattaagcaatgtttcactaacctggtcacctgaaatggcaatggtggttgtaatggcaagccagggataccctggctcttataagaaggggactgtaataaaaaacctagacaaggctgagcaggtctctccatttgtcaagatattccatgctgggacagcactagacgaagatggcaatcttgtcgccgttggaggccgagttcttggtgtcactgccaagggcaaggacatcgaagaagcaagggcaagagcatatgatgcggtagatgctgttgattggccagaagggttcttcaggcgtgacattggttggcgagcactgaggcacaagcaagtggctaactgcctatgactatggggttttcacagagaaccacaactaaggtgatcttgtagtgttataaggaataaaaaagggaaacgtgtaaccttcactgtttttggttgtggaaagacaatgtattgctggtcaaacagcagcatgttcaaattttaacacctgctggtttcagtatatgtagatgttttgtgttcacagagtgaaaacgtgctgaattctgaccaattgtgtcttcaattttcagacaagtggatcttctcccaaataattgtgacatctcctacatgtttatgctta

SEQ ID NO: 921 - DNA, 1658 bp, Triticum aestivum
aaaaagttacaacatcttgtaggagtatatgtgaattgagggaatacttgtattacaagctccacctatggacgctgtatttattgcgtgacggcaaagccttgtcccctagtgccggccgccggaccccggcgatggcctgcaccagcacggccggccgagatgacgacgacaaacacacaactccacctggtgcagcgcacacgtcgcgtactccactgaaccgggtctatatcatcacctcgcacctggcaagtcccatctcaccacggttcactgccataatggcttccgaggactctgccgcgcccgtcgtcgtggacgactgccggggcgtgctgttggtgtacagcgacggggccgtggtgcgcagggatgggccgggcttcgccacgccggtgcgggacgacggcaccgtggagtggaaggacgccgagttcgacgcgccccgcgggctgggactccggctctacaggccgcgccagcggaaccagctcctaccggtcttcttctactaccacggcggcggcttctgcatcggctcgcgcacctggcccaactgccagaactactgcctccgcctcgccgccgagctcggcgccgtcgtggtcgccccggactaccgcctcgcccccgagaaccgcctccccgcggccatcgacgacggcgccgccgccctcctctggcttgcttcgcaggccggccccgccggcgacacatggctgaccgaggccgccgactttactcgggtgtttatctccggtgactccgcgggaggcaccatcgcccaccacctggccgtgcgtttcggctccgcggccgggcgctctgagctgggcaacgtccgcgtcaggggctacgtccaactcatgcccttcttcggcggcacagaacggacgaggtccgaggcggagtgccccgacgacgcgttcctcaaccgcccgctcaacgaccgctactggcgcctctcgctgcctcccggcgccacggtcgaccacccggcctccaacccgttcgggcctgacagcccggcgctggaggcggtggagctggccccgacgctggtggtggtcggaggccgcgacatcctccgtgacagggccgtggactacgccgcgaggctgcgggcgatggggaagccggtgggggtgagggagttcgaagggcagcagcacggcttcttcaccatcgacccatggtccgacgcgtccgcggagctcatgcgcgcgctcaagcgcttcatccacaccgacgggcgcttcgactagatccgttccatcgcctccgactcgccagtctctgtctttctgctgctttaccaagtctacagatggcattgcaataccaaaactcatgaaattacaccgaggcaaaagatatcgttttccaaagatatgctcccacacggaacaaatagatcgtcttgtttcagattttctcaaagacccatggaatgtactcatgtttgctttcaaagctagatcgaaagattacacgagatttattggaacattgaacatataaacctctctaggcaacccggccatagagggcacctgcgcgcgctatagttttttgaccgtccgatggttttactcctgaacgaattagctgctcgcagtcactcctccgttggtcttctcgtacattaatatcat

SEQ ID NO: 922 - DNA, 1166 bp, Secale cereale
tgccttgatcagtccaccccatcgcaccacggttcactgccataatggcttccaaggactctgccgcgcccgtcgtcgtggacgactgccggggcgtgctgttggtgtacagcgacggggccgtggtgcgcagggatgtgccgggcttcgccacgccggtgcgggacgacggcaccgtggagtggaaggacgccgagttcgacgcaccccgcgggctgggactccggctctacaggccgcgccagcggaaccagctcctgccggtattcttctactaccacggcggcggcttctgcatcggctcgcgcacctggcccaactgccagaactactgcctccgcctcgccaccgagctcggcgctgtcgtggtcgccccggactaccgcctcgccccagagaaccgcctcccagcggccatcgacgacggcgccgccgccctgctctggcttgcctcgcaggctggccccgctggcgacacatggctgaccgaggccgccgacttcactcgggtgtttatctccggcgactccgcggggggcaccatcgcccaccacctggccgtgcgtttcggctccgcggccgggcgctctgagctgggcaacgtccgtgtcaagggctacgtccaactcatgcccttcttcggcggcacggaacggacaaggtccgaggcggagtgtcccgacgacgcgttcctcaaccgcccgctcaacgaccgctactggcgcctctcgctgcctcccggcgccacagtcgaccacccggcctccaacccgttcggaccggacagcccggcgctggagccggtggagctggccccgacgctggtggtggtcggaggccgcgacatcctccgtgacagggccctggactacgccgcgaggctgcgggcgatggggaagccggtgggggtgagggagttcgaggggcagcagcacggcttcttcaccatcgacccatggtccgccgcgtccgcggagctcatgcacgcgctcaagcgcttcatcgacaccgacgggcgcttcgactagatccgttccatcgcctcaaacgctttgtatctaagactccaccgtcagaccactcaaacgtcgtcgatctactccaaatctgacgctcgacagtagtcctggttttgcaattaaggaaattaagaaaatcaccgatct

SEQ ID NO: 923 - DNA, 1771 bp, Brachypodium distachyon
ttcccgccgatgggaatcggacggccgagagcacgcagcacaaggcacatcttgcacgccacgaactgctccacctccaccgagcacccagccggccgagtctatatcatcgtcagttcgcagcaccacctggcgagcaggcgcttcgatcgctcccgtctcacactccgctatcgattgaaggtggctgttaggccaatctgaccggggggagccatggcatccgaggactccgtggcggcgccggcgccggcgcccgtggtggtggacgagtgccggggcgtgctgttcgtgtacagcgacgggtccgtggtgcggcgggccgggccgggcttcgcgacgcccgttcgggacgacggcagcgtggagtggaaggacgcggtgttcgacgcggcccacgggctgggcctccgcctgtacaagccccgcgaccggaagaaccatgatctgctgccggtgttcttctacttccacggcggcggcttctgcatcgggtcgcgcacctggcccaactgccagaactactgcctccgcctcgccgccgagctcgacgccgtcgtggtcgccccggactaccgcctcgcccccgagcaccgcctccccgccgccctcgacgacgccgccgccgccctcctctggctcgcctcccacgcagcccccggtggcggcgacccgtggctcacggaagccgccgatttcgggaggatcttcgtgtccggcgattccgcggggggaacaatcgcgcaccacctggccgtgcgcttcgggtgccccacggcccggacctcgctcggccccggcgtccgcgttaaaggatacgtccagctgatgcccttcttcggcgggacggagcggacgagatcggaggcggagtgccccgacgacgccttcctcaaccgcccactcaacgaccgctactggcgcctctcgctgcccgacggcgcgacggcggaccacccggcgtccaacccgttcgcgccgggggagagccgcgaggcgctggaggcggcggagatggcgccgacgctggtcgtggtcggcgggcgcgacatcctccgcgacagggccgtggactacgccgccaggctcagggccatggggaagcccgtggaggtcagggagttcgagggccagcagcatgggttcttcaccattgatccctggtccgacgcctccgcggagctcatgcgagcgctcaagcgcttcgtcgacacggacggccgcttcgactgattaagtgattaagcgtcgtgtcgtcgtcttccttcttcttggctgtgtgcactgtgcatcgatggatgtgttctccgtttacgtttcccgtgcttggttggcggatttgcgtaccgtgcttggctgttactagtgtgttctgaaggccggaatcagttcggtcgtgtggtgtttttttttctgtgtggtggtcaagaagaaattaaaattgggcccgacgagtgcgtggggcttatttggacgggctggacaggatcagttatggcccatgggctagttccatgatcgtccttggtatttgcttcatggaacccaaaccgtacgagacaccagacaatacaatgatgacaactcaaacagtacagaattgtcgcgtttgaagatctcgtccagaaaaatactacacatattgtcaaatcgacctctagatccagacaacacatgcaaagcagaaagttttgctgatttcgtgattcatgatccatatctctctcggataagctcgtgacgtttcacttcctccttccatctctctcct

SEQ ID NO: 924 - DNA, 976 bp, Triticum aestivum
gcgagcatacaaagtgtgccctcgaggaataggttctaggtagatagatctaagcggcccagagcccgacaccagctgccatggcaggaggaagtggaggagctgggggaggaacagggggaggggactcgttggctcgcagggcctggaggcagtacctgctccagctgcagcgccacccactccgcaccaagatggtcactgcggggtgcctcgcaggcgtcagcgactccgtggcgcagaagctctctggatatcagaagattgagaagcgccgcctcctgctcaagatgatatttgggtttgcatatggtggcccatttgggcatttcctgcataaagtgttggattatatctttaaagggaagaaggataccaaaactgtagctaagaaggtgttgctggagcagatcacttcctctccctggaacaatttactcttcttattctattatggatatgttgttgagaagaggcctttcaaggaggtgaagactagggtgaagaaacaatatctgtcagtgcaattgtctgcttggatgttttggccagtagttggttggataaaccatcagtacgtgcctttgcagtttcgggtgattgtccacagctttgttgcatgttgctgggggatatttctcaaccttcgcgccagagccatgtctttgaagcagtcatagacagatttagtgggggtataacactgctccatcatggttcaaactggccggagaacaaggatgctgattgctatgtaatataccgttgattgtcctagggtatttaaatagtgggatttcgatacttgtttggcatcaagttgcagatttgttcgtcagcgcatgcgaggccgcttatctgattctctctggtagtactatttaagctttgtgactgaaacgtaattgaattatattagctatggatatattcggtctacttcggagagcaaataattgttttttcatgagtggaa

SEQ ID NO: 925 - DNA, 971 bp, Secale cereale
ggctaccaaacaggctgtaaaagaattcgcatcttggcgcgagcatacaaagtgtgcccttgaggaatacagtaggttctaggttgatagatctaagcggctcagagcccgacgccagctgccatggaaggaggaagtggaggagctgggggaggggattcgttggctcgcagggcctggaggcagtacctgctccagctgcagcgccacccactccgcaccaagatgatcaccgcggggtgcctcgcaggcgtcagcgactccgtggcgcagaagctctctggatatcacaagattgagaagcgtcgcctcctgctcaagatgatatttgggtttgcatatggtggcccatttgggcatttcctgcataaagtgttggattatatctttaaagggaagaaggataccaaaactgtagctaagaaggtgttgctggagcagatcacttcctctccctggaacaatttactcttcttattctattatggatatgttgttgagaagaggcctttcaaggaggtgaagactagggtgaagaaacaatatccgtcagtgcagttgtctgcttggatgttttggccagtagttggttggataaaccatcagtacgtgcctttgcagtttcgggtgattgtccacagctttgttgcatgttgctgggggatatttctcaaccttcgcgccagagccatgtctttgaagcagtcatagacaaatttagtgggggtataacactgctccatcatggttcaaaatggctggagaacaagggtgctgattgctatacaatataccgtggattgtcctagggtatttatatagttagaggatttcgatacttgtttggtatcaagttaaacatttgtttgtcaacgcatgcgaggaagcttatctaatttctctgttgccaccatttaagccttgtgtatgaaacgtaactgaattatattagctatatgatgtatttggtc

SEQ ID NO: 926 - DNA, 1049 bp, Secale cereale
tacagatgcaaaatctagtacttttcatgcgtaatccaaactcccgttcccctgcccccgttggctaccaaacaggctgtaaaagaattcacatcttggcgcgagcatacaaagtgtgcccttgaggaatacagtaggttctaggttgatagatctaagcggctcagagcccgacgccagctgccatggtaggaggaagtggaggagctgggggaggggactcgttggctcgcagggcctggaggcagtacctgctccagctgcagcgccacccactccgcaccaagatggtcaccgcggggtgcctcgcaggcgtcagcgactccgtggcgcagaagctctctggatatcacaagattgagaagcgtcgcctcctgctcaagatgatatttgggtttgcatatggcggcccatttgggcattttctgcataaagtgttggattatatctttaaagggaagaaggataccaagactgtagctaagaaggtgttgctggagcagatcacttcctctccctggaacaatttactcttcttattctattatggatatgttgtcgagaagaggcctttcaaggaggtgaagactagggtgaagaaacaatatccgtcagtgcagttgtctgcttggatgttttggccagtagttggttggataaaccatcagtacgtgcctttgcagtttcgggtgattgtccacagctttgttgcatgttgctgggggatatttctcaaccttcgcgccagagccatgtctttgaagcagtcatagacaaatttagtgggggtataacactgctccatcatggttcaaaatggctggagaacaagggtgctgattgctatacaatataccgtggattgtcctagggtatttatatagttagaggatttcgatacttgtttggtatcaagttgcacatttgtttgtcgacgcatgcgaggccgcttatctgatttctctgttgccaccatttaagctttgtgtatgaaacgtaactgaattatattagctatatgaagtatttggtctacttttgggagcaaa

SEQ ID NO: 927 - DNA, 1348 bp, Brachypodium distachyon
ctgccgccagcgaccttggctaccttcatctccacccccacgtgggctatttactgccggaatcacagatagtctctcctctctcttcttcgtctccaaacatcagaaattctctctaaaaaaagacccgaaaatcagtgccaaaatcggacacaaaaatcgcatcacacagccgtgagcatagaaagcgtgctctatctgaggagtagggtccgtgctaggtagatcgaagcggctcggagccagaagccggttgccatggcaggaggagttgcaggaggtggcggcggcggaggaaggggggattcgttgcctcagagggcgtggaggcagtacctgctccagctccgactccaccctctacgcaccaagatgatcacggcggggtgcctcgccggcgtcagcgactctgtggcccagaagctctccgggtaccagaagatcgagaagcgccgcctccttctcaagatgatctttggctttgcatatggtggcccatttgggcatttccttcataaagtgttggattatatctttaaagggaagaaggatacaaaaactgtagctaagaaggtcttgctggagcagatcacttcatctccctggaacaatattctattcttattctactatggatatgttgttgagagaaggcctttcaaggaggtgaagactagggtcaggaaacagtatccttcagtgcaattgtctgcttggatgttctggccaatagttggttggataaaccaccaatatgtaccattgcagttccgggtgattgtccacagctttgttgcatgctgttgggggatatttctcaacctccgtgcgagggctatgtctttgaagcagtcctagaggaaagaaaatgtggcacagctccaacttggctcacatgatcagatggcaaggatgctaagccctatattatgtgctgcttgtagtttgttgatatatttctctagtatattgttggtttatttgttttgccttgtctaagcgaggctgcttatctaagtactctgttagttaagctctctgatgggacgaaattatgttatctatggaagaactgtgcctacattttgacagcaagtttgtgcagcaactggtcacatctcttttttcgctgactgttcatttttctttctttcatttgagatgatcagtcgattgttcttttatgaatgcaagtggtcgttgttgaaggttgtgctcaaatgctctgacttgtaagttttttattttgagactgagacttgtaaatgtgtgaacctatttattttgtcaaaagtcgaaacacatggaactgaatcctcaatccgaagaacagaaatttttgattgaa

SEQ ID NO: 928 - DNA, 1092 bp, Avena sativa
atgcttttttcgtctccaaagtccaaacattgaaaagatcagtggcgaaaaccggacctaaaaacatcgcaatcgcgccgcgagcgtgcaaagcgtgctctgagaagtagtaggtgcaaaggtagatcgaagcggctccgtgcaagacgccggctgccatggcaggaggaggcggaggagatggggattcgttgcctcgcagggcgtggaagcagtacctgctccagctccagctccaccctctccgcaccaagatgatcacggcggggtgcctcgccggcgtcagcgactccgtggcccagaagctctccgggtaccaaacgatcgagaagcgccgcctcctgctcaagatgatgttggggtttgcatatggaggcccatttgggcatttcatgcacaaactgttggattatatctttaaaggaaagaaggataccaaaactgtagctaagaaggtgttgttggagcagatcacctcctctccctggaacaatctgctcttcttgttctattacggatatgttgtcgagaagaggcccttcaaggaggtgaagactagggtgaggaaacaatatccttcagtgcagttgtctgcttggatgttttggccggtagttggctggataaaccatcagtacgtgccattgcagctccgggtgattgtccacagctttgttgcatgttgctgggggatatttctcaacctccgcgcgagggcaacgtccttgaagcagtcatagacgagttcagaagtaagactctggctcagatccagattgttccaagttgcaacaaaggatgcagagcccaacatcgtaaaatgctgacagttcgatgtgtttaagtggtttgaggatccggaatatttctctagagtttagattgttttactatctgtttcctgtcgcttgcgaggctgcttatcagggtactccgttattcattatatcttgagaagaaagaaaagagtgctctgttattgccatttaagctctgtgatggaacaaaattatacttattagccacgaatatatttggcctgtctttcagcacaagtttgtgatgaatagaagcgctggtcgttcaaggttc

SEQ ID NO: 929 - DNA, 1161 bp, Pennisetum glaucum
caagagtccaaactcccacgtgattcccgtctctcgccgaatcacaaaaacatcgcagaatccgaccctcccgaagaaaatcaagagagcgcacaaaggacgcgtgcgcagtgctcagttgtcgtcgtcggagtaggtggtgggcagatcgatcgaaggggttcaggcggcggggttggaggtcggccgtgccatggcagcagcgggaggaccagtgcggggaggagggaaaggagggaagggggaggggtcgctggcgtacagggcgtggaggcagtacctgctccagctccagcagcacccgcttcgcacaaagatgatcacggcggggtgcctcgccggtgtcagcgactccgtcgcgcagaagctctccggctaccagaagattgagaagcgccggctgttcctcaagatgctctttggttttgcatatggtggcccatttggacattttttgcacaaaattttggattatatcttcaaagggaagaaggataccaaaactatagctaagaaggtgctgctggagcaagtgacgtcttctccctggaacaatttgctgttcttgttctattacggatatgttgttgagaggaggcctttgaaggaggtgacaatcagggtgaagaagcagtacccttctgtgcaattgagcgcttggatgttttggccaattgtcggttggatcaaccaccagtacatgcctctgcaattccgtgtgatcttccacagcttcatcgcctgctgctgggggatattcctcaaccttcgcgcaagggctatgtctctgaagcaggcttagatggtgtagaaggaacagatagcagcgcagctccaacctgggtgctaaccagtcaaagaacaagcatgatgctggacgctatatatcctgtaggagtactgttttggaacaacaaaagaagtcttgaaaccaaggacttaggaggatctcgactatttatctccagtagcagcagtcggtttattctgcggaactgctagcgcccggacgtccgatccgggcgctaggatcggacaccttctcggccacacgattcgaattaggaaacatatcagccgttggatcatgacgttgcgaagcgtgtcgcgaatgttgcgaacaacttttcctatgttgcgaacaccttttcccatgttgcg

SEQ ID NO: 930 - DNA, 1226 bp, Oryza sativa
gctatgcggcccacccccgccggccgagtccctccgccgtacgtccggccggcgatgcaccaccgcgacgcgacggaatcatcacgcggatctcccctcttccccaacccaaacctgacgctgtgaatttaattaataataataaaaaaacaaagatctcgccgcgcttcccaccgagcggcggagcatacaaagcagcaggagcagttgattgggtagatcgaagcagcagggtgaggtaggcctgaaggattccgccatggcagcagcagcagtagcagcagggagaggaggggttaggggaagaggagagggggaggaggggtcgctggctcggcgggcgtggcggcagtacctgcgccagctccagctccaccctctccggaccaagatgatcacggcggggtgcctcgccggcgtcagcgactccgtggcgcagaagctctccggctaccagaggatcgagaagcgccgcctcctgctcaagatgctctttgggtttgcttatggtggcccttttggccatttcctccataaagtgttagattatatcttcaaagggaagaaggataccaaaactatagccaagaaggtgttactggagcagatcacttcttctccctggaataatctgctcttcttgttctattatggatatgttgttgagaggaggccttttaaggaggtgaagaccagggttaagaaacaatatccctcggtgcaattgtctgcttggatgttttggccaatagttggttggataaatcatatgtacatgccgttgcagttccgggtgattttccacagctttgttgcatgttgctgggggatatttcttaaccttcgtgcaagggccatgtctttgaagcagtcgtagagaatttagtaggaaaaaattgcagcacctctccaacttgattcttactgactaaagaacaaggatgctgagtgctacgcaatatgcagttagcaacaaattgttacgagtggtttgggatttcgagtatttatctggtgtttagttgggtttgtttgtcagcaaatgcgagattgttaacaaaggtattctgttgacaccggttatgacttatgatgaacccaaagtatgatttgatatctatggatgagcttggcctgcctttgaaatccaccctgtccatctgccttatcatatcttggaaatatgcaactgtttctattgtatattctgctgttccttccctgca

SEQ ID NO: 931 - DNA, 1120 bp, Setaria italica
ggttaactgcctctggcccacacgtcggccaccacgtgcatcgtccggccggcgagggaccaccgcggcagccacccgccggaatcaactcccacgcgattcccatctctcgccgactcacccacacaagagcatcgcagaatccgcccctccaaaaaaaatcaagcgagcgcacagaggcagcgtgcgcagtgctcggttgtcggaggaggagtaggtgggcagatcgatcgaaggggttcaggcggtggggttggtggtcggtcgccatggcagcagcgggaggagcaggacggggaggagggaagggggaggggtcgctggcgtacagggcgtggaggcagtacctgctccagctccagcagcaccctcttcgcacaaagatggtcacggcggggtgcctcgccggcgtcagcgactccgtggcgcagaagctctccgggtaccagaagattgagaagcgccggctgttcctcaagatgctctttggttttgcatatggtggcccatttggacatttcttgcacaaaattttggattatatcttcaaagggaagaaggataccaaaactatagctaagaaggtgttgctggagcaagtgacatcttctccctggaacaatttgttgttcttgttctattacggatatgttgttgagaggaggcctttgaaggatgtgacgatcagggtgaagaaacaatatccttctgtgcaattgagcgcttggatgttttggccaattgtcagttggatcaaccaccagtacatgcctttgcaattccgtgtgatcttccacagctttgtcgcatgctgttgggggatatttctcaaccttcgcgcaagggctatgtctctgaagcaggcttagatggtatagaaggaacacatagcagcgcagctccaacccgggtactaaccggccaaagaacgaggatgctggacgctatatcatgcactgttttggaaacaaaaagtcttgaaaccattcaagtaggaggatctcgactatttatccagtaggagcagtcggtttattaggttgtcaacatgtgcaaagacaaattgagctttcgtgaattgagatggaacagaagtatgatgaattggcctgcctttgag

SEQ ID NO: 932 - DNA, 1247 bp, Panicum virgatum
gttaactgcctctgggcccacacgtcggccaccacgtgcatcgtccggccggcgagggaccacggcgacacccacccgccggcgcacggttccggaatctctccccacacgattccttcctctcgccgggaccgagacgccgacccaactacccgagcatcgcggaatccgccgctccccggaaaaaaaaaatcaagcgagtacagtacaaagggcgcgtgcgcagtgctcggttgtggccctgtgggaggaggagtaggtgggtagatcgatcggagcggttcgggcggggtcggaggccggccgccatggcagcagcgggaggagcggggcggggaggagggaaaggaggaggagggaagggggaggggtcgctggcgtacagggcgtggaggctgtacctgctccagctccagcagcacccgcttcgcacaaagatgatcacggcggggtgcctcgccggcgtcagcgactccgtggcgcagaagctgtccgggcaccagaagattgagaagcgcaggctgttcctcaagatgctctttggttttgcacatggtggcccatttggacattttttgcacaaaattctggattatatcttccaagggaagaaggataccaaaactatagctaagaaggttttgctggagcaagtgacatcttctccctggaacaatttgttgttcttgttctattacggatatgttgttgagaggaggcctttgaaggaggtgaccatcagggtgaagaaacaatatccttctgtgcaattgagtgcttggatgttttggccgattgttggctggataaaccatcagtacatgcctttgcaattccgtgtgatcttccacagctttgttgcatgttgttgggggatatttctcaacctccgcgcaagggctatgtctctgaagcaggcttagatggtattggaggagcaaaatagcagcgcagctccaacccgagtactaactggccaaagaccaaggatgctggactctatatcctgtactgtttagaaacaaaaatcttcttcaagccattctagtagttgaggctttcgactatttatcctgcagtagtcggtttattcaattgtcaacacgtgcaaagacagattgagcttttgtgaatcgtgatggaaccgatgtatgacgaatttacctgcatttgagaacagctcattctctgtttttttttcttcttttcaacaaagttctggtcatgatattgttccagtgtctact

SEQ ID NO: 933 - DNA, 1154 bp, Sorghum bicolor
acctgtcatcaggttgttacaggaggggcctaataaaagcggcaacttcctcgggcccacacgtcagccaccacgtgcatcgtccggccggcgaggtaccaccgcggcagctatcctccggcgcccacgattcccacgcgattggatcctctcgccgacccaagcatcgtagaatcccctcaccaagaaaaatcaagcgggcatacaaagagcgcgtgcgcagtgctaggagtagtaggtgggcagattggtcgaacttcgaaggggttggaggccttcaggcttcagctatggcatcagtgggaggtgcaggacgaggagaagggaaacgagatggagggaagggagaagaggggtcgctggctcgcagggcgtggaggcagtacctgctccagctccagcaacatccgctccgcacaaagatgatcacggcggggtgcctcgccggcgtcagtgacaccgtcgcgcagaagctctccgggtaccagaagattgagaagcgcagactcctgctcaagatgctctttggttttgcatatggtggcccatttggacatttcttacacaaaattttggattatattttccaagggaagaaggataccaaaaccatagcaaagaaggtgttgctggagcaagtgacatcttctccatggaataacatattgttcttgttctattatggatatgttgttgagaggaggcctttgaaggaggtgacgaccagggtcaagaaacaatatccttctgtgcaattgagcgcttggatgttttggccgatagttggttggataaaccatcagtacatgcctttacagttccgtgtgatcttccacagcgttgtcgcatgctgttgggggatatttctgaaccttcgtgcaagggccatgtctctgaagcaggcgtagatggtttagaaggaagaaatagcagcatagctccaacccggtaccagatgaaatgattatcaaggaagctggatgctgttatcctgtagtgttctgcacccaaatcgttgctgaatccattcaagtagttgggtttttttttactattaattatctggtactggtagtagatttatttgattgtcaacgcgtgcaaagacagatgacccttacgtggattgtgaattgtgatggaagcaaagtatg

SEQ ID NO: 934 - DNA, 956 bp, Panicum virgatum
  misc_feature (142)..(142): n is a, c, g, or t
  misc_feature (849)..(849): n is a, c, g, or t
tcggagcggttcgggcggggtcggaggccggccgccatggcagcagcgggaggagcggggcggggaggagggaaaggaggaggagggaagggggaggggtcgctggcgtacagggcgtggaggctgtacctgctccagctcnagcagcacccgcttcgcacaaagatgatcacggcggggtgcctcgccggcgtcagcgactccgtggcgcagaagctgtccgggcaccagaagattgagaagcgcaggctgttcctcaagatgctctttggttttgcacatggtggcccatttggacattttttgcacaaaattctggattatatcttccaagggaagaaggataccaaaactatagctaagaaggttttgctggagcaagtgacatcttctccctggaacaatttgttgttcttgttctattacggatatgttgttgagaggaggcctttgaaggaggtgaccatcagggtgaagaaacaatatccttctgtgcaattgagtgcttggatgttttggccgattgttggctggataaaccatcagtacatgcctttgcaattccgtgtgatcttccacagctttgttgcatgttgttgggggatatttctcaacctccgcgcaagggctatgtctctgaagcaggcttagatggtattggaggagcaaaatagcagcgcagctccaacccgagtactaactggccaaagaccaaggatgctggactctatatcctgtactgtttagaaacaaaaatcttcttcaagccattctagtagttgaggctttcgactatttatcctgcagtagtcggtttattcaattgtcaacacgtgcaaagacagattnagcttttgtgaatcgtgatggaaccgatgtatgacgaatttacctgcatttgagaacagctcattctctgttttttttttcttcttttcaacaaagttctggtcatg

SEQ ID NO: 935 - DNA, 1257 bp, Zea mays
acctgtcaggttgttagtggggattaactttagaagaagggattaacttcctctggcccacacgtcagccaccacgtgcatcgtccggccggtgagggaccaccgcggcagctatcctcggcgccgcgctcacgattccggaatcactccccacgcgattcgatcctctcgccggcccaggcatcgtagaatccccccaccgaaaaaaatcaagcgggcatacaaagagcgcgtgcgcagtgcttggaataggtgggtcgaacttcgaaggggttcgaggacttcagctatggcatctgtgggacgtgcaggacgaggagggaaaggagatggagggaagggagaagggtcgctggctcgcagggcgtggaggcagtacctgctccagctccagcaacatcctctccgcacaaagatgatcacggcggggtgcctcgccggcgtcagtgactccgtggcgcagaagctctctgggttccagaagattgagaaacgcagactcctgctcaagatgctctttggttttgcatatggtggcccatttggacatttcttgcacaaaattttggattacatcttccaagggaagaaggataccaaaaccatagcaaagaaggtgttattggagcaagtgacatcttctccctggaataacatattgttcttgttctattatggatatgttgttgagaggaggcctttgaaggaggtgacgaccagggtgaagaaacaatacccttctgtgcaactcagcgcttggatgttttggccgatagttagttggataaaccaccagtacatgcctttacaattccgagtgatcttccacagctttgtcgcatgttgttgggggattttcctgaaccttcgtgcaagggccatgtctctgaagcaggcctagatggtttagaaggaacgtatagcagcatagctcctgcccggtgctaactaaagcagccgaagaaggaggatgctggaagctgtatcctgtacggttacaaaaaccgttgtttatttcctggtagtagtcggtttatttgattgtcaacgcatgcgaagacagattatgcttttgtaaaaaaaaaaattgtgatgggagcaaagtatggtgaattcggttagctttgaggaccagttcgtattcgttcattcattgttcagctaaatggtcatgggactgttccagcgtccaccgttcttgctttgctggtaatcaaacctgttgcctgaccggatgctcttggcagctccattcag

SEQ ID NO: 936 - DNA, 1046 bp, Cynodon dactylon
gccatccgccggcgcacgattcctggaatatcactgcgcacgattccctcccgtcggcgacccgagcatcgcgtaatccgcccaaaaatatcacaagagagcacgagcagcgcgtgctcagtctccggaggagtaggtggatcaaaagggggcagcttggcggagtcggacggaggacggtcgccatggcagcagcggggggagggaaagccgggggaaggaagaagggagaggagtcgctgccgcgcgtggcgtggaggaattacatgctccagctccagcagcacccgcttcgcaccaagatgatcacggcaggttgcctcgccggagtcagcgactccgtggctcagaagctctccgggtaccagaagattgacaagcgccgcctcctgctcaagatgctctttgggtttgcatatggtggtccatttggacatttctggcacaaagtgttggattatatctttagagggaagaaggataccaaaacgatagctaagaaggtgttggtggaacagctgacatcatctccctggaacaatattctgttcttgttctattatggatatgttgttgagaggaggcctttcactgaggtgaagaacagggtcaagaaacaatatccttcagtgcaattgagtgcttggatgttttggccaatagtcggttggataaactatcagtacatgccgccgcaattccgggtcatattccacagctttgttgcatgctgttgggggatatttctcaaccttcgtgcaagagccatgtctttgaagcaggcctagacaatcaggtcccaccttgttgtaactgcttaaagaacaaggagctgggtgctattcgctgtgctgttgtcaacaaatcgttgttcgaatagctatttggtagtagtaggtttatttgattgtcaaaagtgcaagacagatcaagaattacgaattgtgatgagttagaagtatgcaactatgacaattctgcctacctttgggacccacttcatgctgcaaggtccgactttgtattgggagactctggagtcttgc

SEQ ID NO: 937 - DNA, 3014 bp, Secale cereale
gcttctcccccctcaggccaagtcccgattcacggccgcaattcacgccatgagaggggaggccgagctacatagcccccgctagctcctccgccgcagctcccggcgcaagaatccgcggtcatcttccacgcccccgtccgtccaagaaagatgcggccgtcacggcgggatctcgccgtcctctgctgctgctgcttcctgctcctgctgctccctctcccgtcccatggcaaggacatgcccctgggctccaccctctcgccgggcggcaactcggccgcgtggtcgtcgcccaactccaccttctccctcgccttcgcgccgtccccgaccgcgccgtcgctctccgtcgccgcggtcacctacgccggcggcatctccgtctggtccgcgggcgccggcgcgcccgtcgactcggggggctcgctccgcctctcctccaccggcgacctgcagctggtcaacggctccggcgccgtgctctggtcgtccggcaccgccggccggggcgtctccgcggccgccctccaggagagcggcaacctcgtgctcaagaactccacggggggcgccgtgtggcagtccttcgaccaccccacggacaccgtggtcatgtcgcagaacttcgcgtccggcatgaacctcacctcgggcccctacgtcttcgccgtcgaccgggccaccggcaacctcacgctccggtgggccaccgccggctccgccaccgtcacctacttcaacaagggctacaactccaccttcaccgccaacaagacgctcagctccccgacgctcacgatgcagaccaacggcatcgtctccctcaccgacggcacgctcaacgcccccgtcgtcgtcgcctacagcagcaactacggcgagagcggcgacatgctgcgcttcgtgcgcctcgactcggacggcaacttccgcgcctacagcgccggccgcggcagcggcacggccaccgagcagtggtccgcggtggcggaccagtgcgaggtgttcggctactgcggcaacatgggcgtgtgcggctacaacggcacgtcgccggtgtgcatgtgcccgtcgctcaacttcgagctcaacgacgccaacaacccccggagcgggtgcaagcgcaagacggagctccagaactgcccgggaaactccaccatgctccagctcgacaacacgcagttcctcacctacacgccggagatcaccaccgagcagttcttcgtcggcatcaccgcgtgccgcctcaactgcctgtccggcagctcctgcgtcgcctccacggcgctctccgacggctccggcctctgcttcctcaaggtgtccaacttcgtgagcgcataccagtcggcgtcgctccccagcacgtccttcgtcaaggtctgcttccccggccagcccaacccgcccctcagcaccggcgaccagtccaactcgagatcctccggcctgcgcgggtgggtcgtggccctggtcgtcctcggcgtggtgtccgggctggtgctcgccgagtggttgctgtggtgggtgttctgccggaacagcccgaagtacgggccggcgtcggcgcagtacgcgctgctggagtacgcgtccggcgcgccggtgcagttctcgtaccgcgagctgcagaggtcaaccaaggggttcaaggagaagctgggcgccggcgggttcggcgcggtgtaccgcggcgtgctggcgaaccggacggtggtggcggtgaagcagctggaggggatcgagcagggggagaagcagttccggatggaggtggcgaccatcagcagcacgcaccacctcaacctggtccgcctcatcgggttctgctccgagggccggcaccgcctcctcgtctacgagttcatgaagaacggctcgctggactcgttcctcttcggcgccggcggcggcagcagcaacgacagcggcaaggcgatgtcgtgggcgacgcggttcgcggtggcggtgggcacggcgcgcggcatcacgtacctgcacgaggagtgccgggacaccatcgtgcactgcgacatcaagccggagaacatcctcctcgacgagcagcacaacgccaaggtgtccgacttcggcctcgccaagctcatcaaccccaaggaccaccggcaccggacgctgaccagcgtgcgcggcacgagggggtacctggcgccggagtggctggccaacctgcccatcacggtcaagtcggacgtgtacagctacgggatggtcctgctggagacggtgagcgggcaccgcaacttcgacatctcggaggagacgagccggaagaagttctcggtgtgggcgtacgaggagtacgagaaggggaacgtggtggccatcgtggaccggcgcctcgccggggaggaggtggacatggcgcaggtggagcgcgcgctgcaggtgagcttctggtgcatccaggagcagccgtcgcagcggccgagcatgggcaaggtggtgcagatgctggagggggtcatggagctggagcggccgccgccgcccaagtcgtccgacagcttcatgacggtgaccacggccaccacgggcgtgagcagcagcgtggcgtcgacgttcgcctcgtcggtggcggcgccgccggcgcccgtgccgtcgccgaacgtggagcaggagatgtccgtggggcggtcggcgtccgcccgcacccgcgagatcgcgtccgtcccgctgcgctcgtcggagccatacatgacaatgtgagaatgccaatgctgattgatcttcgaggcggcgaaaacgacggagaatgcttccgtgctgcgatcgaaggggagtcgtgcagatcatcgagcaagttagggatttggtaggctgctctagggcctgcttggttttgttcttggtggacttcagaagcatgtgtgtatgtacgtgactgatgagccaaattacccagaatttgtaagtaatagaacttagaccgaacgctagtcgtcgtgacttgtacaaataattcaaatttgaggcagagtattgtg

SEQ ID NO: 938 - DNA, 3757 bp, Brachypodium distachyon
aagtgcaagctcgaggacatttccttctcctctccttctcgagctccctccttcgtgttcttccccccttcctcctcgcttcttcttcttccccctcgtgccaagaccaaaattcacgacagcctccatttccccaatcaatcgggcaagagagaagacgagaagacgccatgggaggaggagggggcgagctacaccgccgctagcttcttcttctctgccgcatcttctatctttctttcttgctcccctccgtccgtccaagaagaaagatgcggactctatggggaggagaagatctcgccttcctccttcgctgttgctcgctgcttctcctactggcttccttctcccatggcgcggacatgccgacgggctcgtccctctcgccggggaaccaggcggccccgtggctgtctcccaactccaccttctccctggccttcgcgccgtcgccttcctcaccgtccctcttcgtcgcggccgtcacctacgcgggcggcgtccccgtctggtcggccggcgcgggcgcggccgtcgactcgggcggctcgctgcgtctctcctccaccggcgacctgcagctcgtcaacgggtccggcgccgtgctctggtcctccggcaccggcggccggggcgtggcggccgcggccctgcaggagagcggcaacctcgtgctcaagaactccacgggcggcgctctgtggcaatccttcgaacaccctacggacacggtcgtgatgtcgcagagcttcacctcgtccatgaacctcacctccggcaactacgccttcgccgtcgacaggcccagcggcaacctcacgctcaggtggtcttcttcctcctccggctccggcggggggaacgcggtgaagtacttcaacaagggctacaactccaccttcacggggaaccagacgctgacgtcgccatcgctggtgatgcagagcaacggcatcgtgtccctcaccgacacctcgctgtcctcccccgccgtggtcgcctacagcagcaactacggcgagagcggcgacatgctgcgcttcgtccgcctcgacgccgacggcaacttccgcgcctacagcgccgccaggggcagcagcagcgccacggagcagtggtcggcggtggtggaccagtgcgaggtgttcggctactgcggcaacatgggcgtctgcggctacaacgggacttcgccgttctgcagctgcccttcgcagaacttccggcccaaggacgccgccgacccccggagcggctgcgagcgcaaggtggagcttgtaaactgtcccgggaactccaccatgctggaactcgccaacacgcagttcctgacatacccgccggagatcaccacggagcagttcttcgtggggatcaccgcctgccggctcaactgcctctccggcggctcctgcgtggcgtccaccgcgctcgccgatggctccgggctctgcttcctcaaggtctcgcccttcgtcagcgcttaccagtctgcgtctctgcccagcacgtccttcgtcaaggtctgcttccccggcgtgccgaacccgccgcttgtcgctggcggcggatcgtcgggtggttcctccggcctccgtgcgtgggtcgtcgccttggtggttctcggcgcggtgtcagggctggtgctgtgcgagtgggtgctgtggtgggtcttctgccggaacagccccaagtacgggccggcgtcggcgcagtacgcgctgctggagtacgcctccggcgcgccggtgcagttctcgtacaaggagctgcagaggtcgaccaaggggttcaaggagaagctgggcgctggcgggttcggtgccgtgtaccgtggcgtgctggcgaaccggacggtggtggcggtgaagcagctggaagggattgagcaaggggagaagcagttcaggatggaggtggctaccatcagcagcacgcaccacctcaacctcgtcaggctcattggcttctgctccgagggccggcatcgcctgctcgtctacgagttcatgaagaacggctcgctcgacgccttcctcttcgctggtgccgacgcgcccaagatgccatggtccacgcggttcgctgtcgccgtcgggacagcgcgcggcatcacctacctccatgaggaatgccgcgactgcatcgtgcactgcgacatcaagcccgagaacatcctcctcgacgagcagcacaacgccaaggtgtctgatttcgggctcgccaagctcatcaaccccaaggatcaccggcaccggacactcactagtgtgcgcggcaccagggggtacctggcgccagagtggctcgccaacctcccgatcacggtcaagtccgacgtctacagctatgggatggtcttgctggagatcgtcagtggccaccgcaactttgacatctccgaggagactgacaggaagaagttctcggtctgggcatatgaggagtatgagaaggggaacattgcctgcatcgtcgacaagaggctcgccgaggaagacattgacatggctcaagcggagcgcgccctccaggtgagcttctggtgcatccaggagcaaccggtgcaacggccgaccatggggaaggtggtgcagatgctggaaggtatcatggagctcgagcggccgccaccccccaagtcatcagacagtttcttgaccgttaccacagccactggctccaccagcggtgccagcagtagtatggcatcgacattcgcctcgtcggcactggtagcgcccatgtcaacgccaaatttggagcagcagatggctgtgggacgctcagcctcggtccgggaccgtgaaatagcatctcacccgctgcgctcatcggagccatacatgacaatgtgatgcctatgctgatcttctctagagctgaacagaaaaacgaggcaaaatggttgccgagaaaaaaacgcacggatcatcgagcaatcaggtaaattgataggctgcttcgctgtctggttggtttttgttctgttggggaatggaagaagtttcctggaaagcaaagtgtttttcagtgcctgtgagattttccatacttccgaagtatgtatgtgcctgataagccaaataccaacaattcgtaagtaatagaattagatcatactcgacgctgcgctacttgtagtaatttgtacaaataattcaaactgaggattgagggcaaacttgatttccaattcagatgtagaattggtggtgcttgtcatggcactgccaattcagtgtctctgcattttgtgctcatatcatataacctcaattcagtgtctctgaattctgcttgtcatggcactgccaatttggcaccactgaatgcatttgagagaacatgtccaggagctttcagcagacttatccatcaacttttatttggttagcattaaaagatcatttatccggttgaatgcttgggacccatccctggatcaagtggcaccaaaatattgcatcatgtgtcatccttgtgatcactggcagcagttgccctggccttcatcctgcatttgcttcccaagcatgtgagtgaggcttgtgttaggtcttctttaatgctaggtttgtgtgggcacagctgttcttcgtactgcttgttacttctagttgatagaagcagccactggaaaaagttgttgagcttagctccattgaatctactaggtgatttgctgtttgggaggtggaatggtaaatccagcactcatcagtaatgtgtgtttaactcagaaaagagaaac

SEQ ID NO: 939 - DNA, 3236 bp, Setaria italica
gaggagccagtcaatgtgcgtcactgtcactatcgctctaaacgcttgcacatctccaatcctccatggctctactactagtagtcttcgtctctctcctggtatcgctcccgcctccccagttccaattccccccttcctaatctcctcttcccagtcgtgccaggaccagattcacagcctggattgctaaaatatctaaccgattgcagaggagaagagaagacgccatggcccgcgggagagggaggtggggtttgctgccttgattagcttcttctctgcctctctgtccgcaatcgccatccgagaaagccagccgccccgaatcgccggaaagatgcggcctttgcggggaaagcacggggatcttgctatcctctgctgcctcgcgctcctcctcccgctgctttcccatggcgcggacatgccgctggggtcgaccctctcaccgggcaactcggcgccgtggacttcgcccaacaacaccttctcgctctccttcacggcgtccccgacctccccgtccctcttcgtcgccgccatcacctacgccggcggggtgcccgtctggtccgcgggagccggcgcggccgttgactcgggtggctcgctccgcctctcctccaacggcgacctccagctcgtcaatggatctggggccgtgctatggtcgtccaacaccggcggccggggcgtcgccgccgcggccgtccaggagagcggcaacctggtgctcaagaactcgacggccaccctgtggcagtcgttcgaccatcccacggacacggtggtcatgtcgcagaacttcacctccgggatgaacctcacctccggcccctacgtcttctccgtcgacaagagctccggcaacctcacgctcaagtggaccagcggcgccaacaccgtcacctacttcaacaagggctacaatacgaccttcacggggaacaagacgctgagctcgccgacgctgacgatgcagaccaacggaatcgtgtcgctgaccgacggccagctgacggcacccgtcgtggtggcgtacagcagcaactacggcgagagcggcgacatgatgcggttcgtgcgcctcgacgccgacggcaacttccgcgcctacagcgcggcgcggggcagcaacgcggcggcggagcagtggtcggcggtggcggaccagtgccaggtgttcggctactgcggcaacatgggcgtgtgcagctacaacggcacgtcgccggtttgcgggtgcccgtcgctcaacttccagttcagcaacccctccaacccccgcgacggctgcaagcgcaaggtggacctccagaactgccccggcaactccaccatgctccagctcgacaacacccagttcctcacctacccgccggagatcaccaccgagcaattcttcgtggggatcaccgcctgccggctcaactgcctctccggcggctcctgcgtggcgtccacggcgctctccgacgggtcgggcctctgcttcctcaaggtctccaacttcgtgagcgcctaccagtcggccgcgctgccgagcacgtccttcgtcaaggtctgcttccccggcctgcccaacccggcccccgacgccgcgacatcttcctcccgcggcggctccggcgtccgcgcctgggtcgtcgccgtcgtggtcctcggcgccgtgtccgcgctggtgctctgcgagtgggcgctctggtggtggttctgccggcacagccccaagtacgggccggcgtcggcgcagtacgcgctgctggagtacgcgtcgggcgcgccggtgcagttctcctaccgcgagctccagcggtcgaccaaggggttcaaggagaagctcggcgccggcgggttcggcgccgtgtaccgcggcgtgctggcgaaccggacggtggtggcggtgaagcagctggaggggatcgagcagggggagaagcagttccggatggaggtggccaccatcagcagcacgcaccacctcaacctcgtccgcctcatcggcttctgctccgagggccgccaccgcctgctcgtctacgagttcatgaagaacggctcgctggacgccttcctcttcggcgccgcgccgggggggaagatgccgtggccgacgcgcttcgccgccgccgtcggcaccgcgcggggcatcacctacctccacgaggagtgccgcgactgcatcgtccactgcgacatcaagcccgagaacatcctcctcgacgagcacttcaacgccaaggtctccgacttcgggctcgccaagctcgtcaaccccaaggaccaccgccaccgcacgctcaccagcgtaagggggaccagggggtacctggcgccagagtggctcgccaacctgcccatcacggccaagtccgacgtttacagctacgggatggtcctgctggagatcgtcagcggccaccgcaacttcgacgtctccgaggagaccggccggaagaagttctccgtgtgggcgtacgaggagtacgagaagggaaagatcttcgacatcatcgacaagaagctccccggggaagacatcgacatggcccaggtggagcgcgcgctccaggtgagcttctggtgcatccaggagcagccggcgcagcggccgtccatggggaaggtggtgcagatgctggaagggatcatggacctcgagaggccgccgccgcccaagtcgtcggacagtttcctgagcaccaccacgggcagtaccggcatcggcagtggcgtcagcacgagcatagtctcgagtacggttgcctcgtcggccccgatcgcgccgacgacgtcgccgaacctggagcaggagatggcgttggcgcgctcgacgtcggccacgaaccgtgagagggtgtcgcggcagctgctatcgccgcagccgtacatgacgatgtaataaggtgcatcttccatggcagatcatctgaacccgtagcgtcgtaaacaaagtggggtgctgaagcatgcggaaattaatgcttctatgctccattggaaggaagaggaaatgtacagattatagagcggttagggaattgatgtgctgaatttgctgttacgtctggtgatcttgttctggttgtgacaacaaaacagagtgttgttcacttctagtgagtttgcatactgcatctgcatatgtaactgtaagtagcaggattttgatatgggcattgtattttgtacaaataattgagatgtaggcgatgtattgtcctagcattggc

SEQ ID NO: 940 - DNA, 2840 bp, Setaria italica
agccagccgccccgaatcgccggaaagatgcggcctttgcggggaaagcacggggatcttgctatcctctgctgcctcgcgctcctcctcccgctgctttcccatggcgcggacatgccgctggggtcgaccctctcaccgggcaactcggcgccgtggacttcgcccaacaacaccttctcgctctccttcacggcgtccccgacctccccgtccctcttcgtcgccgccatcacctacgccggcggggtgcccgtctggtccgcgggagccggcgcggccgttgactcgggtggctcgctccgcctctcctccaacggcgacctccagctcgtcaatggatctggggccgtgctatggtcgtccaacaccggcggccggggcgtcgccgccgcggccgtccaggagagcggcaacctggtgctcaagaactcgacggccaccctgtggcagtcgttcgaccatcccacggacacggtggtcatgtcgcagaacttcacctccgggatgaacctcacctccggcccctacgtcttctccgtcgacaagagctccggcaacctcacgctcaagtggaccagcggcgccaacaccgtcacctacttcaacaagggctacaatacgaccttcacggggaacaagacgctgagctcgccgacgctgacgatgcagaccaacggaatcgtgtcgctgaccgacggccagctgacggcacccgtcgtggtggcgtacagcagcaactacggcgagagcggcgacatgatgcggttcgtgcgcctcgacgccgacggcaacttccgcgcctacagcgcggcgcggggcagcaacgcggcggcggagcagtggtcggcggtggcggaccagtgccaggtgttcggctactgcggcaacatgggcgtgtgcagctacaacggcacgtcgccggtttgcgggtgcccgtcgctcaacttccagttcagcaacccctccaacccccgcgacggctgcaagcgcaaggtggacctccagaactgccccggcaactccaccatgctccagctcgacaacacccagttcctcacctacccgccggagatcaccaccgagcaattcttcgtggggatcaccgcctgccggctcaactgcctctccggcggctcctgcgtggcgtccacggcgctctccgacgggtcgggcctctgcttcctcaaggtctccaacttcgtgagcgcctaccagtcggccgcgctgccgagcacgtccttcgtcaaggtctgcttccccggcctgcccaacccggcccccgacgccgcgacatcttcctcccgcggcggctccggcgtccgcgcctgggtcgtcgccgtcgtggtcctcggcgccgtgtccgcgctggtgctctgcgagtgggcgctctggtggtggttctgccggcacagccccaagtacgggccggcgtcggcgcagtacgcgctgctggagtacgcgtcgggcgcgccggtgcagttctcctaccgcgagctccagcggtcgaccaaggggttcaaggagaagctcggcgccggcgggttcggcgccgtgtaccgcggcgtgctggcgaaccggacggtggtggcggtgaagcagctggaggggatcgagcagggggagaagcagttccggatggaggtggccaccatcagcagcacgcaccacctcaacctcgtccgcctcatcggcttctgctccgagggccgccaccgcctgctcgtctacgagttcatgaagaacggctcgctggacgccttcctcttcggcgccgcgccgggggggaagatgccgtggccgacgcgcttcgccgccgccgtcggcaccgcgcggggcatcacctacctccacgaggagtgccgcgactgcatcgtccactgcgacatcaagcccgagaacatcctcctcgacgagcacttcaacgccaaggtctccgacttcgggctcgccaagctcgtcaaccccaaggaccaccgccaccgcacgctcaccagcgtaagggggaccagggggtacctggcgccagagtggctcgccaacctgcccatcacggccaagtccgacgtttacagctacgggatggtcctgctggagatcgtcagcggccaccgcaacttcgacgtctccgaggagaccggccggaagaagttctccgtgtgggcgtacgaggagtacgagaagggaaagatcttcgacatcatcgacaagaagctccccggggaagacatcgacatggcccaggtggagcgcgcgctccaggtgagcttctggtgcatccaggagcagccggcgcagcggccgtccatggggaaggtggtgcagatgctggaagggatcatggacctcgagaggccgccgccgcccaagtcgtcggacagtttcctgagcaccaccacgggcagtaccggcatcggcagtggcgtcagcacgagcatagtctcgagtacggttgcctcgtcggccccgatcgcgccgacgacgtcgccgaacctggagcaggagatggcgttggcgcgctcgacgtcggccacgaaccgtgagagggtgtcgcggcagctgctatcgccgcagccgtacatgacgatgtaataaggtgcatcttccatggcagatcatctgaacccgtagcgtcgtaaacaaagtggggtgctgaagcatgcggaaattaatgcttctatgctccattggaaggaagaggaaatgtacagattatagagcggttagggaattgatgtgctgaatttgctgttacgtctggtgatcttgttctggttgtgacaacaaaacagagtgttgttcacttctagtgagtttgcatactgcatctgcatatgtaa

SEQ ID NO: 941 - DNA, 5411 bp, Oryza sativa
acggaaggttgtacaaaacaaaatacatcttaaaaaaaatcacttggggttacatctgagaaaaaaaaatcttaaggattaacaaaccagctatgctctcattggatgtactagtatcatgtatgatatggaagcattttatgtaaactaattgagcacttgaggtgttgaagtggcgttaattagtccaataagcagacgatttgaccctaatagagtcattacaaggagcagcccggtcggtcagtgtgtgtcactgtctctcaccctcccaacgcttagacatttcaacgttctcctccacagcaacagcagcagcagcagcatctcctcttcttcaccgcatctgccagcctagcgagcctaatcaggtcttcgtcttcttcttcctcatccccgtgccaataccgatttcgcgagctccgatggattccgcgagagaggagacgtcgccatgagaggggaagccgagctgtgcgtgtagctcgctgcaatcgctgcgccggtcaagaaaccagccggaatcggcggctgattccggtggaggaagatgcggcggaaggcggccggagatgctgctctggtaggcggctgcttcttgctgctcctccaccctctcctctcccatggcgcggacatgccgttgggctcctccctctcgccggcgaaccaggcgttgtggtcgtctcccaacaacaccttctccctctccttcacggcgtccccgacctcgccgtccctcttcgtcgccgccatcacctacgccggcggggtgcccgtgtggacggccggcaacggcgcgaccgttgactccggtggcgcgctccgcctctcgtccagcggcgacctccagctcgtcaacggctccggcgccgtggtctggtcatcgaacaccggcgggcagggggtcaccaccgccgcgctgcaggagagcggcaacctcctgctcaggaactcgtcggcgacgttgtggcaatcgttcgaacaccccacggacacggtggtgatggggcagaacttcacctccggcatgaacctcacctcggcgagctaccaattctccctcgaccggaacaccggcaacctcaccctcaagtggaccggcggcggcacggtcacctacttcaacaaggggtacaacaccaccttcacggcgaacaagacgctgagctcgccgacgctggcgatgcaaaccaacggtatcgtctccctcaccgacggctcgctcacctctcccgtcgtcgtcgcgtacagcagcaactacggcgagagcggcgacatgctgaggttcgtgcgcctagacacggacggcaacttccgcgcctacagcgcggcgcgcggcagcaacgcgccgacggagcagtggtcggcggtggcggaccagtgccaggtgttcggctactgcggcaacatgggcgtgtgcggctacaacggcacgtcgccggtgtgccggtgcccgtcggagaacttccagctgagcaacccggccgacccgcgcggcggctgccggcgcaagatcgagctccagaactgcccgggcaactccaccatgctccagctcgacaacacgcagttcctgacctacccgccggagatcacgacggagcagttcttcgtcggcatcaccgcctgccgcctcaactgcctctccggcagctcgtgcgtcgcctccacggcgctctccgacggctcgggcctctgcttcctcaaggtgtccaacttcgtcagcgggtaccagtccgcggcgctgcccagcacgtcgttcgtcaaggtctgcttcccggggatccccaacccgcccctcggcggcggcgggtcgccgtcgggcagggcgtcgggcgtccgcgggtgggtggtcgcggtggtggtgctcggcgcggtgtccgggctggtgctgtgcgagtgggcgctgtggtgggtgttctgccggcacagccccaagtacggcgcggcgtcggcgcagtacgcgctgctggagtacgcgtccggcgcgccggtgcagttctcgtaccgggagctgcagcgatcgaccaaggggttcaaggagaagctgggcgccggcgggttcggcgccgtgtaccgcggcgtgctggcgaaccggacggtggtggcggtgaagcagctggaggggatcgagcagggggagaagcagttcaggatggaggtggccaccatcagcagcacgcaccacctcaacctcgtccgcctcatcggcttctgctccgaggggcgccaccgcctgctcgtctacgagttcatgaagaacggctccctcgacgccttcctcttcgccgacgcgccgggcggcaggatgccgtggccgacgcggttcgccgtcgccgtcggcaccgcccgcggcatcacctacctccacgaggagtgccgcgactgcatcgtccactgcgacatcaagcccgagaacatcctcctcgacgagcaccacaacgccaaggtctccgacttcggcctcgccaagctcgtcaaccccaaggatcaccgccaccggacgctcaccagcgtgcgcgggacgaggggctacctcgcgccggagtggctcgccaacctccccatcacggccaagtccgacgtctacagctacggcatggtgctgctcgagctcgtcagcggccaccgcaacttcgacgtgtcggaggagaccggccggaagaagtactccgtgtgggcgtacgaggagtacgagaaggggaacatcgccgccattgtcgacaagaagctccccggggaggacatcgacatggtccaggtggagcgcgcgctgcaggtgagcttctggtgcatccaggagcagccggcgcagcggccgtcgatggggaaggtggtgcagatgctggaagggatcatggatctcgagaggccgccgccgcccaagtcgtcggacagcttcttgagcctgacgtcggcgaccaccgccaccggtgtcagcggcagcggcagcaccagcatggtctccacgtttacttcctcggcggcgccgccggcgcccacgccgtcgccgaacgtcgacgaggtccagcaggagatggccgtgggacgctcggcgtcggccaggatccgcgaccgggcgtctcgttcgctgctggggcaggagccatacatgacaatgtaaaacttcatcttctcatgaggtgaatagcaaaatgattttgctttttttttttgctccagtaaatgggaaaattgctctggttagtgagcaattagggagttgatctggttgattttgttttggtggaacatagaagcagctgtcggtggaagagaagtgcttttcactgatggtgagcaatttcgtacttctacttgagaggatatctatgtgcctgatgagctgaattctgcaatttgtaagtacagattagatcaaactcaatggtatattcgcgttgtaacttgtacaaataattcaaatgaggcgatgcattgataaatggagtgcaaacatagatgcaatagcttgtctgattgtagattatggttttggggaagctaaagcaaaggcagagataagcagatcaataaaaattcagctacttcagtttgttcagtactgagaagcagcttgcctcacactcacatgcatactactggtaagagattgttttggcatttggggcaaggcatgagcaatctggcagattgatagtacacaaaaacatgtgcaggaactttcaacaaacttctctatcaacctttattccattaaattaaatgcatgggacccatgacaaccctttccaaagatcaaattgcctgcatcatgtgtcatcactggcaattgcatctccatgtccatggagagcttgcaattgcgtagtagctgaggaaacatgtgattaaggcttatactgggtcttatttaatgctagatttatgagcacacagctgttcttgagtcttggccccttgttcagctattcattcagaagcagtcactgaagaatgttgttgagcttagactcactgatttataagcttcctgtttagcaagcagactcatcggtgttacattcagaaaataccggcacattccaacttgaacctagatttattggccaattgctttagttaagaaaatgaagtaaaatggttccatagtgtagtggttagcactccagactttgaatctggcgacctgggttcgaatcccggtgggacctttttttttagttttactaatctttttgcatcactgcatttaacatcatcactgtctaaacaacttcttgacgcaaactgcatatcctttccttttcttaggtgcatttatgcgaagttactgatgattatgatgttggagccataagtttccaaaacaataacaaccttaccgacagaattcctcctaccctcaaactgttgaagtcattttcttgatcaaaacgaactaagtgtcatgtccttttattgttggaccacttatcgtccttatcttagcttctcgtagtttaacatgtgacaccgaagaaacattcagccatgataagagcagtccgaactaagatattcgccagtctcacccaccaccaattgaactgtcatatacggtctttctccaggtctcctgcctcccggtcagccaatgcccaagaacaattagtgtaaccacacaagtaatcatcctcagcttttccaatgtttgtgagcttggacaggatgaacaaaaggcggggttcaaatgtcaatgaataactttgaacatgccctgggtttaaaataattccattcttaccagttctgcacttcaattcggttgcaacaacaaagttggcagttctagaaagtcattcagaaagacccaagcacttcaaattttcttttgaagaaaaaggacagataacgaagaaaagctgtggaatactttacagagcggggagttttgcgtggaaaacttacagtgttgtaatccagtattgtaggcaagaaacttgcccacctttatctgtacatgattatcagatccttcttcattgaagtcagatgataaatttgaaggaccgtattagtgaagtcctcctagttagtactcaatccaattagcatccagatccttcagcttcaggagccatttctgtttgtccggagaaacgcttggtttgtttggcttgcttgcgtgtttatttgttatggcatatgaggatccagccttactctcatcatcagagttggctcgccttctaggtcgtctgagttcaagagaaagaaggcgagaaacctcgtgtactccaccccatttttccaacgcccgagcaatgtcataacgtcctatcattaacaacaaagtacgagcattattcataaagaaagattgtgagttcttgacaaaagagagaactggtaaaactagcatgataggaacccaggcaataaggttgttacaaacatcagtctga

SEQ ID NO: 942 - DNA, 1916 bp, Brachypodium distachyon
tttaacatggattcggccggggttagtaatatccggatttgggattttatgccaagaagcaaaagcaaagctagggaatccactcgccaagattcctcgtctcgtctccttccgcgctccccaagctccctcaaccgccgccaattctgcccatacataggagtatactggggatagggagtcgcgagttcccctagtcccaagtttccggaggatttgctttcttctctgctcagctcagctcagctgccccctagccgccagcagcaccaactcctcctccgagggagaaaggggagagagggaggctaaggaaggaggaggagcgatgggtatacccagcgacgaggtggtgcaaatccggcaccccgacgtcgccggcgaccccaccgtcgtcaccatcagctgccccgacaagacgggcctcggctgcgacctctgccgggtcgtcctcctcttcggtctcaacgtcctcaagggagacatgagcacggatgggaggtggtgctacatcgtgctgtgggtggtggcaaggcgggggcggaccatggcgtgggaccttctcaaggagagattggttgagctttgccccgtctcctcgctttgcggtctcgacagctcctatcttgcagccgctggccttcaggaggatctagaacccgccgcccctcgggtcttcttgctcaagttctcctgctacgaccggatgggccttttgcatgacgtgacacacgtgttgtctgagatggaactcacaattaggagggtaaaggtctccaccacacctgacgggagagtgatggaccttttcttcatcactgatgctagggaccttctacatacaaagaacagaagggaagaagcttatgaaaaacttcaaagcgtactaggcgactccgtgacgagttgtgaaatagagtgtgccacagaagacatgtcatcttgcctccaagcgtctgcactgttgccgcctcttgtggtcgaacagatgtttaacacagatctcatagaagagcaattgagccgctcaaggtccagtagcaaattgtcagtcacgatggacaactcgctcagtcctgtgcacagccttattcagatccagtgtggtgaccataagggcctcctatacgacatcatgcggacattgaaggactgtgacatccagatttcctatagccgattctatgccggtcgaaaggacaggtgtgaggtggatttgtttgcggtgcaatcggatgggaagaaaatccttgatcagcagaaacaaagagcgctgtgctctcgcctaaggatggaactcttgcatccactccgtgtggcgttggtgaaccggggtcctgacatggagctactggtagcaaacccggtcgagatatctgggaagggtaggccgctggtgttgcacgatataacccttgctctcaagaatcttcacagacggatcttcttggccgagatcgggaggcatgtggtggatgatagggagtgggaggtgtacagagtgcacctgggtgaggatgaccatgagctctcttgtgcggtgcgaagaaagatagttgatggcgtcaccaacatgctaatggggtgggagtgatttcagcctttatctaacaaacctgtgcagatcgaagaccaacttaatctgtttcatctaaagttaggtactcttgactagttagagaatattgttgttgctgcccgctgtaagttacttgttcctgactagttacttagcttagggtctaaagtcagtagactagattggatgcacttgttgttcttgacctttttgggtgattcagaagtactgctagtgtgtttgtgcctaatgaactagaagcggatgttcgcgtgatcccgtttgcagtccctggcttgtgtgtttaaaaagaagggaattcaaaacataaaggtag

SEQ ID NO: 943 - DNA, 1464 bp, Secale cereale
agcgccagcgaacccaaccacgaggacacggcgagatgcagcgcgcggcggcctccctcgcctcctcccgctccgcggcggcctgggcgtgctccaccacctcgcgacatgccggctccggcgcctcctgttccgccgccgcgcgccggtactccgtcgtgcctctccgaattcgtggccaagagcagcggcccgccgccctccccatgtccctgtcgctgctctccgggagtcggccagcgcggacaactgctgcggcggccgcaacggcggagctggccccggccgacgaggtgggcgcgggcggcagcattgccgggacggtgcagctcggcgccatgatcgtcgcctggtacctcctcaacatctacttcaacatctacaacaagcaggttctccaggtactgccattgccgctcccctacaccatcaccgccttccagctcgccttcggctcgctcgtcatcttcttcatgtgggccgccaggctccaccccgtgcccaagctctccgccggacagctggccaagatcgcgccgctggccgccgggcacatgctgggcacggtgttcaccaacatgagcctgggcatggtggccgtctccttcacgcacaccgtcaaggcctcggagccgttcttcaccgtcctgctctcggccttcttcctcggcgaggtgccgtcgccgctggtgctgggctccctggtgccgatcgtcggcggcgtcgccctggcatcgctgaccgaagtctccttcaactgggtcggattctggagcgccatggcgtcgaatctgctcaaccagaccaggaatgtgctcagcaagcggctcctcggcggcgaagaggaggagttcatggacgacataaacctcttctcggtgatcaccgtgctgtccttcctgctgtccttccctctcatgatcttcacagaaggggtcaggttctccccggcgttcctccagagcaccggcctgaacctgcaggagctgtgcgtgagggcagccctggccggcctctgcttccatggctaccagaagctgtcgtacatgatcctggcgagggtgtcgcccgtgacccactccgtggccaactgcgtcaagcgtgtggtggtcatcgtctcctccgtcctcttcttccggacgcccatctcccctgtcaatgcactgggaactggtgcggcactggcgggagtttacctgtactccaggctcaagaaaacaaagccaaagagttcatgagggcatttttttcctgttccaaatacagggttttgaggtagacgactaggtcgatatagtagtattcacgaaaaaaatgtattgagatagtaggttgtacagaacttgccatggccagtagtacacttgtactacaggctacagcagcttctttcaatagtagcaagaccaaacttcttgtcttgaagatttgtaacatcctccctgaataatgtcatatctcctg

SEQ ID NO: 944 - DNA, 1262 bp, Triticum aestivum
tgtccctgtcgctgctctccggcagtcggcccgcgcggacggcaaaagcggcggccgcggcggcggagctggccccggcggacgaggtggccgcgggcggcggcattgccggcacggtgcagctcggcgccatgatcgtcgcctggtacctcctcaacatctacttcaacatctacaacaagcaggttctccagatgctgccattgccgctcccctacaccatcaccgccttccagctcgccttcggctcgctcgtcatcttcttcatgtgggccgccaagctccaccccgtgcccaagctctccgccgcacagctggccaagatcgcgccgctggccgccgggcacatgctgggcacggtgttcaccaacatgagcctgggcaaggtagccgtctccttcacgcacaccgtcaaggcgtccgagcccttcttcaccgtgctgctctccgccttcttcctcggtgaggtgccgtcgccgctggtgctgggctcgctggtgccgatcgtcggcggcgtcgccctggcatcgctgaccgaggtctccttcaactgggtcggattctggagcgccatggcgtcgaatctgctcaaccagaccaggaatgtgctcagcaagcgcctcctcggcggcgaagaggaggagttcatggacgacataaacctcttctcggtgatcaccgtgctgtccttcctcctatccttgcctctgatgatctttgcagaaggggtcagcttctccccagcgttcctccagagcaccggcctgaacctgcaggagctgtgcgtgagggcggccctggccgggctctgcttccatggctaccagaagctgtcgtacatgatcctggcgagggtgtcgcccgtgacccactccgtggccaactgcgtcaagcgtgtggtggtcatcgtctcctccgtcctcttcttccggacgcccatctcgcctgtcaatgcactggggactggagcggcactggcgggagtttacctgtactccaggctcaagaaagcaaagccaaagagctcatgaagatgttttttctttcctgttttgggtacaggtttttgagatagaggattaggtcgatatagtatccacgagaaaatgtattgagatagtaggttgtacagaacttgccacggccagtagtacacttgtactacaggctacagcagcttctttcaatagtagcaggaccaaacttctggtcttgaagatttgtaacatcctccctgaataatcacaaatctcctgacaaat

SEQ ID NO: 945 - DNA, 2684 bp, Brachypodium distachyon
acaaatatttggtccaaccacaatctcgtgggattcaaatggatacgacatcacaatcctgtaatttttctatcctgcgaacaaaaaaaactttccaaagaaacgtacatgctccgcaggaatttcacaggaaaatttgcctagtcaccctgcagacgtcgagaaacatttctgcgtgagactggagttttcaatgaattgaaatcaatcactaggcgctactctctctacaaacaaaaagcagcgtcactttggtagagaccagcacgaagagagggtgttcaaacctaattggcgttcatgcagccccggccgccctcactttcctcgctactgcggtcttacatggggctgcttaaagaaaagaaacctggagcaaggcgacgacgaatctgtacgggatcccggcaagattcaaccagcttccccgctgtaacgtcgctataactcccgtcctatatattttgtgcaaagggccccaacaagcacgagcgaatccatcgcacacacacaagagacaacaggagaaacccggcaagcgagctagatgcagcgggcggccgcctcgctctcgtcctcgcgcgccgcggcctgggcggcggccgcctcttcgcgccatgccgccggcgcctcctgctccgccgccgctggccgccgcgagaacaccatggccccgccgcctctccggattctccgcggccagcaactgctccccctcctgccgctgctttcggggaacagggcccggcgcgcggtcaccgcgagcgctgctgctgcggcggagctcccggcgggggacgacgcggccgcgggcggcattgcgggcgcggtggagctcggcgccatgatcgtcgcctggtacctcctcaatatctacttcaacatctacaacaagctggtcctccaggcattgccgttcccctacaccatgacggccttccagctcggcttcggctccctcgtcatcttcttcatgtgggccgccaggctccacccggcgcccaagctctccgccgcacagctggcgaggatcgcgccgctggccgcggggcacatgctgggcacggtgttcaccaacatgagcctgggcaaggtggctgtctccttcacgcacaccgtcaaggcctccgagcccttcttcaccgtcctgctctccgccttcttcctcggcgagacgccttcgctgctggtgctgggctccctggtgccgatcgtcggcggcgtcgccctggcatctttgaccgaggtttctttcaactgggtcgggttctggagcgccatggcgtcgaatctgctcaaccagacaaggaacgtcctcagcaagcggctcctcggcggccaacaggaggaggaatccatggacgacataaacctcttctccgtcatcaccgtgctgtccttcctcatgtcctgccccctgatgctgctcgcggaaggggtcaagttctccccagcttacctccagagcaccggcctgaacctcccggagctctgcgtgagggcagcgctggccggcctctgcttccatggttaccagaagatctcgtacatgatcctagcgagagtgtctcccgtgacgcactctgtcgccaactgcgtgaagcgcgtggtggtcatcgtgtcgtctgttctcttcttcaggactcccatctcggctgtcaacgcactgggaactggcgcggcattagggggagtttacctctactctaggctgaagaaaagtaaacccaagagtatatgaagattgacctcagtttacactttacagtagttgtttccaaacacgagattttgtggcagagaagattaggtccagatattgacaggaaatgtacgtactacttgccagttgccgcccccagttgtacactcgtactacaggctacagcagtttcttaacgtgatagcaagaacattttattttcggtctgaaaaattgtagcatcctcctggaataatcaaatgagagatgcatcatctatgtgtaaaattcagaatctttgctgagacaacttgcagcagcagagctgcagaggcatgtcatgagctagattgttcagaagttcagcacatgtaaagcataggtcatccggtccaacatctagccaccctgaggctgagagcatttacaccagtcaaacataacttacatggtacggcccaaaattcacgtctcaggaggttcgtttccgaggattataaaacactaccagggtataaatagcaaagaagtcccaaggttcaaggtttcaccaagtactaacaccggcataccgacaatataaagtgcctcccaggcaccgcatcaacagagcaaaagactaacaagctatgtcagggggatcccaggacattctttgcttcagcgagcacaagagatactataatttggttagaaaaccaattccaaactccacctaatttcgtcaccatcatgattgccaggtcgcatcttgacatttaccagttggagactcccacagccttgggaggactcctgctcctagcccggaagccgtcattgcttgttctgttctgatcagcacctcgagagctatagaatctgccagccaattgcacagagaggaacgtcaaatataaagcttttgtggatgaatcacatcccaataaactaaactactccctccgttccataattctcgtctcaagtttgctaaaaaatg

SEQ ID NO: 946 - DNA, 1653 bp, Secale cereale
tggcctccgtcctcgcgcctataatattcgggtagggggtcgttccgtccacgcttcgcgcacaggagttgttccttcttcttgggcggaaatggcggacgagcaccacggcgcgggcgcggggttctggctgccggacgagttcctcgacgacgacttcttcgccgacgagaaggcggcggcggcggcggcggccaggagcgacagcgacgacgaggacgggctcggcggcctctcgcgccgcgtggccggcctcgactgcgacggcggcgaccgcgccattcccaaggcggaggtgatgtctgggtctccgcagtccacgctctgcgtgctgcaggcctcaggggaggacagccctaccggcggcgcttcgcaggtcagctcgccgccgtcctcgccgctggagcagcagccggccgacccatgggacctgctgcacgaggcggctggccaggtggcccgcctgggcgcggacagtatccccgtgccagttgttaacccttctcctatccatggcgccgccgtcacgccgccggcaaggaagccctcttcgccgctgctcccgtccccaaagcccgtcggaccttaccagtatccgccgaacaactcgttcgcccagcgccaggctcaagtcgctcgtttccatctcctgaagcagcagcagctgatgaagcatcagagggagcagcagctggccatggcggcggccatggcgtggggctccaccgacgtcgggccgctcgggctgagcccctcggcctggccacctctgcagaagtccccgcaccacgcacctccctccgcggccggcatgcgcgccgtgttcctcacccctccgggagccaagcgcgagtgcaccggcaccggtgtgttcatcccccggcaggccggcgcacccgccgagcccaagaagaaaccaagctgctccacggttcttctcccggcgcgcgtcgtgcaggcgctcaatctcaacgtcgaggacctcggcgcccgcccgtgctaccccggagccttcgttctcgatcacgacgcgctggtgagccggagcaacgcgatgcaggcgagccagaggcgcgagcacaacaacgccaatgccggcgccgccgcgcattccccgccgctcgccgtggcctgcgaggtcaatctgccgcaggagtggacgtactgagatggagattgctgctctccgtctccccccgtttccatggattactatctattattactattatcatcgatggttagcgctaggtagatgttagctagaggtaggaggcggtggcagtagcgtcgatcgatcagcgttaggtgttcttttgtgcgtgcgtgcgtgcgtgcgtgtggtgatatattggttattttgggaggacggttggtgatggatggatggatgggcgcggacgaacaaacggaggagaaacaaaatccatggcttcccttcgtaggttgttgccgggaggaataaataagtgtcgtggttccgacgaaggaagagatttcggaggtatggtgctgcccgctcagtaagtagttctagccgtgtaaggtgataatgatgatgatgatgatgattgggaaaatatcatcggcggtttggaaaggtgtcgctgtaagatacagtaatatgaagcaagaaataagagctccatgttt

SEQ ID NO: 947 - DNA, 1539 bp, Secale cereale
gcggaaatggcggacgagcaccacggcgcgggcgcggggttctggctgccggacgagttcctcgacgacgacttcttcgccgacgagaaggcggcggcggcggcggcggccaggagcgacagcgacgacgaggacgggctcggcggcctctcgcgccgcgtggccggcctcgactgcgacggcggcgaccacgccattcccaaggcggaggtgatgtctgggtctccgcagtccacgctctgcgtgctgcaggcctcaggggaggacagccccaccggcggcgcctcccaggtcagctcgccgccgtcctcgccgctggagcagcagccggccgacccatgggacctgctgcacgaggcggctggccaggtggcccgcctgggcgtcgacaccatccccgtgcctgttgttaaccctcctcccatccatggcgccggcgtcgcgccgccggcgaggaagccctctccaccgctgcttccgtccccaaagcccgtcggcccttatcagtatccgccgaacaactcgttcgcccagcgccaggctcaagtcgctcgtttccatctcctgaagcagcagcagctgatgaagcatcagagggagcagcagctggccatggcggcggccatggcgtggggctccaccgacgtcgggccgctcgggctgagcccctcggcctggccacctctgcagaagtccccgcaccacgcacctccctccgcggccggcatgcgcgccgtgttcctcacccctccgggagccaagcgcgagtgcaccggcaccggcgtgttcatcccccggcaggccggcgcgcccgccgagcccaagaagaaaccaagctgctccacggtgcttctcccggcgcgcgtcgtgcaggcgctcaatctcaacgtcgaggacctcggcgcccgcccgtgctaccccggagccttcgttctcgatcacgacgcgctggtgagccggagcaacgcgatgcaggcgagccagaggcgcgagcacagcaacgccaatgccggcgccgccgcgcattccccggcgctcgccgtggcctgcgaggtcaatctgccgcaggagtggacgtactgagatggagattgctgctctccgtctccccccgtttcaatggattactatctatattactattatcatcgatggttagcgctaggtagatgttagctagagtaggaggcggtggcagtagcgtcgatcgatcagcgttaggtgtcttttgtgcgtgcgtgcgtgcgtgcgtgtggtgatatattggtatttttgggaggacggttggtgaaggatggagtcagacgaacgaacaaacggaggagaaacaaaaatccatggcttccctccgtaggttgttgccgggaggaataaataagtgtcgtggttccgacgaaggaagagatttcggaggtatggtgctgcccgctcagtaagtagttctagccgtgtaaggtgataatgatgatgatgatgatgattgggaaaatatcatcggcggtttggaaaggtgtcgctgtaagatacagtaatatgaag

SEQ ID NO: 948 - DNA, 1918 bp, Triticum aestivum
agcatttgcacccgccgaagcccatcgacattcccctccctttcctctccttctccgtcccacgaccccccacctctctccgctgataagcacagcactcctctgccttccattggacggccggcccgctcgctcggattgcccggacgaggattcttcaaggtggagcaaatggcggtggagtggtccgacggcggcgaggagttccttcttcctgacgagttcttggacgacgacttcttctccgaggaggagaaggcggcggtggccgcgcggagcgagagtgatgaggaggacagcttggctggcctctcgcgccgcctcgcgggcctcctcggcggtgacaaactcgccgtcacgcctgccaaggaggaggtgactgcagggtcgcccaagtcgacgctgtgtgggctgccgaagtcgggccaggagagccccaacagcggcgcgtctcacgggaactcgccgccgtcgtccccgctggagcagcagccggccgacccgtgggacctcctgcacgaggcggccgggcaggtggcccgcctgggcgtggacagcgtccccgtgccttgtcaaccctccccccatccacggcaccggcgtcgcgccgccggcgaggaagccctctccgccgctgcttccctccccaaagcccgtcggcccttaccagtacccgccgaacaactcgctcgcccagcgccaggcccaagtcgctcgttttcatctcctgaagcagcagcagctgatgaagcaccagagggagcagcagctggccatggcggcggccatggcgtggggctccaccgacgtcgggccgctcgggctgagcccctcggcctggccgccgctgcagaagtccccgcaccacgccccaccatccgcggccggcatgcgcgccgttttcctcacccctccgggggccaagcgcgagtgcaccggcaccggcgtgttcatcccccggcaggccggcgcgcccgccgagcccaagaagaaaccaagctgctccacggttctcctcccggcgcgcgtcgtgcaggcgctcaacctcaacgtcgaggacctcggcgcccgcccgtgctaccccggagccttcgttcttgatcacgacgcgctggtgagccggagcaacgcgatgcaggcgagccagaagcgcgagcacaacgccaacgccaatgccgccgccgcgcactccccgccgctcgccgtggcgtgcgaggtcaatctcccgccggagtggacgtactgagatgcatcgtccgtccgtctccgtctccccccgtttccatggatcactgccatatttaagtattactcatattaccattatcgatggttagcgctaggtagaagttagctagaggtaggaggcggtggcggtagcatcagcgttaggtgttcttttgtgcgtgcgtgtggtgatatattggttattttggaggacggttggtgatggatggatgggcgccgacgaacgaacaaacggaggagaaacaaaatccatggcctccgtaggttgttgccgggaggaataataagtgtcgtggctccgacgaaggaggaaatttcggaggtatggtgctgcccgctcagtagttcttctagctgtgtaaggtgatgaactgacgatgattgggaaaatatcgtcggcggtttggaaaggcgtcgctgtaagatataagtaaggaagaaagaaataagagctccatgtttccattagtgcctactgctgccttgggtttgctttgttgcaattccacttcagtcatgtgtaccatcatatcatcccttttggcatcgttcggttgcttcatgaataaggaacccctctcttctataataaggaaagatatagtgctgttttttgttcggtgcttgggcttttcctccttgttacatttctgttttggaattatttttg

SEQ ID NO: 949 - DNA, 2713 bp, Triticum aestivum
ggctttgttagcatgcaaaagatggtgcccatgggtttggaatgagggactacactacctagaaatggatgaaacaccaactagttctgggcgatctgaagctacttcatgtgaacctagttggtggccgccagactttttggagaagatagaatctgtcgccttagcaagagaacaagaagttttggctgaaaaagaatcgcaattcagtctgtcaaattcaaggtcctcatcctggaaggcttctcagttactgtggtcaactggaacttattcagggtttattcctaatggtttctattcgatcatcccggataaaaagctgaaggagagtttcccaacaataccatcactaactgaccttcaaagtcttgaagcagatgggcttaagcctgaaataattgttgtggatgctgaaaaggataagaagattttcatgttgaagcagcttagtggcgcacttgtgaaaggattgaacaatccagctctagtgataaagaagatagcaggtttggtttttgactgcttcaagggccaaagctctgatgcaagtccaggaagagcttcaaccgaagatactcacttctttggaaatagaggaccacaacttcttgggcagataaggcatggatcatgccgaccccgagctatcctatttaaagttcttgcagatgctgttggccttgagagtaaacttgttgtgggtctacctgatgacggtgcagttggatttgtggactcctacaaacatatgtctgtggtagttccgctgaattctatggagctactagttgaccttatgcgatttcccggccagttgattcctttttcagccaaggccatctttatatcacatatctctgctgcgggtgagagtgattcagctgaaaatgactcgtgtgattctcccctggagcccaacagtcctctatatggattatctgataaagttgaagctgaaggaatcgaagcttcatcaaatctatctgggcgttcattgcgtaatacaatgttgagatcgagaacattctcagaggggaaattaagcacatcatgtagtgagccaaacatcgcaaatgccttctggaggcgaagccagaggagaggagttgctgaagaacctcgtggtgctagctcaagtcctgagcatccgttaatgagggccaagggaagatccatacttggtgaccggcaatcatttcaagaatacaccgatagagttactttaagatcagatgatcagggtgtcactactacacctaaccctcgaagaataaggcgaagaagcattagcatcacacctgagattggagatgacattgtgagggcagttcgggctatgaatgaaacactaaagcagaatcgcctccaaagggatcatgttaatgatggttcatgttcatatattggggcggacgaaagcaatgcaaacgactgcccaaataatgatgataaatctgggacgaacaatggcttgagaaaccgagctggttctactcagaaggctatgtcattgcctacttctcctcatgactatgggggcgaaatttctgaaacaagcaataattgtgattttataagcgaagagaagatggtatttgcatggaacagggttttgcaaagctctccttttaataagcctctatcgcctttccaagagtggaacatagatttctctgagcttacaattggtacacgggttggaataggattctttggagaggttttccgtggtatatggaatggcactgatgtcgccatcaaagtatttctggagcaggatctgacgactgaaaacatggaagatttttgcaatgagatatacatcctgagccggctgcggcatccaaatgtaatattgttccttggggcatgcatggtacctccgcacctgtcaatggttactgaatatatggaaatgggatcactgtactatctcatccatatgagtggtcacaaaaagaaactcagctggcgcaggaggctgaaaattattcgtgatatatgcaggggattgatgtgcatacaccgcatgaagatagttcacagggacctgaaaagtgcgaactgtctggtgaacaagtattggactgtcaagatatgtgactttggcctttctcgagcaataacagatagtcctatgactgataactcctctgctggcacaccagaatggatggcccctgagctcattaggaacgaacccttctcagaaaaatgtgacattttcagccttggtgtgataatgtgggagctgtgcacattgagccgcccatgggatgggatcggcccagttaaagtggtgtacgcagttactgaagggtcgctgcttgaaattccagaagggcctcttggcaagttaattgcagattgctgggcggagccccaggatcggccgagctgccaggagatcctcgctcgcttgctggactgcgagtacgctgatagctgagacgaacctggcgaatgcttcactcccaacctcccagtgccttgagaggtggatccgtttctctgtataaaacttgtaaaaatctagcctgttggtcctgcagaccggcagggatacatatattgaactcttgtatttcggctgttatcggcgaccctttctttcaaatttgtaaaggaaaattctctccttttatagaagaatgtcgcagggctaagctagcgtgtcgcagggctaagctagcgtgtcctcggatctatc

SEQ ID NO: 950 - DNA, 2719 bp, Triticum aestivum
tcagccagactgatcagtggtcatattgaatacaaagctttctcgtatggtttttgttagcatgcaaaagatggtgcccatgggtttggaatgagggactacactacctagaaatggatgaaacaccaactagttctgggcgatctgaagctacttcatgtgaacctagttggtggccgccagactttttggagaagatagaatctgtcgccttagcaagagaacaagaagttttggctgaaaaagaatcgcgatccagtctgtcaaattcaaggtcctcatcctggaaggcttctcagttactgtggtcaactggaacttattcagggttcattccaaacggtttctattcgatcatcccggataaaaagctgaaggagagtttcccaacaataccatcactaactgaccttcaaagtcttgaagcagatgggcttaagcctgaaataattgttgtagatgctgaaaaggataagaagattttcatgttgaagcagcttagtggcgcacttgtgaaaggattgaacaatccagctctagtgataaagaagatagcaggtttggtttttgactgcttcaagggccaaagctctgatgcaagtccaggaagagcttcaaccgaagatactcacttctttggaaatagaggaccccaacttcttgggcagataaggcatgggtcatgccgaccccgagctatcctatttaaagttcttgcagatgctgttggccttgagagtaaacttgttgtgggtctacctgatgacggtgcagttggatttgtggactcctacaaacatatgtctgtggtagttccgctgaattctatggagctactagttgaccttatgcgatttcccggccagttgattcctttttcagccaaggccatctttatatcacatatctctgctgcgggtgagagtgattcagctgaaaatgactcgtgtgattctcccctggagcccaacagtcctctatatggattatctgataaagttgaagctgaaggaatcgaagcttcatcaaatctatctgggcgttcattgcgtaatacaatgttgagatcgagaacattctcagaggggaaattaagcacatcatgtagtgagccaaacatcgcaaatgccttctggaggcgaagccagaggagaggagttgctgaagaacctcgtggtgctagctcaagtcctgagcatccgttaatgagggccaagggaagatctatacttggtggtgaccggcaatcatttcaagaatacaccgatagagttactttaagatcagatgatcagggtgtcactactacaccgaaccctcgaagaataagacgaagaagcattagcatcacacctgagattggagatgacattgtgagggcagttcgggctatgaatgaaacactaaagcagaatcgcctccaaagggatcatgttaatgatggttcatgttcatatattggggcggacgaaagcaatgcaaatgactgcccaaataatgatgataaatctgggacgaacaatggcttgagaaaccgagctggttctactcagaaggctatgtcattgcctacttctcctcatgactatgggggcgaaatttctgaaacaagcaataattgtgattttataagtgaagagaagatggtattcgcatggaacagggttttgcaaagctctccttttaataagcctctatcgcctttccaagagtggaacatagatttctctgagcttacaattggtacacgggttggaattggattctttggagaggttttccgtggtatatggaatggcactgatgttgccatcaaagtatttctggagcaggatctgacgactgaaaacatggaagatttttgcaatgagatatacatcctgagccggctacggcatccaaatgtaatattgttccttggggcatgcatggtacctccgcacctgtcaatggttactgaatatatggaaatgggatcactgtactatctcatccatatgagtggtcacaaaaagaaactcagctggcgcaggaggctgaaaattattcgtgatatatgcaggggattgatgtgcatacaccgcatgaagatagttcacagggacctgaaaagtgcgaactgtctggtgaacaagtattggactgtcaagatatgtgactttggcctttctcgagcaataacagatagtcctatgactgataactcctctgctggcacaccagaatggatggcccctgagctcataaggaacgaacccttctcagaaaaatgtgacattttcagccttggtgtgataatgtgggagctgtgcacattgagccgcccatgggatgggatcggcccagttaaagtggtgtatgcagttactgaagggtcgctgcttgaaattccaaaagggcctcttggcaagttaattgcagattgctgggcagagccccaggatcggccgagctgccaggagatcctcgctcgcttgctggactgcgagtacgctgatagctgagacgaacctggcgaatgctttacaacagacctcccagtgccttgagaggtggaaccgtttctctgtataaaacttgtaaaaatctagcctgttggtcctgcagaccggcagggatacatatattgaactcttgtatttcggctgtatatcggcgaccctttctttcaaatttttaaaggaaaattctctccttttatagaagaatgtcgcagggc

SEQ ID NO: 951 - DNA, 2746 bp, Triticum aestivum
cgcgattcaatctgtcaaattcgaggtcctcatcctggaaggcttctcagttactgtggtcaactggaacttattcagggtttattccaaatggtttctattctatcatcccggataaaaagctgaaggagagtttcccaacaataccatcactaactgaccttcaaagtcttgaagcagatgggcttaagcctgaaataattgttgtagatgctgaaaaggataagaagattttcatgttgaagcagcttagtggcgcacttgtgaaaggattgaacaatccagctctagtgataaagaagatagcaggtttggtttttgactgcttcaagggccaaaactctgatgcaagtccaggaagagcttcaaccgaagatactcacttctttggaaatagaggaccacaacttcttgggcagataaggcatggatcatgccgaccccgagctatcctatttaaagttcttgcagatgctgttggccttgagagtaaacttgttgtgggtctacctgatgacggtgcagttggatttgtggactcctacaaacatatgtctgtggtagttccgctgaattctatggagctactagttgaccttatgcgatttcccggccagttgattcctttttcagccaaggccatctttatatcacatatctctgctgcgggtgagagtgattcagctgaaaatgactcgtgtgattctcccctggagcccaacagtcctctatatggattatctgataaagttgaagctgaaggaatcgaagcttcatcaaatctatctgggcgttcattgcgtaatacaatgttgagatcgagaacattctcagaggggaaattaagcacatcatgtagtgagccaaacatcgcaaatgccttctggaggcgaagccagaggagaggagttgctgaagaacctcgtggtgctagctcaagtcctgagcatccgttaatgagggccaagggaagatctatacttggtggtgaccggcaatcatttcaagaatacaccgatagagttactttaagatcagatgatcagggtgtcactactacacctaaccctcgaagaataagacgaagaagcattagcatcacacctgagattggagatgacattgtgagggcagttcgggctatgaatgaaacactaaagcagaatcgcctccaaagggatcatgttaatgatggttcatgttcatatattggggcggacgaaagcaatgcaaatgactgcccaaataatgatgataaatctgggacgaacaatggcttgagaaaccgagctggttctactcagaaggctatgtcattgcctacttctcctcatgactatgggggcgaaatttctgaaacaagcaataattgtgattttataagcgaagagaagatggtattcgcatggaacagggttttgcaaagctctccttttaataagcctctatcgcctttccaagagtggaacatagatttctctgagcttacaattggtacacgggttggaataggattctttggagaggttttccgtggtatatggaatggcactgatgtcgccatcaaagtatttctggagcaggatctgacgactgaaaacatggaagatttttgcaatgagatatacatcctgagccggctacggcatccaaatgtaatattgttccttggggcatgcatggtacctccgcacctgtcaatggttactgaatatatggaaatgggatcactgtactatctcatccatatgagtggtcagaaaaagaaactcagctggcgcaggaggctgaaaattattcgtgatatatgcaggggattgatgtgcatacaccgcatgaagatagttcacagggacctgaaaagtgccaactgtctggtgaacaagtattggactgtcaagatatgtgactttggcctttctcgagcgatcacagatagtcctatgactgataactcctctgctggcacaccagaatggatggcccctgagctcataaggaacgaacccttctcagaaaaatgtgacattttcagccttggtgtgataatgtgggagctgtgcacattgagccgcccatgggatgggatcggcccagttaaagtggtgtacgcagttactgaagggtcgcggcttgaaattccggaagggcctcttggcaagttaattgcagattgctgggcagagccccaggatcggccgagctgccaggagatcctcgctcgcttgctggactgcgagtacgctgatagctgagacgaacctggcgaatgcttcactcccaacctcccagtgccttgagaggtggaaccgtttctctgtataaaacttgtaaaaatctagcctgttggttctgcagaccggcagggatacatatattgaactcttgtatttcggctgtatatcggtgaccctttctttaaaatttgtaaaggaaaattctctccttttatagaagaatgtcgcagggctaagctagcgtgtcctcggatctatcatttgcttttctaagaaattgtagactgggtacatccggttccggtggatgtgacaacctcactgctgcctccgccgttctctgcatgtcacctcactctttttaggacgcctcgccaatttgtcgggcttctgttgtcgacgacactggtagtactctgtaagagcgtttagatcactaggggaatcacctatcctgctgccattcattgtcatcatggacattctcatggtaatcttttggaaagcag

SEQ ID NO: 952 - DNA, 3574 bp, Brachypodium distachyon
atgctgaacagcaaacccatctccacgcccatcgacgccgaggccaagctgtccgcttccgagggatctcctgtcaaaaatccctctgactaccgcagcctcgcaggtgccctccagtacctcactctcatgcgccccgacatctcccatgatgaacaaagtgtgcctacaaagccaccgtcaacccccctgggctcctggctgctctgccattccccgcacaaagccaggcaaaggcagtgcgggccgacgcgacgcctcccctccacagctggagccgccgtactttttaatcttctcacccgcgtcctccgctctcgtctctcgtcgtccctcccggctaccgggtttgaagtctcagctcccagttacttcctcctcttcctcttccgtccgctccaccgcgccgcgccgcgcgcaggctgctcgatcgctggctcgctgcccacctaccgtaccagcccacctaccgcctctctaaatccaccgtgcaatcgagcccgcgtcgcgctgccgctcccaaatcccgaagccgctggacgcgccgctcctccttccagttccaccgaagcgaagcagcccaacctcggactctccgccgccgcgttctcctccttcggcactgccctctgctggattggcgtggagcggggaggagatccaccttgactttatcttctcctgttggtttactgtgagttcccaagttcagatatcaaccatattgattagtggtcatactgaatacaaagttttgtcgtatagcttatgttagcatgcaaaagatggtgcgcatgggattcaaatgagggactacaccgtccgagcaatggatgaagcaccaactagttctgggcaatctgaagctacttcatgtgaacctagttggtggccgccagacctcttggacaagatagaatctgttgccatatcaagaaaacaagaagttttggttgataaagaatcccgaatcattttggctaattcaaggtcctcgtcctggaaggcttctcaattactgtggtcaacaggaacttattcagggtttatacccaatggtttctattcaatcattccggataaaaagctgaaggagtgtttcccaacaataccatcactgaatgagcttcaaactctcgaagcagatgggcttaggactgacataattgttgtagacgctgagaaggataagaagattttcatgttaaagcagcttagtgctgcgcttgtgaaaggattgaactctagtccagctttagtgataaagaagatagcaggtttggtttttgactgcttcaagggtcaaaaccctgatgttagtccaggaagagctgcaaccgaagatactcatttctttggaaataaaggaccacaacttcttggacagataaggcatggatcatgccgaccccgagctatcctatttaaagttcttgcagatgctgttggccttgagagtaaacttgtggtgggtctacctgatgacggtgcagatggatttgtcgattcgtacaaacatatgtctgtggtagttcctctgaattctatggagctgctggttgatcttatgcgatttccaggccagttgattcctttttcagccaaggctatctttacttcgcatatctctgctgcgggtgagagtgattcagctgaaaatgactcatgtgattccccccttgagcccaatagccctctgtatggattatctgataaagttgaagctgaaggaattgaagcttcatcaaatctatctggacgttcattgcgtaatacgatgttgagatcaagaacgttttcagaggggaaattaagcacatcatgtagtgagcccaatatcgcaaatgcattttggaggcgaagccagaggaaaggagttgctgaagaacctcgttgtgctagttcaagtcctgagcatccattaatgagggcaaagggaagatctatacttagtggtgagaggcaatcatttcaagaatacactgatggagttacatcaagatcagatgatccaggtggcactactatacctacccctcgaagaattagaagaagaagcattagcatcacaccggagattggagatgatatcgtgagggcagttcgggctatgaatgaaacattaaagcagaatcgcctccaaagggatcatgttaatgatggttcatgctcatatattagtgaggacacaagcaatgcacatgactgcccaaacaaagatgataaatctggtcgagatgttgctaccaataatggcttgagaaaccgaacctgttctactcagaaagctatgtcattgcctacttctcctcatgactatgagggtggaatttctgaaacaagtgataattgtgattttataagcaaagaaaagatggtattcgcatggaacaaggttttgcaaagctccccatttaataaacctttattgccttttcaagagtggaacatagatttctctgagctgacaattggtacgcgggttggaataggattctttggagaggttttccgtggtatatggaatggcactgatgtcgccatcaaagtatttctagagcaggatctgacaactgaaaacatggaagatttttgcaatgagatatacatcctgagccggctgcgacatccaaatgttatattgtttcttggggcatgcatggtacctccacacctatcaatggttactgaatatatggaaatgggatcactgtactatctcatccatatgagtggtcagaaaaagaagctcagttggcgtaggagactgaagattattcgtgatatatgcaggggattgatgtgcatacaccggatgaagatagttcacagagacctgaaaagtgctaactgcctggtgaataagcattggactgtcaagatatgtgacttcggtctttctcgagcgatgacagatagtcctatgacggataactcctctgctggcacaccagaatggatggcccctgagctaataaggaatgaacccttctcagagaaatgtgacattttcagccttggtgtgataatgtgggagctgtgcacattgagtcgcccatgggatgggatctccccagttcaagtggtatacgcagttgctaatgaagggtcacggcttgaaatacctgaaggacctcttggcaagttaattgcagattgctgggcagaaccccaagatcggccgagctgccaggaaatacttacccgcttgctcgactgtgaatactctaccagctgagataaaactgacaaaactagttcgctccccgccacccagtgcgttcagaggtgggacagtttcttgtataaaacttgtaaaaatatagcctcttaatcttgcagaccggcttgaacttgtatactttggctgcatatcggcgatcgtttctttcaaaattgtaaagaaaaaacatgtttctccatttatagaagaatatcgaaggattgccaggtagtgcgtccacagatctgttgtttctttgtttgagaattttcctaggtacatctgattgaagcgacaactaagttgaacagatctttgttttgggggaaagagatctttatattactctaa

SEQ ID NO: 953 - DNA, 4014 bp, Oryza sativa
cccaacctccggccggccggttcgtcctccctgtagtctgcagtgctcaccgagtcactggcccgcgggtcgcaagccacagtagcctgccccagtgcgtaccgacgcctcccccaacagctggaggagccgtccgtccttccttccttccttccttccttccgtcgcagccagcattcttctcctctctcctctcactgacccgccccgcctccttctctcgccgcgctctcgttaagtttctctccggagtctcgaactctcaaccacttccctcctcgtcgtcgtcctcctcctcccactcccctgtccgcgtctcggctgactcggcgactgaccgcgcgccaccgccgctgacggctgagcacgccgcgcgccggcctaaccctggtcaagtggcgacgccgcgagcgacgggttcgtcgtggggtgtcgcacgtggcctcaccctccccggtcccttgaatcctctgcctccgcctccgccaccgcacctaccaacccacctaccgccaaatcgcgcgctgcgactgcgagcgatcgaggcggcctagcctgcggggggctgcctgggcgacgtgaccggcccgcgctcctctccgaatccgaagccgcagcgcagagcgcacgcctcctccccgccggaagcggagcaggacgcctcggaatcttcgccagcccgtgctccggtcggtcatcccatctgctggattgtcgtggagcggagcgtgagtggagtggagatccgtcccgaccgctcttccgtgtcgatacagactagtttgatcagtggtggtgttaaatacgaagtttttatcatataacatttggaaacatgcataaggggactctcacgtcttggaaatgagtaattccattatctgaaaaatggacgatacaccaactagttcggggaaatccgaagtgaattcatgtgaaccgagttggtggccaccagactttttggcaaagatagaatctgtttccttatctagaaaacaaagtgtattttctgataaagaacctcgaagcaatttgcgatcctcatcatggaaggcttctcaattactgtggtcaacagggacttattcagggttcatccctaatggtttctactcaataattccggataaaaagctgaaggaaaatttcccaacaataccatcattggatgaccttcaaactcttgaagcagatggacttaaggctgacataattattgtggacgttgagagagataagaagcttttcatgttgaaacagcttagtggcgcacttgtgaaaggattaaactctagtccagctttggtgataaagaaaatagctggcttggtttttgactgcttcaagagcctagatcctgatgtaagtcctgcaagatctccaactgaagataatcatttctttggaaacaaagggtcacaacttctagggcagataaagcatggatcatgccgaccccgagctatcctgtttaaggttcttgcagatgctgttggtcttgagagtaaacttgtagtgggtctacctgatgatggtggagttggatttgtggattcctacaaacacatgtccgtggttgtttcactgaactctatggaactgctagttgatcttatgcgatttccagggcaattaatcccgttctcagccaaggctatctttatatcgcatatctctgctgctggcgagagtgattcagccgaaaatgactcatgtgattcccctcttgagcccaacagtcctctgtatggattatcagataaagttgaagctgaaggaattgaagcttcatcaaatctatctgggcgttcattgcgcaatgttatgttgaggtcaagaacattttccgaggggaaattgagcacatcatgcagcgagccaaatattgcaaatgccttttggaggcgaagccagagaagaggagttgctgaagaacctcgcggtgctagttcaagccctgagcatccattaatgaagacaagggcaagatctatactaggtggcgagcaacattcatttcaggaatatgcagaaagtggagttacatcaagatcagatggtctaggtggtgcatcaacatctaaaactcgaagaatacggggaagaagcattagcatcacgcctgagattggagatgacattgtgagggcggttcgggctatgaatgaaacactaaagcaaaatcgcctccaaagggaccatgttaatgaaggttcaccctcgtatgttggggaggaccaaaacaatgcaagtgattgcccaaataatgatgatacatctggaggagttgttgctaccaacaatggcccaaggaaccgaaatggttccactcagaaagctatgtcattgccttcttctcctcatgaatatagggcgcaaatttctgaaacaatcaatccttgtgattttgtaagtaaagaaaagatggtattggcgtggaacaaggttttgcagagttccccatttctcaataaacctttattgccctttgaagagtggaacatagatttctctgagctaacaattggcacaagggttggaataggattctttggagaggttttccgtggtatatggaatggcactgatgttgctatcaaagtatttctagagcaggatctgacaactgaaaacatggaggatttttgcaatgagatatatatcctgagccggctgcggcatccaaatgttatattgtttcttggggcatgcatggtaccaccacacttgtcaatggtaacagaatatatggaaatgggatcgctgtactatctcatccatatgagtggtcagaaaaagaagctcagttggcgtaggaggttgaaaattgtccgtgatatctgcaggggtttgatgtgcatacaccgcatgaagatagttcacagggacctgaaaagtgcaaattgcctggtgaataagcattggaccgtcaagatatgtgatttcggcctttcccgagtgatgactgatagtcctatgactgacaactcctctgctggcaccccagaatggatggcccctgagcttataaggaacgaaccctttacagagaaatgtgatattttcagccttggtgtgatcatgtgggagctatgcacattgagtcgtccttgggatgggatctccccagttcaagtggtatatactgttgcaaacgaaggttcacggctcgagattcctgaaggacctcttggcaagttaattgcagattgttgggcagagccccaagatcggccgagctgtcaggagatccttacccgcttgctcgactgcgaatatgccgtcagctgaagtcaagctgacgaaccagctcactccttgcctgcagaggccgataagtttctcctgtaaaacctgtaaaaattagcctgtggattttgcaaaccggcgagggtacacatattgacttcttatattgcggctgtataaccgcgaaccttcatgaatgtacaaaaagaatgtgtctccgcttatagaagaacatgccttgaatcgcaggactagttttgctgtcatacttcatcaggaccgttgcgtgtcctcggatctatcatttgtttctctgaaagttttggccggggtactcggtaaaagttgacatttgagatcttccttgagatgcaaccaaattgagcagagtacctgtgttttctgactttattattgatctgaatgtactgctcagtacagtacccacggtttgatgatccaagcttatctgcttatcgcctgtgctccataccaaagttgccaggaatgtagagatatgttacgaggatcgcaatatatttgaggccatatctgaaaagcgaaaattttttatgttcctctatgcgaatcaaatcattttctatgaaattttcacccttgaaactttttctacgaaattttacaaaattcacaagaaatcctcctgttcccgactgaactgggttttaggatctcgatgacttcgtctcaaccgggagaaccagcaaactccacccgaaacacctcgctcaaaaaaaaaaa

SEQ ID NO: 954 - DNA, 2954 bp, Setaria italica
aaatacgaggctggatctagatcacagaatgcatggcgttatgcaccaattgcacacattccacagatagtccccggtcaaagatgccttaaaattgactccatgttttgacaaaatgaacagtacccaattcccttatagtgtactaggaatctagatatgagctaaattggtcagtggtcctattgaatatggttcccataggttgggtttaaggagcttcactgtctgagaaatggatgaaacaccaactagttccgggcaatctgaagctagttcaagtgaacctagttggtggcccccagactttttggagaaaatagagtctgcttccatatcgaggaaacaggatgttttgggtaatctaaggacctcatcctggaaggcttctcaattactgtggtcccaaggatcttactcagggttaatcccgaatggtttctactcaatcatcccggataaaaagttgaaggagactttcccaaacattccgtcactagatgacctgcaagctcttgaagcggatgggcttaaggctgacataattattgtagacaccgagagggataagaaggttttcatgttgaagcagcttagtgctgcacttgtgaaagggttaaactctagcccagcattggtgataaagaaaatagcaggtttggtttttgactgcttcaagagacaaaatgttgattctagtccagcaagaggctcgactgaagatacccatttctttggaaataaaggaccacaacttctagggcagataagacatgggtcatgccgaccccgagctattctatttaaagttcttgcagatgctgttggccttgagagtaaacttgtagtgggtctacctgatgatggtgctgttggatttgtggactcttacaaacatatgtctgtggtagtttcactgaactctatggagctgctagttgatcttatgcgatttccaggccagttgattcctttttcagctaaggctatctttatatcacatatctctgctgcgggtgaaagcgactcagctgaaaatgattcgtgtgattctcctcttgagcctaacagccctctttatggattgtctgataaagttgaagctgaaggaattgaatcttcatcaaatctatctggacgctcattgcgtaatatgatgttgagatcaagaacattttcagagggaaaattaagcacgtcatgcagtgaaccaaatatagcaaatgccttttggaggcgcagccaaaggaaaggagttgctgaagaatcccgtggtgctagttcaagtccggagcatccattaatgagagcaaggggaagatctatacttggcggtgagaagcaaccatttcaagaatacacagaaagtggatctgcatcaagatcagatggtcttagtggcacttcaacatctaatgctcgaagaataagacgaagaagcattagcatcacacctgagattggagatgacattgtgagggcagttcgggctatgaatgaaacactaaagcaaaatcgcctccaaagggatcatgttgaaggttcatgctcatatgttacggaggaccaaaacaatgcaaatgactgcccaaatgatgatgatgcgtctcgaagagtcggtgctactgacaatggctcaagaaaccgaactggttctactcagaaggccatgtcattaccttcgtcgccacatgaatataggggtcaagttactgaaaagaatgacgattttatgagtaaagagaagatggcactggcatggaacaaagtattccagagctctccatttcttaataagccgttattgccttttgaggaatggaacatagatttctccgagataaccattggcacacgggttggaataggattctttggagaggttttccgtggtatatggaacggaaccgatgttgccatcaaagtgtttctagaacaagatctaacaactgaaaatatggaagatttttgcaatgagatatacatcctgagtcggctacgacacccgaatgttatattgtttcttggtgcatgcattacgcctccacacctgtcaatggttactgaatatatggagatgggatcactgtactatctcatccatatgagtggtcagaaaaagaagctcagttggcgtaggaggttgaaaattattcgagatatatgcaggggattgatgtgcatacaccgcatgaagatagttcacagggatctcaaaagtgcaaactgcctggtgaacaagcattggactgtcaagatatgtgacttcggtctatctcgagtgatgattgatagtcctatgactgataactcctctgctggcaccccagaatggatggcccctgagcttatccggaatgaacctttcacagagaaatgtgatatatttagccttggtgttatcatgtgggagctgtgcacattgagtcgcccgtgggagggcatctctccagttcaagtagtttacgcggtagctaatgaaggatcacgtctcgagattcctgaaggacctctcggcaggttaattgcagattgctgggcagagcctgataatcggccgagctgccaggagatcctcacccgcttgctggactgcgaatacgctgtcagctgaagtggaagctgtcccgctgaagttgctttgctcacacgccacccgattcctgcagaggtggacacgttttcttgtataaaacctgtaaaaattagccagtcgactctgcgggccggcgaggttactcatactgaagtcttatattcctgctttatgacggcgatcctttctcccaaaatgtaaaaaatgtttccccggttatataagaacatgtctggccaagaaatgcacctcgcgtgtcgcggggacaagcctggttgctgttatgccgtacctgttctggaatctggataattgcacgtcctcgggagtctgggtcaaccattcggtagtttccaag

SEQ ID NO: 955 - DNA, 3284 bp, Sorghum bicolor
tctccctccttccctcgctccagcgagtaccgacgcctcccacagctggagaccgtactttactggcagtaatcttcccacccgcctcggcgcctcctccctccctctctcccaacctcgcccgctctcgcctcgctgttctcctctgtcacctctcccggagaagcgtggctcctgcagccggcctcccacgtcccacctgcacctcctccgcgcgccgagcaccacacgacgcgacccggccgagcacggccgctccgccagtccgctgcttccgcggcgccgccgctccactctcgtgctgcagctagcggaacggagatccgtggggacatgagccagggtttctcctctctgtcggtatgaactaaatttatcaatggtcctattgaatacggagctacaattatatgtcatattctgtcatgcaaatgatggtggctgtaagttgtgagtaaggaactccattgtctgagaaatggatgaaacaccaactagttctgggcaatccgaagctagttcatgtgagcctaattggtggccagcagacttattagagaagatagagtctgcttccatatcaaggaaacaggatgttttgggtaatctaaggtcctcatcctggaaggcttctcaattactgtggtcaacaggatcttattcagggttaatccctaatggtttctattcaatcatcccggataaaaagttgaaggagactttcccaacagttccatcactagatgacttgcaaactctagaagcagatgggcttaaggctgatgtaattattgtagacactgagagggataagaagattttcatgttgaagcagcttagtgctgcacttgtgaaagggttaagctctagcccagcattagtgataaagaaaatagcaggtttggtttttgactgcttcaagcgacaaaatcctgatgccagtccagcaagaggctcgattgaagatacccatttctttggaaataaaggaccacaacttctagggcagataagacatggatcatgccgaccccgagctattctatttaaagttcttgcagatgccgttggccttgagagtaaacttgtagttggtctacctgatgacggtgctgttggatttgtggactcttacaaacatatgtctgtggtagtttcgctaaactctatggaactgctagtggatcttatgcgatttccaggccagttgattccgttttcagctaaggctatctttatatcgcatatatctgctgcgggtgaaagtgactcagctgaaaatgactcctgtgattctccccttgagcccaacagccctctttatggattgtctgataaagttgaagctgaaggaattgaatcttcatcaaatctgtctggacgatcactgcgtaatatgatgttgagatcaaggacattttctgaggggaaattaagcacgtcatgtagcgaaccaaatatagcaaatgccttttggaggcgcagccaaaggagaggagttgctgaggaaccccgtggtgctagttccagtcctgagcatccattaatgagagcaaggggaagatctatacttggtggtgagaagcaatcatttcaagaatacacagaatctggagctgcttcaagatcagatggtcttgagggcacttcaacctctaatgctcgaagaataaggcgaagaagcattagcatcacccctgagattggagatgacattgtgagggcagttcgggctatgaacgaaacactaaagcaaaatcgcctccaaagggatcatgtcgaaggttcatgctcatatgttacggaagaccaaagcaacgccaatgattgcccaaataatgatgatgcatctcggagaattggtgctactgacagtgactcaagaaaccgaactggttctactcagaaggccatgtcattgccttcttcacctcatgaatataggggtcaagttacccaaaaaagtgatgattttataagtaaagagaagatggcattggcatggaacaaagttttccagagctccccatttcttaataagcctttgctgccgtttgaggaatggaacatagatttttccgagataacaattggcacgagggttggaataggattcttcggagaagttttccgtggtatttggaatggaactgatgttgccatcaaagtgtttctagagcaggatctgacaactgaaaacatggaagatttttgcaatgagatatacatcttgagccggttacgacacccaaatgttatattgtttcttggtgcatgcattacacctccacacttgtcaatggttactgaatatatggaaatgggatcactatactatctcatccatatgagtggtcagaaaaagaaactaagttggcgtaggaggttgaaaattattcgcgatatatgcaggggattgatgtgcatacaccgcatgaagatagttcacagggatctcaaaagtgcaaactgcctggtgaacaagcattggactgtcaagatctgtgactttggtctatctcgagtgatgattgatagtcctatgactgataattcctctgctggcaccccagaatggatggcccctgagcttatacggaatgaaccttttacagagaaatgtgatatattcagccttggtgttatcatgtgggagctgtgcacattgagtcgcccatgggaaggcatctccccagttcaagtggtgtacgcagttgctaatgaagggtcacggcttgagattcctgaaggacctctcggcagattaattgcagattgctgggcagagcctgagaatcggccgagctgccaggagatcctaacccgtttgctggactgcgaatacactgtcagctgaatggaagctgcttgctcagccacccaattcctgcacaggtgaaaacatttcttgtataaaacctgtaaaaaaaaggctgccgattctgcggactcgaggtcacatattgaagccctgtgtttttttttgcaacgacgaccctttctcccaaaaatgtaaaaaattcttcccggttatagaagaacatgtctggttcgagaaacgtgccttgcatcgcagggcaagctggttgttgtaccttattctagataagtagcatgccctcgaatcaacaagtgattgttccgaagaatgttgccggtactctggggaatatggtaaggaagtgcatggtgcgaactgctccctctcgcccaaaactaatgccatgccatcctagattttgattgaataaaatattatcaaaatttatatctctaattaggtt

SEQ ID NO: 956 - DNA, 3286 bp, Zea mays
cgacgcctcccacagctggagaccgtactttactggcactggcagtaatcttcccacccgcctcggcgcctcctccctctctcccaacatcgcccgctctctcctcgctgttctccgctgtcatctcccccggagaagcgtggctcctgtagccggcctcctacctgcccctcctccgcgcgccgagcaccagacgacgcgacacggccgagcacggtcgctgcttccgcggcggcgccgctccactctcgtgctgcagctagcggaacagagatccgtggggacatgaacagggtttctcctctctgttggtatgaactaaattgatcgatggtcctattgaatatagagctactattatatggcatattctgtcatgcaaatgatggtggttgtaagttgtgattgaggaactccattgtttgagaaatggatgaaacaccaactagttctgggcaatctgaagatagttcatgtgaacctaattggtggccaccagacttattagagaagatagagtctgcttccatatcaaggaaacatgatgttttgggtaatctaaggtcctcatcctggaaggcatcacaattactgtggtcaacaggatcttattcagggttaatccctaatggtttctattcaatcatcccggataaaaagttgaaggagactttcccaacaattccatcggtagatgacctgcaaactcttgaagcagatgggcttaaggctgacataattattgtagacactgagagggataagaaggttttcatgttgaagcagcttagtgctgcacttgtgaaagggttaagctctagcccagcattagtgataaagaaaatagcaggtttggtttttgactgcttcaagcgacaaaatcctgacgccagtccagcaaaaggctcgattgaagatactcatttctttggatataaaggaccacaacttctagggcagataagacatggatcatgccgacctcgagctattctatttaaagttcttgcagatgctgttggccttgagagtaaacttgtagttggtctacctgatgacggtgccgttggatttgtggactcctacaaacatatgtctgtggtagtttcgctaaactctatggaactgctagtggatcttatgcgatttccaggccagttgattccattttcagctaaggctatctttatatcgcatatatctgctgcgggtgaaagtgactcagctgaaaatgactcctgtgattctccccttgagcccaacagccctctgtatggattgtctgataaagttgaaactgaaggaattgaatcttcatcaaatctatctggacgatcactgcgtaatatgatgttgagatcaaggacattttctgaggggaaattaagcacgtcatgtagtgaaccgaatatagcgaatgccttttggaggcacagtcaaaggagaggagttgccgaggaaccccgtggtgctagttccagtcctgagcatccattaatgagagcaaggggaagatctatacttggtggtgagaagcaatcatttcaagaatacacagaatctggagctgcttcaagatcagatggtcttgggggcacttcaacctctaatgctcgaagaataaggcgtagaagcattagcatcacccctgagattggagatgacattgtgagggcagttcgggctatgaacgaaacactaaagcaaaatcgccttcaaagggatcatgtcgaaggttcatgctcatatgttacggaagaccaaagcaacgccaatgactgcccaaataaagatgatgcatctcggataattggtgctactgacagtgactcaagaaaccgaactggtcctactcaaaaggccatgtcattgccttcttcgcctcatgaatataggggtcaagatacccaaaaaggtgatgattttataagtaaagagaagatggcattggcatggaacaaagttttccagagctccccatttcttaacaagcccttgctgccgtttgaggaatggaacatagatttctctgagataacaattggcacgcgggttggaataggattcttcggagaagttttccgtggtatatggaatggaaccgatgttgccatcaaagtatttctagaacaggacttgacaactgaaaacatggaagatttttgcaacgagatatacatcctgagccggttgcgacatccaaacgttatattgtttcttggtgcatgcattacacctccacacttgtcaatggttactgaatatatggaaatgggatcactgtattatctcatccatatgagtggtcagaaaaagaaacttagttggcgtaggaggttgaaaattattcgtgatatatgcagggggttgatgtgcatacaccgcatgaagatagttcacagggatctcaaaagtgcaaactgcctggtgaacaaacattggactgttaagatatgtgactttggtctatctcgagtgatgattgatagtcctatgactgataattcctctgctggcaccccggaatggatggcccctgagcttatacggaatgaaccttttacagagaaatgtgatatattcagccttggtgttatcatgtgggagctgtgcacattgagtcgcccatgggaaggcatctccccagttcaagtggtgtacgcagttgctaatgaaggttcgcggcttgagattcctgaaggacctctcggcaggttgattgcagattgctgggcagagcctgagaatcggccgagctgccaggagatcctaacccgtttgctggactgcgaatacactgtcagctgaaatggaagctgctcgctcgtccactcaattcctgcacaggtggaaacatttcttgtataaaacctgtaaaaaaggctgccgattctgcggacttgaggtcacatatcgaagcgctgtgtttttttttaaacaatggcgaccctttctcaaaaaaaatgtaaaaatgattccctggttatagaagaacatgtctgattcgatagacgtgccttgcatcgcagggcaagctggttgttgtaccttattctagataagtagcacgcccgcgaatgctgttcggctttcaaatagctgcagctgcaaatttttacctgttgctacagtatttcctttctatataaccaggcggcagcagcagccgaatgttgccagtacgttggagatggcataagcaactccatgttgtgaactgttccctcgcgaccataaagaacatgccatcctagatttggaataaaaatattgtcaaaatttgtat

SEQ ID NO: 957 - DNA, 3257 bp, Zea mays
gtaatcttcccacctgcctcggcgcctcctccctctctcccaacctcgcccgttctcgcctcgctgttctcctctgtcacctctccctgagaagcgtggctcctgcaaccggcctccccacctgctcctcctctacgcgccgagcaccacacgacgcgacacaaccgagcacggccgctccgccactccactgcttccgcggtggcgccgcttcactcccgtgctgcagcgagcgttacggagatccgtggggacatgaaccagggtttctcctatctgttggtgaacataaagctggatccagaccacagaatgcatgatattatgcaccattgcacacgtccccagagagttcagagttcccagtcatagatgccttttactgcgtgtcttgacaaaatgaacagtacccagtgcccttgaaatgtgctaggaatataaagatatgaactaaatttatcagtggtcctattgaatatggagctactgttatatgtcattgtctcatgcaaatgatggtggctgtaagttgtgattgaggaactccattgtctgagaaatggatgaaacaccaactagttctgggcaatctgaagctagttcatgtgaacctaattggtggcctccagacttcttggagaagatacagtctgcttccataccaaggaaacatgatgttttgggtaatcaaagttcctcatcctggaaggcttctcaattactgtggtcaacaggatcttattcagggttaatccctaatggtttctattcaatcatcccggataaaaagttgaaggagactttcccaactattccatcactagatgacttgcaaactcttgaagcagatgggcttaaggctgacataattattgtagacactgagagggataagaaggttttcatgttgaagcagcttagtgctgcacttgtgaaagggttaagctctagcccagcattagtgataaagaaaattgcaggattggtctttgactgcttcaagcgccaaattcccgatgccagtccaactagaggctcgattgaagatacccatttctttggaaataaaggaccacaacttctggggcagataagacatggatcgtgccgaccccgagctattctatttaaagttcttgcagatgccgttggccttgagagtaaacttgtagttggtctaccagatgacggtgctgttggatttgtggactcttacaaacatatgtctgtggtagtttcactaaactctatggtgcttcttgtggatcttatgcgatttccaggccagctgattccgttttcagctaaggctatatttatatcgcacatatctgctgcgggtgaaagcgactcagctgaaaatgactcttgtgattctcctcttgagcccaacagcccactttatggattgtctgataaagttgaagttgaaggaattgaatcttcatcatatctatctggacgatcactgcgtaatatgatgttgagatcaaggacattctctgaggggaaattaagcacgtcatgtagtgaaccaaatatagcaaatgccttttggaggcgcagccaaaggagagttgccgaggaaccccgtggtgctagttccagccctgagcatccattaatgagagcaaggggaagatctatacttggtagtgagaagcaatcatttcaagaatacacagaatctggagctgcttcaagatcagatggtcttgggggcccttcaacctctaatgctcgaagaataaggcgaagaagcattagcattacacctgagattggagatgacatcgtgagggcagttcgggctatgaacgaaacactaaagcaaaatcgcctccaaagggatcatgtcgaaggttcatgctcatatgttatggaagatcaaagcaacaccaatgactgcccaaataaagatgatgcatcttggagaattggtgctactgacagtgactcaagaaaccgaactggttctactcagaaggccatgtcactaccttcttcgcctcatgaatatagaggtcaagttacccaaaaaagtgatgattttataagtaaagagaagatggcattggcatggaacaaagttttccagagctccccatttcttaataaggctttgctgccttttaaggaatggaacatagatttctccgagataacaattggcacgcgggttggaataggcaagattctttggagaagttttccgtggtatatggaatggaactgatgttgccatcaaagtgtttctagaacaggatttgacaactgaaaacatggaagatttttgcaacgagatatacatcctcagccggttacgacacccgaatgttatattgcttcttggtgcatgcattacacctccacacctgtcaatggttactgaatatatggaaatggggtcactgtactatctcattcatatgagtggtcagaaaaagaaacttagttggcgtaggaagttgaaaattattcgtgatatatgcaggggattgatgtgcatacaccgcatcaagatagttcacagggatctcaaaagtgcaaactgcctggtcaataagcattggactgtcaagatatgtgactttggtctatctcgactgatgattgatagtcctatgaccgataattcctctgctggcaccccggaatggatggcccctgaacttatacgtaatgaacctttcacagagaaatgtgatatattcagccttggtgttatcatgtgggagctgtgcacattgagtcgcccatgggaaggcatctccccagttcaagtggtgtattcagttgctaatgaagggtcacggcttgagattccggaaggacccctcggcaggttaatcgcagattgctggtctgagcctgagaatcgaccgagctgccaggagatcctaacccgtctgctagactgcgaatatactgttagctaaaatggaagctgcatgctcgttcacccaattcctgcacaggtgagaatatttcttgtataaaacctataaaaaaagcctgccgattctgcggacttgaggtcacatattgaagccctgttcttttttttttacaacggcgaccttttctctcaaaaatgtaaaaaaatgcttccccggttatagaagaacatattctggcccagaaatgtgccttatcgcagggcaagctaattctagataattagcatgccctcgaattaaccaagtgtttgttccgaagaatgttgccagtttgccattaccctgtggaatatggta

SEQ ID NO: 958 - DNA, 1314 bp, Pseudoroegneria spicata
ggagaaagaaagggcgaggttgcgtcccgctcatccacttggctctgctcgcatcttccttctcgattccgattccccttgccttgctaagggaagggaagggaagggatcccgacgacgatgggggaggacgggcagatccgccgcgacagggtcatcatcgacacggatcccggcatcgatgacagcatgacgatcctaatggcttttggagaaccaagtgtggagatcattgggctgacaaccatatttggcaatgtcactacagagtatgctacacgcaatgcgctcttgctgtgtgagagagcagggcatcctgaggttccagtagcagagggcagcccggagcctcttaagggaggagagccacgcgttgctgactttgttcatggatccgatggtcttggtaatttgtctcttcctgcacctactactaagaaggttgaggaaagtgctgccgagttcatggttaataaggtctctcagtttcctggagagatatctgtacttgcattgggacccctgacaaatgtcgcattggccatcaaaagggactcgtcatttgcaagcaaggtcaaaaaaatagttgtgctgggtggagctttcttcgcagctggaaatgtcaaccctgctgctgaagcaaatatctatggagatccggatgcagcggatgtagtttttacatcaggagcagatattgatgtggttggcattaacataacaactcaatgctgttttacagacgaggatctcttggaactgaaaaactcaaaagggttgcacgcacagttcttgtgtgacatgtgcaagttctacagagattggcatgcgaagtctgacggcttccatgggattttcctacatgatcctgtgagctttacagccttagttcatcctgagtacttcacattcaagaagggtgttgtgagagttgagacccagggcatttgcaccggccatactttgatggatcatggattgaaaaagtggaattcagaaaatccatggtcgggctatgcaccaatttcagttgcatggacagtcgatgtgccaaaggtccttgcatatgtgaagaagctgctgatggcgccctgagaatagaaccagaggtctattctgactctttgagctgaagtgtaatggttcagatcaactctcatggccaaagcatattttttttctgtttttagaagcaagcataggaggaagggaagcttcctagtgcaaatcaaactatggggtaaattctgcacatgacagacacaattgtgacaacattgattccaaacatttatatataccaagtacatttca

SEQ ID NO: 959 - DNA, 1437 bp, Secale cereale
accgccaagatctcatcttttctttcccttttccccagccccagcagcaagaggaacgaacttggcgctcctgacacccccgtttacccccaaccatcatctataaaattccggggaggcgagtctggttggaaaaaggaggacagtctggagaaaaagaaagggcgaggtatccacttggctctgctcgcatcttccttgtcgattccattccgacccccttgctaagggaagggaagcggaaggatccggacgacgatgggggaggacgggcagatccgccgcgacaggctcatcatcgacacggatcccggcatcgatgacagcatgacgatcctaatggcttttggagaaccaagtgtggagatcattgggctgacaaccatattcggcaacgtcactacagagtatgctacacgcaatgcgctcttgctgtgtgagagagcagggcatcctgaggttccagtagcagagggcagcctggagcctcttaagggaggagagccacgcgttgctgactttgttcatggatccgatggtcttggtaatttgtctcttcctgcacctaccactaagaaggttgaggaaagtgctgccgagttcatggttaataaggtctctcagtttcctggagagatatccgtacttgcattgggacccctgacgaatgtcgcattggccatcaaaagggactcgtcatttgcaagcaaggtcaaaaaaatagttgtgctgggtggagctttcttcgcagctggaaatgtcaaccccgccgctgaagcaaatatctatggagatccggatgcagcggatgtagtttttacatcaggagcagatattgatgtggttggcattaacataacaactcaatgctgttttacagatgaggatctcttggaactgaaaaactcaaaaggggtgcacgcacagttcttatgtgacatgtgcaagttctacagagattggcatgcgaagtctgacggcttccatgggattttcctacatgatcctgtgagctttacagccttagttcaccccgagtacttcacattcaagaaaggtgttgtgagagtcgagacccagggcatttgcaccggccatactttgatggatcatggattgaaaaagtggaattcagaaaatccatggtcgggttatgcaccaatttcagttgcatggacagtcgatgtgccaaaggtccttgcatatgtgaagaagctgctgatggcgccctgagaatagaaccagaggtctattctgactctttgagctgaagtgtaatggttcaggtcaactctcatggccaaagcatattctttctgtttttagaagcaagcataggaggaagagaagcttcctagtgcaaagcaaactatgggtaaattctgcatatgacagacagcattgtgacaacattgcctccaaatatttatatatacc

SEQ ID NO: 960 - DNA, 1694 bp, Triticum aestivum
aggttgcgtcccgctcatccacttggctctgctcgcatcttccttccttgtcgattccgattcccctcgctagctaagggaagggaagggaagggaagggatcccgacgacgatgggggaggacgggcagatccgccgcgacagggtcatcatcgacacggatcccggcatcgatgacagcatgacgatcctaatggcttttggagaaccaagtgtggagatcattgggctgacaaccatatttggcaacgtcactaccgagtatgctacacgcaatgcgctcttgctgtgtgagagagcagggcatcctgaggttccagtagcagagggcagcccggagcctcttaagggaggagagccacgcgttgctgactttgttcatggatccgatggtcttggtaacttgtctcttcctgcacctactactaagaaggttgaggaaagtgctgccgagttcatggttaataaggtctctcagtttcctggagagatatctgtacttgcattgggacccctgacaaatgtcgcattggccatcaaaagggacccgtcatttgcaagcaaggtcaaaaaaatagtcgtgctgggtggagctttcttcgcagctggaaatgtcaaccctgctgctgaagcaaatatctatggagatccggatgcagcggatgtagtttttacatcaggagcagatattgatgtggttggcattaacataacaactcaatgctgttttacagatgaggatctcttggaactgaaaaactcaaaaggggtgcacgcacagttcttgtgtgacatgtgcaagttctacagagattggcatgagaagtctgacggcttccaagggattttcctacatgatcctgtgagctttacagccttagttcaccctgagtacttcacattcaagaagggtgttgtgagagtcgagacccagggcatttgcaccggccatactttgatggatcatggattgaagaagtggaattcagaaaatccatggtcgggttatgcaccaatttcagttgcatggacagtcgatgtgccaaaggtccttgcatatgtgaagaagctgctgatggcgccctgagaatagaaccagaggtctattctgactctttgagctgaagtgtaatggttcaggtcaactctcatggccaaagcattttttttttctgtttttagaagcaagcataggaggaagggaagcttcctagtgcaaatcaaactatggggtaaattctgcatatgacagcattgtgacaacattgattccaaatatttatatatactaagtacattacaaatttgggaaaaacttccccatactcgttgttgctttgtgcccgtctcatgtctttgtttagcaggcatatttgcacgtgtttagacaaatgaggaagatctatttgctcatgtttggtcatgtcgggctaaacctgacctgcccatgagaggtcgaaatgaacatgagttggcactacttcctacttgtaattgcctgcacattttaggcccttttttggaactgtttctgtgtgggaacgaaccgattgccatgcattattttgtaaaattcttgtgcttcaaacatgacatgaatacatagattttatcatcccagctcatttcaagacatgagcaaattacacaaacctgattacctgaacatactataattcaagaatacatgcttg

SEQ ID NO: 961 - DNA, 1849 bp, Triticum aestivum
ctctatcccatctaatccagatccgacggcctaggagacacggccacgctgatccgacgggcattccagcgcaagatctcatcttccttttccctaatccccagccccagcagcaagaggaaggaacttggcgctcctgacaccccctttacccccaaccttccgtgtttgcatcgtgtataaaagtccggggaagcgaggctcgttggaaaaagaaggacagtctggagaaagaaagaaagggcgaggttgcgtccgctcatccacttggctctgctcgcatcttccttgttgattcattccgattcccctcgctagctaagggaagggaagggaagggatcccgaggacgatgggggaggacgggcagatccgccgcgacagggtcatcatcgacacggatcccggcatcgatgatagcatgacgattctaatggcatttggagaaccaagtgtggagatcattgggctgacaaccatattcggcaatgtcactacagagtatgctacacgcaatgcgctcttgctgtgtgagagagcagggcatcctgaggttccagtagcagagggcagcccggagcctcttaagggaggagagccacgcgttgctgactttgttcatggatctgatggtcttggtaatttgtctcttcctgcacctactactaagaaggttgaggaaagtgctgccgagttcatggttaataaggtctctcagtttcctggagagatatctgtacttgcattgggacccctgacaaatgtcgcattggccatcaaaagggactcgtcatttgcaagcaaggtcaaaaaaatagttgtgctgggtggagctttctttgcagctggaaatgtcaaccctgctgctgaagcaaatatctacggagatccggatgcagcggatgtagtttttacatcaggagcagatattgatgtggttggcattaacataacaactcaatgctgttttacagatgaggatctcttggaactgaaaaactcaaaaggggtgcacacacagttcttgtgtgacatgtgcaagttctacagagattggcatgagaagtctgacggcttccaagggattttcctacatgatcctgtgagctttacagccttagttcaccctgagtacttcacattcaagaagggtgttgtgagagtcgagacccagggcatttgcaccggccatactttgatggaccatggattgaagaagtggaattcagaaaatccatggtcgggttatgcaccaatttcagttgcgtggacagtcgatgtgccaaaggtccttgcatatgtgaagaagctgctgatggcgccctgagaatagaaccagaggtctattctgactctttgagctgaagtgtaatggttcaggtcaactctcatggccaaagcattttttttcctgtttttagaagcaagcataggaggaagggaagcttcctagtgcaaatcaaactatggggtaaattctgcatatgacagcattgtgacaacattgattccaaatatctatatataccaagtacattacaaatttgggaaaaacttccccatactcgttgttgctttgtgcccgtctcatgtctttgtttagcaggcatatttgcacgtgtttagacaaatgaggaagatctatttgctcatgtttggtcatgtcgggctaaacctgatctgcccatgagaggtcgaactgaacatgagttggcactacttcctacttgtaattgcctgcacattttaggcccttttttggaactgtttctgtgtgggaacgaaccgattgccatgcattattttgtaaaattcttgtgcttcaaacatgacatgaatacatagattt

SEQ ID NO: 962 - DNA, 1256 bp, Triticum aestivum
gaaagaaagggcgaggttgcgtcccgctcatccacttggctctgctcgcatcttccttgtcgattccgattcccctcgctagctaagggaagggaagggaagggaagggatcccgacgacgatgggggaggatgggcagatccgccgcgacagggtcatcatcgacacggatcccggcatcgatgacagcatgacgatcctaatggcttttggagaaccaagtgtggagatcattgggctgacaaccatattcggcaatgtcgctacagagtatgctacacgcaatgcgctcttgctgtgtgagagagcagggcatcctgaggttccagtagcagagggcagcccggagcctcttaagggaggagagccacgcgttgctgactttgttcatggatccgatggtcttggtaatttgtctcttcctgcacctactactaagaaggttgaggaaagtgctgccgagttcatggttaataaggtctctcagtttcctggagagatatctgtacttgcattgggacccctgacaaatgtcgcattggccatcaaaagggactcgtcatttgcatgcaaggtcaaaaaatagttgtgctgggtggagctttcttcgcagctggaaatgtcaaccctgctgctgaagctaatatctatggagatccggatgcagcggatgtagtttttacatcaggagcagatattgatgtggttggcattaacataacaactcaatgctgttttacagatgaggatctcttggaactgaaaaactcaaaaggggtgcacgcacagttcttgtgtgacatgtgcaagttctacagagattggcatgagaagtctgacggcttccaagggattttcctacatgatccagtgagctttacagccttagttcaccccgagtacttcacattcaagaagggtgttgtgagagtcgagactcagggcatttgcaccggccatactttgatggaccatggattgaagaagtggaattcagaaaatccatggtctggttatgcaccaatttcagttgcatggacagtcgatgtgccaaaggtccttgcatatgtgaagaagctgctgatggcgccctgagaatagaaccagaggtctattctgactctttgagctgaagtgtgatgcttcaggtcaactctcatggccaaatcttttttttttcttgtttagaagcaagcagtaggaggaagagaagcttcctagtgacaaagacaactagtgggtaaattctgcatatg

SEQ ID NO: 963 - DNA, 1424 bp, Avena sativa
aaaggaaggaggttgcgtcccgctcgtctcactcatccacttgtctcgcctctggccggcccagccttgcggtgctcttccagattccgatcggagaggaacagggatccatccggcccggagagggatggggcaggacgggcagatccgccgcgacaggatcatcatcgacacggatcccggcatcgatgatagcatgacgatcctaatggcttttgaagaacccagtgtggagatcattgggctgacaaccatttttggcaatgtcactaccgagtatgctacacgcaacgctctcttgctgtgtgagagagcagggcatcctgaggttccagtagcagagggcagccctgagcctcttaagggaggaattccacgtgttgcagattttgttcatggatctgatggccttggtaatttgttccttcctgcacctactactaagaaggtcgaggaaagtgctgccgagttcttggttaataaggtctcccagtttcctggagagatctctgtactcgccttgggacccctgacgaacgtagcattggccatcaaaaaggactcttcctttgcaagcaaggtcaagaaaatagttgtactgggtggagctttcttcgcggctggaaatgtcaacccagccgctgaagcaaatatttatggagatccggatgcggcggacgtagtttttacctcaggagcagatattgatgtggttggcattaacataacaactcaagtctgctttaaagacgaggatctgttggagcttaaaaactacaaaagggaaggcatgcacaattcttgtgtgacatgtgcaagttctacagagattggcataccaagtctgacggcttccacgggattttcctccatgatcctgtgagctttacagccttagttcatcctgagtacttcacatttaagaagggtgtcgtgagggttgagacccagggcatttgcaccggacatactttgatggatcatggattgaaaaagtggaattcagaaaatccatggtcaggttatgcaccgatttcagtcgcatggacagtcgatctccccaaagtccttgcatacgtgaagaagctgctgatgagcgatgcgacgacaatttaacagatgttctctgagaacaagagatctgccctgactgtgttgagctgaagtgtcatggttcagatcaactctcacggtcaaagtaatctcttctgttcttagaagcaagcataggaagaaaaggaaagcttccttgtgaaaacaagcattgggggtaaattctgcatatgacagacagcattgtaacacattgttttcaaacatttataccaagtactacatttaaaatttggaaacaacttcccagtacgccttgttactctgtgcctgtcggtgagctctcatttctgtctttcgcgtttctgtcc

SEQ ID NO: 964 - DNA, 3710 bp, Brachypodium distachyon
tctcatcatcatcttcttgttgctataagacgacgagccaacgaacaggagaggggagctgacaagtcacccgccgcggaagccagtggaagagaggttgcttgcttcacgggccctgccgcttcctccggtcgcgcgcgatccgctccattggtccggaaatcgatcatggggcaggagggcgacgggcagatccgccgccgcgacagggtcatcgtcgacacggatcccggcatcgatgacagcatgacgatcctaatggcgttcgaagaaccaagcgtggaaatcatcgggctgacaaccatattcggcaatgtcaccacagagaacgctactcgcaacgcgctcttgctgtgtgagagagcaggacatcctgaggttccagtagccgagggcagccctgagcccctaaagggaggaattccacgcgtcgctgactttgttcatggatctgacggtcttggtaatttgtctctccctgcacctactactaagaaggttgaggaaaatgctgctgagttcatggttaacaaggtctccgagtttcctggagagatcactgtactcgcactgggacccctgacaaatgtagcattggctatcaaaagagacccttcttttgcaagcaaggtgaagagaatagttgtactgggtggagcgttcttcgctgctggaaatgtcaacccggccgctgaagcaaatatctatggagacccagatgcagctgacgtagttttcacctcaggagcagatatcgatgtggttggcattaacattacaactcaagtctgtcttacagatgaggatctgttagagctaaaaaactcaaaaggaaaacacgcacagttcttatgtgatatgtgcaagttctacagagattggcattataagtctgacggtttccaagggattttcctccatgaccctgtgagctttacagccttagttcatcctgagtacttcggattcaagaagggcgttgtgagagttgagacccagggcatttgcaccggccatactttgatggatcatggactgaaaaagtggaatacagaaaatccatggtcaggttacacgccgatttcagttggatggacagtcgatgtgccaaaggtcctcgcatacgtgaagaagctgctcgtgacaccctaagtaataccacgaccttttactgggtatcctccgagaacaagagaattattacgactgtttgagctgaagtgtaaaatgattcagatcaactctcacggtcaacataatattttctgtttttagaagcagaagcataggaggaaggggaagcttcctatcgaaaacaaacagtggggtacattctgcacatgacagacagcattatgacacattgctttcagaagtttataccgattaatttcaaatttggaaacaactttcctatacattactgtgtgcctatctctgaactgttattcctctgttccatctgcttgcctgttttttgtgcatgcttaggcgatgagaaagattaattgctcatgtttaacactaaacctgagctgccaatgggagatttttattacagtccattttcaagacatgaccaacttacagaaacctgaaaaacatattacacaagaatacattcttttaaatactgatcatgatatgggcttccccagactccaatacaataatccgatagcctagtcgacgcataaatactttcacttcttttttatcacatatccatatcggatgaacaaatagatttggcatttccaggacacgttttttcggctcttgtggagaaaatgaggtgtaaacgtaatgcaaagccctagatacacatcgcggcagcattttcttcacttgagcacatatttgaggacaccaggaatgtggatcttgtagaagtagtggttccagtcgacagtcttgggatcgaagttgaacaggtcgtcctcggggctcgtccgcgccattgtcaaccgcagccgctccaagttcatgtcgtcgaagcttccattcatttcattcattgatcagccagggttagttacttagctgttcatagttaaaaccaacgtagtaggaattagtaaactgcaattagttcatccttttagattaccatcctctgaagaaggcgaagggcccgtagacgtcgcagagatggatgacgaacttgtacttgcggctgaggtcttcgtagagctgcgagaagatcccgcagagcagcaggttcaccaggtgcaggatctgcatacatatgagagagagatcatcaaattcattcactctaagcaatggttcctccttccattcttatctgaactaatcatctgaagaaacagagcattgtatgtatcttcagaaacagagcattgtagtatatctgaagaaacagagcatcattataggtatctcaaacagagcattattatgtatctgaagaaacagagcaatgtactggtgttgaagaaggaggaagaaaaggtgacctcaagggggagcttgtacttgatgagcatgtagagatgaaagctagcaatggtcttgaagaagtacatctccttggtggggatgaccttcccgtccttgctcagccgcgggttctcgtagaagtggcggcggccggactcgtagagcacgccgtacagcgccgggttccgcagcgacgacgtggcgtggtacagcgccacctcctcctcccccggctccggcgagccctggccgccgtgcgccgccatgacggccatcatggcgttcaccaccatgtcccccgggatcacgtccatggtgccctccaggtccgccaggaagcacgtcaggttctgcttcgcgtacccgatgatgatcgtgtctatcgtcctgcagcgctccggcgagcaatcagatccccgtcagcgagcaattggatccgagaaattaggaatccggcgagcaattgaagcaagaaagaccccggcggcgaggaattacctggtgccttgcatccagccggggagggggtcgcggaggagggaggtgataatgctggggcgcatgatggcgacggcagcggcggggccggcgcggagctgggagaggagcatctcgcccatggccttggtgaatacgtacgtgttggaccaaccgaagtgccgcgaccgacggagccccagctccttcatcgccttccgctccgccttctcgtcgtctccgtctccggcgccggcagccgcgaggtccgccttgacgtcggcgaccagccgcagctcggcgtcgatgtccagccgcgtgccttcccgcagggtctcccctctcttgaacggccgctccatgatcagcccttccctgtcccccgccgcaaacgctgcatccatcggcgtccaacatttcttcagacattatttcactattatgccaatctgaagatacttgtcgatcaaaattgagttttttactcctatacatgaccagtgatcactgtgatttattgcaagtttgtgctggcttgtcgataacaattgtgtgttgaagactgtcatattttgggttttagactaagcagactacagtagcagagaacaggattcagatcctagtagagcttcacagtagttacctgtggagacatggaggaacattttgagattggtacatttgtgggcgaattcgcacagatgcttcactcccatgacattaacatccaaggagacatcatatctgcgaaaataaatgttaattat

SEQ ID NO: 965 - DNA, 1732 bp, Oryza sativa
cgctaatcaatccacgtgcatcgtgttcgaccgacgtcatcttgcctctcctcctcctcgtcgccatcgtcatcgccatcgtcgcggtctatatatggaggcgaggcgaggcgaggagatcggtgtcgtttgttgctgccagaaagaaagcccaagtctgagttggaacttacttggaagggagagtagtagaggttgcgtcctactgctacttcttcctcctcgatcttcctctacttgaggagagagagagagagagagagagagagagagagagagagagagagagttagttttgggtggatttgtgatggggtcgaacgagcagatccaccgggacaagctcatcatcgacacggatcccggcatcgatgatagcatgacaatccttatggcgttcagagctccaactgtggagatcatagggctcacaaccatatttggcaacaccaccacaaagaatgcgactcagaatgcgctcttgctgtgtgagagagcaggacatcctgaggttccagtagcagagggcagcgcagagcctctcaagggaggagagccacgtgttgctgactttgttcatgggtctgatggcctggggaatttgtttcttcctgcacccactagtaagaaggttgatgaaaatgctgctgagttcatggttaataaggtctctcaatttcctggagaagtttctatactcgcattgggacccctgacaaacgtggcgctggccatcaaaagggacccttcctttgcaagtaaggtgaagaaaatagttgtactgggtggtgctttctttgcggctggaaatgtcagcccagctgctgaagcaaatatatatggagatccagaagcagctgacatagtttttacctcaggagcagatgttgacgtggttggcattaacataacaactcaagtctgttttacagatgaggatctcctggagctaagaaactcaaaagggaagcatgcacagttcttatgtgacatgtgccagttctatagagactggcatgccgaatccgatggctttcatggaattttcctccatgatcctgtgagcttcactgccctagttcaccctgagtacttcacgttcaagaagggtgttgtgagagtagaaacccagggcatttgcactggtcacactttaatggaccaaggattgaaaaagtggaattcagagaatccatggtctggctacaagccaatctcagttgcatggacagttgatgtgccaaatgttctcgcattcgtgaaggaactcctcatggctccatgagcgattttacgcctatttcttgtgcttttggatacacaagcaaatttgacaaatacagagttgtgattagatcctggaaaccggaagctttctattcccctatgaataagaagatatggttgttttgatttcttgagttcaagtctggtggctcaaaacaacctggttccacctaagaacagaataaggactggtttgttctgggctagtaggcatcagacctgaggaccaaaacaatctgttatcttattatatgtaataggaggattagaagtttgcttcctagctacaagcaaaatatatgtagtaaattgaaattctgcatacgaaagacagcattattacaaactgtttcagacatttgtgccacagatatacatttcaaattcggaaatcagtttgccactcgccgtgttactgtgtgctaattgtgtcacaactctctcg

SEQ ID NO: 966 - DNA, 1761 bp, Setaria italica
atatggtgcagtaaacatgtgctaatgataaattaattaagcttaatagattcatcgtgaattagcctccacctatataattagtttttataactaacttaggtttagttctcctaattaactttcgaatattcgatttgatataaattttagtccaccccaagaaccgaacacccccttccttgtctcgtctcatctcgtctataaggcctcctgctcctgacaagaagaggaggaaggccaaaaggaagccaaaaggccaggccaaaaggcagaatccgcgagacgagacaccgagagagagagagagaaagcaggagggagagaggttgcgtccctccacttgccatctcctctcccgcttcggcgctcttcttcgtcttcctcttcctccgcttgcgaagggctctccagattcagattggggcggcgtttgcagtaccagtgctgcgtgctgctgctcctgacgacgacgaggagagggcgctcgggatggggcaggacggccaccagatccgcggcaacaagctcatcatcgacacggatcccggcatcgatgatagcatgacaatcctaatggcgttcagaacaccaagcgtggaaatcattgggttgacgaccatatttggcaacgtcagcacggagggtgcaacgcgtaatgcactgttgctgtgtgagagagcagggcatcctgaagttccagtagctgagggcagccctgagcccctaaagggaggaaagcctcgtattgctgattttgttcatgggtcagatggcattgggaatatgtttcttcctgaacccacttctaagaaagttgaggaaagtgctgctgagttcctggtcaataaggtctctgagtttccaggagaggtctcagtacttgctttggggcccctgacaaatgtagcattggctatcaaaagagacccatcttttgcaagcaaggtgaagaaaatagttgtactgggtggagctttcttcgcggcaggaaatgtcaaccctgcagctgaagcaaatatccatggagatccagaagcagctgacattgtttttacctcaggagcagatattgtcgtggttggcattaacataacaactcaagtctgcttgaaagatgaggatctcttggagctaagaaactcgaaagggaagcacgcacagttcttatctgagatgtgcaagttttacagggattggcatgccaagtctgatggtttccacggaattttccttcatgatcctgtgagcttcacggccctagttcaccctgagtacttcaccttcaagaagggtgtggtgagagtagagacccagggcatttgcactggccacactttgatggatcagggattgaaaaagtggaattcagagaacccatggtcaggctataaaccgatttcggttgcatggatggtcgatgtgccaaaggttatcagcttcataaagaagctgctcatggcaccatgagaaattgcaaccattcaacaacctctggcgctttctgatgtccacgaaaatttgaccaagtacagagcctctatcccagctaccttgtaagttgtaactagttcctggacataggaagctttcttcagtgtcctgagaaacataggaagcttccttgtgaaaggttacgcaacagcctcagaaaccacggagtaaattctgcatatgacagcattgtttcacacatttgtatcagtacattcgagaatgaaatgaagtttcccgcatacgcctccttaccgcatacttttc

SEQ ID NO: 967 - DNA, 1455 bp, Panicum virgatum
ccagagagagagagagagagagagagagagagagagagagagagcgtccctccacttgccgtctccctctcccgcttcgcgctcttcgtcatcttcctcttcctccgcttgggggctgggctctccactccagggttcggttcagattcagattggggcgccgccgcagtcctaccgtgctgctctccctcaccacgacgaggatggggcaggacggccaccagatccgccgccacaagctcatcatcgacacggatcccggcatcgatgatagcatggcaatcctaatggcgttcagagaaccaagcgtggaaatcattgggttgacgaccatatttggcaacgttagcacggagggtgcaacacgtaatgcgctgttgctgtgtgagagagcagggcattctgaagttccagtagcagagggaagccctgagcccctaaagggaggaaaaccccgtattgctgattttgttcatgggtcagatggcattgggaatctgtttgttcctgaacccactactaggaaggttgaggaaagtgctgctgagttcttggtcaataaggtctctgagtttcctggagaggtctctgtactcgctttggggcccctgacaaatgtagcattggctgtcaaaagagacccttcctttgcaagcaaggtgaagaaaatagttgtactaggtggagctttctttgcggcaggaaatgtcaaccctgcagccgaagcaaatatccatggagatccagaagcagctgatatagtttttacctcaggagcagatattgttgtggttggcattaacataacgactcaagtctgctttacagatgaggatctcttggagctaagaaactcgaaagcgaagcatgcacagttcttgtccgatatgtgcaagttctacagggattggcatgccaagtctgatggtttccacggaattttccttcatgatcctgtgagcttcacggctctagttcatcctgagtacttcacgttcaagaagggtgtggtgagagtggagacccagggcatttgcactggtcacactttaatggatcagggattgaaaaagtggaattcagagaatccatggtcaggctataaaccgatttcagtcgcatggactgtggatgtgccgaaggttatcagctttataaagaagctgctcatggcaccatgagaaactgcaaccatttaaacatgccctcgctttctaatgtccaagaaaatttgacaaatacagacagagccctctatcccagctgccttgtaattagttgctggacagcaggaagctttcttcagtgttctgagaaacatgggaagcttccttgtgaaaggttattgaaagtaaattctgcataggacagcattgttccacattgtttcacatatttgtaccattaatacattcgagtatgaaatgaagtttcccgtatgcaccgcatactttt

SEQ ID NO: 968 - DNA, 1579 bp, Panicum virgatum
gtcttcctccttgtctcgtcttcggcttcgtctcatcttagactataaagcaagccaagcctcctgtccggacaagatcaagaggaaggccaaaagggagccaaaaaggctaggccaaaaggcagaatccacgagacgagaccacgagagagaagcaggagggaggagaggttgcgtccctccacttgccatctcccctactctcccgcttcgcgctcttcgtcatcttcctcttcctgcgcttgggggctctccactccaggtccagggttcagattcagattggggcgccgccgcagtcctaccgtgctgctctccctcacgacgacgaggatggggcaggacggccaccagatccgccgccacaagctcatcatcgacacggatcccggcatcgatgatagcatggcaatcctaatggcgttcagagaaccaagcgtggaaatcattgggttgacgaccatatttggcaacgtcagcacggagggtgcaacacgtaatgcgctgttgctgtgtgagagagcagggcattctgaagttccagtagcagagggaagccctgagcccctaaagggaggaaaaccccgtattgctgattttgttcatgggtcagatggcattggggatctgtttcttcctgaacccactactaagaaggttgaggaaagtgctgctgagttcttggtcaataaggtctctgagtttcctggagaggtctctgtactcgctttggggcccctgacaaatgtagcattggctgtcaaaagagacccttcctttgcaagcaaggtgaagaaaatagttgtactaggtggagctttctttgcggcaggaaatgtcaaccctgcagccgaagcaaatatccatggagatccagaagcagctgacatagtttttacctcaggagcagatattgttgtggttggcattaacataacgactcaagcctgctttacagatgaggatctgttggagctaagaaactcgaaagggaagcatgcacagttcttgtctgatatgtgcaagttctacagggattggcatgccaagtctgatggtttccacggaattttccttcatgatcctgtgagcttcatggctctagttcgtcctgagtacttcacgttcaagaagggtgtggtgagagtggagacccagggcatttgcactggccacactttgatggatcagggattgaaaaagtggaattcagagaatccatggtcaggctataaaccgatttcagtcgcatggaccgtcgatgtgccaaaggttattagctttataaagaagctgctcatggcaccatgagaaactgcaagcatttaacaatttcttcgctttctaatgtccaagaaaatttgtcaagtacagagccttctatcccagctgcctagtaactagttcctggacagtaggaagctttcttcagtgtcctgagaagcataggaagcttccttgtgataggttatgcaagtaaattctgcataggacagcattgttccacattgtttcacatatttgtaccaatatattcgagtatgaaatgaagtttcccgtatgcaccgcatactttttt

SEQ ID NO: 969 - DNA, 1497 bp, Pennisetum glaucum
cagaatccgcgagacgagagaccacgggatagagagagagagaggttgcgtccctccacttgcgtctcccgcttcgcgctcttcttcgtcttcctctccctccgcttgccaagggccttctctagtctaggattcagattcagattgggcggcgtcccagtcccagcaccagtgtcctgctgttcctgttcacgacgacgggatggggctggacggccaccagatccgcgcccacaagctcatcatcgacacggatcccggcatcgatgatagcatgacaatcctaatggcgttcagaacaccaagtgtggaaatcattgggttaacgaccatatttggcaacgtcagcacggaaggtgccacgcgtaatgcactgttgctgtgtgagagagcagggcatcctgaagttcctgtagcagagggcagccctgagcccctaaagggaggaaagccccgtattgctgattttgttcatgggtcggatggtgttgggaatatgtgtcttcctgaacccactaccaagaaggttgaggaaagtgctgctgagttcctggtcaataaggtctctgagtttccaggagaggtctcggtactcgctttgggacccctgacaaatgtagcattggctatcaaaagagacccatcatttgcaagcaaggtgaagaagatagttgtactgggtggagctttctttgctgcaggaaatgtcaaccctgcagcagaagcaaatatccatggagatcctgaagcagctgacattgtttttacctctggagcagatattgttgtggttggcattaacataacaactcaagtctgcttgaaagatgaagatcttttggagctaagaaactcgaaagggaagcatgcacagttcttatctgagatgtgcaagttttacagggattggcatgccaagtctgatggtttccatggaattttccttcatgatcctgtgagcttcacagccctagttcaccctgagtacttcaccttcaagaagggtgtggtgagagtggagacccagggtatttgcactggccacactttgatggaccagggattgaaaaagtggaattcagagaacccatggtcagggtataaaccgatttcggttgcatggacggtcgatgtgccaaaggttatcagcttcataaagaagctcctgatggcaccatgagaaattgcaaccatataacaacctctggcgctttctgatgtccacggaaatttgaccagtacagacagagcctctatcccagctgccttgtaagttgtaagttgtaactaattcctggacataggaaagctttcttcagtatcctgagaagagaaacataggaagcttccttgtgaaaggttgcctcagaaaccatggagtaaattctgcatatgacagcattgcttcacacatttgtatcagtacattcgagaattaatgaaatgaagtttacaactaaaaaaaaaaaaaaaaaaagtactaactagacgttagat

SEQ ID NO: 970 - DNA, 1646 bp, Zea mays
aacaaccacatctgcatctcccgtcatctactcgaactcaactcatcgcctcatccgtgtctcatcccattccgtctccgtctccgtctgaactctccatctataaagcttctctgaggcacaagacgagaaggccacagcccacaaagcatgcccggcgagttggaaaagcgcagaatctgcgagacaagaaagcaataggaagggagaaacagggagagaggttgcgtcccagccccacctgccatcgcctcttcttccgctccctcggcggctttccaagattcagattcagattgggggccttttgctgctgcgcggcaattctcgtcgctccagtccccacttcactgttcctgagcgggaggcaccggccggactcgcgatggggcaggacggccagcagatccgccgcgacaagctcatcatcgacacggatcccggcatcgatgatagcatgacgatcctaatggcgttcagagcacctagtgtggaaatcattgggctcacgaccatattcggcaacgtcgacacaaagggcgcaacacgtaacgcgctattgctgtgtgagagagcaggatgccctgaagttccagtagcagagggcagccatgagcccctaaagggaggaaagccccgtgttgctgatttcgttcatgggtcagatggcattgggaatctgtttcttcctgcaccctctgctaagaaggttgaggaaagtgctgctgatttcctgattaataaggtctctgagtttccaggagaggtctctgtgcttgcgttgggacccctgacaaatgtagcattggccatcaaaagagacccttcctttgcaagcaaggttaagaaaatagttgtactgggtggagctttctttgcggctggaaatgtcaaccctgctgctgaagcaaatatccatggagacccagaagcagctgacatagtttttacttcaggagcagatatcgttgtggttggcattaacataacaacacaagtctgcctgacagatgaggatctcttggagctaagaaactcgaaagggaagcatgcagcgttcttatatgagatgtgcaagttctacagagattggcatgccaagtctgatggttttcatggaattttccttcatgatcctgtgagcttcactgccgtacttcatccagagtacttcacattcaagaagggtgtggtgagagtagagacccagggcatttgcactggccacactttgatggatcagggattgaaaaagtggaattcagagaacccatggtcagggtataaaccgatttcagttgcatggacggttgatgtgccaaaggtcatcagctttataaagaagctgctcatggcaccatgagcaaagtacaaccatttaacgacatgtcgacatcagcgctctctgatgtccaagaaaatttgacgagtacagatgctctttctcagttgcactgtaattagttcctggacctaggatgattcctattcctccaatagtaagaggaacctttcattgtgaaaggtcatgcagcagtctcgaataccatgaagcaaattctggcatacgacatcatgtctcacacatttgtatcaatacatttcgaatcaataaagtttccctcactctttactgtgcacttttc

SEQ ID NO: 971 - DNA, 1994 bp, Sorghum bicolor
gtccagccgtccacgcccaactgtcgacgaccaccatggctgccatttgctttcccccaaactctgcagtgtcctctgccctctaccctctgccttaaccaattgattattactactaatccactctataatataaactaatcccacgataatcacgtcctggccgaggccgacgacattacccacatctcccgtcatctattggaactcggctcatctcctcccacctcatctccgtctccatctccatctccttctccttctccgtctccgtctataaagctgcctctgtgacacacaagagaagaaggccaaaagggagccccggcgagttggaaacgaaaagcaagggaaagccaaaaggcagaatccgcgagacaagaaagcagtaggaaggagaggttgcgtcccagccccacccgccatctcctcttcttccctttcctcggcgcctttccacgattcagattcacaaagattggaggacccttcttcctgccgcgcggcaattctcgttcgttccagtgcccagggcgctgttcttgagcggagagcggagggcgccggccgggctcgcgatggggcaggacggccagcagatccgccgcgacaagctcatcatcgacacggatcccggcatcgatgatagcatgacgatcctaatggcgttcagagcacctagtttggaaatcattgggctcacaaccatatttggcaacgtggatacagtgggcgcaacacgtaatgcgctattgctgtgtgagagagcaggacaccctgaagttccagtagcagagggaagccacgagcccctaaagggaggaaagccccgtgttgctgatttcgttcatggctcagatggcattgggaatctgtttcttcctgcaccctctgctaagaaggttgaggaaagtgctgctgatttcctgattaataaggtctctgagtttccaggagaggtctctgtgcttgctttgggacccctgacaaatgtagcattggccatcaaaagagacccttcttttgcaagcaaggtgaagaaaatagttgtactgggtggagctttctttgcagctggaaatgtcaaccctgctgctgaagcaaatatccatggagacccagaagcagctgacatagtttttacttcaggagcagatatcgttgtggttggcattaacataacaacacaagtctgcttgacagatgaggatctcttggagctaagaaactcgaaagggaagcatgcaccgttgttatctgagatgtgcaagttctacagggattggcatgccaagtctgacggcttccatggaattttccttcatgatcctgtgagcttcactgccgtacttcatcccgagtacttcacattcaagaagggtgtggtgagggtggagacccagggcatttgcactggccacactttgatggatcacggattgaagaagtggaattcagagaacccatggtcagggtataaaccgatttcagttgcgtggacggtcgatgtgccaaaggttatcagctttgtaaagaagctgctcatggcacaatgagcaacgacatcagcgctctctgatgtccaagaaaatttgacaagtacagagcctctctcccagctgcattgtaattagtttctggacctaggaagcttcctatttcctccaatagtaagaggatcgccttgttgtttgagttgaggtcttaatgattcagatctattgtcaaaaaaaaagagagattcagatcaacctccgtacttgtgattaaaagatcaatatcacaagagtggataggttggtctaagccattccgtccttctaatctgacagtcaaaattatgtcatgtgtcctgagaaacataggaagcttccttgtgaaaggttatgcatcataccatgaagtaaattctggcatacgacatcacgtctcacatttgtatcaatacatttcgaatcaatgaagtttcccatactccttactgcatacttttc

SEQ ID NO: 972 - DNA, 1625 bp, Saccharum officinarum
ctccacctcctcctcctccatctataaagcctctgtgacactagaggagaaggccaaaaggcagccccggcgagttggaaaaggcaaagccaaaaggcagaatccgcgagacaagaaagcagtaggaaggaccgaaggagggggagagagagaggttgcgtcccagccccacctgccatctcctcttcttccccttcctcggcggctttccaagattcagattcggccttcctgctgcgcggcaattctcgttcgttccagtcctagtcccagtgcgctgttcttgagcggaggcgccggccgggctcgcgatggggcaggacggccagcagatccgccgcgacaagctcatcatcgacacggatcccggcatcgatgatagcatgacgatcctaatggcgttcggagcacctagtctggaaatcattgggctcacgaccatattcggcaacgtcgacacagagggcgcaacacgtaatgcgctattgctgtgtgagagagcaggacaccctgaagttccagtagcagagggaagccacgagcccctaaagggaggaaagccccgtattgctgatttcgttcatgggtcagatggcattgggaatctgtttcttcctgcaccctctgctaagaaggttgaggaaagtgctgctgatttcctggttaataaggtctctgagtttccaggagaggtctctgtgcttgctttgggacccctgacaaatgtagcattggccatcaaaagagacccttcttttgcaagcaaggtgaagaaaatagttgtactgggtggagctttctttgcagctggaaatgtcaaccctgctgctgaagcaaatatccatggagacccagaagcagctgacatagtttttacttcaggagcagatatcgttgtggttggcattaacataacaacacaagtctgcttgacagatgaggatctcttggagctaagaaactcgaaagggaaccatgcaccgttgttatctgagatgtgcaagttctacagggattggcatgtcaagtctgatggcttccatggaattttccttcatgatcctgtgagcttcactgccgtacttcatcccgagtacttcacattcaagaaaggtgtggtgagggtggagacccaaggcatttgcactggccacactttgatggatcagggattgaaaaagtggaattcagagaacccatggtcagggtataaaccgatttcagttgcatggacggttgatgtgccaaaggttatcagctttgtaaagaagctgctcatggaaccatgagcaaagtacaaccatttaatgacatcagcgctctctgatgtccaagaaaactagtagaaagcacgcgccctcgcgtgcgtgggcgaagagagcgtggcaggtacagaagaaagcatatgttataaattagacttaaatgaatatgtttatcaaggaatggtcgctagagagactaatgctatagttcattagacaacaaaagcctcaatattaaagataagtcaacgtaacgaagtaccctaaagacagattgctatcatgatcatgataaggcagcaatgagtagctactaaaatgaacttcgatttttgtttccttccccgatgaaataacagc

SEQ ID NO: 973 - DNA, 1645 bp, Zea mays
cactctaacataaactaatcccacgataattacgtcccggcggatatcacccacatctcctgttgctactggagctcgactcatctcgtcctccgtcgcgagacaagaaagtagtaggaagggaggaagatagaggggttgcgtcccagccccacctgctatctcctctcttcttccccttcctcggcggctttccaccattcaggttcagactggaggggccttcctgccaatctccagtgcgtgttcttcagtggaggcgccggccggactcgcgatggagcgggacggccagcagacccgccgcgacaagctcatcatcgatacggatcccggcatcgatgatagcatggctatcctaatggcgttcagagcacatactctggaaatcattgggctcacgaccatattcggcaacgtcgacacagaaggcgcaacatgtaatgcactattgctgtgtgagagagcaggacatcctgaggttccagtagcagagggcagccacgagcccctaaagggaggaaagccccgtattgctgattttgttcatgggtcagatggcattgggaatctgtttcttcctgcaccctctgctaagaaggttgaggaaagtgctgctgatttcatggttaataaggtctctgagtttccaggagaggtctctgtgcttgctttgggacccctgacaaatgtagcattggccatcaaacgagacccttcctttgcaagcaaggtgaataaaatagttgtactgggtggagctttcttcgtggctggaaatgtcaaccctgctgctgaagcaaatattcttggagacccagaagcagctgacatagtttttacttcaggagcagatgtcattgtggttggcattaacataacaacacaagtctgtttgacagatgagggtctcttggagctaagaaactcaaaagggaagcatgcaccgttcttatctgagacgtgcaagttctacagagattggcatgtcaagtctgatggcttccatggaattttccttcatgatcctgtgagcttcactgccgtgcttcatcccgagtacttcacattcaagaagggtgtggtgagagtggagacccagggcatttgcactggccacactttgatggatcagggattgaaaaagtggaattcagagaacccttggtcagggtataaaccgatttcagttgcatggacggttgatgtgccaaaggttattggctttgtaaagaagctgctcatggcaccatgagcaaggtaccgccatttagcgacatcaatgctctctgatgcccaagaaaatttggcaagtacagagccactctcccagctgcattatacttatttcctggacctggaaagcttcctgttcctccaatagtaagaggatcaccatggttcttttagttgaggtcttaatgatttagatcgacttctatactgcgactaaaaatatcgatatcacaagagtggataaccgtgtctaagccatttcgtccttcaaatctgggagtcaaattgtgaaagcttatgcagcagtctcaaataccatgatgtaaattctggcgtatgacagcatgtctcacacatttgtatcaatacatttcgaatcaatgagatttcccataccctcagtgcatgc

SEQ ID NO: 974 - DNA, 1581 bp, Panicum virgatum
atattcatttgtaataatatctgaattctttactgtaaatcttgttcccagaaggcattcaagttgtaaggaattaatatactattctcactgtctgttcgctccacaatcctgtttctagatgatagcatggcaatcctaatggcgttcagagaaccaagcgtggaaatcattgggttgacgaccatatttggcaacgttagcacggagggtgcaacacgtaatgcgctgttgctgtgtgagagagcagggcattctgaagttccagtagcagagggaagccctgagcccctaaagggaggaaaaccccgtattgctgattttgttcatgggtcagatggcattgggaatctgtttgttcctgaacccactactaggaaggttgaggaaagtgctgctgagttcttggtcaataaggtctctgagtttcctggagaggtctctgtactcgctttggggcccctgacaaatgtagcattggctgtcaaaagagacccttcctttgcaagcaaggtgaagaaaatagttgtactaggtggagctttctttgcggcaggaaatgtcaaccctgcagccgaagcaaatatccatggagatccagaagcagctgacatagtttttacctcaggagcagatattgttgtggttggcattaacataacgactcaagtctgctttacagatgaggatctgttggagctaagaaactcgaaagggaagcatgcacagttcttgtctgatatgtgcaagttctacagggattggcatgccaagtctgatggtttccacggaattttccttcatgatcctgtgagcttcatggctctagttcatcctgagtacttcacgttcaagaagggtgtggtgagagtggagacccagggcatttgcactggtcacactttgatggatcagggattgaaaaagtggaattcagagaatccatggtcaggctataaaccgatttcagtcgcatggaccgtcgatgtgccaaaggttattagctttataaagaagctgctcatggcaccatgagaaactgcaagcatttaacaatttcttcgctttctaatgtccaagaaaatttgtcaagtacagagccttctatcccagctgccttgtaactagttcctggacagtaggaagctttcttcagtgtcctgagaagcataggaagcttccttgtgataggttatgcaagtaaattctgcataggacagcattgttccacattgtttcacatatttgtaccaatatattcgagtatgaaatgaagtttcccgtatgcaccgcatacttttttcaaagctctttgtccttgttttcatgcgccggtcttttgcgtgtgttgaggcaaagaaaatgggtagtttggcttgactccccagcactattttaattttgagctgccaaaattaaaatacattcgagtatgaaatgaagtttcccgtatgcacggcatacttttctcaaagctctttgtcctgttgaggcaaagaaaatgggtagtttggcttgactcttcagccctattttaattttgagctgccagtcgcagtctttcttaggagtaaatcatca

SEQ ID NO: 975 - DNA, 1586 bp, Secale cereale
ctcgtccccattcattcgttcgttcccagagagacgagtaacgaggcgagacgagacgacgaggagagcttggatctctcgaagaattttgtttagttggtggtgaaggatgttgagggctgtggcgaggtgctgcgggcactggccgccgggcgcggcggcggcggatggcatgctctggcagacggagctgcggccgcacgcggcgggcgagttctccatggccgccgcccaggccaacctcatcatggaggaccaggcgcaggtgctcgcctccccctccgccacgctcgtcggcgtctacgacggccacggcggccccgacgcctcccgcttcctccgctccgccctcttcccccacgtccaacgcttcgccaaggagcagggcggcgtgaccgcggaggcgatccggagggcgttcggcgcggcggaggaggacttcctgcacgaggtccgccaggcctggcccaagcgcccgcggatggccgccgtcggctcctgctgcctgctcggggccatagcgggggacacgctctacgtcgccaacctcggcgactcccgcgccgtcctcggccgccgcgtcgtcggcggcggcgtggccgtcgccgagcgcctctccaccgaccacaacgtcgcctccgaggaggtccggatggaggtctcctcgcagaaccccgacgacgggcagatcgtggtgcacaccagaggcgcctggaggatcaaggggataattcaggtgtcaagatccattggtgatgtatacttgaagaaaccggagtatagcttggacccattattccggcagatcggccctgttattgcattgaagaggccagctcttagcgctgaaccacaaattcatgttcgcaagctcaaaccaaccgatcagttcataatatttgcctcggacggtctttgggagcatctcagcgatgatgatgctgtgcaaattgtcttcaagaacccaagaacgggtatagcgaaccgattagtgcggtccgccttgaaggaggccaccaagaagagagaggtcagtgtgcatgacctgaggacgatcgagcggggcgtgcggcgccatttccatgacgatatcagtgtcgtcgtggtgtacctcgaccggcaccggggtcgccgtcagaccagggtggtggactcgagcagcaactgcaccagcgcccccgtcgacatctactcctcctccagctccgtccagtcggcgcagccacggcaggcttaccgtgactccggctagtaggccagaccagacggagcagaagctcagactatatgatcagggtggtgaaaacggtggtggggttgcagatcagcaacgcagactgcaaaccgcaaagctgcagtggcagcgtccgaaagaaatgcgcgaatgtacataagtagtgcgggcgcgtggaacttttgtctgaagagatgattttttcgtatgtacttgcaggatttaactctcctttttttgtttatctctgcttagccagcagttaacccgtgaactagaacagtagcagtatatatcatactgaaatttagaaagggcgcttcgaatttcagcatgtgaattgatccgtgct

SEQ ID NO: 976 - DNA, 1597 bp, Secale cereale
gactatttcctctcgtcccattcattcgttcgttcccagagagacgagtaacgaggcgagacgagacgacgaggagagcttggatctcttggatatttagtttacttggtggtgaaggatgttgagggctgtggcgaggtgctgcgggcactggccgccgggcgccgcggcggcggacggcatgctctggcagacggagctgcggccgcacgccgcgggcgagttctccatggccgccgcgcaggccaacctcatcatggaggaccaggcgcaggtgctcgcctcccctccgccacgctcgtcggcgtctacgacggccacggcggccccgagcctcccgcttcctccgctccgcctcttccccacgtccaacgcttcgccaaggagcagggcggcgtgaccgcggaggcgatccggagggcgttcggcgcggcggaggaggacttcctgcacgaggtccggcaggcctggcccaagcgcccgcggatggccgccgtcggctcctgctgcctgctcggggccatagcgggggacacgctctacgtcgccaacctcggcgactcccgcgccgtcctcggccgccgcgtcgtcgtcggcggcgtggccgtcgccgagcgcctctccaccgaccacaacgtcgcctccgaggaggtccggatggaggtctcctcgcacaaccccgacgacgcgcagatcgtggtgcacaccagaggcgcctggaggatcaaggggataattcaggtgtcaagatccattggtgatgtatacttgaagaaaccggagtatagcttggacccattattccggcagatcggccctgttattgcattgaagaggccagctcttagcgctgaaccacaaattcatgttcgcaagctcaaaccaaacgatcagttcataatatttgcctcggacggtctttgggagcatctcagtgacgatgatgctgtgcaaattgtcttcaagaacccaagaacgggtatagcgaaccgattagtgcggtccgccttgaaggaggccaccaagaagagagaggtcagtgtgcatgacctgaggacgatcgagcggggcgtgcggcgccatttccatgacgacatcagtgtcgtggtggtgtacctcgaccggcaccggggtcgccgtcagaccagggtggtggactcgagcagcaactgcaccagcgcccccgtcgacatctattcctcctccaactccgtccagtcggcgcagccacgtcaggcttaccgtgactctggttagtaggccagaccagacgggcagcagaagctcagactatatgatcagggtggtaaaaacggtggtggggttgcagatcagcaacgcagactgcaacccgcaggctgcagtggcagcgtccgaaagaaatgcgcgaatgtacataagtagtgcgggcgcgtggaacttttgtctgaagagatgattttttcgtatgtaattgcaggatttaactctcctttttttgtttatctctgcttagccagcagttaacccgtgaactagaacagtagcagtatatatcatactgaaatttagaaagggcgcctcgaatttcagcatatgaattgatccgtgctggtgg

SEQ ID NO: 977 - DNA, 1725 bp, Triticum aestivum
gtcgtcccgtccccattcattcattcgttaccagagagacgagacgacgactaccgggagcgaggggcagagttcggatctctattccggagatttttgtctagttggtggtgaaggaggatgttgagggctgtggcgaggtgctgcgggcactggccgccgggcgcggcggcggcggacggcatgctctggcagacggagctgcggccgcacgcggcgggggagttctccatggccgccgcgcaggccaacctcgtcatggaggaccaggcgcaggtgctcgcctccccctccgccacgctcgtcggcgtctacgacggccacggcggccccgacgcctcccgcttcctccgctccgccctcttcccccacgtccaacgcttcgccagggagcaggggggcgtgaccgcggaggcgatccggagggcgttcggcgcggcggaggaggacttcctgcacgaggtccgccaggcctggcccaagcgcccgcggatggccgccgtcggctcctgctgcctgctcggggccatcgcgggggacacgctctacgtcgccaacctcggcgactcccgcgccgtcctcggccgccgcgtcgtcggcggcggggtggccgtcgccgagcgcctctccaccgaccacaacgtcgcctccgaggaggtccggatggaggtctcctcgcacaacccggacgacgcgcagatcgtggtgcacaccaggggggcctggaggatcaaggggataattcaggtgtcaagatccattggtgatgtatacttgaagaaaccagagtatagcctggacccattatttcggcagatcggccctgttattgcgttgaagaggccagctcttagcgctgaaccacaaatccatgttcgcaagctcaaaccaaacgaccagttcataatatttgcctcggacggtctttgggagcatctcagcgatgatgctgctgtgcaaattgtcttcaagaacccaagaacgggcatagcaaaccgactggtgcgggccgccttgaaggaggccacgaagaagagagaggtcagtgtgcatgacctgaggacgatagagcggggcgtgcggcgccatttccacgacgacatcagcgtcgtggtggtgtacctcgaccggcaccggggtcgccgtcagaccagggtggtggactcgagcagcaactgcaccagcgcccccgtcgacatctactcctcctccagctcggcttaccgcgactccggttaataggccagaccagacgggcagcagaagctcagaccatatatatgatcagggtggtagaaaacggtggtagggttgcagatcagcaacgcaagctgcaacccgcaagctgcagtggcagcgtccgaaagagatgcgcggaatgtacataagtagtgcgggcgcgtggaacttttgtctgaagagatgattttttcgtatgtaattgcaggatttaactctctcttttttgtgtatctctgcttagccagcagttaattaacccgtgaactagaacggtagcagtatatatcatactgaaatttagaaagggcaccccggatttcagcgtctgaattcatccgtgctggtgggaaatccgaaatcgggttatctttatacttttcgatcgatcgttctcgtgttcgctgaatggtgattccagttgcttatcaggaatcacttggcttagtagatgaaaggcaaacggcctgctagttgcacttgacg

SEQ ID NO: 978 - DNA, 1826 bp, Brachypodium distachyon
gactctctctgccgctgccgctgccctttcccccttctcctcctccttctcggctgcctgcagcccaccccgcaccaacgcgcttttccccccgcaccgagcgcccctaggattacttaacctaaccccttccccaaccaaggcctcaattccattctcatttccaatttccctttccttccccagagcagcgagacgacgacgagaggacggaggagtgaagcgcgagagaggaggaagaggggaaaggcgttttagatctcgtggtgaggatgttgagggctgtcgcgaggtgctgcgggcactggccgccgggtgcggcggcggcggacggcatgctgtggcagacggagctgcggccgcacgcggcgggggagttctccatggcggccgcgcaggccaacctcatcatggaggaccaggcgcaggtgctcgcctccccggcagccacgctcgtcggcgtctacgacggccacggcgggcccgacgcctctcgcttcctccgctccagcctcttcccccatgtccaacgcttcgcgaaggagcaggggggcatgagcacggaggtgatccggagggcgttcggcgcggcggaggacgagttcctgcagcaggtgaggcaggcctggccgaagcggccgcggatggcggccgtgggctcctgctgcctgctcggggccatatccggtgacacgctgttcgtggcgaacctcggcgactcccgcgctgttctcggccgtcgcgtggtcgggggcactgtggccgtcgccgagcggctctctaccgatcataacgtggcttccgaagaggtccggatggaggtcacctcacaaaacccagacgacggccagatcgtggtgcacaccagaggggcgtggagagtgaaggggataattcaggtatccagatccattggggatgtctacttgaagaaacaggaatatagcatggaccccttattccggcaaatcggccctgttattgcgttgaagagacctgctcttagtgctgaaccacaaattcaggttcgcaagctgaaaccaactgacctgtttctgatatttgcatcagacggtctctgggagcatcttagcgatgatgatgctgtgcaaattgtcttcaagaatccaagaacgggaattgcaaaccgattagtacgggctgctttgaaggaagccaccaagaagagagaggtcagtctgcatgatctgaagacgatagagaaaggagtgaggcgccatttccacgacgacatcagcgtcgtcgtggtctatcttgaccggcaccgcgggcgccgtcacaccagggtcgtggactcgagcagcaactgcactagcgcccccgtcgacatctactcctccaactccggcaaatctgcacagtcactgcaagcttaccgtgactccggttagtagaccggatggccagcaagctttaaactgtctccgggtggtaaacgttagagttgcagatcagcaacgcaaactgcaaccgcaagcatcccaaaaaaacgcggaatgtacataaatagtgcgggcgcgttggattttgatgccggaggggatagttttttcttcttcttttacttgtgtaatcgcagattttttgtttgttcgtctctgcttaaccagcagttagcctgtgaattagagcgggcaagttaatctagcagtatgtcatactgaaagcaggttccaaaatctgtcaacttccttatccctttggatagtttggtctcgtacttgctatcgctgattcctttgcttatcgatctgaccttgtggaatcacattcgcgtagatgaaaggcaaaccaagcattccggg

SEQ ID NO: 979 - DNA, 1744 bp, Setaria italica
gctttcccccgcaccaaggcctcgtgccctgctacttaacctaaccccaccgccgaacaattccccatttctgattccctcctgctcagacgagtcgatagggagagagagagagagatagaggaggaagccaagaacaagctgcggtacccatcttgcgcgcgctcgtgcctgcacagagagagagagagagagagagagagagagagagagagagagagagagagagagagagagagagagagagaggaaagattggattttggtttacggttggtgagcggagatgttgagggcgctgacgaggtgctgcggccactggccgccgggcgcggcggcggcggacgggatgctgtggcagacggagctgcggccgcacgcggcgggggagttctcgatggccgcggcgcaggcgaacgtggccatggaggaccaggcgcaggtgctggcctccccatccgccacgcttgtcggcgtctacgacggacacggcggggtcgacgcctcccgtttcctccgatcccgactcttcccccatgtccaacgcttcgcgacggagcaggggggaatgagcacggaggtgatccggagggcgttcggcgcggcggaggaagagttccataagcaggtgaggcaggagtggacgaagcggccgcggatggccgctgtgggctcctgctgcttgctcggggccatctccggggacacgctttacgtggccaacctcggggactcccgcgccgtgctcgggcgtcgagtggttgggggaggggtggccgtcgccgagcggctgtccgacgagcacaacgcggcgtccgaggaggtgcggcgggagctcgccgctctcaaccccgatgacgcgcagatcgtggtacatgccaggggggcgtggagagtgaaggggataattcaggtgtcaagatccattggtgatttttatctgaagaaaccggagtacagcttggaccccttgtttcggcaagttggcccccctgttgcattgaagaggccagctctaagtgctgaaccatcaattcaagttcgcaagctgaaaccaaatgacctattcctgatatttgcttcagatggtctttgggagcacctcagtgatgatgctgcggtgcaaattgtcttcaagaatccaagaactggaatagccaacagattggtgaaggctgccttgaaggaagcaacaaggaaaagggaggtcaggtaccgcgacctgaggacgatcgagaggggagtgaggcggcatttccacgacgacatcagtgttgtggtggtctacctcgaccgccaccgtgaacgtcgccacaccagggtcatcgattcgagcagcaattgcaccagcgcacccgttgacatctactcatccaacacccaccagtccgcggaacccttgcaatcttataagagctgagctccgtggaatggactggacggcttgcaagttaggcttctctctggctggtggtgaactgtagttgcagatcagggtgcgcgaactggagtgccactgccattggaggagctcgagatgtacatagatagcgtgggtgcgtggcgttttgatgccggagaagatcatttggtcttggattatgtagcataattggttaacgcagcagcatttctgtttctttctttttgtcggattgtcggactagttgaagtgtcgcacgcgattaaaaataaattacatacaagatatttataaataaatatagctataagaaatcataat

SEQ ID NO: 980 - DNA, 1841 bp, Oryza sativa
cagcaagtcaaatcgaccaatcctataaagcgacacatcaccggataaccaccgtagactcctcccctcttccctccgcccgtttcccctcgtcctcctcttcttcctccaaacgcgctttccccacgcttcgtgtacataacctaacctactcctcgtcttcttcctccaaatcaaattccaattccaattccattttctcgatcaaacacagcacacaggattggacgccgagacgaggaggaagaagaagcgagcgaagcttgtgttggatcggagtggggaggagatgttgagggcggtggcgaggtgctgcgggcactggccgccgggggcggcggcggcggacgggatgctgtggcagacggagctgaggccgcacgcggcgggggagttctcgatggcggcggcgcaggcgaacctggccatggaggaccaggcgcaggtgctcgcctcccccgccgccacgctcgtcggcgtgtatgacgggcacggcggcgccgacgcctcccgcttcctccgctcccgcctcttcccccatgtccaacgattcgagaaggagcaaggggggatgagcacggaggtgatccgtagggcgttcggcgcggcggaggaggagttcctgcagcaggtgaggcaggcatggcggcagcggccgaagatggcggccgtgggctcctgctgcctgctcggggctatctccggagacacgctctacgtggccaacctcggcgactcccgcgccgtgctcggccgccgcgtggtcgggggcggggtggccgtcgccgagcggctcaccgacgagcataacgcggcctccgaggaggtccggcgggagctcaccgcgctcaacccggacgatgcgcagatcgtggtgcacgccaggggtgcgtggagggtgaaggggatcattcaggtatcgagaaccattggtgatgtttacttgaagaaacaagagtatagcatggatcccgtgtttcgtaacgttggtccccctattcctttgaagcggccagctcttagcgcagaaccatcgattcaagttcgcaagctcaaaccaaatgatctgttcctgatatttgcttcagatggtctctgggagcatctcagtgacgacgctgcggtgcagattgtcttcaagaatccaaggacgggtatagcaaacagattggtgaaggccgctttaaaggaagccacgaggaagagggaggtcagcttccgtgatctgaagacgatagagaagggagtgaggcgccatttccacgacgacatcagcgtcatcgtcgtctaccttgaccgccaccgcggtcgccgtcacacaagggtcgtcgactcgagcagcaactgcaccaacgcccccgtcgacatctactcctccaactccggccaatccgtggagactcttcaagcccatcggggctccggttggtagaagaagactgggacgcctcccttgaaaagatcaagacggtctcttgttaattagtaaaaacatgtagagccgctgatcagtaacactagctgcagtggcatcatcggaagaaacgcgggaatgtacataaattagtagcggcgcgtggcattttgatgtggggaagaatatttgattttttttccttcctttttgggctaatttaattgcagagattactttttgctgttcttctttggtttatatttctgctgaaccagcagttaactgttgactgggaattaccgcatttatgtgcggcaagataatatagtagtggtataatggtattacactgtaacttgctgagattatattaactaaaaggtgaatcttaatggagatcttacatacaccctaaatttgcata

SEQ ID NO: 981 - DNA, 1999 bp, Sorghum bicolor
agactcggcgcctattctccccccacccgtcaccaccccacacgcgctttcgccgcaccaaagcgtcgtgagctgctacttaacctaaccccaccgccaaacgattccccattcctgattccaaccagcccattcgagtacacacggggagcgggggaagggaagccaagaacaagcaggcgatagtcgtcttcgtgcgcgctggtgggtgttgacagagagaaagagagaggaaaggtcggattttgttttacggctgcgctgaggagagatgttgagggcggtggcgaggtgctgcggtcactggccgccgggcgccgcggcggcggacgggatgctgtggcagacggaactgcggccgcacgcggcgggggagttctcgatggccgcggcgcaggccaacgtgaccatggaggaccaggcgcaggtgctggcctccccggccgccaccctcgtcggcgtctacgacggacacggcggggcggacgcatcccggttcctccgatcccgactcttcccccatgtccaacgcttcgcgagggagcaagggggcatgagcgcggaggcgattcggagcgcgttcggcgcggccgaggaggagttccataagcaggtgaggcaggagtggacgaagcggccgcggctggctgctgtgggctcatgctgcctgctcggggccatctccggggacacgctgtacgtggccaacgccggggactcccgcgccgtgctcggccgtcgagtggtcggcggtggggtggccgtcgccgaacggctgtccaccgagcacaacgcggcgtccgaggaggtgcggcgggagctcaccgcgctcaaccccgacgacgcgcagatcgtggtgcacgccagaggggcgtggagggtgaaggggataattcaggtgtcaagatccattggcgatttttatctgaagaaaccagagtatagcttggaccccttgtttcggcaagttggcgcccctattccattgaagaggccagctcttagtgctgaaccatcagttcaagtacgcaagctgaaaccaaatgacctatttctgatatttgcttcggatggtctttgggagcacctcagcgacgatgatgcggtgcaaattgtcttcaagaatccaagaacagggatagccaacagattggtgaaggctgccttgaaggaagcaaccaggaagagagaggtcaggtaccgtgacctgaggacgatcgacaggggagtgaggcggcatttccacgatgacatcagcgtcgttgtggtctaccttgatagccaccgcgagcgccgccacaccagggtcatcgattcgagcagcaactgcaccagtgcgcccgtcgacatctactcctccaacacccaccagtcagcagagcccttgcacgcttataagtgctgaactctgggtagaggaatgttgggttgtcttgcaagttaggctctctcttgctggtgaacggtggagtcgcagagcaggggaacgactcgctgcagtgttattgccatcggaagaactcggagatgtacatagatagcgtggggtgcgtagcattttggtgccggagaatatcatttggtcccgaactacgtagataattggttgatcacagcattttcttgtttatttttgtctgattatgcttaaccagcagacagcagtaagcccgtccattggatcggaattaatttaagagatctgtaatacaggggtgtcttgaaatagttgatgacgaactggaggttagtggagaccaaagaatatatgctctgcttacgatctggaagttaggttgtgacctgagaatatatactctttgcaacggatgagatgctccttatttcatttagcaatgccttttgtcggaaacttctttactttatgtatagtgacaagattacctctacctggaatcgttgaaattcttcattgttcgtgatgtggaacggactgttcaaatatctcttcgtactgtttagtggaacggactgttca

SEQ ID NO: 982 - DNA, 1834 bp, Pennisetum glaucum
agcaagcagcaggagactccgcgcctcctcttccccaccctcacctcacctcacctcacctcacctcacctccgacgccgacgcgctttcccccgcaccaaggcctctcgtgccctcctgctacttaacctaaccccaccgccgaacaattccccatttccgattcccaccacctcagacgagtcgatagagagaggaggaggaagccaagaacaagcagcggtacccatctcgcgcgcgcgcgtgctcgtagagagagagagagatagtcagatagagaggaaagattggatttttggttttcggttggtgagcggagaagatgttgagggcgctgacgaggtgctgcggccactggccgccgggcgcggcggcggcggacgggatgctgtggcagacggagctgcggccgcacgcggcgggggagttctcgatggccgcggcgcaggccaacgcggccatggaggaccaggcgcaggtgctggcctccccgtccgccacgctcgtcggcgtctacgacggccacggcggggccgacgcctcccgcttcctccgatcccaactcttcccccatgtccaacggttcgcgacggagcagggtgggatgagcacggatgtgatccggagggcgttcggcgcggcggaggaagagttccataagcaggtgaggcaggagtggacgaagcggccgaggatggccgccgtcggctcctgctgcttgctcggggccatctccggggatacgctttacgtggccaacctcggggactcccgcgccgtgctcgggcgtcgagtggtggggggaggggtggccgtcgccgagcggctgtccgacgagcacaacgcggcgtccgaggaggtgcggcgggagctcgccgctctcaaccccgatgacgcgcagatcgtggtacacgtcaggggggcatggagagtgaaggggataattcaggtgtctagatccattggtgatttttatctgaagaaaccggagtacagcttggacccctcgtttcggcaagttggcccccctgttgcattgaagaggccagctctaagtgctgaaccatcaattcaagttcgcaagctgaaaccaaatgacctattcctgatatttgcttcagatggtctttgggagcacctcagtgatgatgctgcggtgcaaattgtcttcaagaatccaagaactggaatagcaaacaaattggtgaaggctgccctgaaggaagcatcaaggaagagggaggtcaggtaccgtgacctgaggacgatcgagcggggagtgaggcggcatttccacgacgacatcagcgttgtggttgtttaccttgaccgccatcgtgagcgtcgccacaccagggtcatcgactcgagcagcaactgcaccagcgcgcccatcgacatttactcgtccaatacccaccagtccacggggcccttgcaatctcggaagagctgagttccgtgcaatggactggatgacggctttacaagttaggctttctctgtctgggtggtgaactgcagttgcagatgagggggcgcgaactggagtgccgccattggaggagctcgagatgtacatagatagcgtgggtgcgtggcgttttgatgccggtgaagatcttttggtcttggattgtgtagcataattggttaacgcagaagcatttctgtttctttctttttcgtcggactatgcttaaccagcagtaagccgcccatttgagcgcgcttaaaagaaatctgtaatggtacaagcagtgccgtgggatattttgattacgaaccggaggttagtggagaccaaagaatatatgctctgcgcctctgctta

SEQ ID NO: 983 - DNA, 3126 bp, Panicum virgatum
tataaagcgacacctcacaggataaccaccgtagactccgcgccttctcttcccctgttccccaccctcacccgacgcgctttccctttccccgcaccaaggcctcgtgccctgctacttaacctaacccacctcagaacaattccccattcctagattccaaccagctcgcacgagtcggtactggatagagagggaggaggaagccaagaacaagcagtcgtactcgtcttgcgcgcgcgtggagaggaaagatcggattttgtcttacgtttggtgagcagagatgttgagggcggtggcgaggtgctgcggccactggccgccgagcgcggcggcggcggacgggatgctgtggcagacggagctgcggccgcacgcggcgggggagttctcgatggccgcggcgcaggcgaacctggccatggaggaccaggcgcaggtgctggcctccccgtccgacacgctcgtcggcgtatacgacggacacggcggggccgacgcctcccgtttcctccgatctcgactcttcccccatgtccaacgcttcgcgacggagcaggggggcatgagcacggaggtgatccggagggcgttcaacgagacggaggaggagtttcatacgcaggtgaggcaggagtggaagcagcgtccgcggatggccgccgtgggctcgtgctgcctgctcggggccatctccggtgacacgctctacgtggccaacctcggggactcccgcgccgtgctcgggcgtcgagtggtggggggcggggtggccgtcgccgagcggctgtccagcgagcacaacacggcgtccgaggaggtgcggcgggagctcgccgatctcaaccccgatgacgcgcagatcgttgtgcacaccaggggggcgtggagagtgaaggggataattcaggtgacaagatccattggtgatttttatctgaagaaacctgagtatagtttggaccccttgtttcggcaagttggtccccctattgcattgaagcgaccagctcttagcgctgaaccatcaattcaagttcgcaagctgaatccaaacgacctatttctgatatttgcttcagatggtctttgggagcacctcagtgatgatgctgcggtgcaaattgtcttcaagaatccaagaactggaatagccaacagattggtgaaggctgccttgaaggaagcaacaagaaagagggaggtcaggtatcgtgacctgaggacgatcgaaaggggtgtgaggaggcatttccatgacgatatcagtgttgtggtggtctacctcgaccgccaccgtgagcgccgccacaccagggtcatcgattctagcagcaactgcaccagcgcccctgttgacatttactcatccaacacacaatcttataagagctgaactccatgtagtgggctgggcagtgttcggctatcctctggctggtgaactgcagttgcagatcagggtgcgcgaactggggcgccattgccattggaggagctcgagatgtacatagatagtgtgtgtgcatggcgatttgatgctggagaagatcatctgttcttggattgtgtagcgtaattggttaatcgcagcatttcttgtttcttttttttggggtcaaattatgcttaaccagcagtaagccgtccactggagcgggcttcaaaaaaatctgtaatgctgcaatactgcagcgtcgtgaggtagttgattaggaactggaggttagtggagaccaaagaatatatgctctgcttacaatctggaagtttggttgagacatgagatttgcttcagaaaaggttgagacatgagaatcaccctgttctgctccatcaccagccaacagtgtttttctctcacaccactccagcagccactaggcagtcagcagtgtttttctctcacaccactccagcagcagcctccagcacaagcacagcgaacagggtgataatatatactctttgccgcagatgagatgcgcttatttcatctagcattaccgtttgccagaaacttgctctataatgataatgacagatatacctggactcgttgaaatcctatataggagtatggtagaacggagcgttcaaatcgctctctgcataattacgccttccatcttgtgttgcgcacatgctgtctgtgcaacagcgttacaatatgttgcccgtggaagccgccttccgggaaggaagacggacaccttcccactgggcgtctcttcggattccctgagcctagaagcttcctcgccatttcgaaacacgggaccaacgccatctctaaaccccaaaccctcgttcccttgctcaaaaaaaaaaaaaaactcgttccccttcgccattatccgaacccagaccaagcaccaagctccgaccacagagccgagccccaaatggccgccgcctcctccatgctgaccgccgcgtcgctctccttctccgcgcccccggtctcgcgcctccgagccgcccctcccaccgccgcctcctttgcggcgcgtcggcgcgcggcggccgcctcgcccaaggccacggctgcggcagaggcggccccgaagaagaaaagggcgaccggcatcacccagccgaagcccgtctccccggcgctgcaggcaatcgtgggcgcaccggagatcccccgcaccgaggcactcaagcgcctctgggcctacatcaagcagcacaacctccaggatcctgcagacaagaaggtggtcgtttgtgatgagaagctgaaggccctgtttgctgggcgggagcgcgttggattcctcgagatcgccaagcttctcaacccccactttgtgaagtgaggagcctcttccatggagttggagttaccctagatggtttctagcgatctagacttttagagagtgcgtcggttggcttttgttggcccttagttagctcgacttagtaggatcatctagctcttcgctgacaatgttagtgtgcccctgatggtggtggttatctgaattgctggttatgtcctgaacaccttcagctcgtatgcttgtagctcgtgtgttgacaagctctcgagtttgagaattgcggagtgcatttcagctttgtggtctcttgcgctcatttcgctgctctcca

SEQ ID NO: 984 - DNA, 1736 bp, Zea mays
agaccccgcgcgcctcttccccccaccccgactgcagctcaccccacacgcgctttcgccgcaccaaagcgtcgtgagctgctacctaacctaaccccaccgccaaacaattcccccattcctgattccaaccagcccgccccgttcgagtacacactgagcgagggagacagagagagagacgagaacaaccagcgatctcgcgtatgtgtgtggagttggagatatacagtacagaggaaagatccgatattttttgctgtacggctgctgagcggaagagatgttgagggcggtggcgaggtgctgcggccactggccgccgggcgcggcggcggcggacgggatgctgtggcagacggagctgcggccgcacgcggcgggggagttctccatggccgcggcgcaggccaacctcaccatggaggaccaggcgcaggtgctggcctccccgtccgccacgctcgtcggcgtctacgacgggcacggcggggtcgacgcctcccggttcctgcggtccgggctcttcccccatgtccaacgcttcgcgagggagcaggggggcatcagcgcggaggcgatccggagcgcgttcggcgcggccgaggaggagttccacaggcaggtgaggcaggagtgggcgaggcgcccacgcctggctgccgtgggctcgtgctgcctgctcggggccatctccggggatacgctatacgtggccaacctcggggactcccgcgccgtgctcggccgtcgagtgggcggcggcggcggcggggcggccgtcgccgagcgtctgtccgccgagcacaacgcggcgtccgaggaggtgcggcgggagctcgcggcgctcaacccggacgacgcgcagatcgtggtacacgccaggggagcgtggagggtgaaggggataattcaggtatcaagatccattggtgatttttatctgaagaaaccggagtacagcttggaccccttgtttcggcaagttgggccccctattgcgttgaagaggccagctcttagtgctgaaccatcggttcaagtacgcaagctgaaaccaaacgacctgtttctgatatttgcttcagacggtctttgggagcacctcagcgatgacgcagcggtgcagattgtcttcaagaatccgagaactgggatcgccaacagactggtgaaggctgccttgaaggaggcagccaggaagagggaggtcaggtaccgtgacttgaggacgatcgacaagggagtgaggcggcatttccatgacgacatcagcgtcgtcgtggtcttccttgatcgccaccgtgagcgccgccacactagggtcgttgactcgagtagcaactgcatcagtgctcccgtcgacatctactcctccaacacacaccagtctgcggagcccttgcacggttaaaagagctgaactctggctagaacgtagaagactggggtttgccttgcgctctcctgctggtgaacggtggagttgtagagctgagggactgcagtgccatagccataggaagggaagaactcgagatgtacatagatagcgtgggtgtgtagcatcggaaaagatcatttggtctggaactacgtagcgtaattggtcaatcagatcattttcttgtttctttttgtctgattatgcttacccagtggtaaatccgtccattgtatcggatttaatttaagaaatctgtaatacagaggtgtcgtgaaatagttgatgacgc

SEQ ID NO: 985 - DNA, 1359 bp, Triticum aestivum
ccgacggccaacctcgtccatcggagggaccacggcgccacggtcgctccgcctccccctccgccacgctcgtcggcgtcacgacggccacggcggcccgacgcctccgcttcctccgctccgccctctccccacgtccacgctcgccagggagcagggggcgtgaccgcggaggcgatccggagggcgttcggcgcggcggaggaggacttcctgcacgaggtccgccaggcctggcccaagcgcccgcggatggccgccgtcggctcctgctgcctgctcgggccatcgcgggggacacgctctacgtcgccaacctcggcgactcccgcgccgtcctcggccgccgcgtcgtcggcggcggggtggccgtcgccgagcgcctctccaccgaccacaacgtcgcctccgaggaggtccggatggaggtctcctcgcacaacccggacgacgcgcagatcgtggtgcacaccaggggggcctggaggatcaaggggataattcaggtgtcaagatccattggtgatgtatacttgaagaaaccggagtatagcttggacccattatttcggcagatcggccctgttattgcattgaagaggcctgctcttagcgctgaaccacaaatccatgttcgcaagctcaaaccaaacgatcagtttataatatttgcctcggacggtctttgggagcatctcagcgatgatgatgctgtgcaaattgtcttcaagaacccaagaacgggtatagcaaaccgattagtgcggtccgccttgaaggaggccacgaagaagagagaggtcagtgtgcatgacctgaggacgatagagcggggcgtgcggcgccatttccacgacgacatcagcgtcgtcgtggtgtacctcgaccggcaccgcggtcgccgtcagaccagggtggtggactccagcagcaactgcaccagcgcccccgtcgacatctactcctcctccagctccatccagtcggtgcagccacgtcaggcttaccgtgactccggttaatagaccagataagacgggactccggttagtagaccagataagacgggcagcagaagctcagactatatgatcatggtggtaaacggtggtagggttgcagatcagcaacgcagactgcaacccgcaagctgcagtggcagcgtccgaaagagatgcgcggaatgtacataagtagtgcgggcgcgtggaacttttgtctgaagagatgattttttcgatgtaattgcagaatttgactctcttttttcgtttatctctgcttagccagcagttaacccgtgaactagaacggtggcagtatatatatgatactgaaatttagaaaaggcaccccgaa

SEQ ID NO: 986 - DNA, 2934 bp, Panicum virgatum
tataaagcgacacctcacaggataaccaccgtagactccgcgccttctcttcccctccccaccctcacccgacgcgcttttccccgcaccaaggcctcgtgcctgctacttaacctaacccacctcagaacaattccccattcctgattccaaccagctcacacgagtcggtactggatagagaggaaggaggaagccaagaacaagcagtcgtactcgtcttgcgcgcgcgtggagaggaaagattggattttgtgttacgtttcggtgagcagagatgttgagggcggtggcgaggtgctgcggccactggccgccgagcgcggcggcggcggacgggatgctgtggcagacggagctgcggccgcacgcggcgggggagttctcgatggccgcggcgcaggccaacctggccatggaggaccaggcgcaggtgctggcctccccgtccgacacgctcgtcggcgtctacgacgggcacggcggggccgacgcctcccgtttcctccgatctcgactcttcccccatgtccaacgcttcgcgacggagcaggggggcatgagcacggaggtgatccggagggcgttcagcgagacggaggaggagttccatacgcaggtgaggcaggagtggaggaggcggccgcggatggccgccgtgggctcgtgctgccttctcggggctatctccggggacacgctctacgtggccaaccttggggactcccgcgccgtgctcgggcgtcgagtggtggggggcggggtggccgtcgccgagcggctgtccagcgagcacaacacggcgtccgaggaggtgcggcgggagctcgccgctctcaaccccgatgacgcgcagatcgttgtgcacgccagaggggcgtggagagtgaaggggataattcaggtgacaagatccattggtgatttttatctgaagaaacctgagtatagtttggaccccttgtttcgggaagttggcccccctattgcattgaagagaccagctcttagcgctgaaccatcaattcaagttcacaagctgaatccaaacgacctatttctgatatttgcttcagatggtctttgggagcacctcagtgatgatgatgcggtgcaaattgtcttcaagaatccaagaactggaatagccaacagattggtgaaggctgccttgaaggaagcaacaagaaagagggaggtcaggtaccgtgacctgaggacgatcgaaaggggtgtgaggcggcatttccatgacgacatcagtgttgtggtggtctacctcgaccgccaccgtgagcgccgccacaccagggtcatcgattctagcagcaactgcaccagcgcccccgttgacatttactcatccaacacagtcttataagagctgaactccgtgtagtggactgggcagcgtgcgagttcgctatctctggctggtgaactgcagttgcatgcagatcagggtgcgcgaactggggtgccattaccattgcaggggctcgagatgtacatagatagtgtgggtgcgtggcgttttgatgccggagaagatcatctggtcttggattgtgtagcataattggttaatcgcagcatttcttctttccttttttttgtcaatttatgcttagtcagcactaagccgccctttggagcgggcttcaaagaaatctgtaatgctgcaatgctgcactgctgcagtgtcgtgaggtacttgattacgaactggagcttagtggagaccaaagaatatatgctctgcttacaatctggaagttaggttgagacatgagatttgcttcagaaaaggttgagacatgtgaatatatactctttgccgcagacgagatgcgcttatttcatctagcatgaccgtactttaactctgcaatgataatgacaagtatacctggacccgttgaaatcctgtgtactatagtagaacgaacagactgttcaaatcgttctctgcgaattacgccttccatcttgtgttacggacatgctgtctatgcaaatgcaacagcgtttagcgtaatatgttgcgcgtggaagccgccttccgggaaggaagacgaacaccctcccactgggcgtttcttcggattccctgagcctagaagcttcctctacatttcgaaacaccaacgccatctctaaacccccaattccccaaaccctcgttccccttcgccattatccgaacccaaaccaagcgccaagctccgaccacagagccgagccccaaatggccgcctcctcctccatgctgaccgccgcgttgctctccttctccgcgctcccggtctcgcgcctccgagccgcccctcccaccgccgcctccttcgcggcgctgcggcgcgcggcggccgcacccgtcgtcgtgcgcgcggcggccgcctcgtccaaggccacggatgcggcggaggcggccccgaagaagaaaagggcgaccggcatcacccagcccaagcccgtctcgccggcgctgcaggcaatcgtgggcgcaccggagatcccccgcaccgaggcactcaagcgcctctgggcctacatcaagcagcacaacctccaggatcctgcagacaagaaggtggtcgtctgtgatgagaagctgaaggtcctgtttgctgggcaggagcgcgttggattcctcgagatcgccaagcttctcaacccccactttgtgaagtgaggatcctcttccatggagactggagttaccctagatggtttctagcgatctagatttttagagagtgcgtcggttggcttttgttggccctgagtttgctcgacttagtaggatcatctagcccttcgctgacaatgttagtgtgcccctgatggtgccggttatctgaattgctggttaatgtcctgaacaccttcaactcgtatgcttgtggcttgtgtcttacagctctcgagttt

SEQ ID NO: 987 - DNA, 1797 bp, Zea mays
aaaccattccccccgttcctgattccaattccaaccagcccatcccccttcgaccatacacacagagcggaggcgaaggcaagagcaaacagagtagccgccgccgccgccgtcgtcgtcgtgtgttgagcagggttttgtttttacggcttagctttgagcagcagagatgttgcgagcgctggcggcgaggtgctgcggccactggccgccgggcgccgcggcggcggacgggatgctgtggcaggcggagctgcggccgcacgcggcgggggagttctcgatggccgcggcgcaggccaacctggccatggaggaccaggcgcaggtgctggcgtccccggccgccacgctcgtcggcgtctacgacggccacggcggggccgacgcatcccggttccttcgctcccggctcttcctgcatgtccaacgcgtcgtgcaggagcaggggggcatgagcgccgaggcgattcggagcgcgttcggcgcggccgaggaggagttccataggcaggtgaggcaggagtggaggagccggccgcggctcgctgccgtgggctcctgctgcctgctcggggccatctccggggacacgctgtacgtggccaacgccggcgattcccgcgccgtgctcggccgtcgagtgcccggcggcggggcggccgtcgccgagcggctctccgccgagcacaacgcggcgtgcgaggaggtgcggcgcgagctcgccgcgctcaaccccgacgacgcgcagatcgttgtgcacgccaggggagcctggagggtcaaggggataattcaggtgtcgagatccattggcgatttttatctcaagaaaccggagtatagcctggaccccttgttccggcaagttggggcccctattgcgctgaagaggccagctctcagcgctgaaccatcggttcaagtacgcaagctgaaaccaaacgacctgttcctgatatttgcttcagatggcctttgggagcacctcagcgacgatgctgcggtgcagattgtcttcaagaatccgagaactgggatagccagcagactggtgaaggctgccttgaaggaagcgaccaggaagagggaggtcaggtaccgtgatctgaggacgatcgagagaggggtgaggcggcatttccacgacgacatcagcgtcgtcgtggtctacctcgatggccaccgcgagcgccgccacaccagggtcgttgactcgagcagcaactgcaccagtgcgcccgtcgacatccactcctccaactcccgctagtttccggagccccttgcaacgcgagctgaactctgggtgggaggtgaggtgggtgcagccgtagccatcggaatcggaacaagtcgatatgtacataggtaggagtgggtgcgtggcatcttgatgccggagaagatcatttggtctcgaaactacttagcacaagtggttaatgactgcatttttcttgtttctttttgtctgaaaccagcagcaagcccgtccattggatcggacttatttttaaggtaagaaatagttgatgacgaactggaggttggttaatggagaccaaagaatatatgctctgctcagtgctcaggatcatagaatttaggttccggcctgagaatatatactctttgcaacggatgagatgctcttatttcatttagcatcgtttttttttgtcggaaacttctttatgtatgcagtgccaagattaccactacctggaatcgttgaaactctgcatggttcgtgctgtggaacggattgctcaaatatcttttcgtactgtttag

SEQ ID NO: 988 - DNA, 1370 bp, Triticum aestivum
gatcaagagagtgttagtttcatcatcgactgttgcactcttgagggagaaataaacttcaaggcacattgcctctccagctgtagtggtaagaacagccttgatataaaaatctccatcggtcaaccagctgagtccagggttgtgagtttcaatattaagtcctccagcaggtgttcggtaatttccaacatggaatgggcattgacatggaagtccgccaccgcttgccccccttcatgttgttgcattgccctcgaggagacgaggtcattagttgattaccagctgccgatcggttgcggattaattgggcagaaggcagtcggtgatctcttgattgatttggacgccatgaaattcggaaagtggctcaagcggcagatcgagcagagcctcccggcgtggaaggacgagttcctgagctacaacgagctcaagcccgtcatcggcgccgtctcgccggccgagttcgtcgcccgcctcgacgttgagatcgagaagatcaacgccttcttcatcgagcaggaggagttcttcatcatcacacaccgggagttgcagggggcgatcaggagcgcgctggagaggaagccggcggtgccggcgtcggcgcacgaggcggagatcgcggcgatccggagggagatcgtcaacttccacggcgagatggtgctgctgctcaactacagcagcgtcaactacatcggcctggccaagatcctcaagaagtacgacaagcgcacgggcgccgggatccggctcgccgtgatcgagaccgtgctagtgcagcccttcttcacggcggaggcggtgtccctgatggtgagggagtgcgaggccatgatggaggcggtgttccccacggcgcccggcgaggggcaggcggcggcgcggcgggaccgcgaggccctggtcgccgcggagcagaggatcttccgcaacaccgtgtcggcgctcctggccatgcaggacgtgcgcagcggcagctccacgcgcggccgccactcgctgccgccgctcaacctgccggactcggactggctccgctccttctagccgccgccccccattccccgtccaatggcccccgccggcctcttcttggtggtctccccagccaccacagccacagcccacagatatgtaattggctatctgtagtttctaacttcttttttgtctccttttcattttaccacatgctggtgtaagatggtaacaaggtgtgagcatacaaattcatactcctgtgcattatgctcctaaatctttgtcaggacactgaccgagcgtcaaatctaattgagtgcgtcgtagaaaattatatctaattcaaactgccatgatgctaaacaaaaattatggtt

SEQ ID NO: 989 - DNA, 1054 bp, Secale cereale
accgcttgctcacctccatatcgtagattgttgtcgcattgccctcgaggagacgaggttcgttgatcaccagctacctgtcggttgtggatcaattaggcagaaggtggtcggtgatctcttgattgatttgttgcacgccatgaaattcggtaagtggctcaagaggcagatcgagcagagccttccggcgtggaaggacgagttcctgagctacaacgagctcaagcccgtcatcggcgccgtctcgccggccgagttcgtcgccctcctcgacgcccagattgagaagatcaacgccttcttcatcgagcaggaggagttcttcatcatcatacacagggagctgcagggggcgatcaggagcgcgctggagaggaagccggcggtgccggcgggggcgcacgaggcggagatcgctgcgatccggagggagatcgtcaacttccacggcgagatggtgctgctgctcaactacagcagcgtcaactacatcggcctggccaagatcctcaagaagtacgacaagcgcacgggcgccgggctccggctcgccgtcatcgagaccgtgctggtgcagcctttcttcacggcggaggcggtgtccctgatggtgagggagtgcgaggccatgatggaggcggtgttccccacggcgcctggcgaggggcaggcggcggcgcggcgggaccgcgaggccctggtcgccgcggagcagaggatcttccgcaacaccgtgtcggcgctcctggccatgcaggacgtgcgcagcgcgagctccacgcgcggcagccactcgctgccgccgctcaacctgccggactcggactggctccgctctttctagccgccgtcccccattccccgcccgtccaatgacccccgccggcctcttcttggtggtctccccagccacagccacagccacagatatgtaattggctatctgtagtttctaacttcttttttgcttccttttcctttttaccacatgctggtgtaagatggtaacaagatgtgagcatacaaattcataccactgtgcattacgctc

SEQ ID NO: 990 - DNA, 1869 bp, Secale cereale
gcggggaagaggacaagcaggcgatccggtggaagcggatacagacaagcgagcgacaacgactctactccctatccaccgcaaggtttgaggcgaatcgaagagaaggagaagcccacgtacgggcgtccatggcgtctagctgctgcggcaagaggcccagaccagccgtccccttgctgctggcgctgctcgtcgtttcctgctcgtccgtgtcggccagtggcggcggcggcaggggcaacggcacacggacgacggagttccgttccggggacgagctgcgagcctaccggagcatcgtggcccgcatggacaagatgaagaaggcctccgtcaagaccattcagagctccgacggcgacgtcatccattgcgtgccggcgcacctccagccggcgtttgaccacccaacgttgagaggccaaaagccagaggctgagccggaggagaggcccaagatcagcgccgacgctgccgaggaagaagaaggggacgcggtgttcccgcaggcgtggagcgacggcggcgagtcgtgcccgggcgggacggtcccgatacggcggaccagggagagcgacctgcggcggtacaccggctccctccggcggtacggcatgaagccccgcgccgccggcgtccggcgcgactccaccagcgacggccacgagcacgcggtggggtacgtgaccggcgaccagttctacggcgccaaggcgagcctgaacgtgtggccggccagggtggcgtcggccgcggagttcagcctctcccagatctgggtcatctccggcaccttcggcaacgatctcaacaccatcgaagcaggctggcaggtgagccctcagctgtatggcgacaacagcccacgcttcttcacctactggacgagcgacgcgtaccaggcgacggggtgctacaacctgcactgctcggggttcgtgcagaccaaccggcggatctcgatcggggcggccatctcgccggcgtccgcctacaacggccgccagttcgacatcagcctgcttatctggaaggacccgcgccggggccactggtggctgcagctcggctccggcccgctcgtcggctactggccctcctccctcttctcccacctcggcggtcacgccaacatggtgcagttcggcggcgaggtcgtcaacacgcgcccctcgggctcccacacccccacgcagatggggagcggccacttcccgcgcgagggattcaaccgcgccgcctacttccgcaacgtccaggtggtcgactgggacaacaacctcctccccgccagggacctccggctcgtcgccgaccaccctacctgctacggcatccagggcgggtataaccgcgcctggggcaactacttctactacggcgggccgggccggaacgtgcactgcccatagtacttacgtgtggatcgccgtcggtgccggagaagaaggagatccatcgatctgcttaactgaagaaagtactgctattgatcgttaattcttactaggagtattacctaagtgattatcctataaagctagctagtagtttcttgatcgggttgacgcgtacattcgtcgcgcgcggggtgcttcttttgatatatggttgaggcttgtttttttttttcttttctccttttgagctacgtagcgtgtatacgtgaagaaactgacatatatagagagagagtggtgcggatttgtgatcctcttatgtatgtacgtgtgttgtaccatagtgtttccagctatacatcaagctacaattgatgtttacaaaaaaaaaaaaaaaaaaagaaaaaaaaaaaaactaaaaaagtgcgagcgacgacggacacacggaggttagaggggggggggg

SEQ ID NO: 991 - DNA, 2422 bp, Brachypodium distachyon
gggccgggaatgtggagaaggggacagagaccatggagtgtccattataaaactggcatgatgccatggctaaggcatgggtaaagggggttggggttgtcgctgtgggtgtgtgtgtgtgtgtgtcctcgggaaaaagcggtcgtgccgctaataggttgcagttaacccccagccgatggatcgacgagctaagctagctatagctgaactgaagtagtactgaaactgaagtactgaagctcactcaacacattacacatagcgatcccgccagtgtcggaagggaactcatcaaatccacccccaccatttgaaccccagctcagctccatccccactgcccccaaccaccgcacggcaaggtttgtttgacctctcgccaggctcaaagctagtagcttcttgctgtcgaggcagggccgggacggggaggaagaggacaagcacgctgcacgcacgcgtgctgatgcgcaagcgtacaaacaggtgatctagagaggaagcagaagacgacgacgacgaagctgatcagagaaatccaagaaagaaggaatggggggagaagaagaagaagaaggagctagcccacacgcgcgcgcccgcgctgaaatggcgtctagcggcggcaagaggaggccaagaccaaccattttctcctggtttgtccccttgctgctgttgctggcttgttcttcttcgttgtcggtgtcggcggacaatggcggcggcagcggcgggggcaacggcgggggcaacggcacgacacatgagttccgttcgggggatgagttgagggcgtaccagaggatcgtggcccggatggcccggaccaagaaggccgccgtcaagaccattcagagccccgacggcgacgtcatcgactgcgtgccggcgcacctgcagccggcgttcgaccatccaaccttaagaggccaaaagcccgaggatgagcccgtgtacaggccaaacatcaccggcggcgcggcggcgaagaacgacgacaccgtgttcccgcaggcgtggagcgacggcggcggcgagccgtgcccgggcgggacggtgccgatacggcggacgacggagcgcgacctgctgcggcactcggcggcgaccggctccctccggcggttcgcgatgaaaccgccccgcgcccgcaacgtcgtccgccgcgactccaccgacgacggccacgagcacgcggtggggtacgtgacgggggatcagttctacggcgccaaggcgagcctgaacgtgtggccggccaaagtggcgtccgccgcggagttcagcctctcccagatctgggtcatctccggcaccttcggcaacgacctcaacaccatcgaagcaggctggcaggtaagccctcagctgtatggagacaacagcccaaggttcttcacctactggacaagcgacgcgtaccaggcgacggggtgctacaacctgcactgctcgggcttcgtgcagacaaacagccggatcgccatcggcgccgccatctcgccggcgtcggcctacaacgggcggcagttcgacatcgcgctgctcatctggaaggacccgcggcggggccactggtggctgcagctaggggacggggcgggcccgctggtcggctactggccgtcgtcgctcttcacgcacctgggagggcacgccaacatggtgcagttcggcggcgaggtggtcaacacgcggccgaagggcgcgcacacgcccacgcagatgggcagcggccatttcccccgagaagggttcaaccgggcggcctatttcaggaacttgcaggttgttgattgggacaataatctcatcccggcggcggggctccggcttgtggcggatcatccggcgtgttatggcgttcagggcgggtataaccgcgcctgggggaattacttctattatggcgggcctggaaggaacgtccgctgcccctgattggttcggtcgtcggtgctagctttgattgatgttgccggtgccggagaagaaggagattggttggtcgatcgagattctcgctgctaaagtaatatagtactactgccaaggagtacgtacgtgctgatcgttgattacttaccaacggctaagaagacaaacgtagctaggtagtagtggttaattgaattactgaaagtttttggagttgatagtagtatctgcctgggaagcgatgcttgtttccatatgtgggtttttggggggagggtttatgtatacgtgggaaactgatatagagatttactgtttgtgaatttcgttagatcacttgcgccccatatgtatagtactagtacggagtagtatgtttctgttgatctctatatagtgttgtttgagcgtcgatcggtgcaattgtcttgcagcttttactccatgtttatttaatttttcctaaaaaggagtaata

SEQ ID NO: 992 - DNA, 2191 bp, Oryza sativa
cacggtattgctgtatttattttggtgtggttgagagtctagtctaaatcgaactactttgtccttgaccatgtggaggcagagagctttgcattgctatctccactatatttatagcctcaagtcaaggagttcaagggaggaagaggacaacccactccaactccaacccgcaagcatccaaactgagctgatctcctcttcctcctccaactccaagcctacaaagttcagagaaatccaagaaagatacgagagagataggtccacgtcgttgacgatggcttcttcgggatgcagcagcaatcggttgcgacaaaccattgtcgttgcgttgctgctgctggcttcttcttcttgcttggcatccgcgaagcacaggggcaatggcacgacgacgacggtgccgttccatggcaaggatgagctgcgcaggtacaggaagatcatggcgcaggttgccaggttgaagaaggcttctgtcaagacgatccagagccccgacggcgatgtcatcgactgcgtgccggcgcacctgcagccggcgttcgagcacccgaagctgcgaggacagaagcccgaggctgagccggaggagaggcccaaggtcggcggcgccgcggcggcggaggcggaggaggaggccgtgttcccgcaggcgtggacggacggcggcgagtcgtgcccggagaagacggtcccggtgcggcggacgaggaggcgcgacgtgctcaggtctagctccgccgtccggttcgggatgaagcagccacgcgccgccggcgtcgtccgccgcgactccaccagcgacggccacgagcatgcggtggggtacgtgacgggggatcagttctacggggcgaaggcgagcctgaacgtgtggtcggcgagggtggcgacggcggcggagttcagcctctctcagatctgggtcatctccggctccttcggcaatgacctcaacaccatcgaagccggatggcaggtgagccctgaactgtatggagataacaacccaaggttcttcacatactggacaactgacgcgtaccaggcgaccgggtgctacaacctccactgctccggcttcgtgcagaccaacaaccgcatcgccattggcgccgccatctcccccacctccgtttacaatggccgccagttcgacatcagccttctcatctggaaggacccacgtcgggggcactggtggctgcagctggggtcgggcccactggtggggtactggccgtcgtccctcttcacccacctgggcggccacgccaacatggtgcagttcggcggcgaggtggtgaacacgcggccgtcggggtcgcacaccccgacgcagatggggagcggccacttcccccgcgagggattcaaccgcgccgcctacttccgcaacctccaggtcgtcgactgggacaacaacctcctccccgccgccgccctccgcctcgtcgccgaccacccctcctgctacgacatccagggcggctacaaccgcgcctggggcaactacttctactacggcggccccgggcgcaacgtccgttgcccctagagccaccacccaattaattaagccgccagagacgaggaagacgacgatgattattaagggggtattactgatcattaccaaccaattacatgcaacaccatctcgatcttattaattactctactcgtcacagaatataagggattttgatcggattggatatatcttaggtaattgaaatccagtcaaaatatcttatattttaggatggaatgagtagttttctaagtagtaattaattagctagatagctatagtagtggttactgatgatgagtgtgtcaagcagccaaggaagagtgatggcgccaaaagtttttgagttgatacgaggcttccttttgattttttttttctgtctttttagggggttgtttagcttaattttcttgagttatgttacttatgtatacatgaagaaattgataggggagtgttatgatcaccatatgtatatatagcgtggcatcaagagtgttttttgccatgcgtttgaattatcgatgcgacctttaaattttcagttgattttgtttacttcgatcaaacactcggctggcatttctaaacatgacgttgtaaaaattggataagagcgagacgtcgattcgataaaactcatgggtc

SEQ ID NO: 993 - DNA, 1228 bp, Secale cereale
cccacaacgggcgcggcaccgtgccggagacggagagccgatgcgccatctcccgcggcggagaatcggccagcgaggcgcctccgtgctccggaagaaagaacgaaccgcttggccccgaggcgaagcgacatttcgtctccgcacgcgcgccagaggaagaagaccgcggaggaggagagagcgctcgcgcgagaggaggaaaaacatgtttatccagaaggcatggaggacggcggcgttcgggctctatggcttcacccagttcaccaaatctggcttcgtggaacacgccaagaaattcagagaggaggatatgcagatccggttggatgggaagaactgcctggtaactggagcaaattccggcctaggttttgctacagctcagggcttggcttctcatggtgccactgtttatatgctttgccgtaacaaagaaaggggagagactgctctgaatgaaataagatccaaaactggcaatatgaatgttcatctggagatatgtgacctttcatcaattaatgaagtcaagtcatttgctacaaaattctcttcatcggagaagccactgcatgtccttgttaacaatgctggcttactggagcacaagcgcacgactacaccggaagggttggagctcaattttgctgtgaatgtggcagcaacatacactttaacagagctagtgatgccactgttggaaaaagcagcacctgatgctcgtgtcattacagttgcatcgggagggatgtacactgagccactgaacacgaatttacaatacagcgaaagcgaatttgacgggacaaaacaatatgctcgtaacaagagagttcaggttgctctcactgaatggtgggccgagaaatacagcaacaagggagtcggtttctactccatgcatccaggatgggctgatacacctggagtctcgaagagcttgccgggactatcagagaagctatcaggaaacctcagatcgaacgaagaaggggctgacacagtggtctggttggctttgcaacccaaggagaagttagtcccgggggctttctacttcgaccgggctgaggcgcagaaacatttgaagtttgctgggactgcagcatcccatgagcagataggttcgattgttgacagcattcgctccatctgtaacctccctgcaaacacataagtttctcagtgttggaagtcctggacatgaaaataaaatttgaac

SEQ ID NO: 994 - DNA, 1345 bp, Secale cereale
ggcgcggcaccgtgccggagacggagagccgatgcgccatctcccgcggcggagaattggccagcgaggcgcctccttgctccggaagaaagaacgaaccgcttggccccgaggcgaagcgacatttcgtctccgcacgcgcgccagaggaagaagaccgcgtaggaggggagagagcgcgcgcgagaggaggaaaaccatgtttatccagaaggcatggaggacggcggcgttcgggctctatggcttcacccagttcaccaaatccggcttcgtggagcacgccaagaaatttagagaggaggatatgcagatccggttggatgggaaaaattgcctggtaactggagcaaattctggcctaggttatgctacagctcagggcttggcttctcatggtgccactgtttatatgctttgccgtaacaaagaaaggggagagactgctctgaatgaaataagatccaaaactggcaatatgaatgttcatctggagatatgtgacctttcatcaattaatgaagtcaagtcatttgctacaaaattctcttcatcggagaagccactgcatgtccttgttaacaatgctggcttactggagcacaagcgcacgactacaccggaagggttggagctcaattttgctgtgaatgtggcagcaacatacactttaacagagctagtgatgccactgttggaaaaagcagcacctgatgctcgtgtcattacagttgcatcgggagggatgtacacggagccactgaacacgaatttacaatacagcgaaagcgaatttgacgggacaaaacaatatgctcgtaacaagagagttcaggttgctctcactgaatggtgggccaagaaatacagcaacaagggagtcggtttctactccatgcatccaggatgggctgatacacctggagtctcgaagagcttgccgggactatcagagaagctatcaggaaacctcagatcgaacgaagaaggggctgacacagtggtctggttggctttgcaacccaaggagaagttagtcccgggggctttctacttcgaccgggctgaggcgcagaaacatttgaagtttgctgggactgcagcatcccatgagcagataggttcgattgttgacagcattcgctccatctgtaacctccctgcaaacacataagtttctcagtgttggaagtcctggacatgaaaataaaatttgaactttgtaaaaaagaatagaggataggttcgattgttgacagcattcgctccatctgtaacctccctgcaaacacataagtttctcagtgttggaagtcctggacatgaaaataaaatttgaactttg

SEQ ID NO: 995 - DNA, 1096 bp, Pseudoroegneria spicata
agaagaccgcgggggaggagagagagcgcgcgcgagaggaggaaaaaacatgtttatccagaaggcatggaggacggcggcgttcgggctctatggcttcacccagttcaccaaatccggtttcgtggaacacgccaagaaatttagagaggaggatatgcagatccggttggatgggaaaaactgcctggtaactggagcaaattctggcctaggttatgctacagctcagggcttggcttctcatggtgccactgtttatatgctttgccgtaacaaagaacggggagagactgctctgaatgaaataagatccaaaactggcaatatgaacgttcatctggagatatgtgacctttcatcaattaatgaagtcaagtcatttgctacaaaattctcttcatcggagaagccacttcatgtccttgttaacaatgctggcttactagagcacaaacgtacgactacaccggaagggttggagctcaattttgctgtgaatgtggcagcaacatacactttaacagagctagtgatgccactgttggaaaaagcagcacctgatgctcgtgtcattacagttgcatcgggagggatgtacactgagccactgaacacgaatttacaatacagcgaaagcgaatttgacgggacaaaacaatatgctcgtaacaagagagttcaggttgctctcaccgaatggtgggctgagaaatacagcaacaagggagtcggtttctactccatgcatccaggatgggctgatacacctggagtctcgaagagcttgccgggactatcggagaagctatcaggaaacctgagatcaaacgaagaaggggctgacacagtggtctggttggctttgcaacccaaggagaagttagtcccaggggctttctacttcgaccgagctgaagcacaaaaacatttgaagtttgctgggactgcagcatcccacgagcagattggttcaattgctgacagcattcgctccatctgtaacctcactgcaaacgcataagtctcactgaagggatggaagtcctggacatgaaaataaaattgaaattctgaataaaaagaaaattttgca

SEQ ID NO: 996 - DNA, 1578 bp, Triticum aestivum
ggcgcggcgccgtgccggagacggagagcagggggggccatctcccgcggcggagaatcggccagcgaggcgcctccgtgctccggaagaaagaacgaaccgcttggccccaaggcgaagcaacatttcgtcaaggcacgcgcgctagaggaagaagaccgcggtggaggagagacctcgtgcgaaagaggaggaaaaacatgttcatccagaaggcatggaggacggcggcgttcgggctctacggcttcacccagttcaccaaatccggcttcgtggaacacgccaagaagttcagagaggaggatatgcagatccggttggatgggaaaaactgcctggtaaccggagcaaactctggcctgggttatgctacagctcagggcttggcttctcatggcgccactgtttatatgctttgccggaacaaagaaaggggagagactgctctgaatgaaataagatccaaaactggcaatatgaatgttcatctggagatatgtgacctttcatcaattaacgaagtcaagtcatttgccacaaaattctcttcattggagaagccacttcatgtccttgtcaacaatgctggcttactagagcacaagcgtacgactacaccggaagggttggagctcaattttgctgtgaatgtggcagcaacatacactttaacagagctagtgatgccactgttggaaaaagcagcacctgatgctcgtgtctttacagttgcatccggagggatgtacactgagccactgaacacgaatttgcaatacagcgaaagcgaatttgacgggacaaaacaatatgctcgtaacaagagagttcaggttgctctcactgaatggtgggctgagaaatacagcaacaagggagtcggtttctactccatgcatccaggatgggctgatacacctggagtctcgaagagcttgccgggactatcggagaagctatcaggaaacctgagatcgaacgaagaaggggctgacacagtggtctggttggctttgcaacccaaggagaaattagtgccaggggctttctacttcgaccgagctgaagcgcaaaaacatttgaagtttgctgggactgcatcatcccacgagcagataggttccattgttgacagcattcgctccatctgtagtctccctgcaaacccgtaagtttctcagtgaaaggatcgaagtcctagaagtgaaaataaaattgaaattctgaaaaaagaaagaaaaagatttgcaccagccgggaatcgaacccgggtctgtaccgtggcagggtactattctaccactagaccactggtgctttgatgacaggctgttcccatttctctatcgataccgggccgtagaatttaatctgttcacaatcagtgctacagtatagtgacctcggcgattattttggtacgtacatcgacgatggatgctagtgcctagtgatagagttttcctctgtactcatacacaacggtattttttccttaaagaaaccatacatttgctgaggttttttgtcattcttgttgtgtaattctatgccactccctctgtaaagaaatat

SEQ ID NO: 997 - DNA, 1512 bp, Triticum aestivum
tataaaatttgagaggaaatgaatagatttatgcatacgacatagtcgaccatctcaccaaacatttttacatgaataccgtaatgtatggtttgtttaaggaaaaaataccgttttgtatgagtacagaggaaaactctatcactaggcactagcatccatcgtcgatgtacatatcaaaataatcgccgaggtcactatactgtagcactgattgtgaacagattaaattctacggcccggtatcgatagagaaatgggaacagcctgtcatcaaagcaccagtggtctagtggtagaatagtaccctgccacggtacagacccgggttcgattcccggctggtgcatctcttttttttttcagaatttcaattttattttcatgtccaggacttccatcccttcactgataaacttgtgggttagcaggtaggttacagatggagcgaatgctgtcaacaatcgaacctatctgctcatgggatgctgcagtcccagcatacttcaaatgtttttgcgcttcggcccggtcgaagtagaaagcccctgggactaacttctccttgggttgcaaagccaaccagaccactgtgtcagccccttcttcgttcgatctcaggtttcctgatagcttctctgatagtcccggcaagctcttcgagactccaggtgtatcagcccatcctggatgcatggagtagaaacccactcccttgttgctgtatttctcagcccaccattcggtgagagcaacctgaactctcttgttacgagcatattgttttgtcccgtcaaattcgctttcgctgtattgtaaattcgtgttcagtggctcagtgtacatccctcctgaagcaactgtaatgacacgagcatcaggtgctgctttttccaacagtggcatcactagctctgttaaagtgtatgttgctgccacattcacagcaaaattgagctccaaaccttccgatgtagtcgtacgcttgtgctctagtaagccggcgttgttaacaaggacatgaagtggcttctccaatgaagagaattttgtggcaaatgtcttgacttcgttaattgatgaaaggtcacatatctccagatgaacattcatattgccagttttggatcttatttcattcagagcagtctctcccctttctttgttacggcaaagcatatagacagtggcgccatgagaagccaagccctgagctgtcgcataacctaggccagaatttgctccagttaccaggcaatttttcccatccaaccggatctgcatatcctcctctctaaatttcttggcgtgttccacgaagccggatttggtgaactgggtgaagccatagagcccgaacgctgccgtcctccatgccttctggatgaacatgttcttcctcctctcgcgcgcgctttctctcctcctccgcggtcttcttcctctggcgcgcgtgcggagacgaaatgttgcttcgcctcggggccaagcggttccttctttcttcccctc

SEQ ID NO: 998 - DNA, 1556 bp, Oryza sativa
gggggcgccttgcgccaccgtgtcggagacgggaggcggcgtggccatctccgcttggctcgacggctcgcggcgcagaatcggccagcgaggccgtcgcttgactgcctgacttccgagctcctctttgcgcttttctcctttgaaccttccagaacgcgcaaggaagatcaagcagcgcgcgacgacgcgacaaattccccccccccctcccccctgccggctgcggacgaacgaacgaacgagcgagcgagcgaagcgaggaattaagatgttcatccagaaggcatggaggacggcggcgtttggggtctacggcttcacgcagttcaccaaatccggcttcgtggaacatgccaagaaattcagagaggaggatatgcagatccggctggatgggaaaaattgcctagtaactggggctaattccggcataggttttgctacagccgagggcttggcatcacgtggtgccactgtttatatgctttgccgtaacaaggaaagaggagagactgctctcagtcaaatacgatctaaaactggcaacatgaatgttcatctggagatttgtgacctttcatctatcagtgaagtcaaatcatttgcaacaaaattctcttcaacagataaaccacttcatgtcctggttaacaatgctggtttactagagcacaagcgtgtgactacgccagaagggttggagctcaatttcgctgtgaatgtagcagcaacatacactttaacagagctagtaatgccactgttggagaaagcagcacctgatgctcgtgtcattacagtttcttcaggaggtatgtacaccgagccattgaacaaggatttgcagttcggtgaaaacaacttcgatggaacacagcaatatgcccgtaacaaaagagttcaggttgcactcaccgaacggtggtctgaaaaatgcagcaacaagggggtaggtttctattcgatgcatccaggatgggctgacacacctggagtctccaagagcctgcctgggctttcagagaagttatcaggaaacctgagatcaaacgatgaaggtgctgatacagtgatctggttagctttgcaacccaaagagaagctaacctcagggtctttctactttgaccgagctgaagcaccgaaacatctgaagtttgctgggactgcagcttcgcacgggcagataggctcgattgttgatagccttcgctccatttgtggcatttagggaaaaaatatttgctgggactgcagcttcccacgttcagataggctcgattctagtttctggatagccttggctccatttaaatttgacaaaaaaaatgaatttgcaccagccgggaatcgaacccgggtctgtaccgtggcagggtactattctaccactagaccactggtgcgttgtttagaggtggtgactcttatttgtaatcgttgtttggttttacaactatcatagctttaagtaaggaacgtggatatttgtattttgtaatggaatttttttcctatatgacatgaaaaaagggagcagatttttttttata

SEQ ID NO: 999 - DNA, 1446 bp, Panicum virgatum
ggagtgctgcaaagaacaagcgcctggcccgcccggggacaaagcagcgtttcttggcgcggaagaagagagggcgggaggagagggagaggggaaggcgaacatgtttatccagaaggcatggaggacggcgtcctttgggctctacggcttcacccagttcaccaaatccggtttcctggaacatgccaagaaattcagagaggaagatatgcagatccggttggatgggaaaaactgcctggtgactggagcaaattctggcataggttttgctacagctgagggtttggcttcacatggagctactgtctacatgctctgtcgtaacaaggagagaggagaggctgctctcaatcaaataagatccaaaactggcaatgaaaatgttcatctggagatatgtgacctttcatctatcaatgaagtcaaatcatttgcagcaaagttctcttcaatggataaaccactccatgtccttgtaaacaatgctggcttactggagcacaagcgggagactacagcagaagggttggagctcaattttgctgtcaatgtggcagcaacatacactttaacagaactagtgatgccattattggagaaagcagcaccagatgctcgtgtcatcacagttgcatcaggaggcatgtacactgagccactgaacaaggacttacagttcagcgaaggaaactttgatgggacagtacaatatgctcgaaacaaaagaattcaggtcgcactcactgaatggtgggccgagaaatacagcagcaagggggttggtttctactccatgcaccctggatgggctgatacacctggagtcgccaagagcttgccgggattttcagagaaattgtctggaaacctgagatcaaatgacgagggagctgataccgtgctttggttggcgttgcaacctaaggacaagttatcaccgggagctttctatttcgatcgagctgaagcaccaaaacatttgaagtttgccgggaccatgtcatcacattcgcagataaactccattgttgatagcattaggtccatctgtggcctccctgcatcgggatgagctgctttgtgaagtaacaaggatagctgataggtcttgaacatgagggagcatgactcatgactaccaaggggcataaaaaaaagttgcaccagccgggaatcgaacccgggtctgtaccgtggcagggtactattctaccactagaccactggtgcttagtgaaaatctttcgatcggtgcgctacttgtatattgtaaagaagttcttagatcagcagcaagccagcaataaatattcgttgtgtaagctagcaggctaggagcagtaagacgtgggtatttcttatattttccttaaacattctatacactggaacttatatatatgcatttaaataatcccaccgagaatataactctggtgc

SEQ ID NO: 1000 - DNA, 1469 bp, Setaria italica
cggcgcaggatcggccaccgaggcgggttcttgaccccactgcgtcctcgcttcgagaaggctcccagattccagaacgaaggaagctgtggagtgctacaaagaacaggcgcttggcctggccccgtggacaaggcaacgtttcttgtgcggaagaagagagggctgacgggagcaagagcgagagggggaagacgaagatgttcatccagaaggcatggaggacggcggcgtttgggctctacggcttcacccagttcaccaaatccggtttcctggaacatgccaagaaattcagagaggaagatatgctaatccagttggatgggaaaaactgcctggtgacgggagcaaattctggcataggttttgctacagctgagggtttggcttcacatggtgctactgtctatatgctctgtcgaaacaaggagagaggagaggctgctctcaatcaaataagatccaaaactggcaatgaaaatgttcatctggagatatgtgacctttcatctatcaatgaagtcaaatcatttgcaacaaagttcacttcaatggataaaccactccatgtccttgtaaacaatgctggcttactagagcacaagcgtgagactacagcagaagggttggagctcaattttgctgtcaatgtggcagcaacatatactttaacagagctagtgatgccattattggaaaaagcagcaccagatgctcgtgtgatcacagttgcatcaggaggcatgtacactgagccactgaacaaggacttacagttcagcgaagaaaactttgacgggacacgacaatatgctcgaaacaaaagagttcaggtcgcactcactgagtggtgggctgagaaatacaacagcaagggagttggtttctactccatgcaccctggatgggctgacacaccaggagtctccaagagcttgccgggattatcagagaagttatctggaaacctgagatcaaatgacgaaggagctgatacagtgctttggttggcattgcaacctaaggagaagttatcctcaggagctttctacttcgaccgagctgaagcgccaaaacatttgaagtttgctgggactgcaccatcacactcgcagataaagtccgttgttgatagcattaggtccatctgtggcctacctgcattgggatgagctgtttggtgtagcaacaagggtagctgatagtgataggtgttgaacgtgattcatgtcattgtgacagaaattaaaaaaaatttgcaccagccgggaatcgaacccgggtctgtaccgtggcagggtactattctaccactagaccactggtgcctttgatgggtaccttttgatggttgttctaatgattataatgtaatcgtagatcagtaaacatacagttttgtataggatcagtcaaacgtggatatttctcatatttcaataaaacattctatttgccctgaaagc

SEQ ID NO: 1001 - DNA, 1910 bp, Panicum virgatum
cagcggtaccagcagcatcacgcggccgaagaccggaaagcggaggcgacggcctcgcgcggcgcaggatcggccaccgaggcgggttcctgactcacctgcgtccccgcttggagaaggctccggaacgaagaaggaagctgtggagtgctgcaaagaacaagcgcctggcccgcccggggacaaagcagcgtttcttggcgcggaagaagagagggcgggaggagagggagaggggaaggcgaacatgtttatccagaaggcatggaggacggcgtcctttgggctctacggcttcacccagttcaccaaatccggtttcctggaacatgccaagaaattcagagaggaagatatgcagatccggttggatgggaaaaactgcctggtgactggagcaaattctggcataggttttgctacagctgagggtttggcttcacatggagctactgtctacatgctctgtcgtaacaaggagagaggagaggctgctctcaatcaaataagatccaaaactggcaatgaaaatgttcatctggagatatgtgacctttcatctatcaatgaagtcaaatcatttgcagcaaagttctcttcaatggataaatcactccatgtccttgtaaacaatgctggcttactggagcacaagcgggagactacagcagaagggttggagctcaattttgctgtcaatgtggcagcaacatacactttaacagaactagtgatgccattattggagaaagcagcaccagatgctcgtgtcatcacagttgcatcaggaggcatgtacactgagccactgaacaaggacttacagttcagcgaaggaaactttgatgggacagtacaatatgctcgaaacaaaagaattcaggtcgcactcactgaatggtgggccgagaaatacagcagcaagggggttggtttctactccatgcaccctggatgggctgatacacctggagtcgccaagagcttgccgggattttcagagaaattgtctggaaacctgagatcaaatgacgagggagctgataccgtgctttggttggcgttgcaacctaaggacaagttatcaccgggagctttctatttcgatcgagctgaagcaccaaaacatttgaagtttgccgggaccatgtcatcacattcgcagataaactccattgttgatagcattaggtccatctgtggcctccctgcatcgggatgagctgctttgtgaagtaacaaggatagctgataggtcttgaacatgagggagcatgactcatgactaccaaggggcataaaaaaaagttgcaccagccgggaatcgaacccgggtctgtaccgtggcagggtactattctaccactagaccactggtgcttagtgaaaatctttcgatcggtgcgctacttgtatattgtaaagaagttcttagatcagcagcaagccagcaataaatattcgttgtgtaagaggctaggagcagtaagacgtgggtatttcttatatttcccttgaacattctataccctggaacttatatatatgcatttaaataatcccaccaagaatataactctggtgcatctgaatgaattgatcagttgaacaacggtaattgtttatttggtatgagatccacttgatcaagtaataggtaaatacgcaaacttcttaggaagcttgacgagatcgtagaacacaacaacaattcctctaattcctatttaaatcagctttccaatttgtttcagataaagctgatcgatcaaacgcacctatcggctggcttcgatttcaaatcactgaaactgttacaatcactgtaattcacatcacagcttaattcacacgcccatgcatgcatgccaatgccatgccatcccaataagtagtacacgcatgcatgt

SEQ ID NO: 1002 - DNA, 1299 bp, Cenchrus ciliaris
gctacaaagaacaggcgttttggcctggccccgtggacaaggcaacgttttttttggtgcggaagaagagagggctgaagggagcgagagcgagagagaggggggaagacgaagatgttcatccagaaggcatggaggacggcggcgttcgggctctacggcttcacccacttcaccaaatccggtttcctggagcatgccaagaaattcagagaggaagatatgctaatccggttggatgggaaaaactgcctggtgacaggagcaaattctggcataggttttgctacagctgagggtttggcttcacatggtgctactgtctatatgctctgtcgtaacaaggagagaggagaagctgctctcaatcaaataagatccaaaactggcaatgataatgttcatttggagatatgtgacctttcgtctatcaatgaagtcaaatcatttacaacaaagttcacttctatggataagccactccatatccttgtgaacaatgctgggttactagagcacaagcgtgagactacagcagaagggttggagctcaattttgctgtcaatgtggcagcaacatacactttaacagagctagtgatgccattattggagaaagcagcaccagatgctcgtgtcatcacagttgcatcaggaggcatgtacactgagccactgaacaaggatttacagttcagtgaagaaaacttcgatgggaccagacaatatgctcgaaacaaaagaattcaggtcgcgctcactgaatggtgggcagagaaatacaagggagttggtttctactccatgcaccctggatgggctgatacacctggagtcgccaagagcttccccggattatcagagaagttgtctggaaatctgagatcaaatgatgaaggagctgatactgtgctttggttggcgttgcaacctaaggagaagctatcctcaggaactttctacttcgaccgagctgaagcgccaaaacatttgaagtttgctgggactgccgcatcacactcacagataaactccattgttgatagcattaggtccatctgtggcctccctccattggggtgagctgcctgatagtgacagttgttgaaagtagaatcatgtcattgtccgtgagctgcctgatagtgatagttgttgaaagagaaaattaaaaaaaaaaagttgcaccagccgggaatcgaacccgggtctgtaccgtggcagggtactattctaccactagaccactggtgcctttgatggtgttcatttgatagtcaatctattgtttcgctagta

SEQ ID NO: 1003 - DNA, 1354 bp, Pennisetum glaucum
caccggtgctgatctacgattacaattttattgtcagaaataaaattttaatcgtagatcagcaccgggcaatatccacgtttgactgctcctatacaaaactgtacgttcaccggtgctgatctacgattacaattttattatcagaatgaccatcaagagctacccaacaaaggcaccagtggtctagtggtagaatagtaccctgccacggtacagacccgggttcgattccctgctggtgcaattttttttggtttatttctgacgacaacacgttcaacaactatcactatcaggcagctaccctttgcttcgccaagcaactcaccccagtgcagggaggccacagatggacctaatgctatcaacaatggggtttatctgtgagtgtgatgcagcagtccccgcgaactttaaatgttttggcacttcaactcggtcgaagtagaaagatcctgaggatagcttctccttctgttgcaaggccaaccaaaccactgtatcagctccttcttcatttgatctcagatttccaggcaacttctctgataatcccggcaagctcttggcgactccaggtgtatcagcccatccagggtgcatggagtagaaaccaactcccttgtcattgtatttctcagcccaccattcagtgagcgcgacctgaactcttttgtttcgagcatattgtctggtcccatcaaagttttcttcactgaactgtaagtccttgttcagtggctcagtgtacatgcctcctgatgcaactgtgatgacacgagcatctggtgctgctttctccaataatggcatcactagctctgttaaagtgtatgttgcagccacattgacagcaaaattgagctccaacccttctgctgtagtctcacgcttgtgctctagtaaaccagcattgttcacaaggatatggagtggcttatccatagaagtgaactttgttgtaaatgatttgacttcgttgatagatgaaaggtcacatatctccaaatgaacattttcattgccagttttcaatcttatttgattgagagcaacctctcctctatccttgttgcgacagagcatatagacagtagcaccatgtgaagccaaactctcagctgtagcaaaacctatgccagaattcgctcctgtcaccaggcagtttttcccatccaaccggattagcatatcttcctctctgaacttcttggcatgctccaggaaaccggatttggtgaattgggtgaagccgtacagcccgaacgccgccgtcctccatgccttctggatgaacatcttcgtcttccccctctcgccgctctgccttccttcagccctctcttcttcc

SEQ ID NO: 1004 - DNA, 1207 bp, Leymus cinereus x Leymus triticoides
ccgcgggggaggagagagagagagcgcgcgcgagaggaggaaaaacatgttcgtccagaaggtgacggtgtttccaaatcgaattgctgtcttctaccattaatccgctggtaaactggcgcaaagattcatcgtcttcggtacatgccggtaatgttttttttttttttgcggattttgttggtggcgcaggcatggaggacggcggctttcgggctctatggcttcgcccagttcaccaaatccggtttcgtggaacacgccaagaaatttagagaggaggatatgcagatccggttggatgggaaaaattgcctggtaacgggagcaaattctggcctaggttatgcgacagcacagggcttggcttctcatggtgccactgtttatatgctttgccgtaacaaagaaaggggagagactgctctgaatgaaataagatccaaaactggcaatatgaatgttcatctggagatatgtgacctttcatcaattaatgaagtcaagtcatttgctaaaaaaatctcttcatcggagaagccacttcatgtccttgttaacaatgctggcttactagagcacaagcgcacgactacaccggaagggttggagctcaattttgctgtgaatgtggcagcaacatacactttaacagagctagtgatgccactgttggaaaaagcagcacctgatgctcgtgtcattacagttgcatcgggagggatgtacactgagccactgaacacgaatttacaatacagtgaaagcgaatttgatgggacaaaacaatatgctcgcaacaagagagttcaggttgctctcaccgaatggtgggctcagaaaaacagcaacaagggagtcggtttctactccatgcatccaggatgggctgatacacctggagtctcgaagagcttgccgggactatcggagaagttatcaggaaacctgagatcgaacgaagaaggggctgacacagtggtctggttggctttgcaacccaaggagaaattagtcccaggggctttctacttcgaccgagctgaagcgcaaaaacatttgaagtttgctgggactgcagcatcccatgagcagataggttcgattgttgacagcattcgctccatctgtaacctccctgcaaacccataagtttctcactgaagggatggtagtcctggacatgaaaataaaattgaaattctta

SEQ ID NO: 1005 - DNA, 1818 bp, Zea mays
cgacgtggcggctaattttcttttcagaaaccgatgatggccaattatctgtccaaacggcaggatagaaaaaactgttggaaaccaaatgcttgctatcccgaaagcccatttttttgaaaagaaagcccaaaattagacgtgggtcttgcagcgcttcctcggaatccaacaaaccgaacaggcccaaatcagtttgccccaaccaaaacgagacccaagcaagacactcgtggagcccagctcacccgaaagctgcatcagcggcccacgagcacaacggacgccgtgccactcacgggctcacggctggtggagacggagaggctaggcggggacggcctgcccctgcgcccctgccatcttgcgcggcgcagcatcggccaccgaggcgcggcttctcgattcttgaccatcctgctgttctgccttctccgtccgcgccttcgagaaggccacagagcgaaggaattgcagagttttcttggcgcgaaagaaggggagagagagagagaaagacgaagatgtttatccagaaggcatggaggacggcggcgtttgggctctacggcttcaaccatttcacaaaatctggtttcctggagcatgcgaagaaattcagagaggaggatatgcagatccggttggatggaaaaaattgcctagtaactggagcgaattctggcattggttttgctacggctgagggcttggcttcacatggtgctaccgtctatatggtctgtcgtaacaaggagagaggggaggcagctctcaaccaaataagatccaaaactggcaatgcaaacgttcatctggagatatgtgacctttcatctatcaatcaagtaaaatcgtttgcaacaaagttcacttcgatggataaaccactccatgtcttggtaaacaatgctggcttattagagcacaagcatgagactacagcagaagggttggagctcaattttgctgtcaatgtagctgcaacatacactttaacagagctagttatgccgtcattggagaaagcggcaccagatgctcgtgtcatcacagttgcatcaggaggcatgtacaccgagccactgaacaaagacttacagttcaccgaaggcaccttcgatgggacgcaacagtatgctcgaaacaaaagagttcaggtggcactgactgaatggtgggctgagaaaagcggtgacaggggagtcggtttctacgccatgcatcctggatgggccgatacgcctggggtcgccaagagcttgcccggactgtcagagaggttgtctggaaacctgagaacaaatgacgaaggagctgatacagtggtttggttggcgttgcaacctaaggagaagttagcctcgggagccttttacttcgaccgtgctgaagcaccaaaacatttgaagtttgctgggactgcagattcgcacgctcagataaaccctatcgttgatagcattagatccatctgtggtctctctgttaatggttgagctgccaaagcaaaagtgatatacagctccatcgtcaatagcattagattcatctgtggcttctctgttaaaggttgagcttccaaagcaaaagtgaagtgatatattacttgatataatgggtgcatgattcataaaaccgcaaaaaattgaagagtggaaaaaaaaatgcaccagccgggaatcgaacccgggtctgtaccgtggcagggtactattctaccactagaccactggtgcctttgatgctaaagttatgtacgtatttaatttcttttgaatcaacaatcaaacatagatccaacattcttatcacaca

SEQ ID NO: 1006 - DNA, 1442 bp, Secale cereale
gagggcccgggaggatggagctgcagacgtcggggcggcccatcgaggtgctcatggagaaggtgctgtcgatgaacatcgtctcctcggactacttcaaggagctctacaagatcaagacgtaccacgaggtcatcgacgagatctacaaccaggtggaccacgtcgagccctggatgacgggcaactgccgcggcccctccaccgccttctgcctcctctacaagctcttcaccatgaagctcaccgtcaaccagatgcacggcctgctcaagcacccggactccccctacatcagagctattgggtttctctacctgcgctatgccgcggacccaaagaccttatggacctggtatgagccctacattcaagatgatgaggagttttcccctggatccaatggtaaaatgacaactatgggcgtttatgtgcgtgatgtcatccttggtcagtactacttcgacagtcttcttccgcgagtgcctctcctaattctgcgacaggtaactgcccatcttgagaaaatgaagctcccaacgaaacagtcggggataactggggattctagtcgccttggttcagatgatactgcccggcggcctccttcagtaaaggcttctctgtctgtctcttttggtcaacgtgctccacaccgtgcatccacaagggactcatccccagtccgaaagactttgccttctgtacgggaaagggaaaggagccatgatggtggtcatggcaaatctccacccaggatgcaccggagtcagagccgtgagcgcagtcgtgacactgagagggaccgttctgatcgtgaccgtggcaggtacaaggatagggagcatggccggcatagccgtgacaacagagatcgtgattaccgccgctcgagctattcagacagggatgttgagaggcgaggccatgaaaggagggacagggactctgaccgaaatgggcgttcgagtggccgcagaagcaggagcaggagcaggagtccaagccgtggcagaaccaacggcgacagccatcgctccagcccgtttggtaaagcgccagagtcatccaacctggcgaagctgaaggatctgtacggcgatgcgacgaacgcaaaggacgacgccggtgatgacagatctcgcagggactccggaactgaagaggtgatcagattgggaggcgccaggtggaggtgaccgccagaagcccgaaaaccatggggattctattcttgttgtactacattgctataggccgccaaagatgcgcaacagatagtgcgtttcttctcctctgagctgcattcctagggtaattccttcagcatgtagaatgcaaaagtatgttggcaggcaaagcaatttgtagtgatgcaagataaattgttcactttggatagccaagttctgtatctgatatatgctttattatgcgctgtg

SEQ ID NO: 1007 - DNA, 1628 bp, Secale cereale
cccgcccccaccgcgccgccgccgcctcgccctccccggcgcgcccgcgcctccgctccgcccgcctccccccggagacaaccaaacagaggagggtccgggaggatggagctgcagacgtcggggcggcccatcgaggtgctcatggagaaggtgctgtccatgaacatcgtctcctcggactacttcaaggagctctacaagatcaagacgtaccacgaggtcatcgacgagatctacaaccaggtggaccacgtcgagccctggatgacgggcaactgccgcggcccctccaccgccttctgcctcctctacaagctcttcaccatgaagctcaccgtcaaccagatgcacggcctgctcaagcacccggactccccctacatcagagctattgggtttctctacctgcgctatgccgcggaccccaagaccttatggacctggtatgagccctacattcaagatgatgaggagttttcccctggatccaatggtaaaatgacaactatgggcgtttatgtgcgtgatgtcatccttggtcagtactacttcgacagtcttcttccgcgagtgcctctcctaattctgcgacaggtaactgcccatcttgagaaaatgaagctcccaacaaaacagtcggggataactggggattctagtcgccttggttcagatgatactgcccggcggcctccttcagtaaaggcttctctgtccgtctcttttggtcaacgtgctccacaccgtgcatccacaagggactcatccccagtccgaaagactttgccttctgtacgggaaagggaaaggagccatgatggtggccatggcaaatctccacccaggatgcaccggagtcagagccgtgagcgcagtcgtgacactgagagggaccgttctgatcgtgaccgtggtaggtacaaggatagagagcatggccggcatagccgtgataacagagatcgtgattaccgccgctcgagctattcagacagggatgtcgagaggcgaggccatgaaaggagggacagggactccgaccgaaatgggcgttcgactggccgcagaagcaggagcaggagcaggagtccaagccgtggcagaaccaacggtgacagccatcgctccagcccgtttggtaaagcgccggagtcatcaaacctagcaaagctgaaggatctgtacggcgacgcgacgaacgcaaaggacgacgccggtgatgacagatctcgcagggactccggaactgaagaggtgatcagattgggaggcgccaggtggaggtgaccgtcagaagcccgaaaaccatggggattctattcttgttgtactacattgctataggccgccaaagatgcgcaacggatagtgcgtttcttctcccctgagctgcattcctagggaaattccttcagcatgtaaaatgcaaaaatatgttggccggcaaagcaatttgtagtgatgcaagataaattgttcactttggatagccaagttctgtatctgatatatgctttattatgcgctgtgagctcaaaacaaacatttgcttctttgcttggcttgcctgtgatgatatgcagcgcatgctcgttttgcatatgttcaaatcataacccaaaaaa

SEQ ID NO: 1008 - DNA, 1551 bp, Triticum aestivum
cgctccgcccgcctcctccccggccggaaccgaacagagcagggtccgggacgatggagctgcagacgtcggggcggcccatcgaggtgctcatggagaaggtgctgtcgatgaacatcgtctcctcggactacttcaaggagctctacaagatcaagacgtaccacgaggtcatcgacgagatctacaaccaggtggaccacgtcgagccctggatgacgggcaactgccgcggcccctccaccgccttctgcctcctctacaagctcttcaccatgaagctcaccgtcaaccagatgcacggcctgctcaagcacccggactccccctacatcagagctattgggtttctgtacctgcgctatgccgcggacccaaagaccttatggacctggtatgagccctacattcaagatgatgaggagttttcccctggatccaatggtaaaatgacaactatgggcgtttatgtgcgtgatgtcatccttggtcagtactacttcgacagtcttcttccacgagtgcctctcctaattctgcgacaggttactgcccatcttgagaaaatgaagctcccaacaaagcagtcagggataaccggggattctagccgccttggttcagatgatactgcccggcggcctccttcagtgaaggcttctctgtccgtctcttttggtcagcgtgctccacaccgtgcatccacaagggattcatccccagtccgaaagacattgccttctgtacgagaaagggaaaggagtcatgatggcggtcatgccaaatctccacccaggaagcaccgaagtcagagtcgtgagcgcagccgtgacattgacagggaccgttcagatcgcgatcgtggtaggtacaaggatagggagcatggtcggcacagccgtgataacagagaccgtgactaccgccgctcgagctattctgatagggatgtcgagaggcggagccatgaaaggagggatagggactccgatcgaaatggacgttcgagtggccgcagaagcaggagcaggagcaggagcaggagtccgagccgtggcagaaccaatggtgacagccatcgctccagcccgtttggtaaagcgccagagtcatccaacttggcgaagctgaaggatctgtacggcgacgcgacgaacgcaaaggacgatgccggtgatgacagatctcgcagggactccggaactgaagaggtgatcagattgggaggcgccaggtggaggtgactgccagaagccgaaaaccatggggattctgttcttgttgtactaacattgctatactctgcgggcgttgcgcagcagtcaatgggtctcgtctcccctgcgatctctgccttccctagggaaaagtgtctccgactagggtgtacaatgcaaaatctgttggccggctaagcaatttagtggtgatttcaagataaattgttacactttggatagccatgttctgtatctgatatatgctttatgtgttgagctcgaacaaacatttgcttctttgcttgtcttgtctgtgactgatatgcagcgc

SEQ ID NO: 1009 - DNA, 1844 bp, Sorghum bicolor
cctgacccaacccaacctacgcacgcacacgggctcgactcctttcctccgcctctcgtctgctaggtcccctctccgaccgaaccctcccaatccaaagcgattcctccggcccgccgccgtcccgatcacgccacgccgcgccgcgccgccggggcggcgtctccccgtgcgcccttagctcagctcgcgttccggtggaacagagacgagaggaggtgaggggatggagatccagtcgtctggccggtccatcgaggggctgatggagaaggtgctgtctgtgaacatcctctcctcggactacttcaaggagctcttcaagtacaagacctaccacgaggtggtcgacgagatctacaaccaggtggaccacgtcgagccctggatgaccggcaactgccgcggcccttcctccgccttctgcctcctctacaagttattcaccatgaagctcaccgtcaagcagatgcacggcctgctcaagcaccaggactcaccctacatcagagctattggattcctctacctgcgatatgttgcagaaccgaagacgctgtggtcttggtacgaaccctatatcaaggatggcgaggagtttgcccctggctcaaatggtaaatcgactacaatgggcgtttatgtgcgtgatcttctccttggtcagtactatttcgatagtcttcttccacgagtgcctctcccaattctccgacaggtcactagccatcttgagaagctgaagcttccaacaaagcagtcaggaatgactggggactccaataggcttgaatcaaatgatactgccagaagacctccttctgtaaaggcttctttgtctgtctcttttggtcagcgtgctccacaccgtgcatccacaagggattcttccccagtccgaagaacattaccttccaaacaggacaaggaaagaagttatgatggcgaccgtgcaaaatcgccaccaaggaaacgccgaagtcggagttctgagcgtgatcatgactctgagagggaccgttcagatcgtgatcgtggcaggtataaggatagggagcatgatcgttatgctcgtgatcacagagaccgtgatcatcatcggtcgagttattcagatagggatgatgaaagacggggccgtgaaaagagggacagggattctgaccgaaatagacattcaagctcccgcaggagcaggagcaggagtccagtccgtggcagaactgacggtgacaaacatcgctccagtccatttggtagggcaccagaatcatccaacctggcaaagctgaaggatctgtatggtgatgcaacaaacacaaagaatgatgctggtgatgatagagctcacagggattctggaacagaagaggtaatccgactgggaggggcaaggtggaggtgaatctcatgttatggcaggtccatgaatccaaacatcattagtgtcagaaattacccaagaaatgatgggctgtatgtcttaacttgaacttgtaatttcaaatatttactctgaagttcccccattattatgctgtcaatcttttttatgttgaagttctgttgcttatctgccaatggttggtgctacagaatgtgctctgacattattgccattcactgtcttatgtattgctgtatctttcatcacattatatttgtgataaccacgccagaatgacgcaataaccatgtgtatattttcaacttatgttccttctgaaaaaaagcacaatgtagcctttctggctgactagctcaaactggaaaatgtacgggttcatttttggagctatgtcattttacaagataactaagttatagatttatacgtgatccaa

SEQ ID NO: 1010 - DNA, 2008 bp, Triticum aestivum
tgtagaaatggcggaggcgctcgcgtccgcgggtgggctcgccatggcggcctcgacctccttcacgcccggccagctttctgcttttctgggatttctttgggttcttgcggcctgggtgtatgctgaggttctctttcataggaagaatgctgcttcacttaaaacacactcggacatcaatttatcagacatggatagcagctcaaacaaaggagaggatcaaacaatgttactggaggagggtggtcaagtagctggtgcaaagccagtttatgcttctttcacatcacagatgctcagacttttctgtatggacgagacacttcttctggagcatcgattgacactgagggcaacatccgagcttggaggccatctactttacttttacatatgtgaccgcacaaatatattcggagagtctgaaaagaattacagccgagatctcttccttttcctctattttcttcttatcatcgtagcagctattacttccttcaaggtccaccaagataagtccacattcactggaaaatctgtactatatttgaataggcatcagacggaggaatggaagggttggatgcaggtgctattcttgatgtaccactacttcaatgctaaagagatctacaatgcaattcgtgtgttcattgctgcatatgtgtggatgactggatttggtaacttctcctattattatgtgcggaaggatttcagtctgggacgattttgctcagatgatgtggcgcctcaatttctttgtggcattctgttgtattgtcctaaataatgattacacactatattatatttgccctatgcacactcttttcaccctcatggtgtatggtgctcttggaattctaaacaagtacaatgagattagatcagtgattgctataaaatttgttgggtgcttcttggtagttatcttggtatgggaaatcccaggtgtctttgagatagtctggagcccattcacttttcttctaggttatgatgatccttctaaaccagatctccccaggttgcatgagtggcacttccgatctggacttgatcgctacatatggattgtggggatgatatatgcctattaccatccaacggttgagaagtggatggaaaagcttgaagaagctgaaacaagaacaaaactctatattaaggcctctatagttacagtttctttaacggctgggtatttgtggtacgagtacatctataagctggacaagattacctacaataaataccatccctacacatcctggatccccataactgtttacatctgcctgcgcaacttcactcaagaattccgggcgtgctctctaacgctatttgcctggcttggaaagattacactagaaacatatatatctcagttccatatctggctcagatcaaaggtacccaatgggcaacccaagtggctattgacgataatcccagattacccactacttaacttcatgctcactactgcgctatatgttgcggtttcccataggctcttcgaactgactaatactttgaagatagcatttgtacctcgtgataacaagcacctctcatacaattttgtcgcagggattaccatttcagttgcactctactctgtatcatttgccttggttggcatagcaggatactagcaaatctagccattagtttgttagttctagttatagtctagggtatcaacaaagatagtttgattgtcggcgagataaatgtcaacaggcacaccgcatagactgcttctctttcaccctggactcgagtcggcgtgcacacgttttagtcttgaagagtttgaagagtgtaacatgtacaatgtgccccaagtgggaatatgataagggtagacacacgtatgcatatgtacacatatgtccttgacattgccggtcgtgattgtaattcttgcggttgagtaatacaagaatttatcaccaaaaaagtactacttgaatagctgttgaaatgcatactggag

SEQ ID NO: 1011 - DNA, 2322 bp, Triticum aestivum
ggatcccagcgccagagcttggcggatgctgtagaaatggcggaggcgctcgcgtccgcgggtgggctcgccatggcggcctcgacctccttcacgcccggccagctttctgcttttctgggatttctttgggttcttgcggcctgggtgtatgctgaggttctctttcatgggaagaatgctgcttcacttaaaactagacactcggacatcaatttatcagacatggatagcagctcaaacaaaggagaggatcaaacaatgttactggaggagggtggtcaagtagctggtgcaaagccagtttatgcttctttcacatcacagatgctcagacttttctgtatggaccagatacttcttctggagcatcgagtgacactgagggcaatatccgagcttggaggccatctactttacttttacatatgcgaccgcacaaatatattcggagagtctgaaaagaattacagccgagatctcttccttttcctctattttcttcttatcatcgtagcagctattacttccttcaaggtccaccaagataagtccacattcactggaaaatctatactatatttgaataggcatcagacggaagaatggaagggttggatgcaggtgctattcttgatgtaccactacttcaatgctaaagagatctacaatgcgattcgtgtgttcattgctgcatatgtctggatgactggatttggtaacttctcctattattatgtgcggaaggatttcagtctgggacgatttgctcagatgatgtggcgcctcaatttctttgtggcattctgttgtattgtcctaaataatgattacacactatattatatttgccctatgcacactcttttcaccctcatggtgtatggtgctcttggaattctaaacaagtacaatgagattagatcagtgattgcgataaaatttgttgggtgcttcttggtagttatcttggtatgggaaatcccaggtgtctttgagatagtctggagcccattcacttttcttctaggttatgatgatccttctaaaccagatctccccaggttgcatgagtggcacttccgatctggactggatcgctacatatggattgtggggatgatatatgcctattaccatccaacggttgagaagtggatggaaaagcttgaagaagctgaaacaagaacgaaactctatattaaggcctctatagttacagtttctttaacggctgggtacttgtggtatgagtacatctataagctggacaagattacctacaacaaataccatccctacacatcctggattcccataactgtttacatctgcctgcgcaacttcactcaagaattccgggcgtgctccctaacgctatttgcctggcttggaaagattacactagaaacatatatatcacagttccatatctggctcagatcaaaggtacccaatgggcaacccaagtggctattgacgataatcccagattacccactacttaacttcatgctgactactgcactatatgttgcggtttcccataggctcttcgaactgactaatactttgaagatagcatttgtacctcgtgataacaagcacctctcgtacaattttgtcgcagggattgccatttcagttgcactctactctgtatcatttgccttagttggcatagcaggatactagcaaatttagccattagtttgttagttctagttatattctagggtatcaacaaagctagtttgattgtcggtgagataagtgtcaacaggcacaccgcataaactgcttctctttcaccctggacttgagtcggcgtgcccgcgttttagtcttgaagagtgtaaaatgtacaatgtgccccaagtgggaatatgataagggtacacacacgtacacatatgtacaaacatgtcctggacattgttggtcgtgattgtaattcttgcggttgagtaattgtcgtggtgggcgcacggcagatgccaagggatggctaaagagaggaggaggctcgagggcgctgctggactccagaggcgaggttggcatgagcgggcgcgggacgccggacatacccaagttcagggctctccggagagataatacccctagtcctgccgagtgtagttggatgatcgataatacaatgttgctccttgagctgtatggaggaggaaggaagctggccaaggcttgggatgctccttctctccggtgctgccgttgggtggctagtcctatgctctcttgtgtttctcttgtgtcgcatacatatgcctcatccctcatgtcccggtgctgccgttc

SEQ ID NO: 1012 - DNA, 2033 bp, Secale cereale
gacttattttctctcggttacctattttttgcccctcctcctccgattcgcgtttggatcccagcgccaaagcttggcggatgctgtagaaatggcggaggcgctcgcgtccgcgggtgggcttgccatggcggcctcgacctccttcacgcccggccagctttctgcttttctgggatttctttgggttcttgcggcctgggtgtatgctgaggttctctttcataggaagaatgctgcttcacttaaaacacactcggacatcaatttatcagacatggatagtagctcaaacaaaggagatgatcaaacaatgttactggaggagggtggtcaagtagctggtgcaaaaccagtttatgcttctttcacatcacagatgctcagacttttctgtatggaccagacacttcttctggagcatcgattgacactgagggcaatatccgagcttggaggccatctactttacttttacgtatgtgaccgcacaaatatattcggagagtctgaaaagaattacagccgagatctcttccttttcctctattttcttcttatcattgtagcagctattacttccttcaaggtccaccaagataagtccacattcactggaaaatctgtactatatttgaataggcatcagacggaagaatggaagggttggatgcaggtgctattcttgatgtaccactacttcaatgctaaagagatctacaatgcgattcgtgtgttcattgctgcatatgtctggatgactggatttggtaacttctcctattattatgtgcggaaggatttcagtctgggacgatttgctcagatgatgtggcgcctcaatttctttgtggcattctgttgcattgtcctaaataatgattacacgctatattatatttgccctatgcacactcttttcaccctcatggtgtatggtgctcttggaattctaaacaagtacaatgagataagatcagtgattgctataaaatttgttgggtgcttcttggtagttatcttggtatgggaaatcccaggtgtctttgagatagtctggagcccattcacttttcttctaggttatgatgatccttctaaaccagatctgcccaggttgcatgagtggcacttccgatctggactggatcgctacatatggattgtggggatgatatatgcctattaccatccaacggttgagaagtggatggaaaagcttgaagaagctgaaacacgaacgaaactctatattaaggcctctatagttacagtttctttaacggctgggtatttgtggtatgagtacatctataagctggacaagattacctacaataaataccatccctacacatcctggatccccataactgtttacatctgcttgcgcaacttcactcaagaattccgggcgtgctctctaacgctatttgcctggcttggaaagattacactagaaacatatatatctcagttccatatctggctcagatcaaaggtgcccaatgggcaacccaagtggctattgacgataatcccagattacccactgcttaatttcatgatcactactgcgctatatgttgtggtttcccataggctcttcgaactgactaatactttgaagatagcatttgtacctcgtgataacaagcacctctcatacaattttgtcgcagggattgccatttcagttgcactctactctgtatcatttgccttagttggcatagcaggatactagcaaatctagccattagtttgttagttctagttatagtctagggtatcaacaaagctagtttgattgtcggtgagataaatgtcaacaggcgaagcatgatgcacagcgcataaactgcttctctttcaccctggacttgagtaggcgtgcacaagttttagtctttaagagtgtaaaatgtacaatgtgccccaagtggcaatatgataaaggtacacatacgtacacatatgtacacacatgtccttgacattgtcggtcgttattgtaattcttgaggttgagt

SEQ ID NO: 1013 - DNA, 2054 bp, Triticum aestivum
ctctcacacatacccgcgcttattttctctcggttacctaattttcgcccctcctcctccgattcgcgtttggatcccagcgccaaagcttggcggatgctgtagaaatggcggaggcgctcgcgtccgcgggtgggctcgccatggcggcctcgacctccttcacgcccggccagctttctgcttttctgggatttctttgggttcttgcggcctgggtgtatgctgaggttctctttcataggaagaatgctgcttcacttaaaactagacactcggacatcaatttatcagacatggatagtagctcaaacaaaggagaggatcaaacaatgttactggaggagggtggtcaagtagctggtgcaaagccagtttatgcttctttcacatcacagatgctcagacttttctgtatggacgagacacttcttctggagcatcgattgacactgagggcaacatccgagcttggaggccatctactttacttttacatatgcgaccgcacaaatatattcggagagtctgaaaagaattacagccgagatctcttccttttcctctattttcttcttatcatcgtagcagctgttacttccttcaaggtccaccaagataagtccacattcactggaaaatctgtactatatttgaataggcatcagacggaggaatggaagggttggatgcaggtgctattcttgatgtaccactacttcaatgctaaagagatctacaatgcgattcgtgtgttcattgctgcatatgtctggatgactggatttggtaacttctcctattattatgtgcggaaggatttcagtctgggacgatttgctcagatgatgtggcgcctcaatttctttgtggcattctgttgcattgtcctaaataatgattacacactatattatatttgccctatgcacactcttttcaccctcatggtgtatggtgctcttggaattctaaacaagtataatgagattacatcagtgattgctataaaatttgttgggtgcttcttggtagttatcttggtatgggaaatcccaggcgtctttgagatagtctggagcccattcacttttcttctaggttatgatgatccttctaaaccagatctccccaggttgcatgagtggcacttccgatctggactggatcgctacatatggattgtggggatgatatatgcctattaccatccaacggttgagaagtggatggaaaagcttgaagaagctgaaacaagaacgaaactctatattaaggcctctacagttacagtttctttaacggctgggtatttgtggtatgagtacatctataagctggacaagattacctacaataaataccatccctacacatcctggattcccataactgtttacatctgcctgcgcaacttcactcaagaattccgggcatgctctctaacgctatttgcctggcttggaaagattacactagaaacatatatatctcagttccatatctggctcagatcaaaggtgcccaatgggcaacccaagtggctattgacaataatcccagattacccactacttaacttcatgctcactactgcgctatatgttgcggtttcccataggctcttcgaactgactaatgctttgaagatagcatttgtacctcgtgataacaagcgcctctcatacaattttgtcacagggattgccatttcagttgcactctactctgtatcatttgccttagttggcatagcaggatactagcaaatctagccattagtttgttagttctagttatagtctacggtgtcaacaaagctagtttgattgtcggtgagataaatgtcaacaggcgaagcatgatgcacatcgcataaactgcctctctttcaccttggacttgagtcggcgtgcaaaagtttagtcttgaagagtgtaaaatgtacaatgtgccccaagtgggaatatgataagggtacacatacgtacacatatgtacacacacgtccttgacattgtcggtcgtgattgtaattcttgtggttgagtaat

SEQ ID NO: 1014 - DNA, 2028 bp, Hordeum vulgare
acttgttttgtacttcatcccagctttctgcttttctgggatttctttgggttcttgcggcctgggtgtatgcggaggttctctttcataggaagaatgctgcttcacttaaaacacactcggacatcaatttatcagatatggatagtagctcaaacaaaggagaggatcaaacaatgttactggaggagggtggtcaagtagctggtgcaaagccagtttatgcttctttcacatcacagatgctcagacttttctgtatggaccagacacttcttctggagcatcgattgacactgagggcaatatctgagcttggaggccatctactttacttttacatatgtgaccgcacaaatatattcggggaatctggaaagaattacagccgagatctcttccttttcctctattttcttcttatcatcgtagcagctattacttccttcaagatccaccaagataagtccacattcactggaaaatctatactatatttgaataggcatcagacagaagaatggaagggttggatgcaggtgctattcttgatgtaccactacttcaatgctaaagagatctacaatgcgattcgtgtgttcattgctgcatatgtctggatgactgggtttggtaacttctcctattattatgtgcggaaggatttcagtctgggacgatttgctcagatgatgtggcgcctcaatttctttgtggcattctgttgcattgtcctgaataatgattacacactatattatatttgccctatgcacactcttttcaccctcatggtgtatggtgctcttggaatactaaacaagtacaatgagattagatcagtgattgctataaaatttgttgggtgcttcttggtagttatcttggtatgggaaatcccaggtgtctttgagatagtctggagcccattcacttttcttctaggttatgatgatccttctaaaccagatctccctaggttgcatgagtggcacttccgatctggactggatcgctacatatggattgtggggatgatatatgcctattaccatccaacagttgagaagtggatggaaaagcttgaagaagctgaaacaagaacgaagctctatattaaggcctctatagttacagtttctataacggctgggtatttgtggtacgagtacatctacaagatggacaagattacctacaataaataccatccttacacatcctggatccccataactgtttacatctgcctgcgcaacttcactcaagaattccgggcgtgctctctcacgctatttgcctggcttggaaagattacactagaaacatatatatctcagttccatatctggctcagatcaaaggtgcccaatgggcaacccaagtggctgttgacgataatcccagattacccactgcttaacttcatgctcacgactgcgctatatgttgcggtttcccataggctcttcgaactcactaatactttgaagatagcatttgtacctcgtgacaacaagcacctctcgtacaattttgttgcagggattgccatttcagttgcactctactctgtatcatttgccttagttggcatagcaggatactagcaaatttagccattagctgttagttctagttatagtctaggctatcaacaaagctagttttgatcgtcggtgagataaaagtcaatgggcgaagcatgattgacagcgcataaactgcttctctttcacccttggccttgagtcggcgtgcacaagttttagtcttgaatagtgtaaaatgtacaatttgccactatcatatccttgacattgttggttgtgaatgtaattcttgaggttgagtaatacaagaatttattttaaaaaagtattgcttgtatagatgttgaaatgcataccggagtgtaacagcctgagaccgacgcttcagaagattccctttttattccaattatagattttgaaatgcataccggagtgtaacagcctgagaccgacgcttcagaagattcccttt

SEQ ID NO: 1015 - DNA, 2230 bp, Setaria italica
gctttaaaccggcgagagcctttccgctcgagaaaaaccgcgcttgatttttctttttttctctctcacctactaatttccgtacccgtgttcgcggcgctcgctcgctcgggtttggatccgagcggaggcccggccggtggatgctgtagagaaatggcggaggccgtcgcgtccgcgggcgggctcgccgtggcggcagcctcgacctccgtaacgccaggccaggtttctgctattctggggtttctttgggttttcgcagcctgggcatatgctgaggttctctttcataggaagaatgctgcttctattaaaactagacactcggatgtcaatttagcagtaatggataacagttcagtcaaaggagaagatcagacacttctgttggaggagggtggccaagctgtagctgtaaagccagcttatgcttccttcacatcacaaatcctcagacttttcttcatggaccagatgcttcttctggagaatcgtttaacactcagggcaatatctgagtttggagggtatctactttatttttacatatgtgatcgaacagacttactcggagagtctgctaagaattacagccgagatctgttccttttcctctactttcttcttattattgtagcagctatgacttcctttaaagtccatcaagacaagtctgcattcacaggaaaatctatattgtacttgaataggcatcaaaccgaagaatggaagggttggatgcaggtgctattcttgatgtaccactacttcaatgctaaagagatctacaatgcaatccgtgtttttattgctgcatatgtttggatgactggatttggcaacttctcttattattatgtgaggaaggatttcagtcttggacgatttgctcagatgatgtggcgcctcaatttctttgttatattctgctgcattgtcctgaacaatgactatacactatattatatttgccctatgcacacccttttcaccctaatggtttatggcgctcttggaattctaaacaaatataatgagattagatctgtgatggcaatgaaatttgttgcttgcttcttggtagttatccttgtatgggaagttccaggtgtatttgacatagtatggagcccatttacatttcttctaggctataccgatccttctaaaccagatctcccacggttgcatgaatggcaattccgatctggactggatcgctacatttggatcgtggggatgatatatgcgtattaccacccaactgttgagaagtggatggagaagctggaagaaactgaactgagaaccaaactctatattaaaggctcgatagttacagtgtctttgacggctggttatttgtggtacgaatacatttataagctggataagattacatacaacaagttacatccctatacatcctggatccccataactgtctacatatgcctacgcaactttactcaagaattcaggagtttctctctcacactatttgcctggcttggaaagattacactagagacatacatatcacagttccacatctggctcagatcaagggtgcccaatgggcaaccgaagtggctattggcaataatcccaaattaccctttgctcaatttcatgctcactactgctatatatgtcgcggtttcccataggctcttcgaattgactaacaccttgaaggtggcatttgtacctagtcgtgacaacaagcgcctctcatacaattttgtggcaggaattgtcatttcggtcgcactataccttgtatcatttgttctagttggcatcgcaggatactaggaatctctcttttttttttctttccattttcatgtgttctagttcaacgactaggccagtccaattgtgagcaaattcaaggcgacacgtcattcactatccagaaagctgccatttctttcactggaataagattttacctgagttccttggtgaaaagtaatcgagctgcgcgagaacagaagatcttgaagagtgtaacatatgagtgaagcaaccccaagaaggggatatgataaaacagaaacagatatatccctgtatagccgctgagatgcatacgtcggctgtggaaatcagatgatgtttcctatttgtctaatagacagaatggtaatgagaagttcggctagttgattcctgtatgctcgtatattgttaatagaagtaatcagaattgtggatcccc

SEQ ID NO: 1016 - DNA, 2095 bp, Panicum virgatum
ccacctactaatttccgaacccctgttcgcgtcgctcgctcgggtttggatccgagcacaggcccggccggcggatgctgtagagaaatggcggaggccgtcgcgtccgcgggtgggctcgccatggcggcagcctcgacctccctcacgcccggccaggtttctgctattctggggtttctttgggttttcgcagcctgggcatatgctgaggttctctttcataggaagaatgctgcttctattaaaactagatactcggatgtcaatttagcagtaatggataatagttcagtcaaagaagatcaaacacttctgttggaggagggtggccaagctgtagctgcaaagccagcttataattccttcacatcacaaatgctcagacttttcttcatggaccagatgcttcttctggagaatcgtttaacactgagggcaatatctgagtttggagggtatctactttatttttacatatgtgatcgtactgacttactcggagagtctgccaagaattacagccgagatctgttccttttcctctactttcttctcattattgtatcagctatgacttcctttaaagtccatcaagacaagtctgcactcacagggaaatctatattgtacttgaacaggcatcaaaccgaagaatggaagggttggatgcaggtgttattcttgatgtaccactactttaacgctaaagagatctacaatgcaatccgtgtgtttattgctgcatatgtctggatgactggatttggcaacttctcttattattatgtgaggaaggatttcagtctaggaaggtttgctcagatgatgtggcgcctcaatttctttgttatattgtgctgcattgtcctgaacaatgactatacactctattatatttgccctatgcacacccttttcaccctaatggtttatggtgctcttggaattcttaacaaatataacgagattagatcggtgatggcaatgaaatttgttgcttgcttcttggttgttatcctggtatgggaagttccaggtgtcttcgacatagtatggagcccatttacgtttcttctaggctatactgatccttctaaaccagatctcccccggttgcatgagtggcaattccgatctggactggatcgctacatttggatcgtggggatgatatatgcgtattaccacccaactgttgagaagtggatggagaagctggaagaaactgaactgagaaccaaactctatattaagggctcgatagttacagtatctttgacggctggttatttgtggtatgaatacatttataagctggataagattacatacaacaagttacatccctatacatcctggatccccataactgtctacatatgcctacgcaacttcacccaggaattcaggagcttctctctcacactatttgcctggcttggaaagattacactggagacatacatatctcagttccacatctggctcagatcaagggtgcccaatggacaaccgaaatggctattgacaataatcccaaattacccactgctcaatttcatgctcactactgctatatatgtcgcggtttcccacaggctctttgagttgactactaccttgaagatggcatttgtgcccagtcgtgacaacaagcgcctctcatacaattttgtagcaggcattaccatttcagttgcactatactgtgtatcatttgttctagttggcattgcaggatactaggaaatctttttattttcattttcaagtgttctatttggtgttctagttcaacgactaggccagttcaatcatgagcaaattcaaggcgacacgtcacgcactgcccagaaagctgctatttctttcactggagtaagttttgcctgagttccttggtgaaaagtaatcgagctgcgcctcacaagaacagaagatcagtgtaacatacgagggaaccaaccccatgaaggggatatgataagaatagatattcctgtatagccgttgagatgcatacgtcggctgttgaaatcagatgtttcctatttttgtttaatatagacagaatggtgatgagaagttcgac

SEQ ID NO: 1017 - DNA, 1986 bp, Pennisetum glaucum
tcgccgtggctacagcctcgacctccgtcacacccggcccggtttctgctattctggggtttctttgggttttcgcagcctgggcatatgctgaggttctctttcataggaagaatgctgctgctattaaaactagacactcggatgtcaatttagcagtaatggataacagttcagtaaaagaagaagatcagacacttctgttggaagagggtggtcaagctgtagctgcaaagccagcttatgcttccttcacatcacaaatcctcagacttttcttcatggaccagattcttcttctggagaatcgtttaacactgagggcaatatctgagtttggagggtatctactttatttttacatatgtgatcgaacagacttactcggagagtctgctaagaactacagccgggatctgttccttttcctctactttcttcttattattgtagcagcgatgacttcctttaaagttcatcaagacaagtctgcattgacaggaaaatctatattgtacttgaataggcatcaaaccgaagaatggaagggttggatgcaggttctattcttgatgtaccactacttcaatgctaaagaaatctacaatgcaatccgtgtgtttattgctgcatatgtttggatgactggatttggcaacttctcttattattatgtgaggaaggatttcagtcttggacgatttgctcagatgatgtggcgcctcaatttctttgttatattctgctgcattgtcctgaacaatgactatacactctattatatttgccctatgcacacccttttcaccctaatggtttatggcgctttgggaatcctaaacaaatacaatgagattagatcggtgatggcaatgaaatttgttgcttgcttcttggtagttatccttgtatgggaagttccaggtgtatttgacatagtatggagcccatttacatttcttctaggctataccgatccttctaaaccagatctcccccggttgcatgagtggcaattccgatctggactggatcgctacatttggatcgtggggatgatatatgcgtattaccacccgactgttgaaaagtggatggagaagctggaagaaactgaactgagaaccaaactctatattaaaggctccgtagttacggtgtctttgacggctggttatttgtggtacgaatacatttataagctggataagattacatacaacaagttacatccctatacatcctggatccccataactgtgtacatatgcctacgcaactttactcaagaattcaggagcttctctctcacactatttgcatggcttggaaagattacactagagacttacatatcccagttccacatctggctcagatcaagggtgcccaatgggcaaccgaagtggctattggcaataatcccaaattacccattgctcaatttcatgctcactactgctatatatgttgcggtttcccataggcttttcgaattgactaataccttgaaggtggcatttgtacctagtcgtgacaataagcgcctctcatacaattttgtggcaggaattgccatttcggtcgcactatactttgtatcatttgttctagttggcatagcaggatactaggaatttttcattttcttttctctttcatttccatgtgttctagttcaaccactaggccagttcagttgtgagcaaattcaaggtgacacgtcatgcactacccagaaagctgccatttctttcactggagagtaaggttttacccgagtgcctttggtgaaaagtaatcgagctgcgcgagaacagaagatcttgaagagtgtaacatatgagtgaagcaaccccaagaaggggatttgattaaaagaagatatgtccctgtatagccactgagaagcatacgttgactggaaatcagatgatatttcctatttttgtgtagtgagcataatggtaatgagaagttcgacta

SEQ ID NO: 1018 - DNA, 2405 bp, Panicum virgatum
gttacacggtcacttccgagccccacaggctgcgggccccgcggcccagggaacttcttccctgtcccaccttcagtgaccgcgtctcctacaagtatccgttcctggacccacgcgacagtctccgcaaggctcccattccctcaccccaccccacgcgcacgtccggtcgtgcaccgccctccgctttaaaccggcgaagcattttccgctcgggaaaacccgcgcttgattttccttttttctatcacccacctactaatttccgaacccctgttcgcgtcgctcgctcgggtttggatccgagcacaggcccggccggcggatgctgtagagaaatggcggaggccgtcgcgtccgcgggtgggctcgccatggcggcagcctcgacctccgtcacgcccggccaggtttctgctattctggggtttctttgggttttcgcagcctgggcatatgctgaggttctctttcataggaagaatgctgcttctattaaaactagatactcggatgtcaatttagcagtaatggataatagttcagtcaaagaagatcaaacacttctgttggaggagggtggccaagctgtagctgcaaagccagcttataattccttcacatcacaaatgctcagacttttcttcatggaccagatgcttcttctggagaatcgtttaacactgagggcaatatctgagtttggagggtatctactttatttttacatatgtgatcgtactgacttactcggagagtctgccaagaattacagccgagatctgttccttttcctctactttcttctcattattgtatcagctatgacttcctttaaagtccatcaagacaagtctgcactcacagggaaatctatattgtacttgaacaggcatcaaaccgaagaatggaagggttggatgcaggtgttattcttgatgtaccactactttaacgctaaagagatctacaatgcaatccgtgtgtttattgctgcatatgtctggatgactggatttggcaacttctcttattattatgtgaggaaggatttcagtctaggaaggtttgctcagatgatgtggcgcctcaatttctttgttatattgtgctgcattgtcctgaacaatgactatacactctattatatttgccctatgcacacccttttcaccctaatggtttatggtgctcttggaattcttaacaaatataacgagattagatcggtgatggcaatgaaatttgttgcttgcttcttggttgttatcctggtatgggaagttccaggtgtctttgacatagtatggagcccatttacgtttcttctaggctatactgatccttctaaaccagatctcccccggttgcatgagtggcaattccgatctggactggatcgctacatttggatcgtggggatgatatatgcgtattaccacccaactgttgagaagtggatggagaagctggaagaaactgaactgagaaccaaactctatattaagggctcgatagttacagtatctttgacggctggttatttgtggtatgaatacatttataagctggataagattacatacaacaagttacatccctatacatcctggatccccataactgtctacatatgcctacgcaacttcacccaggaattcaggagcttctctctcacactatttgcctggcttggaaagattacactggagacatacatatctcagttccacatctggctcagatcaagggtgcccaatggacaaccgaaatggctattgacaataatcccaaattacccactgctcaatttcatgctcactactgctatatatgtcgcggtttcccacaggctcttagagttgactaataccttgaagatggcatttgtgcccagtcgtgacaacaagcgcctctcatacaattttgtagcaggcattaccatttcagttgcactatactgtgtatcatttgttctagttggcattgcaggatactaggaaatctttttattttcattttcaagtgttctatttggtgttctagttcaatgactaggccagttcaatcgtgagcaaattcaaggcgacacgtcacgcactgcccagaaagctgctatttctttcactggagtaagttttgcctgagttccttggtgaaaagtaatcgagctgcgcctcacaagaacagaagatcagtgtaacatacgagggaaccaaccccatgaaggggatatgataagaatagatattcctgtatagccgttgagatgcatacgtcggctgttgaaatcagatgtttcccatttttgtttaatatagacagaatggtgatgagaagttcgactacttgattctcgttttatatgctcggatgttgatagtgatcggaattatgggatcccc

SEQ ID NO: 1019 - DNA, 2314 bp, Oryza sativa
gcacctaattttcttcgtcctctccctctcttcttctcttctcttctctgctcggctcctgtacgcggctggatccgagcggcgcaggaaggaggcggggcggatgctgtagagagaatggcggaggcgatcgcgtccgcgggtgggatcgccatggccgcctcgacctccctcacgccgggccaggtctctgctcttctgggatttctttgggttttcaccgcctgggcatatgcggaggttctctattataggaagaatgctgcttctattaaagcacactcggatgtaaatttagcagtaatggattctagctcaaacaaaggagaggatcaagtgatgttattggaggagggtgtccaagcaccagtgcaaaagccagtttatgcttctctcacatcacaaatgttcagacttttcttgttggaccaggcacttattctagagaatcgattgacgttgagagcaatatctgagtttggaggtcatctgctttacttttacatatgtgatcgcacaaatctactgggagagtctgcgaagaattacagccgagatatgttccttttcctttactttcttcttattatcgtagcagctatgacttctttcaaggtccaccaagacaagtcgtcattcacggggaaatctatactgtatctgaataggcaccaaactgaggaatggaagggttggatgcaggtgctgtttttgatgtaccactacttcaatgctaaagagatatacaatgcaattcgtgtgttcattgctgcatatgtctggatgactggatttggtaacttctcctattattatgtgcggaaggatttcagccttgcacgatttgctcagatgatgtggcgcctcaattttttcgtggcattctgttgtattgtgctaaataatgactacaccctctattatatttgccctatgcacacactttttacccttatggtttatggtgctcttggaatactaaataagtataacgagattggatcagtgatggctataaagtttgttgcctgctttttggtggttatcctgatatgggaaatcccaggagtcttcgagattgtctggagcccattcacgtttcttctcggctatactgatccatctaaacctgatctccctcgattgcatgagtggcatttccgatctggactggatcgctacatatggattgtggggatgatttatgcttattaccatccaactgttgagaagtggatggagaagcttgaagaagctgaaacgaaaactaaactctatattaaggccttgatagtttcaattgctttaacggctggttgtttgtggtacgagtacatttataagctagacaagattacctacaacaaataccatccctatacatcctggatccccataactgtgtacatctgcttacgcaacttcactcaagaattccggtgctgctctctcacactatttgcctggctcggaaagattaccttagaaacgtacatatcacagttccatatttggctcagatcaaaagtgcccaatgggcaacctaaatggctattgacaataatcccaaattacccaatgctgaatttcatgctcacaactgctatatatgttgcagtctcccataggctatttgagttgactaacaccttgaagatcgcatttgtgcctagtcgtgacaacaagcgcctctcgtacaattttgtggcgggaattgcaatttcagtggcgctatattctttatcatttcttatagttggcgttgcaggatactagcaagtcctatagttggccttatgtggcatctgcaaagctgatttgattaccttcacggcttggagacttccattgtttcaccctgagcttcgttttttatgagtgttacatggtgaaaaggagtcgggatgcagaacaaaaaatgatcagggagagtgtaacatgtagcattaaaccccaaatgggaatataatgaagtagatatatgcctgtatagccgttgaaaattgaaatgcatatgtaagcgagctcgttggctatagaaacttctctctcttggcctcttggcccgttgagattgagatttgaaataggatagtggaaacatgtaagaatattattcttttgacccttctcgaaataacgttgttagcttggtgcaagctgggtaaatattttgttcgcctgcgttttgagttgttattttgtattgaatcatgtacacatgataaccaaatatttcgtctcgtaccaaacgtccaaactatacttctattgggaaatttaagacagaggggagcctgaaaactattcaatc

SEQ ID NO: 1020 - DNA, 2303 bp, Sorghum bicolor
cgctttaaaccggcgagtcccatttcctctcacataaacccgcgcttatttctttttctctcacctaatttccgtcctcgtgttggcgttgctcgcctgggtttggatccgagcgggggggctcgggccggcggatgctgtagaggaatggcggaggctgtcgcgtccgcgggcaggctcgccatggagccctcgacctccgtcacgcccggccaggtttctgctattctgggctttctatgggttttcgcagcatgggcgtatgctgaggttctcttccataggaagaatactgcttctattaaaactagacattcagatgtcaatctagcagtaatggataacatttcagtcaaagcagaagaccagacaatgttgttggaggagggcggccaagcagtggttgcaaagccagcttacacttccctcacatcacaaatactcagacttatcttcatggaccagatgcttcttctggagaaccgtttaacactgagggcaatatctgagtttggagggtatctactttatttttacatatgtgatcgtacaaacttgctcggagagtctgccaagaattacagccgagatctgttccttttcctctactttcttcttatcatcgtagcagctatgacttcctttaaggtccatcaggacaagtcagcattcacaggaaaatctatactgtacttgaataggcatcaaaccgaagaatggaagggttggatgcaggtgctattcttgatgtaccattacttcaatgctaaagaaatctacaatgcaatccgtgtgttcattgctgcatatgtctggatgactggatttggcaatttctcttattattatgtgaggaaggatttcagtcttggaagatttgctcagatgatgtggcgcctcaatttctttgtgatattctgctgcattgtcctgaacaatgactatacactctattatatttgtcctatgcacacccttttcaccctcatggtttatggtgctcttggaattctaaacaaatataatgagattagatcagtgatggcaatgaaatttgttgcttgcttcttggtggttgtcctggtttgggaagttccaggtgtctttgacatagtatggagcccattcacatttcttctaggctataccgatccttctaaaccagatctcccccggttgcatgaatggcaattccgatctggactggatcgctacatttggattattgggatgatatatgcatattaccatccaactgttgagaagtggatggagaagctggaagaaactgaaatgagaaccaaactctatattaaggcctcaatagttacagtgtcattgatggctggttatttgtggtatgaatacatttataagctggataagattacttacaacaagctgcatccatatacttcctggatccccataactgtctatatatgcctacgcaacttcactcaagaattcaggagcttctccttcacactatttgcctggcttggaaagattacactagagacatacatatctcagttccatatctggctcagatcaagtgtgcccaatgggcaaccaaaatggctattgtcaataatcccaaattatccactgctcaatttcatgctcactactgcgatatatgttgcggtttcccataggctcttcgaattgactaataccttgaagacggtatttgtaccaaatcgtgacaacaagcgcctctcatacaattttgtggcaggagctgccatttcggctgcactgtactttgtatcatttgttctaattggcattgcaggatactaggaagtctagttattgccctttcttttgttcaattagttacaacgacaaagcctgatcgacagagcaaatttaaggcgacacagcacgcactgctaggggggctgctatttcagtcactggactcgggttttatctgagttacatggtgaaggaaaaaattgctgtgcaaggcagaagatctcgaagagtgtaacatatgagtgaaccccaatcccaagaggggatatgataaaaaaaatatatatatatatccctgtataggcgttggaacgcaaaccgacttagcgagtgatcacgtcagctgtgaaaatcagattttgttccttgttttgtttaaaagcttgaaatagacagaatggttcctccttttttgggggggtttaaagcatgaaagtcagaggcctcatatttttcctccggttactagggagtcgtcctgcaatggctgcttgctttgaatgcatatgcatattcctgaaactctgaaagcgttc

SEQ ID NO: 1021 - DNA, 2207 bp, Zea mays
cgctttaaaacggcgagtccatttttcctctcacataaacccgcgctcattcctttttctctcacctaattcccgtcctcgtgtgttggcgctgctcgcttgggtttggatccgatcgagggctcggcccggcggatgctgtagaggaatggcggaggctgtcgcgtctgcgggcaggctcgccatggactcttcgacctccgtctcgcccggccaggtttctgctattctgggctttctgtgggttttcgcagcatgggcgtatgctgaggttctcttccataggaagaatactgcttctattaaaacacattcagatgtcaatctagcagtgatggatgacagttcagtcaaagcagaagaccagacaatgttattggaggagggtggtcaagcaatggctgcaaagccagcttatacttccctcacatcacaaatactcagacttatattcatggaccagttgcttcttctggagaatcgtttaacactgagggcattatctgaatttggaggttatctactttatttttacatatgtgatcgtacaaacttgcttggagagtctgccaagaattacagccgagatctgttccttttcctctactttcttcttatcattgtagcagctatgacttcctttaaggtccatcaagacaagtcatcattcacaggaaaatctgtactgtacttgaataggcatcaaactgaagaatggaagggttggatgcaggtgctattcttgatgtaccattacttcaatgctaaagaaatctacaatgcaatccgtgtgttcatcgctgcatatgtctggatgactggatttggcaatttctcttattattatgtgaggaaggatttcagtcttggaagatttgctcagatgatgtggcgcctcaatttctttgttatattctgctgcattgtcctgaacaatgattatacactctattatatttgtcctatgcacacccttttcaccctcatggtttatggtgctcttggaattctaaacaaatacaacgagattagatcagtgatggcaatgaaatttgttgcttgcttcttggtagttgtcctggtttgggaagttccaggtgtctttgacatagtatggagcccattcacattccttctaggctataccgatccttctaaaccagatcttccccggttgcatgaatggcaatttcgatctggactggatcgctacatttggatcgtggggatgatatatgcatattaccatccaactgttgagaagtggttggagaagctggaagaaactgaaatgagaaccaaactctatattaagacctcaatagttacagtgtcaatgatggctggttatttgtggtatgaatacatttataagctggataagattacttacaacaagttgcatccatatacatcctggatccccataactgtctacatatgtctacgcaacttcactcaagaattcaggggcttctccctcacactatttgcctggcttggaaagattacactagaaacatacatatctcagttccatatctggctcagatcaagtgtgcccaatggccaaccaaaatggctattgtcaataatcccaaattatccactgctcaatttcatgctgactactgctatatatgttgcggtttcccataggctcttcgaattgactaataccttgaagatggtatttgtaccaaatcgtgacaacaagcgcctctcatacaattttgtggcaggaacagccatttctgctgccctgtactttgtatcgtttgttctaattggcattgcaggatactaggaagtctagttattgcctttttctttgttcgattagttacaacaaggcctgatctactgatcaaatttaaggcgacacagcacgcagccacgcactgctaaggaacctgcaatttcattcactggagtcaggttttatctgggtttcatggtgaagaaaaaaaattgctgtgcaaggcagaagatctcgaagagtgtaacatatgagtgaaccccaatcccaagaggggatatgataaaaatatctctgtataggcgttggaacacataccgacttaccgagtggtcacgtcgtctgtgaaaatcagattttgttccttgttttgtttaaaagcttgaaatagacagaattgttccttttttttgtttaaagcgtaaaatagacataatggtctcatgcg

SEQ ID NO: 1022 - DNA, 2095 bp, Saccharum officinarum
atttcttttctctcacctaatttccgtcctcgtgttcgcgttgctcgcttgggtttggatccgagcggggggctcggcgcggcggatgctgtagaggaatggccgaggctgtcgcgtccgcgggcaggctcgccatggagccctcgaccgccgtcacgcccggccaggtttctgctattctgggctttctatgggttttcgcagcatgggcgtatgctgaggttctcttccataggaagaatactgcttctattaaaactagacattcagatgtcaatctagcagtaatggataacatttcagtcaaagcagaagaccagacaatgttgttggaggagggcggccaagcagtggttgcaaagccagcttatacttccctcacatcacaaatgctcagacttatcttcatggaccagatgcttcttctggagaaccgtttaacactgagggcaatatctgagtttggagggtatctactttacttttacatatgtgatcgtacaaacttgctcggagagtctgccaagaattacagccgagatctgttccttttcctctactttcttcttatcatcgtagcagctatgacttcctttaaggtccatcaggacaagtcagcattcacaggaaaatctatactgtacttgaataggcatcaaacggaagaatggaagggttggatgcaggtgctattcttgatgtaccattacttcaatgctaaagaaatctacaatgcaatccgtgtgttcattgctgcatatgtctggatgactggatttggcaatttctcttattattatgtgaggaaggattttagtcttggaagatttgctcagatgatgtggcgcctcaatttctttgttatattctgctgcattgtcctgaacaatgactatacactctattatatttgtcctatgcacacccttttcaccctcatggtttatggtgctcttggaattctaaacaaatataatgagattaggtcagtgatggcaatgaaatttgttgcttgcttcttggtagttgtcctggtttgggaagttccaggtgtctttgacatagtatggagcccattcacatttcttctaggctatactgatccttctaaaccagatctcccccggttgcatgaatggcaattccgatctggactggatcgctacatttggattattgggatgatatatgcatattaccatccaactgttgagaagtggatggagaagctggaagaaactgaaatgagaaccaaactctatattaaggcctcaatagttacagtgtcattgacggctggttatttgtggtatgaatacatttataagctggataagattacttacaacaagctgcatccatatacatcctggatccccataactgtctatatatgcctacgcaacttcactcaagaattccggagcttctccctcacactatttgcctggcttggaaagattacactagagacatatatatctcagttccatgtctggctcagatcaagtgtgcccaatggccaaccaaaatggctattgtcaataatcccaaattatccactgctcaatttcatgctcactactgctatatatgttgcggtttcccataggctcttcgaattgactaataccttgaagacggtatttgtaccaaatcgtgacaacaagcgcctctcgtacaattttgtggcaggaactgccatttcggctgcactgtactttgtatcatttgttctaattggcattgcaggatactataaagtttagttattgcctttttcttttgttcaattagttacaacgacaaagcttggtcgacagaacaaatttaaggcgacacagcacgcccagctaaggaacctgctatttcattcactggaatcaggttttatctgagttcctggtgaagaaaaaagttgatgtgcaaggcagaagatctcgaagagtgtaacatatgagtgaaccccaatcccgagaggggatatgataaaatataaacgcataccgacttaccaagtgatcacgtcggctgtgaaaatcagattttgttccttgttttgttcaaaagcttgaaatagacaaaggggtcatcc

SEQ ID NO: 1023 - DNA, 3161 bp, Oryza sativa
aaccgtaaacatgcgtagtacattatatttgagagaaacctggtccaatgtgatgttacatggttgaaaaataaaactactactgtttggcgctacttaccaacccaaactaaacaaaaggaaaaggcataataactgggcttctagaggagtaatttggcttacataccctgatgtccactttaatctttaaaaaaaacatcgttatggccatcgccatcacacaccagtgattagctcctcaaccgacaactccacctccggcagctacatcgccgaaactagtaccacgccactgacaggtgggtcagtgtcgacgcaatggcccacccgtcagcgacgcggaggaacagcccgcttcgtttgagcgaggtggtggcacggccgttgatggggacgcgtgtttaaacgttggagaaaagtcaccgcgtcatgtgcaatcgcctcgcgacgtcgcttgcccctgggctggttacaactggccgccactggttaattaaccccccgtttataaccgagcaaaaaaaaaagccagagaaaattaccatacaaaacccgtagggccccacgcgggtggccccaccggtcatacgcccacgcgagaggatcaagtcaaattaccgggcgacagcggggaaaggagtagaagcatcgcatctcgcaacgcgttggctggctattcccctccccttttaccaccaccaccttccccttcggccttctccttctcctcctccttcctcctccttgcagcggccgggtcagggggttgattcgatttcgattccgatttcgcgtctccccagatttccccttccattccgcctcccgatcgctcagacagccaccgcaatccgctctccgaggccaacgtgcgcgcttcgctcgctcgcgggtcgcggcaccactccgcctcgccctttctcttattaattcgcctccaactccgcggttcaaaacctcctcggcttcttcctccaccaccaccaccaccaccaccactccgcgccgccgacgccgccgccgtcgccgtagacgcggtataccggtgattccttgcctgcatttttgatttgctgcttttgggttgggggaggagggtttgtttgtttatttgtttgtttgatcggtgtggggggatcggaggaaggggcaggagagggaggggggcaaaatgtgggtggcggagcgggtggtgggggagcggcggatgcgggagatccagcggttcgcgaggaacgcgaagctcaccgtagtgtgcctgctgctcaccgtcgtcgtgctccgcggcaccgtcggggcgggcaagttcggcacgccgcagcaggacctcatcgagctccgccaccgcttcatctcgcacccgcaccgcgcgctggcggagcaccacgacgcgctgtcgaggggcggcggctcgtcgtcctcctccgggcgcgcggcccagcgggacgacgagccggacccgccgccgaggacgctccgggacccgccctacacgctgggccccaagatctccgactgggacgagcagcgggccgcgtggcaccgccgccacccggagacgccgcccttcgtcaacgacgtcaagccgcgggtgctgctcgtcacgggctcctcgcccaagccgtgcgagaaccccgtcggcgaccactacctcctcaagtccatcaagaacaagatggactactgccgcgtccacggcctcgagatcttctacaacatggcgctgctcgacgccgagatggccggattctgggccaagctcccgctcctccgcgcgctgctcctcgcgcacccggagatcgagttcctctggtggatggactccgacgccatgttctccgacatggcattcgagctgccatgggagcggtacggcccctacaacctcatcatgcacggctgggatgagatggtctacgacgacaagaactggattggcctcaacacaggcagcttcttgctgcgcaactgccaatggtcgcttgatttccttgatacatgggcaccaatgggaccaaagggccctgtccgtattgaggccgggaaggttttgaccaagtacttgaaggatcggccggtgtttgaggctgatgatcagtcggccatggtatacatccttgctacagagcgtgagaaatggggtgacaaggtgtaccttgagaatgggtattacctccatggatattggggtatcttggttgataggtatgaggaaatgcttgagaattaccatccaggacttggtgatcaccggtggccactggtcactcactttgtcggatgcaagccgtgtgggaagtttggggattaccctgtggagaggtgcctcaagcagatggagcgtgctttcaattttggggataatcagatcttgcaaatgtatgggtttacacacaagtcgcttggcagcaggaaggtgaagaggatcaggaatgagactagcaacccacttgatgtcaaggatgaactagggttgctccacccagcattcaaggccatgaagactacttctacgtgataagtgataattagagtacaatgccacgcgttatttcgttcattgtagatccttttgggtctaaaatcttaaaaaggtgttctttttgtagacttgggttgacaagggagtttgggttgggatcaaacatcaaaggatggatatctatgttgtaatgtgaaattttaggagaacaatggtatgtttattgctggcataatttatgtcttacacttctagaaattgagttagtgaagggaactctgttaattgatcaccactatatatttctatagaatttcatatttcttattcgatgaatagtattcttccggtgatattcaatgaatggtttagatttttcttttgtcacaagtgttttggttatgtcttactcaaaagaatttttcatgtgcttattggtaccttcagaaggatatggttgtcggcctctctgctcgctattagtggtagttaggtagcaagatatccagtttgtcacatatgagaggctcggagctctccaaagtgtgcttggctgtaacctacttttcagtttctatattcctgtttcgtcctagcgttcatcgttatccattgtttgtttaaatcattgaagagggcctgatgcaatacatcaattcgtcagctgtcatcttta

SEQ ID NO: 1024 - DNA, 2365 bp, Zea mays
tttttttcatcgagttctttacatgtcaccgtcatcacacaaatcaaaacccgagcaaattaaccgacacctctacgccgtgggtaccacgccccccgggcccaccctacatggacccctccccagaccagagggtaaacagcgatcagttcgttaattaaccgatcaattccttaattaaccaaccgtgtggagggaggcgacagcggtggatgaaagaggtgtcctggaagcatcgcatctcgtgtccgcgtcgcctcattccatgacctctctctctctctctctcgcctcttcttcttcttcctcccctccccttctccccccatctgcggcggggttgattcgatttcgattcccttccccatccatcgcccacctcccctacagacagccaacgcaatccgctccccgaggcgcctccctgaccctgactccctccaccccacaacgtgcgcgctcactcgcgggcggggccgggccgggccggcaggcacactcaccgtcaccacccttattaattcctcttccgcgtccgcgcttcaaaacctcctcccgtcctccgcctcgtcccccctctaccactctccccagcaccccggcggccgcattgcttgccgccgcaccgtgtccggctagggcctctctgggctcctgcatttcgattccctcccctgcctgtgctttggtctgggccggttgcaaggagggggaagggagggaggatttgatcggagggcgaaaatgtgggcggagcgggtggtcggggagcgacggatgcggcagatccagcgcttcgcgcggaacgccaagctcaccgtcgtctgcctcctcctcaccgtcgtcgtgctccgcggcaccgtcggcgccggccgcttcggcacgccgcagcaggacctcatcgagctacgccagcacttcgtgtcccacccgcaccgggcgctcgccgagcaccacgacgccaggtccagggcctccaccaccaccacatcgtcctcgtcctcctccgcccgccgcgacgacgaccccgacccgccgccgaggacgctcagggacccgccctacacgctgggccccaagatctccgactgggacgagcagcgcgccgcctggcaccgccgccacccggagacgccgcccttcctcaacgacatcaagccacgggtgctgctcgtcacggggtcctcgcccaagccctgcgagaaccccgtcggggaccactacctcctcaagtccatcaagaacaagatggactactgccgcgtccacggcatcgaggtcttctacaacatggcgctgctcgacgccgagatggcaggcttctgggccaagctcccgctcatgcgggcgctgctcctcgcgcacccggaggtcgagttcctctggtggatggactctgacgccatgttcaccgacatggcattcgagctcccgtgggagcgctacgggccgtacaacctcatcatgcacggctgggacgagatggtctacgacgacaagaattggatcgggctcaacaccggcagcttcttgctgcgcaactgccagtggtcgcttgacatgctggatacctgggcgccaatggggccaaagggccctgtccgcattgaagccggcaaggtgctgaccaagtccttgaaggatcggccagtattcgaggccgacgatcagtcggccatggtgtacatcctcgcgacgcagcgcgagaaatggggtgataaggtttaccttgagaatgggtactacctccatggctactgggggatcttggtcgacaggtacgaggagatgcttgagaattacaagccagggctcggcgatcaccggtggccactcgtcacacactttgtcgggtgcaagccgtgtggcaaatttggagactaccctgtcgagcgatgcctcaagaatatggaccgtgcattcaattttggggataaccagatcttgcagatgtatgggttcacacacaagtcactagcaagcaggagagtgaagaggaccaggaacgagaccagcaacccacttgagacaaaggatgagcttgggttgcttcatccagcattcaaggctgtgaagacttccacatgattattagagtacaattcaacttgttattttcttggttcgttctagatcctgttgggtctaaatccaaagtgttctttttgtagaatcgggcgagagcaaaagtttgggttggggttatgggatggatatctttgttgtaatgtgaggtattaggagaattatgttatgtttatttattggcataagtcatgtcttacactcgtacaaacgagttaacggatgaactcaagttactggttgcatgatagatttcaatagagttccctgtttttctctt

SEQ ID NO: 1025 - DNA, 2721 bp, Sorghum bicolor
ttttttccatgccacagtcaagacggaaatcaacggattaataataatccaaacaaattaaccgacacctccatggtgcctgtactccatacacgttcccccggggcccactctccatggacccaccaccgcatgaagggaaaccagaagaaggtaaacagcgatcaattccttaattaaccaaccgtgttgaggcaggcgaggcgacagcgggggtggtgaaaaaggtgtcctagaagcatcgcatctcgtgtccgcgtcgttctgcgctccgcttcattccacacctccctctctctctcctcgccttcttcttcctcccctcccccttctccccccatctgcggcggggttgattcgatttcgattcccttcccccatccatcgcccacctcccccagacagccaacgcaatccgctccccgaggcgcgcctccctgaccctgactccctccccccacaacgtgcgcgctcactcgcgggcgggcgtgcgggcggggccggcaccactcaccgtcaccacccttattaattcctcttccgcgtccgcgcttcaaaacctcctcctccgcctcgtccccccctctaccactctctctccagccccgcggcggccgcattgctcgccgccgcaccgagtccggctaggtcccctcttggctcttgcatttcgatttcgcctccccctgtccctgtgtttggtttgggttgggttggttgcaaggaggggacggggagagtttgatcggagggccaaaatgtgggcggagcgggtggtcggggagcgccggatgcggcagatccagcgcttcgcgcggaacgccaagctcaccgtcgtttgcctcctcctcaccgtcgtcgtgctccgcggcaccgtcggcgccggccgcttcggcacgccgcagcaggacctcatcgagctccgccagcacttcgtctcccacccgcaccgggcgctcgccgagcaccacgacgccaggtccagggcctccaccaccaccacgtcgtcctcctcctccgtccgccgcgacgacgagcccgacccgccgccgaggacgctcagggacccgccctacacgctgggccccaagatctccgactgggacgagcagcgcgccgcctggcaccgccgccacccggagacgccgcccttcctcaacgacatcaagccgcgggtgctgctcgtcacgggttcctcgcccaagccctgcgagaaccccgtcggggaccactacctcctcaagtccatcaagaacaagatggattactgccgcgtccacggcatcgaggtcttctacaacatggcgctgctcgacgccgagatggccggcttctgggccaaactcccgctcctgcgggcgctgctcctcgcgcacccggagttcgagttcatctggtggatggactctgacgccatgttcaccgacatggcattcgagctcccttgggagcgctacgggccatacaatctgatcatgcacggctgggacgagatggtctacgacgacaagaattggattgggctaaacaccggcagcttcttgctgcgcaactgccagtggtcacttgacatgctggatacctgggcgccaatggggccaaagggccctgtccgcattgaggctggcaaagtgctgaccaagtccttgaaggatcggccagtattcgaggccgatgatcagtcggccatggtgtacatcctcgcaacgcagcgcgagaagtggggtgataaggtttaccttgagaatgggtactaccttcatggctactgggggatcttggtcgacaggtatgaggagatgcttgagaattacaagccagggctcggcgatcaccggtggccgctcgtcacacactttgtcgggtgcaagccatgtggcaaatttggagactaccctgtcgagcgatgcctcaagaatatggatcgtgcgttcaattttggtgataaccagatcttgcagatgtatggattcactcacaagtcacttgcaagcaggagagtgaagaggatcaggaatgagaccagcaacccgcttgagacaaaggatgagcttgggttgcttcatccggcattcaaggctgtgaagacttccacatgataattagagtacaattccacttgttattttgttggttcgttctagatcctgttgggtctaaatccaaagtgttctttttgtagaatctggtggtaacagaagtttgggttgggatcatgggatggatatctttgttgtaatgtgaggtattaggagaaatgatgttatgtttatttattggcataagttatgtcttacactcgtagaaatgagttaaatggatggactcaggttattggtcgccatgatagatttcaatatagtttcctgtttttctcttattgcggggatttcttttatgtgtgccagtaccatgtaggtgtccttaaatcaagcctcgaaggaattattcttgtgatattggtgtcttctttcacaggataggatagcatatcttgtgagccaattgttttgctctcttctttgccttactattagtggttgttgggttcctagatacagttttggtgtatatacaagctcaaatttctcattaaaaaattatatatattatgcagaggcgggagttactttcagtttccattgtcatgatttgtccttagctttatctttaacttatccaatatatattatttaagtgggattgatgctatccaccatt

SEQ ID NO: 1026 - DNA, 2544 bp, Panicum virgatum
gccggggggtaaaatggtgtggaagcatcgcatctcgtgtccgcgtcgtcctgcactgctccccattctctctcttcccccagcccagcctcgccttcttcctcctcttcctctccccccaatctgcggcggggttgattcgatttcgattcccttcccaccaccgatcgcccaccacctccttcccccagacagccaacgcaatccgctccccgaggtgcctcccctcgcaacgtgcgggctcgctcgcgggcggggccggcacactcaccgccaccaccctcttattaatttccccatccccctccgcgcttcaaaacctcctccgcctccgcctccgcctcatcctcctgctccgccacttccaagccccgcgggcgccgcattgctcgccgccgccgccgccttggttcctcttgcgcccccttctgtatttggtggtttggtctgggtttggttgcgaggagttgtttgatcggaggaggggaaaatgtgggtggagcgggtggtcggggagcgccggatgcgggagatccagcgcttcgcgcggaacgctaagctcaccgccgtctgcctcctcctcaccatcgtcgtgctccgcggctacgtcggcgccggccgctacggcacgccgcagcaggacctcatcgagctccgccagcacttcgtctcccacccgcaccgggcgctcgccgagcaccacgacgccaggtccaggggctccgccacaaccacctcgtcgtcctcctcctccggacgcggcgacgacgagcctgacccgccgccgaggacgctcagggacccgccctacacgctgggccccaagatctccgactgggacgagcagcgcgccgcctggcaccgccgccacccggagacgccgcccttcctcaacgacgtcaagccgcgggtgctgctcgtcaccggctcctcccccaagccctgcgagaaccccgtcggtgaccactacctcctcaagtccatcaagaacaagatcgactactgccgcgtccacggcatcgagatcttctacaacatggcgctgctcgacgccgagatggccggattctgggccaagctcccgctcatccgggcgctgctcctggcgcacccggaggtcgagttcctctggtggatggactccgacgccatgttcaccgacatggcattcgagctcccttgggagcgctacgggccgtacaacctcgtcatgcacggctgggacgagatggtctacgacgacaagaattggattgggctcaacacaggcagcttcttgctgcgcaattgccagtggtcgcttgatatgctggatacctgggcgccaatggggccaaagggccctgtccgcattgaggctggcaaggtgctgaccaagtccttgaaggatcggccagtatttgaggctgatgatcagtcggccatggtgtacatcctcgccactcagcgtgagaaatggggtgacaaggtgtaccttgagaatgggtactacctccacggctactggggcatcttggttgataggtatgaggagatgcttgagaattacaagccagggcttggggatcaccggtggccgctcgtcactcactttgtcggttgcaagccttgcggcaaatttggggactaccctgttgagcgttgtctcaaacagatggaccgtgcattcaattttggggataaccagatcttgcagatgtatgggttcacgcacaagtcgcttgcaagcaggagagtgaagaggatcaggaatgagactagtaacccactcgagatgaaggatgagcttgggttgctccaccccgcattcaaggctgtgaagacttccacatgataattagagtaccaattccacttgttattttgtttcttcgttctagatcctgttgggtctgaatctgaagtgttctttttgtagaatctggtgacaatgggagggttgggatcatgggatggatatgttataatgtgatgagatgttaggataatgatgttatgcttatttgttggcataagttatgtcttacactcctagaaattgagttaatgaatgaactcaagttattggtcaccatgatagccttcaatagaatttcctgtatggttgtgattttccattgcctccagtatacgagtataccagtaggtgttgaattattcatgagatatcaggatccttaagcaggataggatatggttgtcctctgagtcaattattttgctttcttgtttgccttactattagtggtgatgtggtagcaagaaactctagttatgtatatatgtgagctcaaaatcctcaacaagatatgcgttgctaggagttggtttcagtttacactgtcattattttgtccttgcttcatctatatcttctatttaaatcattgaagaggagggcttgatactattcaccatttccttgcttttgtaacatcttttattggcattgatgagaaactgtgcattgatgtgaacttgtgtgcgctggattttgtattgcatgccattatttttgtgctgtgacctgttgatgtaaacccc

SEQ ID NO: 1027 - DNA, 2305 bp, Zea mays
tgaggcaggcgacagcggggatgaaaaagtcatcctagaagcatcgcatctcgtgtccgcgtcgttctgcgctccgcctcattctttctaccttcgtctctctctgtgaccacctccacccctcctcttcttcttcctccccttctcccccgatctgcggcggggttgattcgatttcgatccccttctccatccgtcgcccacctccccgcccaggcagccaacgcaatccgctccccgaggcgcctccctgaccctgactcccctgcccccacaacgtgcgtgctcactcgcggtcgggcgggcggggccggcacactcaccgtcaccacacttattaattcctcttccgcgtccgcgcttcaaaaacctcctccggctcgtccccctctaaccagtccccagtcccgcggcggccgcattgcccgccgccgcaccgtgtccggctaggactaggacccctgtttgggctcttgcgtttcgattcctgggtcgtctgcaaggagtgtggccgacggagggggccaaaatgtgggcggagagggtggtcggcgagcgccggatgcggcagatccagcgcttcgcgcggaacgccaagctcaccgtcgtctgcctcctcctcaccgtagttgtgctccgcggcaccgtcggcgccggccgcttcggcacgccgcagcaggacctcatcgagctccgccagcacttcgtctcccacccgcaccgggcgctcgcggagcaccacgacgccaggtccagggcctccaccaccaccacgtcgtcctcgtcctcgtcttcctccggccgccgcgacgagcccgacccaccgccgaggtcgctcagggacccgccctacacgctggggcccaagatctccgactgggacgagcagcgcgccgcctggcaccgccgccacccggagacgccgcctttcctcaacgacatcaagccacgggtgctgctcgtcacggggtcctcgcccaagccctgcgagaaccccgtcggggaccactacctcctcaagtccatcaagaacaagatggactactgccgcgtccacggcatcgaggtcttctacaacatggcgctgctcgacgccgagatggccggcttctgggccaaactcccgctcatgcgggcgctgctcctcgcgcacccggaggtcgagttcctctggtggatggactctgacgccatgttcaccgacatggcgttcgagctcccgtgggagcgctacgggccatacaacctgatcatgcacggctgggacgagatggtctacgacgacaagaactggattgggctcaacaccggcagcttcttgctgcgcaactgccagtggtcgcttgatatgctggatacctgggcgccaatggggccaaagggccctgtccgcatcgaggccggcaaggtgctgaccaagtccttgaaggatcggccagtattcgaggccgatgatcagtcggccatggtgtacatcctcgcgacacagcgcgagaaatggggtgataaggtttaccttgagaatgggtactacctccacggctactgggggatcttggtcgacaggtatgaggagatgcttgagaactacaagccagggctaggtgatcaccggtggccgctcgtcacacattttgtcgggtgcaagccatgcggcaaatttggagactaccctgtcgagcgatgcctcaagaacatggaccgtgcattcaattttggggataaccagatcttgcagatgtatgggttcacacacaagtcactggcaagcaggagagtgaagaggatcaggaacgagaccagcaacccgcttgagacgaaggatgagcttgggctgcttcatccagcattcaaggctgtgaagacttccacatgataattagagtacagttccacttgtttattttgttggctcgttctagatcctgttgggtctataatccaaagtgttcttttttgtagaatcgggtgacgacagaagtttgggttggggtcatgggatggatatctttgttgtaatgtgaggtgttaggagaattatgttatgtttatttattggcataagttatgtcttacacgtacaaatgagttaatggatgaactcaagttattggttcaatgatagatttcaatggagtttcctgttttttttattattgccgggatttatgttaggctgtctccactctctagtagactgtgtatacttagactctactgtttatacaataggaggtgagatataaagtgctggagaaggccaaagtgtggtaatagccctgtaggtgttcttaaatcaagcttg

SEQ ID NO: 1028 - DNA, 2696 bp, Setaria italica
cgtcataacggcaaatcaaccgattaacccagtggcaaatttaaccaacacttcccacgccacgctgtccatcacgctctcgccgggcccacctccagggacccaccgcatcaagccaaaccggacggtaaacagcgatcaatcccttaattaaagcagccgcgttggggcaggcgacagcggggggtaaaaaaggtgtggaagcatcgcatcccgtgtccgcgtcgtcctgcgctgcgccccattcctttccctctctctctctctctctccagccgcccagcctcgcccttcttctccttcctcctcttcctcttcttctccccccaatctgcggcggggttgattcgatttcgattcccttcccccccatcgatcgcgcgcctccaagggacagccaatgcaatccgcgcccgggggagtagtcaatccccccccccccccccccccccccaacgtgcgcgctcactcgcgggcggggccggcacagtcaccgtcaccacccttattaatttccccctcccccctccgcgcttcaaaacctcctcctccgttctccgtctcgtcctcttcctccgccactccccagccccgcggcggtcgcattgctcgccgccgcctccccggttcctcttgcgtccccttccttatttggttcttggggttggttttggtctgggtttggttgcgaggaggagggggtggagtttgatcggagggaggggaaaatgtgggcggagcgggtggtcggggagcgccggatgcggcagatccagcgctttgcgcggaacgccaagctcaccgtcgtctgcctcctcctcaccgtcgtcgtgctccgcggcaccgtcggcgccggccgcttcggcacgccgcagcaggacctcatcgagctccgacagcacttcgtctcccacccgcaccgggcgctcgccgagcaccacgacgccaggtccagggcctccaccaccacaaccaccacgtcgtcgtcctcctcatcctcatccgggcgcggcgacgacgagcccgacccgccgccgaggacgctccgggacccgccctacacgctgggccccaagatctccgactgggacgagcagcgcgccaactggcaccgccgccacccggagacgccgcccttcctcaacgacgtcaagccgcgggtgctgctcgtctcgggttcctcccccaagccctgcgagaaccccgtcggtgaccactacctcctcaagtccatcaagaacaagatcgactactgccgcgtccacggcctcgagatcttctacaacatggcgctgctcgacgccgagatggccggcttctgggccaagctcccgctcatgcgggcactgctcctggcgcacccggaggtcgagttcatctggtggatggactctgacgccatgttcaccgacatggcattcgagctcccatgggaacgctacgggccgtacaacctcatcatgcacggctgggacgagatgatctacgacgacaagaactggattgggctcaacactggcagcttcttgctgcgcaactgccagtggtcgcttgacatgctggatacctgggcgccaatggggccaaagggccctgtccgcattgaggctggcaaggtgctgaccaagtccttgaaggatcggccagtattcgaggccgatgatcagtcggccatggtgtacatcctcgccacgcaacgcgagaaatggggtgataaggtttaccttgagaatgggtactacctccacggctactggggcatcttggtcgataggtatgaggagatgcttgagaattacaagccagggcttggcgatcaccggtggccgctcgtcactcactttgtcggttgcaagccttgtggcaaatttggggactaccctgttgagcgttgcctcaagcagatggaccgtgcattcaattttggggataaccagatcttgcagatgtatgggttcacgcacaagtcacttgcaagcaggagagtgaagaggatcaggaatgagactagtaacccactcgagatgaaggatgagcttgggttgctccacccagcattcaaggctgtgaagacttccacatgataattagagtacaattccacttgttattttgtttgttcgttctggatcctgctgggtctgaatctaaagtgttctttttgtagaatcgggtgacagcggcagtttgggttgtgatcatgggatggatatgttgtaatgtgaggtgttaggagaatgatgttatgtttatttgttggcataagttatgtcttacactcctagaaattgagttaatgaatgaactcaagttattggtcgccgtgatagcttttaatagaatttcctatagtctctcttattggctgaatggttgtgattttctccaatgcctccagtgtaccagttggtgtccaattattcttgagatattggggtcctcttaagcaggataagatattgttgtgctctgaaccaattattttgctttcttgtttgccttactattactggtggtgtggtagcaagacgctctagttatgttatatatgtgagctcaaaatcctcaacaaggtatgcctagctaggagttactttcagtttacactgtcattattttgtccttgctttatctttatcttctatttaaatcattgaagagggcttgatactatccaccatttccctgtatttcta

SEQ ID NO: 1029 - DNA, 1893 bp, Secale cereale
acgatttcctcccccttccccctggcctccacctccagacacccaccgcaatccgctccccctcaacgtgcgcgctcgcgcactcccaccccactcgcccccatccttattaattccccttcccttccccacttctaaacctcctcctcctcctcctcctcctccccggcctcgtcctcgtcccgcaccgccgccgcattgctcggccgcggcgtcgatctagacagacgctagacgcgtctgcattttggtcttcctgttcgattcggcttggtgttcgatccgaggggatcgacgggaaaatgtgggtggcggagcgggtgctgggggagcgccggatgcgggagatccagcgcttcacccggaacgccaagctcaccgtcgtctgcctcatgctcaccatcctcgtgctccgcggcaccgtcggggcgggcaagttcggcacgccgcagcaggacctctccgagctgcgccaccgcttcatctcccacccgcagcgcgcgctctccgagcaccacgacgcccgctccaaggcctccgacgacgcctccgccgcccaagcccaagccgcccaggccgcgggcaaggccaaggcccgggacgacgagccggagccgcagcccaggtcgctccgggacccgccctacacgctcggccccaagatctccgactgggacgagcagcgggccgcctggaaccgccgccacccggagaccccgcccttcctcaacgacgtcaagccgcgggtcatgctcgtcacggggtcctcccccaagccctgcgagaaccccgtcggcgaccactacctcctcaagtccatcaagaacaagatcgactactgccgcatccacggcctcgagatcttctacaacatggcgctgctcgacgccgagctggcaggcttctgggccaagctgccgctcctccgcgcgctcctcctcgcgcacccggaggtcgagttcttctggtggatggactccgacgccatgttcaccgacatggccttcgagctgccgtgggagcgctatggctcctacaacttcatcctgcacggctgggacgagatggtctacgacgacaagaactggattggtctcaacaccggcagcttcttgttgcgcaactgccaatggtcactcgattaccttgatacctgggcgcccatggggccaaagggccctgttcgtattgaggctgggaaggtgctcaccaagtacctcaaggaccggccggtctttgaagccgatgatcagtcggccatggtgtatatcctggctacccagcgtgagaaatggggtagcaaggtgtatctcgagaatggctactatctccatggctattgggggatcttggtggacaggtacgaggagatgcttgagaattaccagccagggctcggcgatcatcggtggccgctggtcactcactttgtcgggtgcaagccatgctccaagtttggggattaccctgttgagcgatgcctcaagcagatggaccgggccttcaatttcggggataaccaggtgttgcacatgtatgggtttgagcacaagtctcttgcgagcaggaggatcaagaggatcaggaatgagaccagtaaccctcttgatatgaaggatgattacgggttgctccacccagcgttcaaggccgtcaagactactacgtgataactatagtacactacttccacgtttattttgttcgttcgttctagattctcttggatcaaaatcctataattcttctttttgtagactcagggtaacaaggaaatttggttttggtatcacgggacggatatctatgttgtactgtgaaatgttagagaatgaagttatgttgttgatggcacaatccatgtcttctgcttctagaaatcgagttagagat

SEQ ID NO: 1030 - DNA, 1997 bp, Panicum virgatum
cctcctccttcccccagacagccaacgcaatccgctccccgaggcgcctcccccaccccacaacgtgcgcgctcactcgtcgcgggcggggccggcacacacaccgccaccacccttattaatttccccatccccctccgcgcttcaaaacctcctcgtccgcctccgcctcgtcctcctcccctgccactctcaagccccgcgggcgccgcattgctcgccgccgccgcctcggttcctcctgcgtccccttctgtatttggtggtttggtctgggtttggttgcgaggaggagagaggcggagtttgatcggaggaggggaaaatgtgggcggcgcggttggtcggggagcgccggatgcggcagatccagcgcttcgcgcggaacgccaagctcaccgtcgtctgcctcttcctcaccgtcctcgtgctccgcggcaccgtcggcgccggccgcttcggcacgccgcagcaggacctcatcgagctccgccagcacttcgtctcccacccgcaccgggcgctcgccgagcaccacgacgccaggtccaggggctccgccacgaccaccaccaccaccacgctcctcctcctccggacgcggcgacgacgagcctgacccgccgccgaggacgctcagggacccgccctacacgctgggccccaagatcaccgactgggacgagcagcgcgccgcctggcaccgccgccacccggagacgccgcccttcctcaacgacgtcaagccgcgggtgctgctcgtcaccggctcctcccccaagccctgcgagaaccccgtcggtgaccactacctcctcaagtccatcaagaacaagatcgactactgccgcgtccacggcatcgagatcttctacaacatggcgctgctcgacgccgagatggccggattctgggccaagctcccgctcatccgggcgctgctcctggcgcacccggaggtcgagttcctctggtggatggactccgacgccatgttcaccgacatggcattcgagctcccatgggagcgctacgggccgtacaacctcgtcatgcacggctgggacgagatggtctacgacgacagaattggattgggctcaacactggcagcttcttgctgcgcaactgccagtggtcgcttgatatgctggatacctgggcgccaatggggccaaagggccctgtccgcattgaggctggcaaggtgctgaccaagtccttgaaggatcgaccagtatttgaggctgatgatcagtcggccatggtgtacatcctcgccactcagcgcgagaaatggggtgacaaggtgtaccttgagaatgggtactacctccacggctactggggcatcttggttgataggtatgaggagatgcttgagaattataagccagggcttggggatcaccggtggccgctcgtcactcactttgtcggttgcaagccttgcggcaaatttggggactaccctgttgagcgttgtctcaaacagatggaccgtgcattcaattttggggataaccagatcttgcagatgtatgggttcacgcacaagtcgcttgcaagcaggagagtgaagaggatcaggaatgagactagtaacccactcaagatgaaggatgagcttgggttgctccaccccgcattcaaggctgtgaagacttccacatgataattagagtacaattccacttgttattttgtttcttcgttctagatcctgttgggtctgaatctgaagtgttctttttgtagaatcgggtgacagcaggagtttgggttgggatcatgggatggatatgttgtaatgtgagatgttaggaaaatgatgttatgtttatttgttggcataagttatgtcttacactgctagaaattgagttaatgaatgaactcaagttattggtcaccatgatagccttcaatagaatttcctgtatggttgtgatttttcattgcctccagtatacgagtataccagtaggtgttgaatt

SEQ ID NO: 1031 - DNA, 2028 bp, Pennisetum glaucum
cctccgccactccacagccccgccgcggccaccgcattgctcgccgccccggttcctcttagcgtccccttccttatttggttggttcttggggttggtttttgtctgggtttggttgagaggaggaggaggggtggagtctgatcggagggagggcaaaatgtgggcggagcgggtcgtcggggagcgccggatgcggcagatccagcgcttcgcgcggaacgccaagctcaccgtcgtctgcctgctcctcaccgtcgtcgtgctccgcggcaccgtcggcgccggccgcttcggcacgccgcagcaggacctcatcgagctccgccagcacttcgtctcccacccgcaccgggcgctcgccgagcaccacgacgccaagtccaggtcctcctcctccaccaccaccaccacgtcgtcgtcttcctcctcatccgggagcagcaacgacgagcccgacccgccgccgaggacgctccgggacccgccctacacgctgggccccaagatctccgactgggacgagcagcgcgccaactggcaccgccgccacccggagacgccgcccttcctcaacgacgtcaagccgcgggtgctgctcgtcacgggttcctcccccaagccctgcgagaaccccgtcggtgaccactacctcctcaagtccatcaagaacaagatcgactactgccgcgtccacggcctggagatcttctacaacatggcgctactcgacgccgagatggccggcttctgggccaagctcccgctcatgcgggcgctgctcctggcgcacccggaggtcgagttcgtctggtggatggactctgacgccatgttcaccgacatggcattcgagctcccgtgggagcgctatgggccgtacaacctcatcatgcacggctgggacgagatggtctacgacgacaagaactggattgggctcaacaccggcagcttcttgctgcgcaactgccagtggtcgcttgacatgctggatacctgggcgccaatggggccgaagggccctgtccgcattgaggccggcaaggtactgaccaagtccttgaaggatcggccagtattcgaggccgatgaccagtcggccatggtgtacatcctcgccacacagcgcgagaaatggggtgataaggtgtaccttgagaatgggtactacctccacggctactggggcatcctggtggataggtatgaggagatgcttgagaattacaagccagggcttggcgatcaccggtggccgctcgtcacgcactttgtcggttgcaaaccttgtggcaaatttggggactaccctgttgagcgttgcctcaagcagatggaccgagcattcaattttggggataaccagatcttgcagatgtacggattcatgcacaagtcacttgggagcaggagagtgaagaggatcaggaatgagactagtaacccactcgagatgaaggatgacattgggttgctccaccccgcattcaaggctgtgaaaacttccacatgataattagagtacaattccacttgttattttgtttgttcgttatggatcctgttgggtctgaatctaaagtcttctttttgtagaatcaggtgacagcggcagtttgggttgggatcgtgggatggatatgttgtaatgtgaggtgttaggagaattatgttatgttgatttgttggcataagttatgtcttacactcctagaaattgagttaatgaatgaactcaagttattggtcgctcgtaatagtttttaatagaatttcatatagtctttttctccgatgtctccagcttaccagtaggtgtccaattattcgtgagatattgttgtcctgtgaaccaattattctgctttgttgtttgccttactatttgtggtggtctggagtatatgcaagctcaaaatcctcaacaagatatgcctagctaggagttgctttcagtttacactgtcattatactgtccttgctttatctttatcttctacttagttattttgtaatcgttgaag

SEQ ID NO: 1032 - DNA, 1615 bp, Triticum aestivum
tgtgggtggcggagcgggtgctgggggagcgccggatgcgggagatccagcgcttcacccggaacgccaagctcaccgtcgtctgcctcatgctcaccatcctcgtgctccgcggcaccgtcgggggggcaagttcggcacgccgcagcaggacctcaccgagctgcgccaccgcttcatctcccacccgcagcgcgcgctctccgagcaccacgacgcccgctccaaggcctccgacgcccaagcccaagccgcccaggccgcggggaaggccgccgcccgggacgacgagccggagccgcagcccaggtcgctccgggacccgccctacacgctcggccccaagatctccgactgggacgagcagcgggccgcctggaaccgccgccacccggagaccccgcccttcctcaacgacgtcaagccgcgggtcatgctcgtcacggggtcctcacccaagccctgcgagaaccccgtcggcgaccactacctcctcaagtccatcaagaacaagatcgactactgccgcatccacggcctcgagatcttctacaacatggcgctgctcgacgccgagctcgccggcttctgggccaagctcccgctcctccgcgcgctcctcctcgctcacccggaggtcgagttcttctggtggatggactccgacgccatgttcaccgacatggccttcgagctgccgtgggagcgctacggcccctacaacttcatcctgcacggctgggacgagatggtctacgacgacaagaactggattggcctcaacaccggcagcttcttgctgcgtaactgccaatggtcgctcgattacctcgacacctgggcgcccatggggccgaagggccctgttcgtattgaggctggaaaggtgctcaccaagtacctcaaggaccggccggtctttgaagccgacgatcagtccgccatggtgtatatcctcgctacccagcgtgagaaatggggtaacaaggtgtatctcgagaatggctactacctccatggctattgggggatcttggtggacaggtacgaggagatgcttgagaattaccagccagggctcggcgatcatcggtggccactggtcactcactttgtcgggtgcaagccatgctccaagtttggggattaccctgttgagcggtgcctcaagcagatggaccgtgccttcaatttcggggataaccaggtgttgcacatgtatgggtttgagcacaagtctcttgcgagcaggaggatcaagaggatcaggaatgagaccagtgaccctcttgatatgaaggatgattacgggttgctccacccagcgttcaaggccctcaagacttctacatgataactatagtacactacttccacgtttattttgttcgttcgttctagattctcttggatcaaaatcctataattcttctttttgtagactcagggtaacaaggaaatctggttttggtatcaggggacggatatctatgttgtactgtgaaatgttagagaatgaagttatgttgttgatggcacaatctatgttttccgcttctataaatcgctaactggtcacttctaaatagctctatggatttcctatttatttgtt

SEQ ID NO: 1033 - DNA, 1086 bp, Sorghum bicolor
cagcgagaagctaattttgtttttgctatgtgaatgtaaagatagtgatcacaacacaaaggaatgcatggtagaattttacagcaaaacagtgttgatttcttcagggattttacaagttccacgtgcacagtaggactgtaggagtaaacattagaatatatcatacgagatcagcaccgttgatttcctatccagcggtgctacgcgcccaacagcaggagggaggatacgagttcgtcttcctcgaatccctctttcttcacctcctagctctctcgtcctccgttcctcttctccggcgattcgaggatagttttcgccggggggtgcctagaaatcagccgtcaggtgaaccgggaggagtggttgcctgaggaggaggaggaggagatgatcacgcgagcgaagctggtggagcagctgcgggagcaccagatccggtcggcccagtcctactccgccgcgctcgccgtcttctcgccaaacccccacatctcctccaggagagatctcaaggttgctctcatctatgcggtcttgttttgttttctcatggtgtcctgctacgttggcctttacttgaaatggttcagactttcagccatgtttgtaattttcggaatccttcttccagtaagcctcaaaatctctaggcatagaaggctgaagaggaaaagagagaggagattgttgttaccactgtccatgtgaatatatttttgatatcttgtaacattctagtaaaagttggccaactacagataggaaattgtcggcagattaactcaatttacagccccagcttacactttccaaaatgttgtatgcatcacctgttgtgctattgcgcacatgtgtgtgccgacactcgagtttttttgccccttttgtgttcatcaaacttcgtccgttgaaagacgatgcatcatgttggagtttctgacggcaaatcttggacaaatctcgtacttagtagcttgtttgtccagtgcattttttggtggccgcaatcatgtcgaaagaaaatgcatgctgtggcgtcagttggaattactccttgttcagtgtacttggtgagtcgct

SEQ ID NO: 1034 - DNA, 383 bp, Triticum aestivum
atgatcacgcgagcaaagctggtggaacagctgcgggagcaccagatccggtcggcgcagtcgtactccgcggccctcgccgtcttctcccccaacccccacatcgcctccaggcgggacctgagggtggctctcctctatgcctttttgttctgttttctcatggtgtcgtgctatgccgcgctttacctgaaatggttcaagctctcgtccctatttgtaatcctcggaatccttctcccagtaagtctcaaaatctctaggcatagaaggctcagaaggaaaagagagcgaagattgttgttgcccttgtccatgtgaatatctttccgtactaccctcgtaacactttagtgaagtggctcaactaacaaaggaaaggg

SEQ ID NO: 1035 - DNA, 499 bp, Secale cereale
ctctcctctttctttgccccggatcttccttcgttccgccaatttcagagataattggcagcttaggcaaacaattgctagcgtgctcaatcttagaggatcagtagcggggacaggagatgatcacgcgagcaaagctggtggaacagctgcgggagcaccagatccggtcggcgcagtcatactccgcggccctcgccgtcttctcccccaacccccacatcgcctccaggcgggacctgagggtcgctctcctctatgcctttctgttctgttttctcatggtgtcgtgctatgccgcaatttacgtgaaatggttcaagctttcgtccctctttgtaattctcggaatccttctcccagtaagtctcaaaatctctaggcatagaaggctcaaaaggaaaagagagcgaagattgctgttgcccttgtccatgtgaatatctttctgataccctgtaacattttagtgaagtggctcaactacaaagaggaaaaa

SEQ ID NO: 1036 - DNA, 829 bp, Setaria italica
cacgagcgttgatctccgatccaagggtggtacgcgcccaacagcaggagggaggatgataccgagctcctcttcttcctccgaggctccaatccctcttcttccctccggctcccttccaccgttcttccttcccgtctccggcaattcgaggatagttttcgcgtgggtgggaccaagagatcagccgtcaggtgagtcgggaggagcggttgcacggggagagaggagatgatcacgcgagcgaagctcgcggagcagctgcgggaacaccagatccggtcggcccagtcctactccgccgcgctcgccgtcttctcgcccaacccccacatcgcctccaggagggatctcaaggttgctctcatctatgcggttttgtttagttttctcatggtgtgctgctatgttgccctttacttgaaatggttcaaactttcagccatgtttgtaattttcgggattcttctcccagtgagtctcaaaatctctaggcatagaaggctcaagaggaaaagagaaagaagattactgttacctctgtccatgtgaatacgttgccacatcatgtaacatttcagtaaagttgctcaactacagataggaaatttccggcagattaactcaattcacagccccaggttacactttccagaatgttgtatgtatcacctgctttgctgttctgcgcatgcctacatatgtgccgacacttgagttttcgcctttttcttctttttttaaaagttagccctttgaaaggtaatgcgtattgttggagtttgtgacggcaaatcttggacaaatctcgtagcttgtttaccagtgc

SEQ ID NO: 1037 - DNA, 884 bp, Oryza sativa
cactgatgcaatcctagccgttgatctccgatcctgtggtgctgcgagcacagcacagtagaactgtggaacgaacgaacacgaacgatgccgagaatcaccgagtcctcttcctcctccaatacctcttcttccccttcgtggcttcgtattttccctcttgttcttctcttccctccgccaattccaggcagttctagcaaaaaggtgcctcggatgaatcgggggctccagtagggagaggagatgatcactcgagcgaagctggtggagcagctgagagagcaccagatccggtcggcgcagtcctactccgccgccctcgccgtcttctcgcccagccctcacatcgcctccaggcgggatctcaaggttgctctcttctatgctatcttgttttgttttgtcatggtgtcctgctatgttgccctttacttgagatggttcagactttcagccatctttgtagttttcggaattctccttccagtaggtctcaaaatatctaggcatagaaggctgaagaggaaaagagaaaggagattgttgttacctttgtccatgtgaatatatttttgatatcttgtaacattgtagtaaaaccgcgcaactgcaaataggaaattgcctgctttacttaatttacagacagttcaacttacacccaaatgtctgaatgtattacctattctgttttggtgcatgcacatacatatgcaccaacacccttgtctcagtttttgcccatctttttcgagctttgcctttgaaaggtaatgctaccgttagaaaatttctgatagtgaatctttggatatctaagcctgtttgttgtgattatgctcactaatgcatatgtgaaataactggtcaattgtcggtca

SEQ ID NO: 1038 - DNA, 593 bp, Panicum virgatum
  misc_feature (528)..(528): n is a, c, g, or t
  misc_feature (572)..(572): n is a, c, g, or t
ggtctccggcaattcgaggatatttctcgccgtggtgggaccgagagatcagccgtcgggaggagcggctgcctgcgggcgggagaggagatgatcacgcgagccaagctcgtggagcagctgcgggaccaccagatccggtcggcccagtcctactccgccgcgctcgccgtcttctcgcccagcccccacatcgcctccaggaaggatctgaaggttgctctcatctatgcggtcttgttttgttttctcatggtgtcctgctatgttgccctttacttgaaatggttcaaactttcagccatgtttgtaattttcggaattcttcttccagtgagtctcaaaatctctaggcatagaaggctcaagaggaaaagagaaaggagattactgttaccactgtccatgtgaatatgtttccatatcatgtaacattttcagtaaagttgctcaactacagataggaaattcccggcagattaactcgattcacagccccaggttacactttccagtttccagaatgcngtatgtctcctgtttttgctgttatgcgcatgcgtacatatgtnccgacacttgggttttgccta

SEQ ID NO: 1039 - DNA, 460 bp, Pennisetum glaucum
cgacgctccgacccctcttcttccctccggctcccttccaccgttgttccttctcgtctccggcaattcctgggtagttttcgcggggggtgagaccaagagatcagccgtctggtgcgtcgggaggagcggttgcctgaggaagaggagatgatcacgcgagcgaagctcgtggagcagctgcgggagcaccagatccggtcggcccagtcctactccgccgcgctcgccgtcttctcgcccagcccccacatcgcctccaggagggatctcaaggttgctctcatctatgcggtcttgttttgttttctaatggtgtcctgctatgttgccctttacttgaaatggttcaaactttcagccatgtttgtaatcttcggaatccttcttccagtgagtctcaaaatctctaggcatagaaggctcaagaggaaaagagaaagaagattgctgttaccac

SEQ ID NO: 1040 - DNA, 3070 bp, Secale cereale
gactagcgacgaagtgcgacacggccaaagcggccgtccccgtcgaggtgcgcgtcgcacacgcacgcccccgtcccgtccgtccgtccgtccccttccctccagcctccaccctcccgaatgctccaccaccaaaccaccacctccaccgacggcaggcagccccgcaacaacggcaacccccacgagccccggcaaaagaccgtaccacccctcccgctccagacaaggccaggccacgcgcctcccgggtgttgaccggaccccatgggcagttcggtccatcgttaatcccatcaaaacctcccaaacccaaccggctagtcgcacccgcccgcccccctctcttcctcctccccttcttccctcccccctccttccttccgcccgaagtctccacgctcccgtccatttaaaaccttcgcttcgccccgactccacctggccatctcccccgcgcccaatccccgcccgcgtcaaaccctaggggccccgccgagtcctctcagatccaatgggggcggcgccgtcgacgccgaggctgggcgaggcgggcgccgcgtcgccgggggccgcggagcagatgttcgccgcgctcgtcggtgacagggcctacccgatctcctccgagttctggaggcagctgctcgagctgcccctcacccagcagtggccgcgggaccgcgtgctgcaggcctgccacgccttcgcacagaacaactatcatacaaagcatcttgcaaagatcttgatccatttggcttggtgtttgcaagagtgcacatcggcttcttctgtatcttctagtgtctatagaaaggctatcaatgctgcctatatatcatccatatttctcaagttcattattgagaatgccaaggcggataattggcaagagctatgccttgacatcgacaaggatgaaaaggggctggaaaattttccttctgaccaaagtgtggagtattttctgatgaagggggtgctgaactacattggtagtgtagatgtaagtccggagtcatgctacctacatcacgagcttctgaacttgatgctagtccttatgtcgactcagttatgttctggaccatctccagaaccaaaagatgtgcatcctttcattgatgcggctatgcttcaggacagttccatagtagcttcggttgttcaaaagttgctacttaattttgtaagacgaccacaaattccttcaaatggttcacaccctgttttctctgatgatggtgggcctggggttctgcaaagagttggctcagcagctgcaaattttgtactactgccatattatactttcaactattttgtaagtgcaagtgctgaaggtgcgacaagtcaattggcagataacagtttacttgttctgcttattctgatccactaccgaaaatgcatctcaatgaatgagtccattccaaccgatggtgtctacatgagtgattcaaatactaatgtcaaggatgcaccagcttttcatgagaacccttactgcaaggcgctgaacaatgctaaggacattcaatttgatcatgccgatgttgagggaaatgctcaaaatggacccgttgtcaggctgtcttttgcatcgctgtttgatgctcttggcacatgcttaaaagatgagagctcagttctgttgctctattctctggtccatgggaactgcgattttcaggagtatgttctggttcgaacagacttggatactttgcttatgcctattttggaaatgctctacaatgcatcaaggaagacttccaatcagatctacatgctgttgataattctcctgatactcagtcaagattcaaccttcaatgctagtgtgcacaaattggtgcttcctagcgttccttggtaccaggagcgcctcatgcatcaaacttctttgggatcgttgatggtcgtagtactaatccgaaccatcaagtacaacctctccaagctgcgagatgtctaccttcacacgaactgtcttgcaattctagcaaacatgggtcctcatgcgcataggctgagtgcatatgcatctcaaaggctggttagcctcttcgacatgctttctcgcaagtatgccaaattagccgagttaaaaaatgacaaggctctcaaagttatgtctgatcaaatggaaacagacatcatttcagatgatacatcaacggagcttcacatatacactgacttcttaagaattgttctggaaatcatcaatgcaatccttacatatgcattacccaggaatcctgaggttgtgtatgctatattgcaccgacaagaggtttttcagcccttcaagaaccatcctcgtttcaatgaattgcttgagaatatatacacagtattggatttcttcaacagtagaatggacatgcaacagttagacggggaatggtctgttgacaaggttcttgagctcattaataaaaattgtcgttcatggcgtggtgaaggaatgaagatgtttacgcagttacgatttacatatgagcaagaaagtcaccctgaggaattcttcattccatatgcatggaggcttatactatcacgaggattctctttcaatcctggagccataaatttgttcccagtggagatccatgttgatgattcaccatccagcgaacaaaaggtttagggatgatctggagcctttgggttctgacaacacagaaatttggacttgcatcccgacaaagagactgttgtatataggcggcatataccagataatcaaagtgtattttcattcattttgtgttaatatttctgttgtcccataatgtaataccagaggtgggggtgtgaggatttgccggggattgtatctggttcttgaaagtagctagtgcgtagggcaccatacacaattcgtttataagttatatcgttgtattttagagtaagtacaatagcaagcttatagcctgcttacatggcaattttgccaatgtggcggagagagacatgaaaaattggggggaatgagctcccatgcaagagcctaactatatacgtagaggtgcaaaaaagtactatgattataaat

SEQ ID NO: 1041 - DNA, 2803 bp, Hordeum vulgare
cctccccctcccctcccctcccttccgcccgaagtctccaccacgctcccgtccatttaaaaccttcgcttcgccccgactccacctggccattcccccctccccgcccgcgtcaaaccctaggccccccccgccgagtcctcccagatccaatgggggcggcgccgtcgacgccgaggctgggcgaggcgggcgccgcgtcgccgggggccgcggagcagatgttcgccgcgctcgtcggcgacagggcctacccgatctcctccgagttctggaggcagctgctcgagctgcccctcacccagcagtggccgcgggaccgcgtgctgcaggcctgccacgccttcgcgcagaacaactaccatacaaagcatcttgcaaagatcttgatccatttggtttggtgtttgcaagagtgcacatcagcttcttctgtatcttctagtgtctatagaaaggctatcaatgctgcctacatatcatccatatttctcaagttcattattgagaatgccaaggcagataattggcaagagctatgccttgacatcgacaaggatgaaaaggggctggaaaattttccttctgaccaaagtgtggagtattttctgatgaagggggtgctgaactacattggtagtgtagatgtaagtccggagtcatgctacctacatcacgagcttctgaacttgatgctagtccttatgtcgactcagttatgttctggaccatctccagaaccaaaagatgtgcatcctttcattgatgcggctatgcttcaggacagttccatagtagcttcggttgttcaaaagttgctacttaattttgtaagacggccacaaattccttcaaatgattcacaccctgttttctctgatgatggtgggcctggtgttctgcaacgagttggctcagcagctgcaaattttgtactactgccatattatactttcaactattttgtaagtgcaagtgctgaaggtgcgacaagtcaattggcagataacagtttacttgttctgcttattctgatccactaccgaaaatgcatctcaatgaacgagtccattccaaccgacggtgtctacatgagtgattcaactaccaatgtcaaggatgcaccagcttttcatgagaacccttactgcaaggcgataaacaatgctaaggacattcaatttgatcatgccgatgttgagggaaatgctcaaaatggacccgttgtcaggctgtcttttgcatcgctgtttgatgctcttggcacatgcttaaaagatgagagctcagttctgttgctctattctctggtccatgggaactgcgattttcaggagtatgttctggttcgaacagacttggatactttgcttatgcctattttggaaatgctctacaatgcatcaaggaagacttccaatcagatctacatgctgttgataattctcctgatactcagtcaagattcaaccttcaatgctagtgtgcacaaattggtgcttcctagtgttccttggtaccaggagcgcctcatgcatcaaacttctctgggatcgttgatggtcgtagtactaatccgaaccatcaagtacaacctctccaagctgcgggatgtctaccttcacacaaactgtcttgcaattctagcaaacatgggtcctcatgcgcataggctgagtgcatatgcatctcaaaggctggttagcctcttcgacatgctttctcgcaagtatgccaaattagccgagttaaaaaatgacaaggctctcaaagttatgtctgatcaaatggaagcagacatcatttcagatgatacgtcaacggagcttcacatatacactgacttcttaagaatcgttctggaaatcatcaatgcaatccttacatatgcattacccagaaatcctgaggttgtgtatgctgtattgcaccgacaagaggtttttcagccgttcaagaaccatcctcgtttcaatgaattgcttgagaatatatacacagtattggatttcttcaacagtagaatggacatgcaacagttagacggagaatggtctgttgacaaggttcttgagctcattaataaaaattgtcgttcatggcgtggagaaggaatgaagatgtttacgcagttacgatttacatatgaacaagaaagtcatcctgaggaattcttcattccatatgcatggaggcttatactatcacgagggttctctttcaatcctggtgccataaatttgttcccagtggagattcatgttgatgattcaccatccagcgaacaaaaggtttagggatgatctggagcctttgggttctgacaacacacagaaatgttggacttgcatcccgacaacgagactgttgtatataggcggcatataccagataatcaaagtgtattttcattcattttgtgttaatattcccataatgtaataccagaggtggtggacgtgaggaattgcaggggattgtatctggttcctgaaagtaggtagtgcgtagggcaccatacacaattcgtttataagttatatcgttgtatttttagagcaagtacaatagcaagcttatagcccgtttcatgataatttcgcctatttggaggagacatgaaaaattgagaatagtgggctttcatgtaagagcctaaatatatgtgtgctcctaggcagatacaataaatatgaagaaagggatacagtggtggaaaaagtactactgttatagtcaaccttattgtatggatgattataaatgaccactattaaccatgcttcattcattttatcttcct

SEQ ID NO: 1042 - DNA, 3681 bp, Oryza sativa
cccccagcgaaaagaccacaccacccctcctccccagcccgcgcccaggaagaacctcgggggtagattcgtcattgcacgaaaaccccacaatccaaacccacagcgccaagtcccccaaccggttagtcgcgctcgcacccgctcccccgaactcatccatcctcttcctccttccgcccgaagtctccacgctcccgtgtcccatttaaaaccttcttcttcttcttcgcttccttcgtctcgactccagttggggaggcattcttttctttttctttttttttcactctcgcgtccaatccctgaatccgctggcccgcgtcgaaacctaggggcgcggtggcggtatagccgacgttcagatccaaatgggggcggcgccgtcgacgccgaggctgggcgcggtggcgggggccgcggcgtcgcctggggcggcggagcagatgttcgcggcgctggtcggcgggaaggcgtacccgatctcctccgagttctggaggcagctgctcgagctgcccctcacgcagcagtggccgcgggaccgcgtcctgcaggcgtgtcacgcgttcgcccagaacaactaccacacaaagcatctcgcaaagattttgatccatttggtttggtgcttgcaagagtgcatggcagagtcttctcacgcggcgtataggaaggctatcaatgctgcatatatatcatccatatttctcaaattcattattgaaaatgcaaagactgataattggcaagagctaagtcttgaaattgacaaggatgagaaggggctggaaaattttccttctgaacaaagcgtggaatattttctgatgagaggtgttctgaactacattggtagtgtagatgtaagtctggagtcatgctacctgcaccatgaacttctaaacttgatgctagtacttatgtcaactcaattgtgttctggaccatctcctgaaccaaaagatgtgcatcctttcattgatgcggctatgcttcaggacagttccatagtgtcctcggtagttcaaaagttgctgctaaattttgtaaaacgaccacggattcctttaaacagttcacaccctgctttctctgatgatggtggacctggtgttttgcagcgagttggttcagttgctgcaaactttgtactactgccatattatactttcaactaccttgtgagctcaaacgctgaaggcgcatcaagtcaattggcagacaacagtttacttgttctgcttattctgatccactaccggaagtgcattacgatgagcgaatcctttccaagcagtaatgtctacacaagcgatttaaataccaatgtcaaggatgcaccggcttttcatgataatccatattacaaggccttaagcaatgccaaagacagtcaatatgatcgtgctgatgttgaaggaaatgctcaaaatgggctagttgtcaggttgtcttttgcatcgctatttgacgctcttggcacatgcttaaaagatgagagctcggttctactgctctattctttggtccatgggaactgtgactttcaggaatatgttctggttcgaacagacctggatactttgctgatgcctatcttggaaatgctctacaatgcatcaagaaagacctccaatcagatatacatgctattgatagttcttcttatactcagtcaagattcaaccttcaatgctagtgtacacaaattggtgcttccgagcgtcccttggtaccatgagcgccttatgcatcaaacttctttgggatctttgatggttgttatactaatccgaaccatcaaatacaacctctccaaactgcgagatgtctaccttcatacaaactgccttgcaattctagcaaatatggcccctcatgtgcataggctgagtgcatatgcatctcaaaggctggttagcctctttgacatgctctctcgcaagtataccaaattagccgagttaaaaaatgacaaagctatcaaagttatatctgatcagattgaagcagacaacatctcagatgatacgtccacagaacttcacatctataccgacttcttaagaattgttctagaaatcatcaatgcaattcttacatatgcattgcctagaaatcctgaggtcgtgtatgctatcttgcatcgacaagaggtatttcagccattcaaaaaccatccccgcttcaatgaattgcttgagaatatttacacagtgttggatttcttcaatagtcgaatggacatgcagcagttagatggagaatggtctgtagataaggttcttgaggttattaacaaaaactgccgttcatggcgtggagaaggaatgaagatgtttacccagttacggtttacatatgagcaagaaagtcatcctgaggagttttttatcccatatgcatggcgcgttgtcctatcacgaggattctctttcaatcctggtgcaataaatctgttccctgtggagattcatgttgatgatgaaccatccggtgaacaaaaggtctaagaataatcttgaatgttgagttctgactacagcaggatgacatgttccatccaccgaggcaaatagatattgtacataggaggcatataccagacgatcgacatgtattcttattcatttgtgtatatttccgtttcctcataatgtaataccagaggtcagcgggaggagagagcggtatttaggtggcagagaactatgtagggtacaacgaacaattctttcataagttaatctttgtatttttttttcatctcttatcacctctgacgcgggaaggccactctggtgttttaacatgtctaccgtaccgtcggtcggttttcctgtgagaggcctgaaccgttctcttgaatgttgcctcagttcgaagataacctgctactccgtcggtgtttcaacaagcatgctggaagggcagaaaaaggaaagcgtgcgagaagagtttatagaccaaggaaccgacggtttcattaatcggaagctattccattttattcactttctggcttccagaaacaagtactggtaaaagaaaaaaatgtttcatgtgtctgaaaagtagtcaggtaccttcattttgatgaaatatcaaaagttgaaatgtactacggtgattggaaggcattacaactttacaagtgcactgttactaatcgttggtatttgtttgattggaaggtattacaagtacgctgttaaatcgtttgtatttgtttgaatggaaggtggagtacctcttaccttccaaacggtgaaacatttccaaaaagaaaaggtgaacccgccacccgagcgaagatcactgctttttagtactactgtaagtacctccattttggaacggagagaccaactccgtcccaaaatatagcttttggctgggtagtaccgttataagttcaaagaaccaaggaattgcctgaaaaataacatcattccgaggggaagtttgctcactgaccctttgtaagcaccacgaggcccgccaatgtaaccttgaaccaaaaccacggcacaaaattttctggttaagacaaaccctaggatttacatgcttcccacatgctacatgatccatgaattggcatgtacaagtgcattactttggtcggtcagcatgcaccccaatatattggcgcagacactctggaatacctgcata

SEQ ID NO: 1043 - DNA, 2760 bp, Setaria italica
tccgatcaaaacctccccaaacccaacgcaccggctagtcgctgcgctcgctcgcacccgacctccgcctcggctcccccccctccttcccttcccttccgcccgaagtctccacgctccctttcttccgtttaaaaccttcgcttcgtctcgactctacccgcggccggccattctccctctccctcgcccaacccacgcgcgcgtcaaaccctacctagggccccgcgcgtcctcctccccggggggaggctccagatccaatgggcgcggcgccgtcgacgccgaggctgggcgcgccgccgtcgcccggcgccgcggagcagatgttcgcggcgctggtcggcgggaaggcctacccgatctcctccgagttctggaaccagctgctcgagctgcccctcaccctgcagtggccgcgcgaccgcgtgctgcaggcgtgccacgccttcgcccagaacaactaccaaaccaagcatcttgcaaagattttgattcatttggtttggtgcttgcaagagtgcacctcaacaacttctgtatcatctgttgtatatcgaagggctatcaatgctgcatatatctcatccatatttctcaagttcatcattgaaaatgcaaaagctgataattggcaagagctatgccttgacattgacaagaatgagaaggggatggaaaattttcctgcagaaagcactgtggagtattttctgatgagaggcgtgctgaactacattggtaatgtagatgtaagctcggaatcatgctacctacatcatgaacttctgaacttgatgctagttcttatgtcaactcagttatgttctggaccatctccagaaccaaaagatgtgcatcctttcattgatgcagctatgcttcaggacagctccatagtagtctcagtggtgcgaaagttattgctcaattttgtagcgcggccaaaatttcctccaaatggttcacatcctgttttttctgatgatggtaggcctggtgttctgcagcgagttggctcagcagctgcaaattttgtcttactgccatattatacgttcacctaccttgtaagctcaactcctgagggtgcaacaagtcaattggcagataacagtttgcttgttctgcttgttatgatccactaccggaagtgcatttcaactaatgagtccattccaagcaacaatttatacacgggttcagataccaatgacaaggaagcacaggtttttcatgagaatccttattgcaaagcattaaacaatgctaaggacattcaatatgatcgtgctgatgttgaaggaaatgctcaagatggacctgttgccaggttgtcttttgcatcgttgtttgacgctcttggaagatgcttaaacgacgagagctcggttctgttgctctattctttggtccatgggaactgtgactttcaggaatatgtcctggttcgaacagacttggatactttgctcatgcctatcttggaaatgctctacaatgcatcaaggaagacttcaaatcagatttacatgctgttgattattctcctgatcctcagtcaagattcaaccttcaatgctagtgtgcacaaattggtgcttcctgctgttccttggtaccatgagcgccttatgcaccaaacgtctttgggatctttgatggttgtaatactaatccggaccatcaagtacaacctctccaagctaagagatgtctaccttcacacaaactgtcttgcaatattagcaaatatggctcctcatgtgcataggttgagtgcctatgcatcacaaaggctggttagcctctttgacatgctttctcgcaagtatgccaaactagctgagttaaaaaatgacaagtctcacaaagttatatccgatcagatggaagcagacaacatcgcagatgatatgtctacggagcttcacatatatacagatttcttaagaattgttctggaaatcattaatgcaatccttacatatgcattgcctcggaatcctgaggttgtgtatgctgtattgcatcgtcaggaggtttttgagccatttaagaaccatccacgtttcaacgaactgcttgagaacatatacacagtattggatttcttcaatagccgaatggacatgcaacaattagatggggaatggtctgtggataaggtgcttgaagtcatcaacaaaaactgtcgttcatggcgtggagaagggatgaagatgtttacccagttaaggtttacatatgagcaagaaagccaccctgaggaattctttatcccatatgcatggcgccttgtcctgtcacggggattctctttcaatcctggggccataaatctgttccctgtggagattcaccttgatgatgcaccatccggtgaagaaaaggtttaggaagaatgatccgaacctgagttctgacaagaacataaagacatctttttgtttcatcgtggcgaagagcttgttgtaaataggcggcatataccagatggtcgaactgtactcattcttttgtattaatagttctgttggttcataatgcttgtataatggaagaagggatggagggattgcgcaaggtgctagatattttgttagtagtgggggtagatgactatgtagggtatatactcaattcgttcataaattattgttgtattgtaagccgaaagacttttgtaataaccccggtcccactctgtataactatgtaatctaacctttctttaagaactatacccaccgtttttcc

SEQ ID NO: 1044 - DNA, 3231 bp, Panicum virgatum
gacaagtattcaattcattttgtcaatttaagtactccagcttgttaaatttggcatcaagagttttcaaaaaagaaaatggcatcaagaaatgccctatcttttgtagtttcgtccagtttggtaactggcagttttccacgaaacccagcttctgcaaagaaacaaaagacccaaacagaggcgaagaagtcaaacccgcggggtcgctgggccagaaaaccggtggagggcgcccaaacctcgaacccagcaaagtgccacacggccatccacatgaccacatcacgcacccccacggccccacgccctgactccaatgaatgcgagtcgcccaccccaccccccgtcgcgaatccgattgctccgccaccaaaccacctccaccgacggcaggccgccccgcaacaacgacacctcccctctcgcccccacggaaaagaccctctcgcccccgggatccccttccgcttccggggaagagaaccggggctagtctggccatttcctaatccgatcaaaacctccccaaacccaacgcgcaccggctagtcgctgcgctcgcacccgacctcctcgcctcctccttccgcccgaagtctccacgctccctttcctccgtttaaaaccttcgcttcgtctcgactccactcgcggccggccattccccccctcgctcgcccaatcctcgcgcgcgtcaaaacctagggccccgcgcgtcctttttccgggcgggctccagatccaatgggcgcggcgccgtcgacgccgaggctgggtgcggcgggcgcgccgccgtcgcccggcgcggcggagcagatgttcgcggcgctggtcggcgacaaggcctacccgatctcctccgagttctggaagcagctgctcgagctgcccctcaccctgcagtggccgcgcgaccgcgtgctgcaggcgtgccacgccttcgcccagaacaactaccaaaccaagcatcttgcaaaaattttgatccatttggtttggtgtttgcaagagtgtacctcaacaacttctgtatcttctgtcgcataccgaagggctatcaatgctgcatatatctcatccatatttctcaaattcatcattgaaaatgcaaaaactgataattggcaagagctatgccttgacattgacaagagtgagaaggggatggaaaaatttcctgcagaaatcactgtggagtattttctgatgagaggcgtcctgaactatattggtagtgtagatgtaagcctggaatcatgctacctacatcatgaacttttgaacttgatgttagttcttatgtcaactcagttatgttctggaccatccccagaaccaaaagatgtgcatcctttcattgatgcagctatgcttcaggacagctccatagtagtctcagtggtgcgaaagttgttgctcaattttgtaacacggccaaagtttcctcaaaatggttcacaccctgttttttctgatgatggtaggcctggtgttctgcagcgagttgggtcagcagctgcaaattttgtcttactgccatattatacgttcaactaccttggtagctccaatcctgagggtgcaacaagtcagttggcagataacagtttacttgtcctgcttgttatgatccacttccgcaagtgcatttcaactaatgagtccattccaagcaacaatacatacatgggttcagataccaatgacaaggaagctcaggtttttcatgaaaatccttattgcaaagcattaaacaatgctaaggacattcaatatgatcatgctgatgttgaaggaaatgctcaagatgggcctgttgtcaggttgtcttttgcatcgttgtttgactctcttggaagatgcttaaacgatgagagctcggttctgttgctctattctttagtccatgggaactgtgactttcaggaatatgtccttgttcgaacagacttggatactttgctcatgcctatcttggaaatgctctacaatgcatcaaggaagacttcaaatcagatttacatgctgttgatcattctcctaatcctcagtcaagattcaaccttcaatgctagtgtgcataaattggtgcttcctgctgttccttggtaccatgagcgccttatgcatcaaacatctttgggatctttgatggttgtaatactaatccggaccatcaagtacaacctctctaagctaagagatgtctaccttcacacaaactgtcttgcgatattagcaaatatggctcatgtgcataggctgagtgcctatgcatcacaaaggctggttagcctcttcgacatgctttctcgcaagtatgccaaactagctgagttaaaaaatgacaagtcccacaaagttatatccgatcagatggaagcagacaacatcgcagatgatatgtctacagagcttcacatatatacagatttcttaagaattgttctggaaatcattaatgcaatccttacgtatgcattgccccgaaatcctgaggttgtgtatgctgtattgcatcgtcaggaggtttttgagccatttaaggaccatccacgtttcaatgaacttcttgagaacatatacactgtattggatttctttaatagccgaatggacatgcaacaattagatggggaatggtctgtggataaggtgcttgaagtcatcaacaaaaactgccgatcatggcgtggagaagggatgaagatgtttacccagttaaggtttacatatgagcaagaaagccaccctgaggaattctttatcccatatgcatggcgccttgtcctgtcacggggattctctttcaatcctggcgccataaatctgttccctgtggagattcaccttgatgatgtaccatccagtgaacaaaaggtttaggaagaatgatctttttgttccatcgcagcaaagagctcgttgtaaataggcggcatacaaactgtactcattcttttgtattaatatttctgttgttttcataattgcgtgtattatggaagggatggagagggattgcggaaggggttagatattttattagtaggggatagatgactatgtagcgtatatacacaatttgttcataagttaatgttgtattgtacttttagctgaaaggccttgtaactaccccggccccactcttgcattgtaaactctgcaacctaacctacctgtcttgtgctgtactataagtgctgcatctgcacttcgatttca

SEQ ID NO: 1045 - DNA, 2921 bp, Zea mays
gtagtccgatcaaaacctcctcaaacccaacgcaccgactagtcgctacgctcgcacgtcgtacccgacctcattcccttcccttcccttccgcccgaagtctccacgctccctttctcccgtttaaaaccttcgcttcgtctcgactctacttggccggccatttcctctcgcccagtcctcgctcacgtcaaaccctagggcccggggcctcctactcgtaggctcagatccaatgggcgcggcgccgtcgacgccgaggctgggcgcggcaggcgcggcgccgtcgcccagcgcggcggagcagatgttcacggcgctggtcggcgagaaggcctacccaatctcctccgagttctggaagcagctgctcgagctgcccctcaccctgcagtggccgcgcgaccgcgtgctgcaggcgtgccacgccttcgccgagaataactaccaaacaaagcatcttgcaaagattttgatccatttggtttggtgcttgcaagagtgcacatcaacaacttctgtatcttctgtcgtatatcggagggcgatcaatgcggcatacatatcatccatatttctcaagttcatcattgaaaacgcaaaaaccgacagttggcaagagctatgccttgtcattgacaggagtgagaaggggttggaaaactttcctgcagaaaacactgtggagtattttctgataagaggtgtgctggaatatattggtagtgtgggtgtaagtccggagtcatgctacctacatcatgaactcctgaacttgatgctagttcttatgtcaactcagttatgttctggaccatctccagaaccaaaggatgtgcatcctttcattgatgcagctatgcttcaggacagctccatagtggcttcagtagtgcagaaattgttgctcaattttgtaacacgaccgaaacttcctctaaatgcttcgcaccctgttttctctgatgatgctaggcctggtgttctgcagcgagttggctcagcagctgcaaatgtcgtcttattgccatattatactttcaactaccttgtaagctcaactcctgagggtgcgacaagtcaattggcagataacagtttacttgttctgcttatcatgatccactaccgaaagtgcttttcaactaatgagtccattccaaccaacaacgtatacacgatggactcaaataccaatgacaaggatgctccagtttttcatgataacccttattgcaaggcattaaacagtgctaaggacattcaatatgatcgtgctgatgttgaaggaaatgctcaaaatggacctgttgtcaggttgtcttttgcattgttgtttgatgctcttggaagattcttaaatgatgagatcccagttctgttgctctattctttggtccatgggaactgtgactttcaggaatacgtcttggttcgaacagacttggatactttgttgatgcctatcttggaaacgctatataatgcatcaaggaagacttcaaatcagatttacatgctgttgattattctcctgatcctcagtcaagattcaaccttcaatgctagtgtgcacaaattggtgcttcctggtgttccttggtaccatgaacgcctgatgcatcaaacttctatgggatctttgatggttgtaatactaattcagaccatcaagtacaacctctccaagctaagagatgtctaccttcacacaaactgtcttgcaattttagcaaatatggctccgcatgtgcataggctgagtgcttatgcatcacaaaggctagttagtctctttgacatgctttctcgcaagtatgccaaactagctgagttgaaaaatgacaagtctctgaaagttatatctgatcagatggaagcagacaacatcgcagatgatatgtctacagagcttcacatatatacagatttcttgagaattgttctggaaataatcaatgcaatccttacatatgcattgcccagaaatcccgaggttgtatatgctgtattgcatcgacaagaggtttttgagccatttaaaaatcatccacgttttaatgaactgcttgagaacatatacactgtattggatttcttcaatagtcgaatggacatgcaacaattagatggggaatggtccgtggataaagtgcttgaagtcatcaataaaacttgccgttcatggcgcggagaagggatgaagatgtttactcagttgcggtttacatatgagcaagaaagccaccctgaggaattctttatcccatatgcatggcgccttgtcctgtcacggggattctccttcaatcccagcgccataaatctcttccctgtggagattcaccttgaagatgcaccggccggtgaacaaaaggtttaggaagaatggtccgaaccagagttctgacaaggaacataaaggcatatttttgttccattgtggcaaagagcataatgtaaataggcggcatataccaggtagtagtcgaatgtactcattcttttgtattaaaatagttctgttgtttcataatatgtgtaagagggggaagagggtggacgaattgtgcaagggttcagagattgtgctattataggtggtagattactatgtaggctatacacaattctttcataagttattgttgtattgtacccttaagctgcaaggccttgtggccacgctggccactcttatgcagttgtaaactctgcgatcttgtctttatccgttctgtgaagtgtgaagtgctgactctgctcgcaaagcttccccgacgcgcaccaggatggcgtcctgcctcatcatctaccactccagcgagcctccatgctatagagtagcagctgttaaggactcttgtagtccaagggtctcaactataatattaacaaacaagtagacaagaatatgaagt

SEQ ID NO: 1046 - DNA, 2863 bp, Zea mays
gtagtccgatcaaaacctccccaaacccaacgcaccggctagtcgctccgctcgcacgtcgcgcccgacgccccgacctcggctgctcgtccagtcgtccttcgtttcccttcccttcccttcccttccgccagaagtctccacgctccctttctcccgtttaaaaccttcgcttggtctcgactctacttggccggccatttcttcgtctcgcccaatcctcgctcacctcaaatcctagggccccgcttctcctactcgggaggctcagatccaatgggcgcggcgccgtcgacgccgacgttggacgtggcaccgttgacgccgaggttgggcgcggcaggcgcgccaccgtcgcccagcgcggcggagcagatgttcgcggcgctggtcggcgaaaaggcctacccaatctcctccgagttctggaaccagctgctcgagctgcccctcaccctgcagtggccgcgcgaccgcgtgctgcaggcgtgccacgcctttgccgagaataactacaaaacaaagcatcttgcaaagattttgatccatttggtttgttgcttgcaagagtgcacctcaacaacttctgtatcttctgtcgtatatcagagggcaatcaacgcggcatacatatcatccatatttctcaagttcatcattgaaaatgcaaaaactgacagttggcaagagctatgccttgacattgacaggagtgagaaggggttggaaaaaattccagcagaaaacacggtggagtattttctgatgagaggtgtgctggactatattggtagtgtggatgtaagtccggagttatgctacctacatcatgaactcctgaacttgatgctagttcttatgtcaactcagttgtgttctggaccatctccagagccaaaggatgtgcatcctttcattgatgcagctatgcttcaggacagctccatcgtggcttcagtggtgcaaaaattgttgctcaattttgttacacgtccaaaaattcctctaaatgcttcgcaccctgttttctctgatgatggtaggcctggtgttctccaacgagttggctcagcagctgcaaactttgtcttgttgccatattactacctcgtaagctcaactcctgagggtgcgacaagtcaattggcagataacagtttacttgttcttcttatcatgatccactaccgaaagtgcatttcaactaatgagtccattccaaccaacaatgtatacacgatggactcaaataccaatgacaaggatgctccagtttttcatgataacccttactgcaaggcattaaacagtgctaaggacatacaatatgatcgtgctgatgttgaaggaaatgctcaagatcgacctgttgtcaggttgtcttttgcatcgttgtttgatgcttttggaaggtgcttaaatgatgagagctcggttctgttgctctattctttggtctatgggaactgcgactttcaggaatatgtcctggttagaacagacttggacactttgctgatgcctatcttggaaatgctctacaatgcatcaaggaagacttcaaatcagatttacatgctgttgattattctccttatcctcagtcaagattcaaccttcaatgctagtgtgcaccaattggtgcttcctgcagttccttggtaccatgagcgcctgatgcatcaaacgtcactgggatctttgatggttgtaatactaattcggaccattaagtacaacctctccaagctaaaggatgtctaccttcacacaaactgtcttgctattttagcaaacatggctcctcatgtgcataggctgagtgcttatgcatcacaaaggctagttagtctcttcgacatgctttctcgcaagtatgccaaactagctgagctaaaaaacgacaagtctctgaaagttatatatgatcagatggaagcagacatagcagatgatatgtctatagagcttcacatatatacagatttcttaagaattgttctggagataattattgccatccttacatatgcattgcccagaaatcctgaggttgtgtatgctgtattgcatcgacaagaggtgtttgagccatttaaaaaccatccacgtttcagtgaactgcttgagaacatatacacagtattggatttcttcaatagccgaatggacatgcaacaattagatggggaatggtctgtggataaggtgcttgaagtcatcaacaaaacttgccgttcatggcgtggagaagggatgaagatgtttacccagttacggtttacatatgagcaagaaagccaccctgaggagttcttcatcccatatgcatggcgccttgtcctatcacggggattctccttcaatcccgatgccataaatctcttccctgtggagattcaccttgaagaggcaccggccggtggacaaaaggtttaatatgaatggtccgaaccagagttctgacaagaacataaaggcatatttttgtttcattgtggcaaagagcacgatgtaaataggccgcatataccatataccaggtagtcaaatgtacacattcttttgtattaaatcattatatgtgtaagacgaaagggggtggacggattgcgcaagggtgcagagattgtgctagttataggggggagattactatgtagggtatatgcaattctttcgtaagttatcgttgtattgtacccttagttcaaaaggcttgtaaccacttatttattgaaaagttgtagagtctgcgatctaagggcatgtacagtggagagacaccaaaacggttctccaagcacaggagacaactaagagactctattgtacaatggagtgtctataaacgtagtctatt

SEQ ID NO: 1047 - DNA, 2402 bp, Triticum aestivum
tgcttcttctgtatcttctagcgtctatagaaaggctatcaatgctgcctatatatcatccatatttctcaagttcattattgagaatgccaaggcagataattggcaagagctatgccttgacatcgacaaggatgaaaaggggctggaaaatattccttctgaccaaagtgtggagtattttctgatgaagggggtgctgaactacattggtagtgtagatgtaagtccagagtcatgctacctacatcacgagcttctgaacttgatgctagtccttatgtcgactcaattatgttctggaccatctccagaaccaaaagatgtgcatccattcattgatgcggctatgcttcaggacagttccatagtagcttcggttgttcaaaagttactacttaattttgtaaggcgaccacaaattccttcaaatggttcacaccctgttttctctgatgacggtgggcctggtgttctgcaacgagttggctcagcagctgcaaattttgtactactgccatattatactttcaactattttgtaagtgcaagcgctgaaggtgcgacaagtcaattggcagataacagcttacttgttctgcttattctgatccactaccgaaaatgcatatcaatgaatgagtccattccaaccgacagtgtctacatgagtgattcaaataccaatgtcaaggatgcaccagcttttcatgagaacccttactgcaaggcactaaacaatgctaaagacattcaatttgatcatgccgatgttgagggaaatgctcaaaatggacccgttgtcaggctgtcttttgcatcgctgtttgatgctcttggcacatgcttaaaagatgagagctcagttctgttgctctattctctggtccatgggaactgcgattttcaggagtatgttctggttcgaacagacttggatactttgcttatgcctattttggaaatgctctacaatgcatcaaggaagacttccaatcagatctacatgctgttgataattctcctgatacttagtcaagattcaaccttcaatgctagtgtgcacaaattggtgcttcctagcgttccttggtaccaggagcgcctcatgcatcaaacttctctgggatcgttgatggtcgtagtactaatccgaaccatcaagtacaacctctccaagctgcgagatgtctaccttcacacgaactgtcttgcaattctagcaaacatgggtcctcatgcgcataggctgagtgcatatgcatctcaaaggctggttagcctcttcgacatgctttctcgcaagtatgccaaattagccgagttaaaaaatgacaaggctctcaaagttacgtctgatcaaatggaagcagacatcatttcagatgatacgtcaacggagcttcacatatacactgacttcttaagaatcgttctggaaatcatcaatgcaatccttacatatgcattacccagaaatcctgaggttgtgtatgctgtattgcatcgacaagaggtttttcagcccttcaagaaccatcctcgtttcaatgaattgcttgagaatatatacacagtattggatttcttcaacagtagaatggacatgcaacagttagacggggaatggtctgttgacaaggttcttgagctcattaataaaaattgccgttcatggcgtggggaaggaatgaagatgtttacgcagttacgatttacatatgagcaagaaagtcatcctgaggaattcttcattccatacgcatggaggcttatactatcacgaggattctctttcaatcctggtgccataaatttgttcccagtggagattcatgttgatgattcaccatccagcgaacaaaaggtttagggatgatctggagcctttgggttctgacaacacacaaaaatgttggacttgcatcccgacaaagagactgttgtatataggcggcatatacctgataatcaaagtgtattttcattcattttgtgttaatatttctgttgtcccataatgtaataccagaggtggggggtgtgaggaattgcaggggattgtatctggttcttgaaagtaggtagtgcgtagggcaccatacacaattcgtttataagttatatcgttgtattattagagcaagtacaatagcctgcttccgtggtaattttgcatatgtgacagagagacatgcaaaattgaggggaataagctcttatgcaagagtctagctatatgcgtagagttggaaaaagtactatgactataaatgatgactacatatgacatggcaaagctaaaaggtctctgttgttatccacatgcacttgcatgcaagttcacacaggttgtataaatgattcctagttatattgagaacagtatgtatctgccaaga

SEQ ID NO: 1048 - DNA, 3153 bp, Sorghum bicolor
ccgaatgctccgccaccaaaccaccacctccaccgacggcacacggcaggcagccccacaacaacgacaccacctcgaggccccccaccgaaaaagaccatctcacccccgggtctggacctactccctccctcgacgcgcccctggattcttgacccggaaccggctagtttcgccatttcgtagtccgatcaaaacctccccaaacccaacgcaccggctagtcgctacgctcgcacgtcgcgcacccgacctcctccgttcctcctcccctactcttcccttctcttccgcccgaagtctccacgctccttttctcccgtttaaaaccttcgcttcgtctcgactctacttggccggccatttcctctcgcccaatcctcgctcacgtcaaaccctagggccccgcgcctcctacttggagggggctcagatccaatgggcgcggcgccgtcgacgccgaggctgggcgcggcaggcgcgccgccgtcgcccagcgcggcggagcagatgttcgcggcgctggtaggcgagaaggcctacccaatctcctccgagttctggaagcagctgctcgagctgcccctcaccctgcagtggccgcgcgaccgcgtgctgcaggcgtgccacgccttcggtgagtgtggccagggcccctcgagatccacgtcccgcctgaggaaatttcgcggctgtgctgattgcttccttgcgctgtcgtgtctgatgatgatttttactcccccttcctttgagtgttttgatccgtggggcaatgcggatcatgatcatgtgttatgtgcacctgcagccgagaataactaccagacaaagcatcttgcaaagattttgatccatttggtttggtgcttgcaagagtgcacctcaacaacttctgtatcttctgttgtttatcggagggcgatcaatgcggcatacatgtcatccatatttctcaagttcatcattgaaaacgcaaaaaccgacagttggcaagagctatgccttgacattgacaggagtgagaaggggttggaaaactttcctgcagaaaacactctggagtattttctgatgagaggtgtgctggactatattggtagtgtggatgtaagtccggagtcatgctacctacatcatgaactcttgaacttgatgctagttcttatgtcaactcagttatgttctggaccatctccagagccaaaggatgtgcatcctttcattgatgcagctatgcttcaggacagctcaatagtggcttccgtggtgcaaaaattgttgctcaattttgtaacacggccgaaaattcctctaaatgcttcacaccctgttttctctgatgatggtaggcctggtgttctgcagcgagttggctcagcagctgcaaatattgtcttattgccatattatactttcaactaccttgtaagctcaactcctgagggtgcgacaagtcaattggcagataacagtttacttgttctgcttatcatgatccactaccgaaagtgcatttcaactaatgagtccattccaaccaacaatgtatacactatggactcaaataccaatgagaaggatgctccagtttttcatgataacccttattgcaaggcattaaacagtgctaaggacatacaatatgaccgtgctgatgttgaaggaaatgctcaagatggacctgttgtcaggttgtcttttgcattgttgtttgatgctcttggacgatgcttaaatgatgagagctcggttctgttgctctattctttggtccatgggaactgtgactttcaggaatatgtcctggttcgaacagacttggatactttgctgatgcctatcttggaaatgctctacaatgcatcaaggaagacttcgaatcagatttacatgctgttgattattctcctgatcctcagtcaagattcaaccttcaatgctagtgtgcacaaattggtgcttcctgctgttccttggtaccatgaacgcctgatgcatcaaacgtctctgggatctttgatggttgtaatactaatccggaccatcaagtacaacctctccaagctaagagatgtctaccttcacacaaattgtcttgcaattttagcaaatatggctcctcatgtgcataggctgagtgcttatgcatcacaaaggctagttagtctgtttgacatgctttctcgcaagtatgccaaactagctgagttaaaaaatgacaagtcgctgaaagttatatctgatcagatggaagcagacaacatcgcagatgatatgtctacagagcttcacatatatacagatttcttaagaattgttctggaaataatcaatgcaatccttacatatgcattgcccagaaatcctgaggttgtgtatgctgtattgcatcgacaagaggttttcgagccatttaaaaatcatccacgttttaatgaactgcttgagaacatatacactgtattggatttcttcaatagtcgaatggacatgcaacaattagatggggaatggtctgtggataaggtgcttgaagtcatcaacaaaacttgccgttcatggcgtggcgaagggatgaagatgtttacccagttacggtttacatatgagcaagaaagccaccctgaggaattcttcattccatatgcatggcgccttgtcctatcacggggattctccttcaatcccggcgccataaatctcttccctgtggagattcaccttgaagatgcaccggccggcgaacaaaaggtttaggaagaatggtccgaaccagagttctgacaagaacataaagtcatatttttgtttcattgtggcaaagagcacgatgtaaataggcggcatataccatataccaggtagtcgaatgtactcattcttttgtattaaaatagttctgttgtttcataatatgtgtaagaggggagaggatggacggattgcgcaagggttcagatattgtgctagtatagaggttagattactatgtagagggtatacacaattctttcataaattatcgttgtattgtacccttaagctgaaaggccttgtaaccacgctggccactctttattgtaaagttataaactctgcgatctggtctttctccgttatgtgaagtgtgaactgccagctctgctctcc

SEQ ID NO: 1049 - DNA, 2448 bp, Triticum aestivum
cctatatatcatccatatttctcaagttcattattgagaatgccaaggcggataattggcaagagctatgccttgacatcgacaaggatgaaaaggggctggaaaattttccttctgaccaaagtgtggagtattttctgatgaagggggtgctgaactacattggtagtgtagatgtaagtccggagtcatgctacctacatcacgagcttctgaacttgatgctagtccttatgtcgactcagttatgttctggaccatctccagaaccaaaagatgtgcatcctttcattgatgcggctatgcttcaggacagttccatagtagcttcggttgttcaaaaattactacttaattttgtaagacgaccacaaattccttcaaatggttcacaccctgttttctctgatgatggtgggcctggtgttctgcaacgagttggctcagcagctgcaaatttcgtactactgccatattatactttcaactattttgtaagtgcaagtgctgaaggtacgacaagtcagttggcagataacagtttgcttgttctgcttattctgatctactaccgaaaatgcatctcaatgaatgagtccattccaaccgacggtgtctacatgagtgattcaaataccaatgtcaaggatgcaccagcttttcatgagaacccttactgcaaggcgctaaacaatgctaaggacattcaatttgatcatgccgatgttgagggaaatgctcaaaatggacccgttgtcagtctgtcttttgcatcgctgtttgatgctcttggcacatgcttaaaagatgagagctcagttctgttgctctattctctggtccatgggaactgcgattttcaggagtatgttctggttcgaacggacttggatactttgcttatgcctattttggaaatgctctacaatgcatcaaggaagacttccaatcagatctacatgctgttgataattctcctgatactcagtcaagattcaaccttcaatgctagtgtgcacaaattggtgcttcctagcgttccttggtaccaggagcgcctcatgcatcaaacttctctgggatcattgatggtcgtagtactaatccgaaccattaagtacaatctctccaagctgcgagatgtctaccttcacacaaactgtcttgcaattctagcaaacatgggtcctcatgcgcataggctgagtgcatatgcatctcaaaggctggttagcctcttcgacatgctttctcgcaagtatgcgaaattagcagagttaaaaaatgacaaggctctcaaagttacgcctgatcaaatggaagcagacatcatttcagatgatacgtcaacggagcttcacatatacaccgacttcttaagaatcgttctggaaatcatcaatgcaatccttacatatgcattacccagaaatcctgaggttgtgtatgctgtattgcaccgacaagaagtttttcagcccttcaagaaccatcctcgtttcaatgaattgcttgagaatatatacacagtattggatttcttcaacagtagaatggacatgcaacagttagacggggaatggtctgttgacaaggttcttgagctcattaataaaaattgccgttcatggcgtggagaaggaatgaagatgtttacgcagttacggtttacatatgagcaagaaagtcatcctgaggaattcttcattccatatgcatggagacttatactatcacgaggattctctttcaatcctggtgccataaatttgttcccagtggagattcatgttgatgattcaccatccagcgaacaaaaggtttagggatgatctggagcctttgggttctgacaacacacagaaatgttggacttgcatcccgacaaagagactgttgtatataggcggcatataccagataatcaaagtgtattttcattcattgtgttaatatttctgttgtcccatagtgtaataccagaggtggggggtgtgaggaattgcaggggattgtatctggttcttgaaagtaggtagtgcgtagggcaccatacacaattcatttacaagttacatcgttgtatttgtagagcaagtacaacttaagcgcgtttacatggcaattttgcctatatggaggagagatacatgaaaaattgaagggagtggtctcgtgcaagagcctagctatatgtgcgcttgtacgcagattaaatataaagaaagtgattgagagaagatggaaaaaagtactgctcttatggccaatcttattgtatgaatgactaagtgtaagacatggtaacatcatatagtaaccattaaccatgctcttaccattcaagctgaaagaggtctctgatatgcatgcaagttaacacaggttgtataaaagattcctagttatatgcagaacagtatgtatctgcaagacacttcattcccg

SEQ ID NO: 1050 - DNA, 1158 bp, Triticum aestivum
catctcccctttgcctccccctctccggcaatggcctcccccggaccagcccccgccggcgagctcctccgcatcgaccccatcgagctccgcttcccctttgagttgaagaagcagatctcctgctcgatgcagctgtcgaatctcagcgacgactacatcgccttcaaggtgaaaactacaagcccaaagaaatactctgtgcggcccaacacaggggttgtcttgccacgatctacatgcgatgttgttgtgacaatgcaagcacagcgagaagtaccatctgacatgcagtgcaaagataagttcctagtccagagcgttgttgcaccctctggcataaatgtgaaggatgttacaggagagatgtttatgaaggaatctggaaataagattgaagaggtgaaattacgagtcacctatgttgcacctccacagccaccatctccagttcctgaagaatccgaggaaggctccccatctagggttgaatcagaaaatggagatggtcctgctgggggattcaccagggcactgcgagaacgcattgagccccaagaaaaatctttagaggctggagctttgatctccaagttgaccgaagaaaagaattctgcaattcaacagaaccataaaattagacaggaacttgatatgatgagacgggaagtcagcaagaggcgcggtggagggttttcctttgtaattgtcataattgtagctttgatcgggatcttcctgggctacatgatgaagtcataattcttttcatccgtatcacttgaccgtatcgaagggaactggacttgctagtcatgtttgggaacttgaaaagatcattcgagatcaaatgtcttcaagttctcctttatgttttgtcaatataggagtacatgtgtgagaaatattgagctagtttaagcttcttttgttgttaatttcattggtgagttgtgcgctatgatgacgctgtaacttggaaaatgcatcaattgcttttgttcacagttagacctgtactgtgaaattgtcagtccatagttgaatgtgtgtgccatttggaaaggtaaatctgatttgtgttgcagtaatttgctattctagtttgtggaagaactggattttcccctctttatactctgtttggaatatatggtg

SEQ ID NO: 1051 - DNA, 1000 bp, Pseudoroegneria spicata
ccttgcctccccctctccggcaatggcctcccccggaccagcccccgccggcgagctcctccgcatcgaccccatcgagctccgcttcccctttgagttgaagaagcagatctcctgctcgatgcagctgtcgaatctcagcgacgactacatcgccttcaaggtgaaaactacaagcccaaagaaatactctgtgcggcccaacacaggggttgtcttgccgcgatctacatgcgatgttgttgtgacaatgcaagcacagcgagaagtaccatctgacatgcagtgcaaagataagttcctagtccagagcgtcatcgcaccctctggcataaatgtgaaggatgttacgggagagatgtttatgaaggaatctggaaataagattgaagaggtgaaattacgagtcacctatgttgcacctccacaaccaccatctccagttcctgaagaatccgaggaaggctccccatctagggttgaatcagaaaatggagatggtcctgctgggggattcaccagggcactgcgagaacgcattgagccccaagaaaaatctttagaggctggagctttgatctccaagttgaccgaagaaaagaattctgcaattcaacagaaccataaaattagacaggaacttgatatgatgagacgggaagtcagcaagaggcgtggtggagggttttcctttgtaattgtcataattgtagctttgatcgggatcttcctgggctacatgatgaagtcataattcttttctatccgtatcacttgaccgtatcgaaggaaactggacttgctagtcatgtttgggaacttgaaaagatcattcgagatcaaatgtcttcaagttctcctttatgttttgtcaatataggagtacatgtgtgagaagtattgagctagtttaagcttcctttgttgttaatttcattggtgagttgtgcgctatgatgacgccgtaacttggaaaatgcatcaattgcttctgttcaca

SEQ ID NO: 1052 - DNA, 1189 bp, Secale cereale
tttatttccacgtttcttctgttctcgcccctccacgcctctcccctcctcgcacccaccgctccgagatctcccctttgcctccccctctccggcaatggcctcccccggaccagcccccaccggcgagctcctccgcatcgaccccatcgagctccgcttcccctttgagttgaagaagcagatctcctgctcgatgcagctgtcgaatctcagcgacgactacatcgccttcaaggtgaaaactacaagcccaaagaaatactctgtgcggcccaacacaggggttgtcctgccacgatctacatgcgatgttgttgtgacaatgcaagcacagcgagaagtaccttctgacatgcagtgcaaagataagttccttgtccagagcgttgtcgcaccctctggcataaatgtgaaggatgttacgggagagatgtttatgaaggaatctggaaataagattgaagaggtgaaattacgagtcacctacgttgcacctccacagccaccatctccagttcctgaagaatccgaggaaggctccccatctagggttgaatcagaaaatggagatggtccagctgggggattcaccagggcactgcgagaacgcattgagccccaagaaaaatctttagaggctggagctttgatctccaagttgaccgaagaaaagaattctgcaattcaacagaaccataaaattagacaggaacttgatatgatgagacgggaagtaagcaagaggcgcggtggaggattttcctttgtaattgtcataattgtagctttgatcgggatcttcctgggctacatgatgaagtcataattcctttctatccgtatcacctgaccgtatcgaagggtactggacttgctagtcatgtttaggaacttgaaaagatcatccgagatcaaatgtcttcaagttctcctttatgttttgtcaatataggagtacatgtgtgagaaatattgagctagtttaagcttcttttgttgttaatttcattggtgagttgtgcgctatgatgacgctgtaacttggaaaatgcatcaatggcttttgttcacagttagacctgtagtgggaaattgtcagtccatagttgaatgtgtgtgccatttggaaaggtaaatctgatttgtgttgcagtaatttgctattgtagtttgtgaaagaactgga

SEQ ID NO: 1053 - DNA, 1160 bp, Avena sativa
ggaaacgagagccaaatcagtatttctcttctttatttgcttgcttctttttttctcgcccgtccacccctacccgtcttcgcacccaccgcccgagatctccctttgcctctgtcccttccggcaatggcctcccccggaccagctcccgccggcgagctcctccgcatcgaccccatcgagctccgcttcccctttgagttgaagaagcagatctcgtgctcgctgcagctatcgaatctcagcgaagactacatcgccttcaaggttaagacaacaagcccaaagaagtactccgtgcggcccaacacaggggttgtcttgccacgatctacctgcgatgttgttgtgacaatgcaagcacaacgggagagcccgcctgacatgcagtgcaaagataagttcctagtccagaacgtcattgcaccctctggcataaatgtcaaggatgtcacgggggagatgttcacaaaggaatctgggaataaggttgaagaggtgaaattgcgagtcacctatgttgctcctccacagccaccatctccagttcctgaagaatctgaagaaggctccccatctaggggtgaatcagaaaatggagatggtcctgctgggggattcaccagagcactgcgagaacgcattgagcctcaagaaaaatctttagaggctggagctttgatctccaagttgaccgaagaaaagaattctgcaattcaacagaaccataaaattagacaggaacttgatatgatgagacgggaagtcagcaagaggcgcggtggagggttttcctttgtaattgtcataattgtagctttgatcgggatcttcctgggctatatgatgaagtcataattctttcagtccgtaccccttgggtgtatcgaagggaactggagtcggttcatgctagtcatgtctgggaacttgaaaagaccattcgaaatcagatgtcttcaagttctcctttctgttttgtcaatataggagtgcatgtgtgagaaatgttaagctagtttaagcttcttttgttgttaatttcattggtgcgttgtgcgctatgctaacgccttaacttggaaaatgcattaattgtttcattcacagttcacattgtagctgtgaatctttcagtctatagttgaatgtgtgtacca

SEQ ID NO: 1054 - DNA, 1480 bp, Oryza sativa
aggatatggagagagggggtagaaagtgggccccactgatttttttttttaaaaaatgctgactagactgccacgtaggacaaaaccaccgcgtattgagctaagggggttatttgtcctgattgcatagttaagggtgaaaaatgtatggttttgtagtttaggggtgtaattcggtcggccgtaatagttcacagggtaatttgtatttttttctttttaataactttggcctcctttttttttttttttcattcctcattttcccttttcttccttccttcccctctttggcttctctcctggcctctcctctcctctcctctcgtcgttgcacccacctcctctcccaagatctcacctttccaccccctccgcccccgcctcgatccggcaatggcttcccccggaccggccaccgccggcgagctcctccgcatcgaccccgtcgaactccgcttccccttcgagttgaagaagcagatctcgtgctcgatgcagctatcgaatctcagcgacgactacatcgccttcaaggtgaaaactacaagcccaaagaagtattcggtgcggcctaacacaggggttgtcttgccacggtctacctgcgatgttgttgtgacaatgcaagcacagcgggaagccccgcctgacatgcagtgcaaagataagttcctagtccagagcgtcattgcaccttccggtgtaactgtgaaggatatcacgggagaaatgtttacgaaggagtccggaaataaggttgaagaggtaaaattgcgagtgacctatattgctcctccacagccaccatctcctgttcccgaggaatcagaagaaggttccccatcaagggtttctgagtcagaaaatggagacagtcttggtgggggtttcactagagcactgagagaacgcattgagcctcaagaaaattcattagaggctggagctttgattaacaaattgaatgaagagaagaactctgcaattcaacagaaccataaaattagacaggaactggatatgatgagacgggagataagcaagaagcgcggagggttctccttcataatcgtcataattgtcgccttgatcgggatcttcttgggctatatgatgaagtcataattctttgagtcgacatcgaagggaactggaccccacattcatgccaagttattcttgggaggcaaagagaccgtcatgaagttctcctttctgttttgtcaatataggagtgttgcgtacgtgggaaaatcttcaaccagattaagcttgttttcttttgcagtttgttgtttgttgtattgggtgagttgtgcacttctgacactgtaacttggaaatgcattaatcgcttctgttgacagtttatcttgcccatctgaaattttccatccctgtgctgccgtatgatgactggtattgctgaatttcggtgggattaattgaagcaaaatatattagcaccaactttctg

SEQ ID NO: 1055 - DNA, 1524 bp, Panicum virgatum
cattggttaggattcattatgataatctgttttgctacaaccagtcaacagtgtttctctcacaccgaaccagcacatcactagcaccagttagccaacaatatttttctctcataacaaatcagaattaactaccaacctcagccagccgaatagaatgaataaataaataaaatataataatgctgcttttttatcaaatataataatgctgctagtacggagagaacagatacctgctagtattacgaagaccaaagccggagaaaacagagccaaattaatacttgtctttttcttcttctctctcccctcacccacccgccccgagatctccccctctcagtcttatcgcgccggttctctctctacctctttgatccggcaatggccgcccccgctcctgccaccaccggcgagctgctacgcatcgaccctctcgagctccgcttcccattcgagttgaagaagcagatctcgtgctccatgcagctgtcgaatctcagcaacgactacatcgccttcaaggtgaaaactacaagtccaaagaagtattcagtgcgaccaaacacgggggttgtcttgccacggtctacttgcgatgtcgttgtgacaatgcaagcacaacgggagacccctcctgacatgcagtgcaaagataagttcttagtccaaagcatcgttgcacctgctggtattactgtgaaggatgtcacaggggagatgtttacgaaggagtcagagaataagatggaagaggtcaaattgcgagtgacctatgttgctcctccacagccaccctctccagttccggaggaatctgaagaaggttctccatctagggcttctgaatcagaaaatggtgatggccctgctggaggattcaccagagcactgagagagcgcattgatcctcaagaaaaatctttagaggctggagctttgatttccaaactaactgaagaaaagaactctgcgattcaacagaatcatagacttagacaggaacttgatttggttagacgggagatcagcaagaggcgaggaggaggcttctcctttatcgttgtcataattgttgctttgatcggcatattcctgggctatctgatgaagtcataattctttcagccatatcaaagacattcatgcaagtaatgtttgggaactcaaaaagaccattcaagtcagatgtcttgaagttctccttcctgttttgtcgatataggagtgcgtatgtgatgaatgctgagccagtttaagcttttcttcttttgttgttattttccgttgggtgagtcgtgcgcattgctgacactgtaacttggaaaattgcatggattgcttttgttaatcgtttatcttgtattcttgtcgatgcggtaactgcccaaccttgaattgtttgcattacttgtgcgctgcagctgctgcatagatctgttgttgccacaaagcaatctaccgttctgttacctgcaagaacaatgtgacttcgctttgaaaaaacatgttcatcatgtt

SEQ ID NO: 1056 - DNA, 1112 bp, Panicum virgatum
aaaacagagccaaattaatacttgtcttcttcttcttctctctcccctcacccacccgccccgagatctccccctctctgtcttatcgcgccggttctctctctacctctttgatccggcaatggccgcccccgctcctgccaccaccggcgagctgctacgcatcgaccctctcgagctccgcttcccattcgagttgaagaagcagatctcgtgctccatgcagctgtcgaatctcagcaacgactacatcgccttcaaggtgaaaactacaagtccaaagaagtattcagtgcgaccaaacacgggggttgtcttgccacggtctacttgcgatgtcgttgtgacaatgcaagcacaacgggagacccctcctgacatgcagtgcaaagataagttcttagtccaaagcatcgttgcacctgctggtattactgtgaaggatgtcacaggggagatgtttacgaaggagtcagagaataagatggaagaggtcaaattgcgagtgacctatgttgctcctccacagccaccctctccagttccggaggaatctgaagaaggttctccatctagggcttctgaatcagaaaatggtgatggccctgctggaggattcaccagagcactgagagagcgcattgatcctcaagaaaaatctttagaggctggagctttgatttccaaactaactgaagaaaagaactctgcgattcaacagaatcatagacttagacaggaacttgatttggttagacgggagatcagcaagaggcgaggaggaggcttctcctttatcgttgtcataattgttgctttgatcggcatattcctgggctatctgatgaagtcataattctttcagccatatcaaagacattcatgcaagtaatgtttgggaactcaaaaagaccattcaagtcagatgtcttgaagttctccttcctgttttgtcgatataggagtgcgtatgtgatgaatgctgagccagtttaagcttttcttcttttgttgttattttccgttgggtgagtcgtgcgcattgctgacactgtaacttggaaaaatgcatggattgcttttgttaatcgtttatcttgtattcttgtcga

SEQ ID NO: 1057 - DNA, 1221 bp, Panicum virgatum
cctcacccacccgccctgagatctccccctctctctcatcgtgccggttctctctctacctccggtaatggccgctcccgcccctgccaccaccggcgagctgctacgcatcgaccctctcgagctccgcttcccattcgagttgaagaagcagatctcgtgctccatgcagctgtcgaatctcagcaacgactacatcgccttcaaggtgaaaactacaagtccaaagaagtattcagtgcgacccaacacgggggttgtcttgccacggtctacttgtgatgtcgttgtgacaatgcaagcacaacgggaggcccctcctgacatgcagtgcaaagataagttcttagtccaaagcgtcgttgcacctgctggtattactgtgaaggatgtcacaggggatatgtttacgaaggagtcagggaacaagatggaagaggtcaaattgcgagtgacctatgttgctcctccacagccaccctctccagttccggaggaatctgaagaaggttctccgcctagggcttcggaatcagaaagtggagatggccctgctgggggattcaccagagcatttagagagcgcattgaccctcaagaaaagtctttagaggctggagctttgatttccaaactaactgaagaaaagaactctgcgattcaacagaatcatagacttagacaggaacttgattcggttaggcgggagatcagcaagaggcgaggaggaggcttctcctttatcgttgtcataattgttgctttgatcggcatattcctgggttatctgatgaagtcataattctttcagccatatcaaagacattcatgcaagtaatgtctgggaactcaaaaagaccattcacgtcagatgtgaagttctccttcctgttttgttgatataggagtgcgtatgtgaggaatgctgagccagtttaagcttttcttcttttgtttttatttttcgttggatgagtcgtgcgcattgctgacactgtaacttggaaaatgcatcaattgcttttgttcaccgtttatcctgtattcttgttgatgcggtgacttctcaaccttgaattgttgcattacatcgttacgtgtgcgctgcagttggtgcatagatctgtttttgccatagtaatctaaccattctgttatcttgatggacaatgtggttttgctttgttttgcttaggaaaaagatgttcatcatgcaaaagc

SEQ ID NO: 1058 - DNA, 1187 bp, Saccharum officinarum
ccgagatctcccccttctctctcctcgcgccgtttctctctctacctcttttgatccggcaatggccacccccgcccctgccaccgccggcgagctcctacgcgtcgaacccctcgagctacgcttccccttcgagttgaagaagcagatctcgtgctccatgcagctgtcgaatcacaccgacgactacatcgccttcaaggtgaaaactacaagtccaaagaagtattcagtgcggcccaacactggggttgtgttgccacggtctacctgtgatgttgttgttacaatgcaagcacagcgggaagccccgcctgacatgcagtgcaaagataagttcctagtccaaagcgtcgttgcccctgctggtataactgtgaaggatgtcacaggggatatgtttacgaaggagtctgggaataagatggaagaggtcaagttgcgagtgacctatgttgctcctccacagccaccctctccagttccagaggaatctgaagaaggctctccatctagggcttctgaatcagaaaatggagatggacctgctggaggattcaccagagcgctgagagagcgcatcgagcctcaagacaaatctacagaggctggagctttgatttccaagttgactgaagaaaagaattccgcgattcaacagaatcatagacttagacaggaacttgatttggtgagacaggagatcagcaagaggcgtggagggggattctcctttatcattgtcataattgttgctttgatcggcatcatcctgggctatctgatgaagtcataattctttcaggctgtcctctggccatatcaaagacagtcatgcaagttgtgtttgggaactcgaaaaagactattcaaaccagatgtcttgaagttctcctgcctattttgtcgatataggagtgtgcgtacgtgaggaatgctgagccagcttaggcttttctttttcttctcttgttatttttcgttggatgggttgtgcgcattgctgacactgtaacttggaaaatgcatcaattgcttttgttcacaatttatcttgctgacgaaatctgtttttttcccaagtaatcagctgttccattatccggaaagaacaaagtgatttgaccatgtaaaagctttgaacgagtctcgttgcgattatcgcttaaaagcaattaaagttgatc

SEQ ID NO: 1059 - DNA, 1056 bp, Pennisetum glaucum
ccccctccctgtcctcgcggccgttctctctctctacctctttgatccggcaatggccgcccccgcccctgccaccgccggcgagctgctgcgcatcgaccctctcgagctccgcttcccattcgagttgaagaagcagatctcgtgctccatgcagctgtcgaatctcagcggcgactggatcgccttcaaggtgaaaactactagtccgaagaagtattcagtgcgacccaatacaggggttgtctcaccacggtctacttgcgatgtcgttgtgacgatgcaagcacaacgggaggccccccctgacatgcagtgcaaagataagtttttagtccaaagcatcgttacacctgctggtacttctgtgaaggatgtcacgggagagatgtttacaaaggagtcagggaataagatggaggaggttaaattgcgagtgacctatgttgctcccccacagccaccctctccagttccagaggaatctgaagaaggttctccatccagggcttctgaatccgaaaatggagatggccctgctggtggattcaccagagcactgagagagcgcatggagcctcaagaaaaatcttcagaggctggatctttgatttccaaattaactgaagaaaagaactctgcgattcaacagaatcaaaggcttagacaggaacttgattcggttagacgggagatcagcaagaggcgaggaggcggctactcctttatcgttgtcataattgttgctttgattggcatcttcctgggttatcttatgaagtcgtaattctttcagccatatcaaagacattcatgcaagtaatgtttgggaactcaaaaggaccattcaagtcagatgtcttgaagttctccttcctgttttgttgatataggagtgcgtatgtggggaatgatgagccagtttaagccttttcttttgttgttaactcattgggtgggtctcgtgcgcattgctgacactgtaacttggaaaatgcatcaattgctttttgttcaccgtttatttaatgcatactgtcaatgcggtaactgccc

SEQ ID NO: 1060 - DNA, 1250 bp, Setaria italica
gaggagaacggatacctgctggtattacgaagaccaaagctggaaaaccagagccaaataaataattgtcttcttctcttgccccttcgtgtctctctctctctcctcacccacccgccccgagatctcccccctctctctcctcgcgcccgctctctctctctctctctctacctctttgatccggcaatggccgcctccgcccctgccaccgccggcgagctgctacgcatcgaccctctcgagctccgcttcccattcgagttgaagaagcagatctcgtgctccatgcagctgtcgaatctcagcaacgactacatcgccttcaaggtgaaaactactagtccaaagaagtattcagtgcgacccaatacaggggttgtctcaccacggtctacttgcgatgtcgttgtgacaatgcaagcacaacgggagaccccccctgacatgcagtgcaaagataagttcttagtccaaagcattgttgctcctgctggtattattactatgaaggatgtcacggcggatatgtttacaaaggagtcagggaataagatggaagaggtcaaattgcgagtgacctacgttgctcctccacagccaccctctccagttccagaggaatctgaagaaggttcaccgtctagggcttctgaatcagaaaatggagatggccctgctgggggattcaccagagcactgagagagcgcatggagcctcaagaaaaatcttcagaggctggagctttgatttccaaattaactgaagaaaagaactccgcgattcaacagaatcataggcttagacaggaacttgatttggttagacgggagatcagcaagaggcgaggaggcggcttctcctttatcgttgtcataattgttgctttgattggcatattcctgggttatctgatgaagtcgtaattctttcagccatatcaaagacattcatgcaagtaatgtttgggaactcaaaaggaccattcaagtcagatgtcttgcagttctccgtcctgttttgtcgatataggagtcgcgtatgtgaggaatgatgagccagtttaagcttttcttcttttgttgttaactttcattgggtgggtcgtgcgcattgctgacactgtaacttggaaaatgcatcaattgcttttgttcaccgtttatgttgtcaaatgcggtaactgcccaaccttgaactgtggcattacatatgtgctggagttgtttatctttttttgccacaaagt

SEQ ID NO: 1061 - DNA, 1315 bp, Sorghum bicolor
aagtagggagagaacggaacggatacctgcaattacgaagaccaaagctggaaaaccagagcgaaattaatactacttcttttcccacccttcatctctctcctcacccaccaggccacaccaccccccgagatctcccccttctctctcctcgcgccgtgtctctctctacctcttttgatccggcaatggccacccccgcccctgccaccgccggcgagctcctacgcgtggaacccctcgagctacgcttccccttcgagttgaataagcagatctcgtgctccatgcagctgtcgaatcacaccaacgactacatcgccttcaaggtgaaaactacaagtccaaagaagtattcagtgcggcccaacactggggttgtcttgccacggtctacctgtgatgttgttgttacgatgcaagcacagcggctagctccgccagacatgcagtgcaaagataagttcctagtccaaagcatcgttgccccttctggtataactgtgaaggatgtcacaggggatatgtttacgaaggagtctgggaataagatggaggaggtcaagttgcgagtgacttatgttgctcctccacagccaccctctccagttccagaggaatctgaagaaggttctccatctaggacttctgaatcagaaaatggagatggacctgctggaggattcaccagagcactgagggagcgcatcgagcctcaagacaaatctacagaggctggagctttgatttccaagttgactgaagaaaagaattccgcgattcaacagaatcatagacttagacaggaacttgatttggtgagacaggagatcagcaagaggcgtggagggggcttctcctttatcattgtcataattgttgctttgatcggcatcatcctaggctatctgatgaagtcataattctttcaggctgtcctctggccatatcaaagacagtcatgcaagttgtgtttgggaactcaaaaaagactattcaaaccagatgtcttgaagttctcctgcctattttgtcgatataggagtgcatgctgagccagcttaagcttttctttttcttcttttgttattttttgttggattggatgggttgtgcttgtgcgcattgctgacactgtaacttggaaaatgcatcatttgcttttattcacagtttatcttgctgacgaaatctgttttccccaagtaatctgctgttacattattcggaaagaacaggtgaataggtgatttcaccatgtaaaagctttgaacgagtctcgttgcaactatcgcttaaagcaattaaagctgat

SEQ ID NO: 1062 - DNA, 1228 bp, Zea mays
aagtagggagagaacggatatctgccattacgaagccaaccctggaaaaccagggccattaatactactcccacccgtcgtctatctcctcctcaaccaccgccccgagatctccccttctctctcctcgcgccgttttcctctctacctctttgatccggcaatggccgcgcccgcccctgccaccaccggcgacctcctacgcgtcgaccccctcgagctacgcttccccttcgagttgaagaagcagatctcgtgctccatgcagctgtcgaatcacaccgacgactacatcgccttcaaggtgaaaactacaagtccaaagaagtattcggtgcgacccaacactggggttgtcttgccacggtctacctgtgatgttgttgttacgatgcaagcacagcgggaagccccgcctgacatgcagtgcaaggataagttcctagtccaaagcgtcgttgcccctgctggtataactgtgaaggatgtcactggggatatgtttacgaaggagtctgggtataagatggaagaggtcaaattgcgagtgacctatgttgctcctccacagccaccctctccagttccagaggaatctgaagaaggttctccacctagggcttctgaatcagaaaacggagatggaccttctggaggattcaccagagcactaagagagcgcattgagcctcaagacaaatctacagaggctggagctttggtttccaagttgactgaagagaagaattccgcgattcaacagaatcatagacttagacaggaacttgacttggtgaggcaggagatcagcaagaggcgtggagggggcttctccttcatcgtcgtcataattgttgctctgatcggcgccatcctcggctacctgatgaagtcgtaattctttcaggctgtcctctgctggccataccagaggcagtcgtgcaagttgtgtttgggaagaactcgaaaaaaaaactgttgaaaccagatgtcctgagatcatccttcatattttgtcgatataggagtgggtacgtgaggaatgctgggccagtgtttaagcttttcttttccttgttgtttctccgttggatgggcattgcggacgctgtaacttgaaagttgcatcaattgcttctgtttcatagttttatcttgctgagcaaatttgttttttagcaagtaacctgctgtttcattatccggaaagaacaaggtgattcccaag

SEQ ID NO: 1063 - DNA, 1528 bp, Panicum virgatum
gcacacagatctacaccggtaaatgagagagagggggtgggtattaacctatggatctaaatgatctactttgagctaatttttaatctaccaatttaaatctaaatattatagtttttaaaattgatcttgagctaatgttccaaatagaactgatttttgttgtaatcgtagcattaccgatataataacgctgctggtatggagagaagagaacagatacctgctagtattacgaagaccaaagctggagaaacagaaccaaattaatacttgtcttcttctcttgcccccttcttctctctctcctcacccacccgccctgagatctccccctctctctcatcgtgccggttctctctctacctccggtaatggccgcccccgcccctgccaccaccggcgagctgctacgcatcgaccctctcgagctccgcttcccattcgagttgaagaagcagatctcgtgctccatgcagctgtcgaatctcagcaacgactacatcgccttcaaggtgaaaactacaagtccaaagaagtattcagtgcgacccaacacgggggttgtcttgccacggtctacttgtgatgtcgttgtgacaatgcaagcacaacgggaggcccctcctgacatgcagtgcaaagataagttcttagtccaaagcgttgttgcacctgctggtattactgtgaaggatgtcacaggggatatgtttacgaaggagtcagggaacaagatggaagaggtcaaattgcgagtgacctatgttgctcctccacagccaccctctccagttccggaggaatctgaagaaggttctccgcctagggcttcggaatcagaaagtggagatggccctgctgggggattcaccagagcacttagagagcgcattgaccctcaagaaaagtctttagaggctggagctttgatttccaaactaactgaagaaaagaactctgcgattcaacagaatcatagacttagacaggaacttgtaagtgaagcatcgcattttatctatctatgctattgtatcgcagatttatatcacgaatgctgtaagttcagaaaaaaaaagacagggaacttatgtcaaacgatccacctattaatgcttgatccctttttcattatcttgtcaatacaaaggaaaaatcacaaaatagttgtggtggcaatccttataccataggatattttactccatgcttaattttactagagaagcaacaaagaggctttcactacaatcatccctttttttcctctggtgatgatttggatggatttgattaccataatatcagataataataatatcatataagaaaggagtcccatatgttggtctgcacttgtcctttaacatgtatctataagcacaaccgacaacatggtgccatcatgaaaattgaaaaggcacataactacctgtaaacttaagcaacatatgtaccttcttttcttttttcctgaatataagagctgcaagctggacatgaaacgaaactaaaatattacaag

SEQ ID NO: 1064 - DNA, 1069 bp, Leymus cinereus x Leymus triticoides
  misc_feature (533)..(533): n is a, c, g, or t
  misc_feature (974)..(974): n is a, c, g, or t
aaccgaacaagccgtaaagcagaaccttcctctcccacaaggccacaaacccatcttccccgagcccaagcaaaccgcgcgccaccatgttcctcacgaggacggagtacgaccgcggcgtgaacaccttctccccggagggacggctgttccaggtcgagtacgccatcgaggccatcaagttgggatctactgcaatcgggttgaagacgaaggatggggttgttcttgctgtggagaaacgtgtgacgtctccattgctggaacctagcagtgttgagaaaattatggaaattgatgagcatgtaggctgtgccatgagtggccttattgctgatgcaagaacattggttgagcatgctcgtgtggagacccaaaaccatagattctcatatggggaaccgatgacagttgagtccaccacacaagccatttgcgatctagctcttcgctttggagaaggtgaagaagagtctatgtcacgaccttttggagtttctctccttattgctggtcatgatgaaaatgggccnagcttgtactacactgacccatctggaaccttttggcagtgcaatgccaaggccatagggtcaggctctgaaggtgccgatagttccttacaggagcagtttaacaaggagctgacccttcaggaggctgaaaccattgctctatctatcctgaaacaggttatggaagaaaaggtgactccaaataatgtcgacatcgccaaggtcgcgccgaactaccacctttacacccctgcagaggtcgaagcagtcatagcacgattgtgaaacgcagaaatctttgtcgaatgtcaacccggattcatatgttccttctgctgtgtatctgacatcctgatgcctttaaattagcagaagcacaattgctctatgatatgggcactgatgtttgcctcttttcgtttgattatgtggtgttgacaagaaggtttagaggcctanctgttgttgccttgtcacctgccgggaaggagattgtacacccttttgtttgatacgaaggatttgtggcaatagcatgcagtatttgagtaaca

SEQ ID NO: 1065 - DNA, 1309 bp, Triticum aestivum
tcgcttcaaaagaaaaacacctcctgagagttgagcccaaaaaaaatgagaatgagggcattggagaggtttgagggggatcttgacttgcaaggactttaatcccccttattaacccccttcaaacatctccaatcgctgcctaaacggaacaagccataaagcagaacctccccctctcgtagtctcgtctcccacaagccgcaaacccatcttcccctaacccaagcaaaccgcgcaccaccatgttcctcacgaggacggagtacgaccgcggcgtgaacaccttctcgccggagggacggctattccaggtcgagtacgccatcgaggccatcaagttgggatctactgcaatcgggttgaagacgaaggatggggttgttcttgctgtggagaaacgtgtgacgtctccattgctggaacctagcagtgttgagaaaattatggaaattgatgagcatgtaggctgtgccatgagtggccttattgctgatgcaagaacattggttgagcatgctcgagtggagacccaaaaccatagattctcatatggggaaccgatgacagttgagtctaccacacaagctatttgcgatctagctcttcgctttggagaaggtgaagaagagtctatgtcacgaccttttggagtttctctccttattgctggtcatgatgaaaatgggccgagcttgtactacactgacccatctggaaccttttggcagtgcaatgccaaggcaatagggtcaggttctgagggtgccgatagttccttgcaggagcagttcaacaaggagctgacccttcaggaggctgaaaccattgctctatctatcctgaaacaggttatggaagaaaaggtgactccaaataatgtcgacatcgccatggtcgcgccgaactaccacctttacacccctgcagaggtcgaagcagtcatagcacgattgtgaaacgcagaaatctttgtcgaatgtcaaccaggattcatatgttccttgtgctgtgtgtctgacatcccgatgccttcaaattagcagaagcacaattgctctatgatatggacactgatgttttcctcttttcgtttgattatcttgtgttgacaaggtgtagaggcctagctgttgttgccttgtcacttgccggcaaggagattgtactacacccttttgtttgatacgaaggatttgtggcaatagcatgcagtatttcagcaacaactgttgtttccaccgtatgttttggattattattctgttggacacagccatttttcttcacttcctcttagactggacta

SEQ ID NO: 1066 - DNA, 1464 bp, Triticum aestivum
acataatttcatattatttatttttaaggatctcgcttcaaaagaaaaacacctcctgagagttgagcccaaaaaaaatgagaatgagggcattggagaggtttgagggggatcttgacttgcaaggactttaatccccccttattaatccccttcaaacatctccaatcgctgcctaaacggaacaagccataaagcagaacctccccctctcgtagtctcgtctcccacaagccgcaaacccatcttcccctagcccaagcaaaccgcacacgccaccatgttcctcacgaggacggagtacgaccgcggcgtgaacaccttttcgccggagggacgcctattccaggtcgagtacgccatcgaggccatcaagttgggatctactgcaatcgggttgaagacgaaggatggggttgttcttgctgtggagaaacgtgtgacgtctccgttgctggaacctagcagtgttgagaaaatcatggaaattgatgagcatgtaggctgtgccatgagtggccttattgctgatgcaagaacattggttgagcatgctcgagtggagacccaaaaccatagattctcatatggggaaccgatgacagttgagtccaccacacaagctatttgcgatctagctcttcgctttggagaaggtgaagaagagtctatgtcacgaccttttggagtttctctccttattgctggtcatgatgaaaatgggccgagcttgtactacactgacccatctggaaccttttggcagtgcaatgccaaggcaatagggtcaggctctgagggtgccgatagttccttgcaggagcagttcaacaaggagctgacccttcaggaggctgaaaccattgctctatctatcctgaaacaggttatggaagaaaaggtgactccaaataatgtcgacatcgccagggtcgcgccgaactaccacctttacacccctgcagaggttgaagcagtcatagcacgattgtgaaacgcagaaatctttgtcgaatgtcaaccaggattcgtatgttccttgtgctgtgtgtctgacatccagatgccttcaaattagcagaagcacaattgctctatgatatggacactgatgtttgcctcttttcatttgattatcttgtgttaacaaggtgtagaggcctagctgttgttgccttgtcacttgccggtaaggagattgtactacacccttttgtttgatatacgaaggatttgtggcaatagcatgcagtatttcagcaacaactgtcgtttgcactgtatgttttggattgttgaacatagcgatttttcttcacttcttcttagactggactacttaaagaccgctaggtttcacttcagaaactttttattcggctaggaagttgttctttcgctgctgatgagactgcttttaaccatataaacgtgccacgcaataacagttgtgcctgaaacttt

SEQ ID NO: 1067 - DNA, 1204 bp, Triticum aestivum
agcaaaccgcgcgccaccatgttcctcacgaggacggagtacgaccgcggcgtgaacaccttctcgccggagggacggctattccaggtcgagtacgccatcgaggccatcaagttgggatctactgcaatcgggttgaagacgaaggatggggttgttcttgctgtggagaaacgtgtgacgtctccattgctggaacctagcagtgttgagaaaattatggaaattgatgagcatgtaggctgtgccatgagtggccttattgctgatgcaagaacattggttgagcatgctcgagtggagacccaaaaccatagattctcatatggggaaccgatgacagttgagtccaccacacaagctatttgcgatctagctcttcgctttggagaaggtgaagaagagtctatgtcacgaccttttggagtttctctccttattgctggtcatgatgaaaatgggccgagcttgtactacactgacccatctggaaccttttggcagtgcaatgccaaggcaatagggtcaggctctgagggtgccgatagttccttgcaggagcagttcaacaaggagctgacccttcaggaggctgaaaccattgctctatctatcctgaaacaggttatggaagaaaaggtgactccaaataatgtcgacatcgccatggtcgcgccgaactaccacctttacacccctgcagaggtcgaagcagtcatagcacgattgtgaaacgcagaaatctttgtcgaatgtcaaccaggattcgtatgttccttgtgctgtgtgtctgacatcccgatgccttcaaattagcagaagcacaattgctctatgatatggacactgatgttttcctcttttcgtttgattatcttgtgttgacaaggtgtagaggcctagctgttgttgccttgtcacttgccggcaaggagattgtactacaccctttcgtttgatacgaaggatttgtggcaatagcatgcagtatttcagcaacaactgtcgtttgcactgtatgttttggattgttgaacatagcgatttttcttcacttcttcttagactggactacttaaagaccgctaggtttcacttcagaaactttttattcggctaggaagttgttctttcgctgctgatgagactgcttttaacctatataaacgtgccacgcaataacagttgtgcctgaaactttaaa

SEQ ID NO: 1068 - DNA, 1217 bp, Secale cereale
cggccgtccgagccaacccgcaaacatcgttttccacgaaccgcaaacgcgttttgagggccggccggacgcgggtccgctagagttggtgtaaccgaacaagccataaaggagaaccttcctctcgtctcccacaaggccacgaacccactcttcccctagcccaagcaaaccgcgctccaccatgttcctcacgaggacggagtacgaccgcggcgtgaacaccttctcgccggagggacggctgttccaggtcgagtatgccatcgaggccatcaagttaggatctactgcaatcgggttgaagacgaaggatggggttgttcttgctgtggagaaacgtgtgacgtctccattgctggaacctagcagtgtcgagaaaattatggaaattgatgagcacgtaggctgtgccatgagtggccttattgctgatgcaagaacattggttgagcatgctcgtgtggagacccaaaaccatagattctcatatggggaaccaatgacagttgagtccaccacacaagctatttgcgatctagctcttcgctttggagaaggtgaagaagagtctatgtcacgaccttttggagtttctctccttattgctggtcatgatgaaaatgggccgagcttgtactacactgacccatctggaaccttttggcagtgcaatgccaaggcaatagggtcaggctctgaaggtgctgatagttccttacaggagctgtttaataaggagctgaccctgcaggtggctgaaaccattgctctatctatcctgaaacaggttatggaagaaaaggtgactccaaataatgtcgacattgccaaggtcgcgccgaactaccacctttacacccctgcagaggtcgaagcagtcatagcacgattgtgaaacgcggaaatctttgtcaaatgtcaaccaggattcatatgttccttgtgctgtgtgtttgacatccggatgccttcaaatcagcagaagcacgattgctctatgatatggacactgatgtctgccttttttcgtttgattttattgtgttggcaaggtgtagaggcctaactgttgttgccttgtcacttgccggtaaggagattgtactacacccttttgtttgatacggagtacgaaggatttgtggcaatagcatgcagtatttcagcaacaactgtcgtttgcaccgtatgttttggattattattctgttgga

SEQ ID NO: 1069 - DNA, 906 bp, Festuca arundinacea
  misc_feature (641)..(641): n is a, c, g, or t
ggcacgaggcccaagcccaagcaaaccgcgcgccaccatgttcctcacgaggacggagtacgaccgcggcgtgaacaccttctccccggaggggcggctgttccaggtcgagtacgccatagaggcaatcaagttgggctctactgctattgggttgaagaccaaggatggggttgttcttgctgtggagaaacgtgtgacatctccgttgctggaacctagcagtgttgagaaaattatggaaattgatgagcatgttggttgcgccatgagtggccttattgctgatgcgaggacattggttgagcatgctcgtgtggagacccaaaaccatagattctcatatggggaaccaatgacagttgagtccaccacacaagctatttgtgatctagctcttcgctttggagaaggtgaagaagagtcaatgtcacgaccttttggagtttctctccttattgctggtcatgatgaaaatggtcccagtttgtactacaccgacccatctggaaccttttggcagtgcaatgccaaggcaattggatcgggctctgaaggtgctgatagctctttacaggagcagtttaacaaggagctgacccttgaggaggctgaaagcattgctctatctatcctgaagnaggttatggaagaaaaggtaactccaaacaatgttgacatcgccaaggtcgcgccgaactaccacctctacacccctgcagaggtcgaagcagtcatagcacgtctgtgaaaacagataaatctttatctatgccaactcggattcatatactcctgcagtcctgctgatgtgtgtttggcatccgtttaattagcataagcacgattgctcttttgtcttgacactgatgtctacctctgatcgttcgatttaaatctggtatc

SEQ ID NO: 1070 - DNA, 1105 bp, Avena sativa
ggccaggtgcgtgggacttatcgtctagacctccctctgctctacttcttcctcaagcagaactgcagaaccttcttctcgtctcccacaaacccttcttccccgagcccaagcaaaccgcgcgccaccatgttcctcacgaggacggagtacgaccgcggcgtgaacaccttctccccggaggggcggctgttccaggtcgagtacgccatcgaggccatcaagttgggctctactgctattgggttgaagacgaaggatggggttgttcttgctgtggagaaacgtgtgacatctccgttgctggaacctagcagtgttgagaaaattatggaaattgatgagcatgttggttgtgccatgagtggccttattgctgatgcgaggacattggttgagcatgctcgtgtggagacccaaaatcatagattctcatatggggaaccaatgacagttgagtccaccacacaagctatttgtgatctagctcttcgctttggagaaggcgaagaggagtcaatgtcacgaccttttggagtttctctccttatcgctggtcatgatgaaaatggccccagcttgtactacaccgacccatctggcaccttttggcagtgcaatgccaaggcgattggatcgggttctgaaggtgccgatagctctttacaggagcagtttaacaaggagctgacccttgaggaggctgaaaacattgctctatctatcctcaagcaggttatggaagaaaaggtaactccaaacaatgttgacatcgccaaggtcgcaccgaactaccacctctacacccctgcagaggtcgaagcaatcatagcacggctgtgaaaaagcagagaggaatctttatccatgtcgacccggattccttctgctgtgtgtttgacatcctttcgaagcacaggacgattgctctattgtcttgacactgatgtatacgttcgtttgattttaaatgtggtatcgaaccagaagttttagaggcatgtacttcatccgtttggaaataagtatcacaaatttgtctaggttcatatgtatctaaacgtgttttactgttagatacatatgtgtatctagacaaatgtgc

SEQ ID NO: 1071 - DNA, 1048 bp, Avena sativa
accagcaggagtagaaagaaaggccttccgcgatttcaagcgaagaaatagcgagagagaaagaagatcctgcttcgaatccgcatccgccgccgccgacgacgagatgtttctcacgaggactgagtacgaccgcggggtgaacaccttctccccggaggggcgcctgttccaggtcgagtacgccattgaggccatcaagttgggctcgaccgctattgggttgaagactaaggatggtgttgtcctggctgttgagaaacgtgtgacctcaccgctgctggaaccaagcagtgtggagaaaatcatggaaattgatgagcatgtaggctgtgctatgagtggccttattgctgatgctagaacactggttgagcatgctcgtgttgagacccagaatcataggttctcatatggggagccaatgacagtagaatctaccacgcaagctatctgtgacttggctttgcgctttggcgaaggtgaagaagagtcaatgtcacgaccatttggagtctctctccttattgctggtcatgatgaaaatggacccagcttgtactacacagacccatctgggaccttctggcaatgcaacgccaaggcaattggatcaggctctgaaggagctgatagctcactacaagagcagtacaacaaggaactgaccattgctgaggcagagaccatagccctttctatcctcaagcaggttatggaagaaaaggtgacccctaacaatgtcgacatcgcaaaggtgtctcccaactaccacctctacacccctgcagaggttgaagcggtcatcgcgcggttgtgaagcattaccgctttgggaaacgagctgttgctattctgatgaagcattggcacaatggacgtatgaactctgttgatgtgggttttcttcctgttgctgtcatggctatatttgttcaaggatagtacctgcatggccgcatctgattctgatctcccggaccaggcattttcgtttgtttgtttccagtagcactaagacaatgtactagcaaattcgtaaacttgc

SEQ ID NO: 1072 - DNA, 1240 bp, Oryza sativa
gcatgtaagtggcacgccgcatcgtccctctcgtctcggcttggtccgcaagaagaacaacaccgcgagagtaaaagcaccccctcctcttcgtctcggctttcggagctctcgatactttagccgcgattcggagggaaaccctagctagctcccgctctcgatcccgcgcccgccaccgcactcggcaagatgttcctcacgaggacggagtacgaccgcggggtgaacaccttctccccggaggggcggttgttccaggtcgagtacgccattgaggccatcaagttggggtcaactgcgatcgggttgaagaccaaggatggtgttgtccttgctgtagagaaacgtgtgacctcgccactgctggaaccaagcagtgtggagaaaatcatggaaattgacgagcacataggctgtgccatgagtggccttattgctgatgctagaacattggttgagcatgctcgtgttgaaacccagaatcataggttctcatatggggagccaatgacagtagaatctactacacaagctatctgtgacttagctctgcgttttggtgaaggtgatgaagagtcgatgtcacgaccatttggtgtctctctccttattgctggtcatgatgagaatggacccagcttgtactacactgacccatcaggaaccttttggcagtgcaatgccaaggcaattggatcaggttctgaaggagctgatagctcattacaggagcagtacaataaggagttgacccttcaggaggctgagaccatagccctgtctatcttgaagcaggttatggaagaaaaggttactccaaacaacgtcgatatcgcaaaggtttctcccaactaccacctctacacccctgcagaggttgaagctgtcattgcacggttgtgagaagattgccatcgcgtgttattttaatcagccctaagacagcctctgtatgaacttcctaaatggattatcagtccattgtttgctatggctgtcatgttatgttaacaagatagtggctgctagagtttattactggctctaatagtctggtgtgcagcccagtcatttgcttgttttcagcagtgttgagaccatgtactatcaaaaagagaacgacaatcctttccaagatttggttgcaacatttcgacagtcatcttgatcttcggtttcttcccaaccatagtttatttttgatacaatataaagtaggagtatacatatagaaaat

SEQ ID NO: 1073 - DNA, 1398 bp, Sorghum bicolor
caccgcaccgccgtcgcctgtgtgcttcgcttcaacttcctcggcaagcagaagaggagggagggaggtcctgctcgctcgatccagacgcatccgccgaccgccgtcaccggagtcgccgacaggatgtttctcacgaggacggagtacgaccgcggggtgaacacgttctcgccggaggggcggctgttccaggtcgagtacgccatcgaggccatcaagttgggatccactgcgatcgggttgaagacaaaggatggtgttgttctcgccgtcgagaaacgtgtgacctctccactgctggaaccaagcagtgtggagaaaatcatggaaatcgatgagcacataggctgtgccatgagtggacttattgctgatgctagaacgctagtggagcatgctcgtgttgagactcagaatcataggttctcatatggggagccaatgaccgtagaatcttctacacaagctatctgtgacttggctctgcgctttggcgaaggtgatgaagagtcaatgtcacgaccatttggagtctctctcctaatcgctggacatgatgagaatggacctagcttgtactacactgacccatctggaaccttctggcaatgcaatgcaaaggctattggatcaggctctgaaggagctgatagctccttgcaggagcagtacaacaaggaactgaccctccaggaggcagagaccatagccctttctatcctgaagcaggttatggaagagaaggtgaccccaaacaatgtcgatatcgccaaggttgcccccaagtaccacctctacacccctgccgaggttgaagctgtcattgcgaggctgtaaaacacttcagatttctcgatttcccatcatcaatcacggtcgttgtatgaagcatggacatcttgatgctggcctgtcagcctagtgtgtgttgctatgtttgtcaccatgttctgtcaactccacaagggcagttcatgatagattaattggcagcccggtcagttcaatgatttaagtagcattgagaagtttgtactgccagaaagaatgtatacttctttttacgaatttaacttcaatttcttcttttcccagccagttcgtgacgtgttgactggttttgcaacctgcaatttccagtggtgtgtgaattactgcggtggtggtggccatatccggtgcctttcacgcgcaggctatatttttttgttttctgccggtggccaatacagtttggtctgcccagaaaattttggatccatttggttgaaggctagaaattggcatgaccaaacgaatttagaatgtgacaaaggacatgttatgaaatgttaaatctaaaacaattaagaagttttgttacgaatacgatggtttactatagatcataacact

SEQ ID NO: 1074 - DNA, 1287 bp, Brachypodium distachyon
ggtgacacggcggggacgcctgctcctttcccaactcgccgccgtctctcgtctcgtctcgtctttgctttgctttgttcccaagaagaactccggtcccggagcacgaagccttcgagcgctcgagatacctgggcgacgatttgagtagagaaaaagagtgtgaattccttgcttcggttctgcatccgccgccgctggcaagatgtttctgacgaggacggagtacgaccgcggggtgaacaccttctccccggaggggcgtctgttccaggtcgagtacgccattgaggccatcaagttgggatcaactgcgatcgggttgaagactaaggatggtgttgtcctggcagttgagaaacgtgtgacatcgccactactggaaccaagcagcgtggagaaaatcatggaaattgacgagcatgtaggctgtgccatgagtggccttattgctgatgctagaacactggttgagcatgctcgtgttgagactcagaatcataggttctcatatggggagccaatgacagtagaatctacaacccaagccatctgtgacttggctctgcgctttggtgaaggtgatgaagagtcaatgtcacggccatttggagtctctctccttattgctgggcatgacgaaaatggacccagcttgtactacacggacccatctgggaccttctggcaatgcaacgccaaggcaatcggatctggctctgaaggagctgatagctcgttacaggagcagtacaacaaggagctgactcttgcggaggcggagacaatagccctgtctatcctgaagcaggttatggaagaaaaggtaaccccgaacaacgtcgacattgcaaaggtctcccccagctaccacctatacaccccagcagaggttgaggcagtcatcgcgcggttgtgaagcactgccagtcttgttaattttatatcaacctgtaaggaacagtatgagcttgttgatgtgtctgcctgcccactgttgtgatggctcgtggtactagggcttatcgtgtctggcagcctgattcccagtccagtgatttatttgtttccagtagttcggctgaagagaatatttgacatctatttcaagatttggttgcaacctttggaaagtacacaagttaactgctgatccgaagcattgccatgacccatcattggaagctcagaacataatgttgtgtcttgtgactaggtgagctgttcacatgttaaagtgtttctggtggcgctttatagtagaacaggaattaccaaagtagaaat

SEQ ID NO: 1075 - DNA, 1169 bp, Zea mays
aacatctcgccgtcatcacgtctctctttcaacttcgttcgcaagaagctcagaacagaacccatcaaaagcgaggctgcgagagagagagagagagagagagagagagagcgagagagagagagagagagagagagagagagagagagagagagagagagagagtgagtgagggaggcgccgccgcgccgacgccgagtcctttcttcatcctgcatctgccgctgtttccgacaggatgtttctcacgaggacggagtacgaccgtggggtgaacaccttctctccggaggggcggctgttccaggtcgagtacgccatcgaggccatcaagttgggatccactgcgatcggtttgaagacaaaggatggtgttgtcctcgccgttgagaaacgtgtgacctcaccactgctggaaccaagcagtgtggaaaaaataatggaaattgatgagcacataggctgtgccatgagtggacttattgctgatgctagaacactagtggaacatgctcgtgttgaaactcagaatcataggttctcatacggagagccaatgactgtagaatcttcgacacaagctatctgtgacttagctctgcgttttggcgaaggtgacgaagagtcaatgtcacggccatttggagtctctctcctaattgctggacatgatgagaatggacctagcctgtactacactgacccatctggtacattttggcaatgcaacgcaaaggcaattggatcaggttctgagggagctgatagttccttgcaggaacagtacaacaaggaattgaccctccaggaggcggagaccatagccctttctatcctgaagcaggttatggaagagaaggtgaccccaaacaacgtcgatattgccaaggttgcccccaagtaccacctctacacccctgccgaggtggaagccgtcatcgcgaggctgtgaaacgcttccgagctcttgctatccacgtcatcaatcggtaatagacgacccttgtacgaagcgtgggcaccatggtccttgattatggcttgattatggcaaggacagtcgatgttagtttgattcacagctcagccgggctcacttgtctttttaaatttttatgaattagcgttgagaactttgtactgccaagaaagttcattttttttaccct

SEQ ID NO: 1076 - DNA, 1172 bp, Saccharum officinarum
gtcgacccacgcgtccgccgtcgcctgtgttcttcgcttcaacctcctcggcaagcagaagagaagcgaagagagaaaggcggcgagtcgtgctcgatccagcaaccgccgtcaccggagtcgccgacaggatgtttctcacgaggacggagtacgaccgcggggtgaacaccttctcgccggaggggcggctgttccaggtcgagtacgccatcgaggccatcaagttgggatccactgcaatcgggttgaagacaaaggatggcgttgttctcgccgtcgagaaacgtgtgacctcgccactgctggaacctagcagtgtggagaaaatcatggaaattgatgagcacataggctgtgccatgagtggacttattgctgatgctagaacattagttgagcacgctcgtgttgagacccagaatcataggttctcatatggggagccaatgactgtagaatcttctacacaagctatctgtgacctggctctgcgctttggcgaaggtgatgaagagtcaatgtcacggccatttggagtctccctcctaatcgctggacatgatgagaatggacctagcttatactacacggacccatctggaaccttctggcaatgcaatgcaaaggcaattggatcaggttctgaaggagctgatagctccttgcaggagcagtacaacaaggaactgaccctccaggaggcggagaccatagccctttctatcctgaagcaggttatggaagagaaggtgaccccaaacaatgtcgatatcgccaaggttgcccccaagtaccacctctacacccctgccgaggtcgaagctgtcatcgcgaggctgtaaaacacttctgagttcttgatttcccgtcaacaatcacggtcgttgtatgaagcatggacattttgatgtgggcctatcagatgctagtgtgtgttgccatgtttgtcaccatgctctgtcaactccacaagggcagttcatgataaactaattggcagcccggccagttcagtgatttaagtagcattgattactttgtactgccagaaagaatgtatacttctttttaaccacaacaaaaaacccccccacaacccaccacccataccatctccacaccccccacaaccccacccactccaccatacccaacacatcccgggggcg

SEQ ID NO: 1077 - DNA, 1153 bp, Cenchrus ciliaris
  misc_feature (1099)..(1099): n is a, c, g, or t
caaaagcgggcgcgaggggagttgagggaggcgccgccgcggagtagagctcgatccagcacccgccgccgccgtcgacgtcgcctacaggacaggatgtttctcacgaggacggagtacgaccgcggggtgaacaccttctcgccggaggggcgactgttccaggtcgagtacgccatcgaggccatcaagttgggatcgactgcgatcgggttgaagacaaaggatggtgttgtccttgctgttgagaaacgtgtcacctcgccactactggaaccaagcagtgtcgagaaaatcatggaaattgatgagcacataggctgtgccatgagtgggcttattgctgatgctagaacgctagtcgagcatgcacgtgttgagacccagaatcataggttctcatatggggagccaatgaccgtagaatcttcaacacaagctatctgtgacttggctctgcgctttggtgaaggtgacgaagagtcaatgtcacgaccatttggagtgtctctcctaattgctggacatgatgagaatggacctagcttgtactacactgacccatctgggacgttttggcaatgcaatgcaaaggcaattggatcaggctctgaaggagctgatagctccttgcaggagcagtacaacaaggacctgaccctccaggaggcagagaccatagccctttctattctgaagcaagttatggaagagaaggtgaccccaaacaatgtcgacattgccaaggtcgcccccaagtaccacctctacacccctgctgaggttgaagccgtcattgcgaggctgtgaaacgcttccagattcttgtcgttcacatcatcaatcagtaatacagctctttctatcttgtcattcacatcatcgatcagtaatagacagctctttctacgaagcgtggacatgtttgatgtgagccgaactgcctagtgtgttgccgatgctgccatcatcatactcgtgtcactagggcagtcgctgatagtctgattgaactgcagccctgtcattctgtctgtttcaactaatgttgagaactccggtactgccagaaagaatgtacacttgtttttacgaattnggcttccgtttttcttttcctgaacaattacctgatcctccgggcttccgttta

SEQ ID NO: 1078 - DNA, 1331 bp, Setaria italica
caagaagctcaggaagccatcaaaagcgagcgagaggggagagagagaggcgagaggagaagagggaggcgccgacgcggagttcccgttcgatccagcacccgccgccgctgccgacgccgccgccttcgccttcacgacaggatgtttctcacgaggacggagtacgaccgcggggtgaacaccttctcgccggaggggcggctgttccaggtcgagtacgccatcgaggcaatcaagttgggatcgactgcaatcgggttgaagacaaaggatggtgttgtcctcgctgttgagaaacgtgtcacctcgccactgctggaacccagcagtgtggagaaaataatggaaattgatgagcacataggctgtgccatgagtggacttattgctgatgctagaacgctagtcgagcatgctcgtgttgagacccagaatcataggttctcatatggggagccaatgactgtagaatcttctacacaagctatctgtgacttggctctgcgctttggtgaaggtgacgaagagtcaatgtcacgaccatttggagtgtctcttctaattgctggacatgatgagaatggacctagcttgtactacacggacccgtctgggaccttttggcaatgcaacgcaaaggcaattggatcaggctctgaaggagctgatagctccttgcaggagcagtacaacaaggatctgaccctccaggaggcggagaccatagccctttctatcctgaagcaggttatggaagagaaggtgaccccaaacaatgtggatatcgccaaggtcgcccccaagtaccacctctacacccctgccgaggtcgaagccgtcattgcaaggctgtgaaacgcttccagattcttgctattcgcatcatcgatcagtaatagacagtctttgtacgaagtgtggacatgttgatgcgggccaatctgcctagtgtgttgccatggctgtcatcatcatactcttgtcaactccactagggcagtcgctgatagtctgattcactgcagccctgtcacgctgtttgtttcaagtagcgttgagaacttccgtactgccagaaagaaagtacacttgtttttacgaattcggcttttttttggacaattagctgatgctcttatcctggtgccatacttgctgaaatgttaccagtggaaaggtccagcttttcacgtcccgttatttttggcctgtgttttgtaaaataatcagatcgcggtccaaattagggggctatatgcaaataaaagggggtgttttgtaaatatttgaatttcgaccaataattgcgattcaaataagggggttat

SEQ ID NO: 1079 - DNA, 1064 bp, Allium cepa
aaactcctcccttactcagctccactctgccttgttcagccgtccccaaatcttaaaaccccctaagaatcagatttctcaaatccaaatttcaaaaatcccaactttttcttttaaactatttcgtaatgtttcttaccaggacagaatatgatcgaggagtgaacacattctcgcccgaaggcaggctttttcaagtcgaatatgccatcgaagcgatcaagttgggttctactgcgattggattgaagacgaaggagggagtagtgcttgcagttgagaagagagtcacttctcctttgctggagccaagcagcgttgagaagataatggaaatcgatgaacacataggatgtgcaatgagtggattgattgctgatgcacggactcttgtggagcatgcccgtgttgagactcagaatcacaggttttcatatggtgaacctatgacagtggagtctactacacaggctctatgtgatctcgctcttcgttttggtgaaggtgatgaagaatctatgtcccgaccttttggagtttcacttttgattgctggccacgatgaaaatggaccaagcttgtactacacagacccatctggtacattctggcagtgcaatgccaaagcaataggttcaggttcagaaggcgctgacagctctttacaagagcaatataacaaggaattgaccctggctgaagctgaaacaatagccctttctatcttaaaacaagtgatggaggagaaggtaactccaaacaacgtggatatagcaaaggtcgctccaaattatcatctctacgctcctgcagaagtcgaggctgtaattggtcgcttataaatgtttgcctgcaagcttcataagcaagtcgcacacattatcatgccatttgttcatgttatttaatttgtatgaccattgtttatcttgacgaaatgaaatcacttgcacttttgtaagaatattgtttgaattggcatgcataagtctagaccttctgttatatcacttacgtttatatgtactttggttattatgttgtggtaatcttttatattttct

SEQ ID NO: 1080 - DNA, 853 bp, Allium cepa
cttgtttgccaagcagtcgttccccaaatcttaaacccaaaaactacctaaaatttctccaaacatcgacaaaccatctttattttgtttacatcacaatgtttctgaccaggactgaatacgatcgaggagtcaacacattctcgcccgaaggcagacttttccaagtcgaatatgcaatcgaagctatcaagttgggttcgactgcgattggattgaagacgaaagagggagtggtgcttgcagttgagaagagagtcacttctcctttgctggagccaagcagtgttgaaaaaataatggaaattgatgagcacataggctgtgcaatgagtggattgattgctgatgcacggacccttgtagagcatgcacgggtcgaaactcagaatcacaggttttcatatggtgaacctatgacagtggagtctacaacacaagctttatgcgatcttgctcttcgatttggcgaaggtgatgaagaatcgatgtcccgaccttttggagtttcacttttgattgctggtcacgatgaaaacggaccaagtttgtactataccgacccatctggtacattctggcagtgcaatgcaaaggcaataggttcgggttcagaaggtgctgacagctcgctacaagagcaatataacaaggaattgacactcgctgaagctgaaacaattgctttatctatcttaaaacaagtaatggaggagaaggtgacaccaaacaacgttgatatcgcgaaggttgctccaaattatcatctctatactccttcagaggtcgaggctgtaattggtcgtctataagtggtttgtcttcatgatttccacctttgggacgttatcat

SEQ ID NO: 1081 - DNA, 1525 bp, Sorghum bicolor
gaacggcgcaggttgtgcgtgcccccgggttgtgcgtgatacggtgaaactgaactccacaagtccagggatttcggatggcacgatctgcgttccacctgctcggcccatccacgctttccatgctgtgtcagggcccaattcctccgcgtggctgggaccatctgcctggcacgtgggacccgtctgtaagtttcacgacgcgccgtctccgttaacatctcgccatcatctcggctctctttcaacttcgttcgcaagaagctcagaacagaagccatcaaaagtggggagaggctgcgagagggaagcgaggagagagagagggtgagggtaaggggaggcgccgacgccgagttcttgctccatcccgcatccgccgccgtcgccgacacgatgtttctcacgaggacggagtacgaccgcggggtgaacaccttctcgccggaggggcggctgttccaggtcgagtacgccatcgaggccatcaagttgggatccactgcgatcgggttgaagacaaaggatggtgttgtcctcgctgttgagaaacgtgtgacctcgccactgctggaaccaagcagtgtggaaaaaatcatggaaattgatgagcacataggctgtgccatgagtggacttattgctgatgctagaacactagttgagcatgctcgtgttgaaactcagaatcatagattctcgtacggggagccaatgaccgtagaatcttcgacacaagctatctgtgacttagctctgcgctttggtgaaggtgacgaagagtcaatgtcacggccatttggagtctctctcctaattgctggacatgatgagaatggacctagcctgtactacactgacccatctggtaccttttggcaatgcaacgcaaaggcaattggatcaggctctgagggagctgatagctccttgcaggagcagtacaacaaggaattgaccctcgaggaggcagagacgatagccctttctatcctgaagcaggttatggaagagaaggtgaccccaaacaacgtcgatatagccaaggttgcccccaagtaccacctctacacccctgccgaggtcgaagctgttatcgcgaggctgtgaagtgcttccgagctcacgccatcagtcggtaatagacaatccttgtacgaaacgtggacatcttggttcttgattatggctgtcatcgtactctgttgtaactccacaaggacagtcgatggtagtttgattcgcagctcagccggctcagttgtctgtttctagtagcgttgagcgttgagaacattgtattgccagaaacaaagtacacttatttttctttactgtttcgccttccgttttgtgggcaattagctgatgctcgtgatgtgattgcgcctggaatttttagtcctgcgtgaaatggcagcggtggtatcctgtggttttcaggcgtcagttatttatttttgaatgaaaaatacacgcccagcgggggtacgtagaagtcgaccagggaggtgggccgcgaggg

SEQ ID NO: 1082 - DNA, 1393 bp, Panicum virgatum
gccagcaatcgagcccactacgtgaacgacgacaggcccaaatgggtgagcgagaggaaacctaggcggctggggcccacctgcgcggggcccacctgtaagtgtccgagcgtcctccctctccgttcccatctcgcccattcaacttcgctcgcaagaagctcacgaggccatcaaaagcgaggcgagggggaggagagggaggcgccgacgcggagctcctcctgctcgatccagcaccaccagccgccgcagccgacttcgccgccgccgacaggacaggatgtttctcactaggacggagtacgaccgcggggtgaacaccttctcgccggaggggcggctgttccaggtcgagtacgccatcgaggccatcaagttgggatctactgcgattgggttgaggacaaaggatggtgttgtccttgctgttgagaaacgtgtcacctcgccacttctggaaccaagcagtgtcgagaaaatcatggaaattgatgagcacataggctgtgccatgagtggacttattgctgatgctagaacgctagtcgagcatgctcgtgttgagacccagaatcataggttctcatatggggagccaatgaccgtagaatcttctacacaagctatctgtgacttggctctgcgctttggcgaaggtgacgaggagtcaatgtcacggccgtttggagtctctctcctaattgctggacatgatgagaatggacctagcttgtactacaccgacccatctgggaccttttggcaatgcaatgctaaggcaattggatcaggctctgaaggagctgatagctccttgcaggagcagtataacaaggacctgaccctccaggaggcggagaccatagccctttctattctgaagcaggttatggaagagaaggtgaccccaaacaatgttgatattgccaaggtcgcccccaagtaccacctgtacacccccgccgaggtcgaagccgtcattgcaaggctgtgaaacacttccagattcttgctattcctgtcatcaatcagtaatagacagtcattgtatgaagcgtggacatgttgattcttgcctctctgcctagtgtgttgctatggctgtcatcatacactgttttcaactcccgcaggggcagtcactgatagtctgattcacagcccagtcggctcagttgcttgtttttaagtagcgttgagaacttctgtactgccagaaagaaagtacacctgtttttacgaattcgtcttctgtttctttgaacaactggctgatgcttgtgacctgatgccattggatcttttttttttttgaaagagtgccactggatactagctttgcagcttgcactttcctgttgggtgaatggtaatagtggttctcgtctcg

SEQ ID NO: 1083 - DNA, 1102 bp, Euonymus alatus
tctctcggcgtaaagaggtttttgagcttgcgatctagatcgaacagcaaaatgtttctcacaaggaccgagtatgatagaggagtcaacaccttctctccggaaggcagattgtttcaggttgaatatgccattgaagctatcaagctgggctcaactgctattggattgaaaacaaaagaaggagtggttcttgcagtcgagaagcgtattacttcgccactgctggagcccagcagtgtagaaaaaattatggaaattgatgagcatataggatgtgctatgagtggattgattgctgatgcccgtacacttgttgagcatgcacgtgttgaaactcagaaccacagattctcgtatggtgaaccaatgactgtagagtccactacacaagcactatgtgatctcgccctgcgctttggtgagggtgatgaagaatccatgtcccgaccctttggggtatctcttctgattgctggtcatgatgaaaatggccccagcttgtactatacagatccatctggcactttttggcaatgcaatgccaaggctattggttctggttcagaaggtgctgacagctctctgcaagaacagtataacaaggaggtaactcttcaagaagctgagacaattgctctgtcaattctgaagcaagtcatggaagagaaggtaactccaaacaatgtcgatatcgcaaaggtggctccaaattatcacctatacaccccttctgaggtggaggccgtcattggtcgcctatgacggaatctcaaaatgcctgttcatttcctatttagtcccatgcttgctttcctaactgtctgctggggagccccctgttgtgattctgctgttcgtctttctaaaatgcacttgttagtttgagccgtccaactggaacatggatttggctaaatgaaaacttatattttaggggtgaatgatgaccatgcgatttgttcctttgacatgattgattatccaactggaatgttaaaatctttagccaatatttgctttgctagaaatagttcctctgcaggaagcaggcaacattttgattgtatcctcttgcatggcctcacacgatagttgttgg

SEQ ID NO: 1084 - DNA, 1141 bp, Festuca arundinacea
  misc_feature (867)..(867): n is a, c, g, or t
  misc_feature (945)..(945): n is a, c, g, or t
  misc_feature (1099)..(1099): n is a, c, g, or t
  misc_feature (1124)..(1124): n is a, c, g, or t
ggcacgaggtctctctctctctctctctctctctctctctctcctcgtctctacttcgtccccaagaagaacgcaccagcaggagcagaaaggccttggaagatttcgagcgaagaaatagcgagagagacagagagaaagaaggctccgttcctgcttcgatcccgcttccaccgccggcgacgagatgtttctcacgaggacggagtacgaccgcggggtgaacaccttctccccggaggggcggctcttccaggtcgagtacgccattgaggccatcaagttgggctcgaccgccatcgggttgaagactaaggagggtgttgtcctggctgtcgagaaacgtgtcacctcaccgctgctcgaaccaagcagtgtggagaaaatcatggaaattgatgagcatgtaggctgtgccatgagtggccttattgctgatgctagaacactggttgagcatgctcgtgttgagacccagaatcataggttctcatatggggagccaatgacagtagaatctaccacacaagctatctgtgacttggctttgcgctttggtgaaggtgaagaagagtcgatgtcacgaccgttcggagtctctctccttattgctggtcatgatgaaaacggacccagcttgtactacacagacccatctgggaccttctggcaatgcaacgccaaggcaattggatcaggttctgaaggagctgatagctcactacaagagcagtacaacaaggaactgaccattgctgaggcagagaccattgctctttctatcctgaagcaggttatggaagaaaaggtgaccccaaacaacgttgacatagcaaaggtgtcccccagctaccacctctacacccntgcagaggtcgaagcggtcattgcgcggttgtgaagcatttgccactttgtgaaacagtctcttgctattcccatganccctaaagcacaatggactgttgatgtgggttttctgcctattcctgtcataattatcgttctttaagaattattagtgcctgcatctgatttctgatctcccagtccagactctttttttctgtttccagtagcaccaagacattgtaccacncaaacgagttacacatatttttcanacaggtgcagtctgaac

SEQ ID NO: 1085 - DNA, 1221 bp, Zea mays
gctttctgtgttctgtcacggcccaactcctcccagcgccagggatcgtctgcctgactcgtaggacccgcctgtaagttcacgacgcgccgtcatctcgtcttctctttcaacttcgttcgcaagaagctcagaagtcagatcagaagccgccgaggggaggcgccgacgccgagtttttgctccatcccgcatccaccgccagaatgtttctcacgaggacggagtacgaccgcggggtgaacaccttctcgccggaggggcggctgttccaggtcgagtacgccatcgaggccatcaagttgggatccactgcgatcgggttgaaaacaaaggatggtgttgtccttgctgttgagaaacgtgtgacctcgccactgctggaaccaagcagtgtggaaaaaatcatggaaattgatgagcacataggctgtgccatgagtgggcttattgctgatgctagaacactagtcgagcatgctcgtgttgaaactcagaatcataggttctcatacggggagccaatgaccgtagaatcttcaacacaagctatttgtgacttagctctgcgctttggcgaaggtgacgaagagtcaatgtcacggccatttggagtctctctcctaattgctggacatgatgagaatggacctagcctgtactacaccgacccatctggtactttttggcaatgcaacgcgaaggcaattggatctggctctgaaggagctgatagctccttgcaggagcagtacaacaaggagctggcccttgaggaggcggagaccatagccctttctattctgaagcaggttatggaggagaaggtgaccccaaacaacgtcgatattgccaaggttgctcccaagtaccacctctacacccctgccgaggtcgaagccgtgatcgcgaggctgtgaaacgctttcggagctcgtgttattcatgtcatcaatcggtaatagacgatccttgtacgaagcgtggacatcttttgttcttgattatggctgtcatcgtactctgttgttaactccacaaggacagtcgatggtactttgattcacacctcagcccgattccgttgtctgattgcctagtgcctacacttgtttttttattttaccgtttcggcttccgttatgtgggcaattaagctgatactcgtgtggattttccaatccttcgtgaagtggcagcggtggtgctggctatttcctg

SEQ ID NO: 1086 - DNA, 1019 bp, Pennisetum glaucum
ccgcggagttcctgctcgatccagcacccgccgccgccgtcgacgtcgcctacaggacaggatgtttctcacgaggacggagtacgaccgcggggtgaacaccttctcgccggaggggcggctgttccaggtggagtacgccatcgaggccatcaagttgggatcgactgcaatcgggttgaagacaaaggatggtgttgtccttgctgttgagaaacgtgtcacctcgccactactggaaccaagcagtgtcgagaaaatcatggaaattgatgagcacataggctgtgccatgagtgggcttattgctgatgctagaacgctagttgagcatgcacgtgttgagacccagaatcataggttctcatatggggagccaatgaccatagaatcttctacacaagctatctgtgacttggctctgcgctttggcgaaggtgacgaggagtcaatgtcacgaccatttggagtgtctctcctaattgctggacatgatgagaatggacctagcttgtactacactgacccatctgggaccttttggcaatgcaatgcaaaggcaattggatcaggctctgaaggagctgatagctctttgcaggagcagtacaacaaggacctgactctccaggaggcggagaccatagccctttctattctgaagcaagttatggaagagaaggtgaccccaaacaatgttgacattgccaaggtcgcccccaagtaccacctctacacccccgccgaggttgaagccgtcatcgcgaggctgtgaagtgcttccagattcttgtcgttcacaccatcgatcattaatagacagttctctgtacgaagcgtggatatgtttgatgcgggctgaactgcctagtgtgttgccgaggctgccatcatcagactcgtgtcaactccacttgggcagtcgctgatagtccgatttaactgcagccctgtcattctgtttgtttcaactagtgttgagaactcctgtactgccagaaagaaagtacacttttttt

SEQ ID NO: 1087 - DNA, 1111 bp, Pennisetum glaucum
ctgttcccatctcggcctttcaacttcgttcgcaagaagctccgcctgcttaaccatccaaagcgagcgcgaggggagtacagggaggcgccgccgcggagttcctgctcgatccagcacccgccgccgccgtcgacgtcgcctacaggacaggatgtttctcacgaggacggagtacgaccgcggggtgaacaccttctcgccggaggggcgactgttccaggtcgagtacgccatcgaggccatcaagttgggatcgactgcgatcgggttgaagacaaaggatggcgttgtccttgctgttgagaaacgtgtcacctcaccactgctggaaccaagcagtgtggagaaaatcatggaaattgatgagcacataggctgtgccatgagtggacttattgctgatgctagaacgctaggcgagcatgctcgtgttgagacccagaatcataggttctcatatggggagccaatgaccgtagaatcttctacacaagctatctgtgacttggctctgcgctttggtgaaggtgacgaagagtcaatgtcacgaccatttggagtgtctctcctaattgctggacatgatgagaatggacctagcttgtactacacggacccatctgggaccttttggcaatgcaacgcaaaggcaattggatcaggctctgaaggagctgacagctccttgcaggagcagtacagcaaggaactgaccctccaggaggcggagaccatagccctttcaattctgaagcaagttatggaagagaaggtgaccccaaacaacgtcgacatcgccaaggtcgcccccaagtaccacctctacacccccgccgaggtcgaagctgtcatcgcgaggctgtgaaattgcttccggattctcgctattcccatcaccgatagatagtctttgtgcgaagcttggacatgtttgatgcgggccagtctgcttagtgtgttgacgtggcagccatcatcatactctttgtcaactgcactgaccactagggcagtcgctgatagtctgattcactgcagtcttgtaactctgattccagaaagaaactacacttgcctccattctgcagacctatgtgccttatacgtg

SEQ ID NO: 1088 - DNA, 1125 bp, Pseudoroegneria spicata
  misc_feature (8)..(8): n is a, c, g, or t
gaatctcnccgccgtctcctctcctctctactagtagtacttggttcccaagaagaaacaccaccaagcgcccaccccgtgtagaaattgaaacaagggcttcgaattccgatccgcttccgccgacacgatgtttctcacgaggacggagtacgaccgtggggtcaacaccttctccccggaggggcggctgttccaggtcgagtacgccattgaggccatcaagttgggctccactgccatcggcttgatgactaaggatggtgttgtcctggctgttgagaaacgtgtcacttcaccgctgctggaacctagcagtgtggagaaaatcatggaaattgatgagcatgtcggctgtgccatgagtggccttattgctgacgccagaacactggttgagcatgctcgtgttgagactcagaatcataggttctcatatggggagccaatgacagtagaatctacaacgcaagctatctgtgacttggctcttcgctttggcgaaggtgatgaagaatcaatgtcacggccgtttggagtctctctccttattgctggtcatgatgaaaatggacccagcttgtactacacggacccatctgggaccttctggcagtgcaatgccaaggcaattgggtcgggctctgaaggagctgatagctcattacaagagcagtacaacaaggaactgaccatcgctgaggcagagaccatagccctttctatcctgaagcaggttatggaagaaaaggtgaccccaaacaacgttgacattgcgaaggtctcccccagctaccacctctacacccctgcagaggttgaagcggtcatcgctcggttgtgaaggattgccactttgtgagacagcctcttgtattcccatgaaccctaaggcacaatgaacgtatgaattctgttgttgtgggtttgggttgtctgcctactgttgaagggatagtagtgcctgctagggcgttgcatctgattctcatctcccagtccagtcatttgtttgtagcactaagacgttgtatcaccaaaaagaattactacacatatttttcagcattccagccagtgcgttttgtgttctatcaaaggggagttggtgtttctacttaaaga

SEQ ID NO: 1089 - DNA, 1087 bp, Secale cereale
ccgccgtcccctctccactctactagtccttggttcccaagaagatacaccaccaagcacccaccccgtgtagtagaaatagaaacaagggcttcgaattccgatccgcatccgccgacacgatgtttctcacgaggacggagtacgaccgtggggtcaacaccttctccccggaggggcggctgttccaggtcgagtacgccatcgaggccatcaagttgggctccactgcaatcggcttgatgactaaggatggtgttgtattggctgttgagaaacgtgtaacctcaccgctgctggaacctagcagtgtggagaaaatcatggaaattgatgagcatgtcggttgtgccatgagtggccttattgctgacgccagaacactggttgagcatgctcgtgttgagactcagaatcataggttctcatatggggagccaatgacagtagaatctaccacacaagctatctgtgacttggctttgcgctttggtgaaggtgatgaagaatcaatgtcgcggccgtttggagtctctctccttattgctggtcatgatgaaaatggacccagcttgtactacacagacccatcggggaccttctggcagtgcaatgccaaggcaattgggtcgggctctgaaggagctgacagctcattacaagagcagtacaacaaggaactgaccatcgctgaggcagagaccatagccctttctatcctgaagcaggttatggaagaaaaggtgaccccgaacaacgttgacattgcgaaggtctcccctagctaccacctctacacccctgcagaggttgaagcggtcatcgcaaggttatgaaggattgccactttgtgagacagcctcttgtattcccattgaccctaagacacacttagttcatttctttgtagcactgagacgttgtatcaccaaaaggaattactacacataattttcagcattccagcaagtgcgtaggtatcactggatgcatttatgtgcatttggttcgtaaacaggagtttgtacaagtgacgcctttggttgcttgcattaagctcagctaggcccgcgcaagaagaaattga

SEQ ID NO: 1090 - DNA, 952 bp, Secale cereale
ggcttcgagtatccgcatccaccgatacgatgtttctcacgaggacggagtacgaccgtggggtcaacaccttctccccggaggggcggctgttccaggtcgagtacgccattgaggccatcaagttgggctccactgcaatcggcttaatgactaaggatggtgttgtactggctgttgagaaacgtgtaacctcaccgctgctggaacctagcagtgtggagaaaatcatggaaattgatgagcatgtcggttgtgccatgagtggccttattgctgatgccagaacactggttgagcatgctcgtgttgagactcagaatcataggttctcatatggggagccaatgacagtagaatctaccacacaagctatctgtgacttggctttgcgctttggtgaaggtgacgaagaatcaatgtcgcggccatttggagtctctctccttattgctggtcatgatgaaaatggacccagcttgtactacacagacccatcggggaccttctggcagtgcaatgccaaggcaattgggtcgggctctgaaggagctgatagctcattacaagagcagtacaacaaggaactgaccatcgctgaggcagagaccatagccctttctatcctgaagcaggttatggaagaaaaggtgaccccgaacaacgttgacattgcgaaggtctcccctagctaccacctctacacccctgcagaggttgaagcggtcatcgcaaggttatgaaggattgccactttgtgagacagcctcttgtattcccattgaccctaagacacacttagttcatttctttgtagcactgagacgttgtatcaccaaaaggaattactacacataattttcagcattccagcaagtgcgtaggtatcactggatgcatttatgtgcatttggttcgtaaacaggagtttgtacaagtgacgcctttggtt

SEQ ID NO: 1091 - DNA, 1265 bp, Secale cereale
aaagaaaactaccgcccccacgaagtagctcgccgccgtctcctctccactctactagtccttggttcccaagaagatacaccaccaagcacccaccccgtgtagtagaaatagaaacaagggcttcgaattccgatccgcatccgccgacacgatgtttctcacgaggacggagtacgaccgtggggtcaacaccttctccccggaggggcggctgttccaggtcgagtacgccattgaggctatcaagttgggctccactgcaatcggcttgatgactaaggatggtgttgtactggctgttgagaaacgtgtaacctcaccgctgctggaacctagcagtgtggagaaaatcatggaaattgatgagcatgtcggttgtgccatgagtggccttattgctgacgccagaacactggttgagcatgctcgtgttgagactcagaatcataggttctcatatggggagccaatgacagtagaatctaccacacaagctatctgtgacttggctttgcgctttggtgaaggtgatgaagaatcaatgtcgcggccgtttggagtctctctccttattgctggtcatgatgaaaatggacccagcttgtactacacagacccatcggggaccttctggcagtgcaatgccaaggcaattgggtcgggctctgaaggagctgacagctcattacaagagcagtacaacaaggaactgaccatcgctgaggcagagaccatagccctttctatcctgaagcaggttatggaagaaaaggtgaccccgaacaacgttgacatcgcgaaggtctcccctagctaccacctctacacccctgcagaggttgaagcggtcatcgcgaggttgtgaaggattgccactttgtgagacagcctcttgtattcccattgaccctaagacacacttacgctccgtttggatgttcgcattcaggccttgtattgggtattggcatttgtctgggcctaatatcccgaatgtcaccgtttggttggtcttggctttcagttgtggcattcgggcccgatattgagcaatccgtccataacgcaaaaaactgctggcccaattcgaagcctgtgtgctcgacatcgctaggcattcggatagtgtgtgtatctgttcgcgaactattcgagattgaaagtgaaatctctgtcattgatcaattgagagtacaaacctaaaaaaaaaaaaacaaatgacgactcgacgaacggcacaacggagggaagtgggggggggg

SEQ ID NO: 1092 - DNA, 1178 bp, Panicum virgatum
cgcaagaagctcacggggccatcaaaatcgaagcgagggggaggagagggaggcctcctactcgatccagcgcccgccgcagccgacttcgccgccgccgacgggacaggatgtttctcacgaggacggagtacgaccgcggggtgaacaccttctcgccggaggggcggctgttccaggtcgagtacgccatcgaggccatcaagttgggatctactgcgattgggttgaggacaaaggatggcgttgtccttgctgttgagaaacgtgtcacctcgccacttctggaaccaagcagtgttgagaaaatcatggaaattgatgagcacataggctgtgccatgagtggacttattgctgatgctagaacgctagtcgagcatgctcgtgttgagacccagaatcataggttctcatatggggagccaatgaccgtagaatcttctacacaagctatctgtgacttggctctgcgctttggcgaaggtgacgaggagtcaatgtcacggccgtttggagtctctctcctaattgctggacatgatgagaatggacctagcttgtactacaccgacccatctgggaccttttggcaatgcaatgctaaggcaattggatcaggctctgaaggagctgatagctccttgcaggagcagtataacaaggacctgaccctccaggaggcggagaccatagccctttctattctgaagcaggttatggaagagaaggtgaccccaaacaatgttgatattgccaaggtcgcccccaagtaccacctgtacacccccgccgaggtcgaagccgtcattgcaaggctgtgaaacacttccagattcttgctattcctgtcatcaatcagtaatagacagtcattgtatgaagcgtggacatgttgattcttgcctctctgcctagtgtgttgctatggctgtcatcatacactgttttcaactcccgcaggggcagtcactgatagtctgattcacagcccagtcggctcagttgcttgtttttaagtagcgttgagaacttctgtactgccagaaagaaagtacacctgtttttacgaattcgtcttctgtttctttgaacaactggctgatgcttgtgacctgatgccattggatctttttttttttgaaagagtgccactggatactagctttgcagcttgc

SEQ ID NO: 1093 - DNA, 1231 bp, Panicum virgatum
gctcgccattcaacttcgttcgcaagaagctcacgaggccatcaaaaagcgaggcgagggggaggagagggaggcgccgacgcggagctcctccacctcgatccagcacccgccgaagccaacttcgccgcagccgacttcgccgacgacgacacgacaggatgtttctcacgaggacggagtacgaccgcggggtgaacaccttctcgccggaggggcggctgttccaggtcgagtacgccatcgaggccatcaagttgggatctactgccatcgggttgaggacaaaggatggtgttgtcctggctgttgagaaacgtgtcacctcgccacttctggaaccaagcagtgtggagaaaatcatggaaattgatgagcacataggctgtgccatgagtggacttattgctgatgctagaacgctagtcgagcatgctcgtgttgagacccagaaccataggttctcatatggggagccaatgactgtagaatcttccacacaagctatctgtgacttggctctgcgctttggtgaaggtgacgaggagtcaatgtcacggccatttggagtctctctcctaattgctggacatgatgagaatggacctagcttgtactacactgacccatctgggaccttttggcaatgcaacgcaaaggcaattggatcaggctctgaaggagctgatagctccttgcaggagcagtataacaaggacctgacccttcaggaggcggagaccatagccctttctattctgaagcaggttatggaagagaaggtgaccccaaacaatgttgatattgccaaggtcgcccccaagtaccacttgtacacccccgccgaggtcgaagccgtcattgcaaggctgtgaaacacttcccgattcttgcgcttctcatcatcaatcagtaatagacagtcattgtacgaagcgtggacatgtgattcgggcctctgcctagtgtgttgccatggctgtcttcatacactgttttcaattcccgcaggggcagtcgctgatagtctgattcacagcccagttggctcagctgtctgtttttaagtagcgttgagaacttctgtacttatgaatttttttttttttgaaaaagagtgccactttcctgttgggttgaattgtaacagtggttctcgtctcatctgttgagtttttcacgcccagttattttgttggcctgtgttgtgaagaacttgccaatgtgactg

SEQ ID NO: 1094 - DNA, 1206 bp, Panicum virgatum
caacttcgctcgcaagaagctcacgaggccatcaaaagcgaggcgagggggaggagagggaggcgccgacgcggagctcctcctgctcgatccagcaccaccagccgccgcagccgactttgccgccaacaggacaggatgtttctcacgaggacggagtacgaccgcggggtgaacaccttctcgccggaggggcggctgttccaggtcgagtacgccatcgaggccatcaagttgggatctactgcgatcgggttgaggacaaaggatggtgttgtcctggctgttgagaaacgtgtcacctcgccacttctggaaccaagcagtgtggagaagatcatggaaattgatgagcacataggttgcgccatgagtggacttattgctgatgctagaacgctagtcgagcatgctcgtgttgagacccagaatcataggttctcgtatggggagccaatgactgtagaatcttctacacaagctatctgtgacttggctctgcgctttggcgaaggtgatgaggagtcaatgtcacggccatttggagtctctctcctaattgctggacatgatgagaatggacctagcttgtactacaccgacccatctgggaccttttggcaatgcaatgccaaggcaattggatcaggctctgaaggagctgatagctccttgcaggagcagtataacaaggacctgaccctccaggaggcggagaccatagccctttctattctgaagcaggttatggaagagaaggtgaccccaaacaatgttgatattgccaaggtcgcccccaagtaccacctgtacacccccgccgaggtcgaagccgtcattgcaaggctgtgaaacacttccagattcttgctattcccgtcatcaatcagtaatagacagtcattgtatgaagcgtggacatgttgattcaggcctctctgcctagtgtgttgctatggctgtcatcatacactgttttcaactcccgcaggggcagtcgctgatagtctgattcacagcccagtcggctcagctgtttgtttttaagtagcattgagaacttctctactgccagaaagatagtacacctgtttttacgaatttgtcttctgtttctttgaacaactggctgatgcttgtgacctggtgccattggatactttttttttttgaaagagtgccatggatactagctttgcagcttgc

SEQ ID NO: 1095 - DNA, 932 bp, Arnica chamissonis
acggagacggtagaaatcgctaatatatcattaactgagatctattaagccgctgaactcaatcgaagatgtttctaaccagaaccgagtatgataggggtgtcaacaccttctctcccgaaggccggttgtttcaagttgaatatgctattgaggccatcaagttgggttctacagccatcgggttgaagaccaaggaaggggttgttcttgctgttgaaaaacgtattacctcgcccctcctggagcctagcagtgtcgagaaaattatggaaattgatgagcacattggctgtgccatgagtggattaattgcagatgcgcgtacactcgttgaacatgcacgagttgagactcagaatcataggttttcctatggtgagccgatgactgtcgagtccactacccaagccctatgtgatctggcactgcgatttggtgaaggagatgaagaatctatgtctcgaccatttggggtatctcttcttattgcaggccatgatgaaaatggtccaagtctatactataccgatccatcaggcacattttggcagtgcaatgcaaaagctataggctcaggctctgaaggtgctgacagttctctacaggagcaatttaacaaggacttgactctaaaagaagctgaaacaattgctctttccatcttgaagcaagttatggaagaaaaggtgactcccaataatgtggatattgcaaaggttgctcctacttatcacttgtacactccggctgaggttgaagctgttatcagtcgcttataaaatgggagtcttatttgaccaattgtagactgtctctctttgcatgcatgtatttgtactaaaccgctgagattttttattctgcttttctttgtcaagtatggtatctgaacacatggtcctttttatgttttgacaaaatcattatgt

SEQ ID NO: 1096 - DNA, 979 bp, Artemisia annua
tattaatccaacaacaagatgtttctaacaaggactgagtatgataggggtgtcaacaccttctctccagaaggtcgtttgtttcaggttgaatatgctattgaggccattaagctgggttcgacagccatcgggttgaagaccaaggaaggcgttgttcttgctgttgaaaagcgtatcacctccccactcttggagcctagtagtgtggagaagattatggaaatcgacgagcacattggctgtgccatgagtggattaattgcagatgcacgtacactcgttgagcatgcacgagttgagactcagaatcataggttttcctatggtgagccgatgactgttgagtccaccacccaagccctgtgtgatctggcactgcgatttggtgaaggagaggaggaatctatgtctcggccttttggggtatctcttcttattgcaggccatgatgaaaatggtcccagtctatactatacggatccctcaggcacgttttggcaatgcaatggaaaagctataggctcaggctctgaaggtgctgacagctctctccaggagcaatataacaaggacttgacactaaaagaagctgaaacaattgctctttccatcttgaagcaagtcatggaagaaaaggtgactcccaataatgtggatatcgctaaggttgctcctacttatcacttgtacaccccagctgaggttgaagctgttatcggtcgcctataaactgagtcttagcgacaagtcgtagacactcttcatttggtttccttcaacatgtattctgtactaaattgctgagaattatccttattttcattaagtatggcatttgaacacatggtaatttttatgtttttgatgaaatcgtggagatgtagaacttgttttaaatatttaaaaaatgtttcacaaaccaggcagtttcttcattgcaaagtgtgatggttatgttatgattagacttggtttt

SEQ ID NO: 1097 - DNA, 1049 bp, Euonymus alatus
aagaagatccctctaaacccaaacgaaaaacaattaccagacgttgtttctctcggcgtaaagaggtttttgagcttgctatctagatcgaactgaaaaatgttcctcacaaggaccgagtatgatagaggagtcaacaccttctctccggaaggcagattgtttcaggttgaatatgccattgaagctatcaagcttggctcaactgctatcggattgaaaacaaaagaaggagtggttcttgcagtcgagaagcgtattacttcgccactgctggagcccagcagtgtagaaaaaattatggaaattgatgagcatatcgggtgtgctatgagtggattgattgctgatgcccgtacacttgttgagcatgcacgagttgaaacgcagaaccacagattctcatatggtgaaccaatgactgtagagtccactacacaagcactgtgtgatcttgccctgcgctttggtgagggtgatgaagaatccatgtctcgaccctttggtgtatctcttctgattgctggtcatgatgaaaatggccccagcttgtactatacagatccatctggcactttttggcaatgcaatgctaaggctattggttctggttcagaaggtgcagacagctctcttcaagagcagtataacaaggagctaactcttcaagaagctgagacaatcgctctgtcaattctgaagcaagtcatggaagagaaggtaactccaaacaacgtcgatattgcaaaggtggctccaacttaccacctatataccccttctgaggtggaggccgtcattagtcgtctatgagcatctcaaaatgaatatttatttcctattactcccatacatgcttgctttctcatctgtattctggggaaccctgttgtgtttctgttttaactttgatcgtagactggcgattccattttgtttgtctgtttaaaatgcacatgttagtttgagcaggatttagctgaatgagaacttatatttgcaagaggctaaagcaaatgaccactatgaatacgccggatgagattatg

SEQ ID NO: 1098 - DNA, 1319 bp, Vitis vinifera
atgggcctaagtgggattgaatgcgggaaaagaatggaaagtgaatgggctggttcagttggaataaggcccacatggtacatagaaatggagatggttcggcttgctagtcagacccgatccaaaagtcagacaaacccgaacccgaagttgccttgtttcgcaagaaggctattacctttgtgaagaagcagagtgacatacaacacaagaagaacaaacccacagactgagagaaactatacgcagagctttttcaatccgaacagtacaaaatgtttctcacaaggactgagtacgacagaggtgtgaataccttctccccagaaggccgattgtttcaggttgaatatgctatcgaggccatcaagctgggttcaactgcaattgggttgaagacgaaggaaggtgttgtgcttgctgtcgagaaacgcattacttctccattgctggagcccagcagtgtagagaaaattatggaaattgatgagcatataggttgtgctatgagtggattgattgctgatgctcgtacacttgttgaacatgcacgagttgaaactcagaatcataggttttcatatggggagccaatgactgttgagtccactacacaagctctttgtgaccttgccctgcgatttggtgaaggggatgaagaatccatgtctcgaccatttggagtatctcttctcattgctggtcatgatgagaatgggcccagcttatactatacggacccatctggaacattttggcagtgtaatgcaaaagctattgggtcgggttctgaaggtgcagacagttctctgcaggagcaatttaatcaggacctaactcttcaagaggctgaaacaatagctctttccattctgaagcaagttatggaagaaaaggtgacccctaacaacgtggacattgcgaaggtggctccaacctaccatttatacacccctgcagaggtggaggctgtcatcagtcgcctatgaaagaactccctacaaaagaagtcctcagacctcaaatccgttccccatgatatccatacaccaatgctattttattagtttatggggaggatctttatttgtttctgatttgggattttgtcagggaaactcaggaaactttttttgggtgtgtactcaaaccatgctgcttcagttgttggcgtgatcaattctcttgcactttacgatctaccttcgatgaacttaacaaaacttcgagctgccgtttagctaattgatggcatatgtttgcatttaagtcatattgttaggggatgacctattaaaagggatgaattattctccact

SEQ ID NO: 1099 - DNA, 1119 bp, Glycine max
gaacagaggaggagagagagagtttacacggcaagccccttgagcaagaaagcaagcaaattaggcagagtgagtgaggagcaagcaaataaaacccaaacaaacgcttctcattctctctctactcgttttgaagatgtttctcacaaggactgagtatgaccgaggagtcaacaccttttcccccgaaggacgtttgtttcaggttgagtatgcaatcgaagccatcaagctgggatcaactgcgattgggttgaagaccaaagagggtgttgtcctcgcagttgaaaagcgcatcacttcgccgctcctggagcctagtagtgttgagaaaattatggaaattgatgagcacataggttgtgcaatgagtgggttgattgcagatgctcgaacacttgttgagcatgcacgggtggaaactcagaatcataggttctcctatggtgagccgatgactgttgagtccaccacccaagctctttgtgatctagccttgcgttttggtgaaggtgatgaagaatccatgtctcgcccatttggagtttctctcctcattgctggccatgatgagaatggacctagcttatactacactgatccatcgggcacattttggcaatgcaatgcaaaagctattggttcagggtccgaaggcgcagacagttctctacaagaacaattcaacaaggacctaacccttcaagaagccgagacaattgctttatccattttgaagcaagttatggaagagaaggtcactcccaacaacgttgacattgccaaggtggctccaacatatcatctttataccccctctgaggtggaagctgtgataagccgtctatgattttctttttcatgattttctctattcagcatttctttcctattcttcttgcctgtacgtcttattatttagtattatgcgggaacttttttggtggatgatgctgtgttgtgctacacttgtggccaagttgtacactgtatgagattctggtgtcatatttgctgcattcagtctagttgaaattgaggactaaaaaagtttcaatggttgggaaaatcgagaactattatccgaatggggagacaatgaaggaaaaaagaattaca

SEQ ID NO: 1100 - DNA, 1176 bp, Glycine max
tccaaaatgaacagaggaggagagagagagtttacacggcaagccccttgagcaagaaagcaagcaaattaggcagagtgagtgaggagcaagcaaataaaacccaaacaaacgcttctcattctctctctactcgttttgaagatgtttctcacaaggactgagtatgaccgaggagtcaacaccttttcccccgaaggacgtttgtttcaggttgagtatgcaatcgaagccatcaagctgggatcaactgcgattgggttgaagaccaaagagggtgttgtcctcgcagttgaaaagcgcatcacttcgccgctcctggagcctagtagtgttgagaaaattatggaaattgatgagcacataggttgtgcaatgagtgggttgattgcagatgctcgaacacttgttgagcatgcacgggtggaaactcagaatcataggttctcctatggtgagccgatgactgttgagtccaccacccaagctctttgtgatctagccttgcgttttggtgaaggtgatgaagaatccatgtctcgcccatttggagtttctctcctcattgctggccatgatgagaatggacctagcttatactacactgatccatcgggcacattttggcaatgcaatgcaaaagctattggttcagggtccgaaggcgcagacagttctctacaagaacaattcaacaaggacctaacccttcaagaagccgagacaattgctttatccattttgaagcaagttatggaagagaaggtcactcccaacaacgttgacattgccaaggtggctccaacatatcatctttataccccctctgaggtggaagctgtgataagccgtctatgattttctttttcatgattttctctattcagcatttctttcctattcttcttgcctgtacgtcttattatttagtattatgcgggaacttttttggtggatgatgctgtgttgtgctacacttgtggccaagttgtacactgtatgagattctggtgtcatatttgctgcattcagtctagttgaaattgaggactaaaaaagtttcaatggttgggaaaatcgagaactattatccgaatggggagacaatgaaggaaaaaagaattacactacgatttatatgcattatgtatatgccattaaaagaaatatgactta

SEQ ID NO: 1101 - DNA, 1035 bp, Helianthus annuus
cttcttcttctttatagtctgtcatcagaagaagaagaaatcgctaatcgggagctaattcatcatcatcaactgagatctattattaagccgttaagctcagccgaagatgtttctaacaaggaccgagtatgataggggtgtcaacaccttctctccagaaggcaggttgtttcaggttgaatatgctattgaggccatcaagttgggttctacggccattgggttgaagaccaaggaaggagttgttcttgctgttgaaaagcgtattacctccccactcctggagcctagtagtgttgagaaaattatggaaattgatgagcacattggctgtgccatgagtggactaattgcagatgcccgtacactcgttgaacatgcacgagttgagactcagaatcataggttttcctatggtgagccgatgactgtcgagtccactacccaagctctatgtgatcttgcactgcgctttggtgaaggagacgaagaatctatgtctcgaccatttggggtatctcttcttattgcaggccacgatgaaaatggtccaagtctatactatacggatccttcaggcacattttggcaatgcaatgcaaaagctataggctcaggctctgaaggtgctgacagttctctgcaggagcaatttaacaaggacttaactctaaaagaagctgaaacaattgctctttccatcttgaagcaagttatggaagaaaaggtgactcccaacaacgtggatattgcaaaggttgcgcctacctatcacttgtacaccccagctgaggttgaagctgttattagtcgcctgtaggaacgggactcttattaaatcaattgtagacgctctctgtttggtttggtttggtttgctttgctttgacatgtatttttgtactaaactgctgacattttatcctgcttcccttcttaagtatggcatttgaacacattgttttggtggagttattttcaacaaaccaagttacgatgcatgcaagcaatctcattgttccttgctgtaac

SEQ ID NO: 1102 - DNA, 1004 bp, Helianthus annuus
gcgggaagaggtcttcttcttctttatagtctctgtcttgtacacagaaagtgtggaaatcgctaatcgggagctaattcatcataatcatcaactgagatctattattaagccgttaggttcagccgaagatgtttctaacaaggaccgagtatgataggggtgtcaacaccttctctccagaaggcaggttgtttcaggttgaatatgctattgaggccatcaagttgggttctacggccattgggttgaagaccaaggaaggagttgttcttgctgttgaaaagcgtattacctccccactcctggagcctagtagtgttgagaaaattatggaaattgatgagcacattggctgtgccatgagtggactaattgcagatgcccgtacactcgttgaacatgcacgggttgagactcagaatcataggttttcctatggcgagccgatgactgtcgagtccactacccaagctctatgtgatcttgcactgcgctttggtgaaggagacgaagaatctatgtctcgaccatttggggtatctcttcttattgcaggccacgatgaaaatggtccaagtctatactatacggatccttcaggcacattttggcaatgcaatgcaaaagctataggctcaggctctgaaggtgctgacagttctctgcaggagcaatttaacaaggacttaactctaaaagaagctgaaacaattgctctttccatcttgaagcaagttatggaagaaaaggtgactcccaacaacgtggatattgcaaaggttgcgcctacctatcacttgtacaccccagctgaggttgaagctgttattagtcgcctgtaggaacgggactcttattaaatcaattgtagacgctctctgtttggtttgctttgctttgacatgtatttttgtactaaactgctgacattttatcctgcttcccttcttaagtatggcatttgaacgcatgttttggtggagttattttcaacaaaccaa

SEQ ID NO: 1103 - DNA, 1221 bp, Triticum aestivum
aagaaaactctatcccaaggagaaactcgccgccgtctcctctcctctctactagtacttggttccgaagaagaaacaccaccaagcacccaccccgtgtagtagaaatagaaacaagtgcttcgaattgcgatccgcatccgccgacacgatgtttctcacgaggacggagtacgaccgtggggtcaacaccttctccccggaggggcggctgttccaggtcgagtacgccattgaggccatcaagttgggctccactgcaatcggcttgatgactaaggatggtgttgtactggctgttgagaaacgtgtcacctcaccgctgctggaaccaagcagtgtggagaaaatcatggaaattgatgagcatgtcggctgtgccatgagtggccttattgctgacgccagaacactggttgagcatgctcgtgttgagactcagaatcataggttctcatatggggagccaatgacagtagagtctaccacacaagctatctgtgacttagctttgcgctttggtgaaggtgatgaagaatcaatgtcacggccgtttggagtctctctccttattgccggtcatgatgaaaatggacccagcatgtactacacagacccgtcggggaccttctggcagtgcaatgccaaggcaattgggtcgggctctgaaggagctgatagctcattacaagagcagtacaacaaggaactgaccatcgctgaggcagagaccatagccctttctatcctgaagcaggttatggaagaaaaggtgaccccgaacaacgttgacattgcgaaggtctcccctagctaccacctctacacccctgcagaggttgaggcggtcatcgcgaggttgtgaaggattgccactttgtgagacagcctcttgtattcccatgaaccctaaagcacaatgaacgtatgaactctgttgtgggtttgggttgtctgcctactgttgaagggatattagtgcctgcttgggcgttgcatctgattctcatctcccagtccagtcatgtctttgtagcactaagacgtgtcaccaaaaagaattactacacatatttttcagcatttccagcaagtgcgtaggtatcgttggctgcatttgtgtgcatttggttcgtaaacatctttacggggagtcggtgtttgtactagtggcctgtttgccaggctcgtgcgggaagaaattggcctgttttgttccgg

SEQ ID NO: 1104 - DNA, 1198 bp, Triticum aestivum
aggctcggacggaaaagccactacagtccgtccgtcctccctccctccccaagaaaagaaaaactccgtcccaagaagaaactcgccgccgtctcctctcctctctactagtacgtacttggttcccaagaagaaacaccaccaagcacccaccccgtgtagtagaaatagaaaaagtgcttcgaattccgatccgcatccgccgacacgatgtttctcacgaggacggagtacgaccgtggggtcaacaccttctccccggaggggcggctgttccaggtcgagtacgccattgaggccatcaagttgggctccaccgcaatcggcttgatgactaaggatggtgttgtactggctgttgagaaacgtgtcacctcaccgctgctggaaccaagcagtgtggagaaaatcatggaaattgatgagcatgtcggctgtgccatgagtggccttattgctgacgccagaacactggttgagcatgctcgtgttgagactcagaatcataggttctcatatggggagccaatgacagtagagtctaccacacaagctatctgtgacttggctttgcgctttggtgaaggtgatgaagaatcaatgtcacggccatttggagtctctctccttattgctggtcatgatgaaaatggacccagcttgtactacacagacccgtcggggaccttctggcagtgcaatgccaaggcaattgggtcgggctctgaaggagctgatagctcattacaagatcagtacaacaaggaactgaccatcgctgaggcagagaccatagccctttctatcctgaagcaggttatggaagaaaaggtgaccccgaacaacgttgacattgcgaaggtctcccctagctaccacctctacacccctgcagaggttgaagcggtcatcgcgaggttgtgaaggattgccactttgtgagacagcctcttgtattcccatgaaccctataaagcacaatgaacgtatgaactctgttgtgggtttgggttgtctgcctactgttgaagggatattagtgcctgcttgggcgttgcatctgattctcatctcccagcccagtcatttgtttgtactccctttgttccgatttatttgttgttgggggattttagtacattttccgttacgttacaagttatcttcgttttcccaaaaaagaaaagtaccgactgcg

SEQ ID NO: 1105 - DNA, 1085 bp, Triticum aestivum
gtacttggttcccaagaagaaacaccaccaagcaccaccccgtgtagtagaaatagaatcaagtgcttcgaattccgatccgcatccgccgacgcgatgtttctcacgaggacggagtacgaccgtggggtcaacaccttctccccggaggggcggctgttccaggtcgagtacgccattgaggccatcaagttgggctccaccgcaatcggcttgatgactaaggatggtgttgtactggctgttgagaaacgtgtcacctcaccgctgctggaaccaagcagtgtggagaaaatcatggaaattgatgagcatgtcggctgtgccatgagtggccttattgctgacgccagaacactggttgagcatgctcgtgttgagactcagaatcataggttctcatatggggagccaatgacagtagagtctaccacacaagctatctgtgacttggctttgcgctttggtgaaggtgatgaagaatcaatgtcacggccatttggagtctctctccttattgctggtcatgatgaaaatggacccagcttgtactacacagacccgtcggggaccttctggcagtgcaatgccaaggcaattgggtcgggctctgaaggagctgatagctcattacaagatcagtacaacaaggaactgaccatcgctgaggcagagaccatagccctttctatcctgaagcaggttatggaagaaaaggtgaccccgaacaacgttgacattgcgaaggtctcccctagctaccacctctacacccctgcagaggttgaggcggtcatcgcgaggttgtgaaggattgccactttgtgagacagcctcttgtattcccatgaaccctaaagcacaatgaacgtatgaactctgttgtgggtttgggttgtctgcctactgttgaagggatattagtgcctgcttgggcgttgcatctgattctcatctcccagcccagtcatttgtttgtactccctttgttccgatttatttgttgttgggggattttagtacattttccgttacgttacaagttatcttcgttttcccaaattgccctccctcttgcacagcct

SEQ ID NO: 1106 - DNA, 1121 bp, Phaseolus vulgaris
gagcaagcaaattaagctcaaaagcggaaccctctgctgcagtgcggggcagtcacacagcattcgcagatcgaatagaagtaatttcaccaaatcttttcggagatgtttctcacaaggactgagtatgaccgaggagtcaacaccttttctcctgaaggtcgattgtttcaggttgaatatgcaattgaagccatcaagctgggatcaactgcaattgggttgaagactaaagagggtgttgtccttgcagttgaaaagcgcataacttcaccactgctggagccaagtagtgttgagaaaattatggaaattgatgagcacataggctgtgcaatgagtggattgattgctgatgctcgaacacttgttgagcatgcacgggtggaaactcagaatcataggttctcctatggtgagccaatgactgttgagtccacaacccaagctctttgcgatctcgccttgcgttttggtgaaggtgatgaagaatccatgtctcgaccatttggagtatctcttctcattgctggccatgatgagaatgggcctagcttatattacactgatccatctggcacattttggcaatgcaatggaaaagcaattggttcagggtcggaaggtgcagacagttctctgcaagaacaattcaacaaggacctgactcttcaggaagccgagactattgctttatccattttgaagcaagttatggaagagaaggttactcccaacaacgttgacattgccaaggtggctccaacatatcatctttataccccctccgaggtggaagctgtgataagtcgtctatgatttccttttcatgacttcctctgttcaacatttgtgtttcctataactctctgtacgtctaattatttagcattctgcggaatatttctttggtggatgatgctatgtagtgctatacttgtgaccaagttgtccactgtaccagattttacagtcatatttgctgcattcggtctagttgaaattgaggactaaaagggttctaatgtttgggaaaatccataactgttaccagaataccgtgcttttcttttactgtgtgaaatattgaggaatgggtccaatttttcgcaccttagaaa

SEQ ID NO: 1107 - DNA, 1120 bp, Amsonia hubrichtii
aagaagggcaagcagagctttaagatcaaaaaccgtagtacttttgtgcatatagaagacgatcaaaacgacattccctagcgctagcctttttctcttattctccagttttttaatcggagctcttaatttatcgaatccacaatgttcctcaccaggaccgagtacgataggggagtcaacaccttctctcctgaaggtcgattgtttcaagtggaatatgctattgaagccatcaagctggggtctacagcaattgggttaaagactaagcacggagttgttctggcagttgagaagcgtattacctctccactcctggagcccagcagtgtggagaagattatggagattgatgaacatataggctgtgcaatgagtggattaattgctgatgcccgaacactggttgagcatgcacgagttgagactcagaatcatagattctcatatggtgagccgatgactgttgaatccactacccaggctctctgtgatcttgccctccgatttggtgagggggatgaagaatctatgtctagaccctttggggtatctcttctcattgctggtcatgatgagaatggtcccagcttatattatacagatccatctggaacgttctggcaatgcaatgcaaaagctattggttcaggttctgaaggtgctgacagctccttgcaagagcaatataacaaggacctaactcttcaagaagctgaaacaatagccctttccatccttaagcaagttatggaagaaaaggtaactcctaataatgttgatattgcaaaggtcgcaccaacttatcatttgtacaccccttctgaggttgaggctgtcattaatcgcctataagagaagattttcgaagcagtttcttgatccaatccttcaatgcttgaattccttgtgtactcatttcgatggatgaatattcctttttggtacttttagaatatggaatttcaattagaaactgctttgagtgtgttaaagcatattattaagtgtaccgaaccatgtatttctccttccttatcttggacttcatttcatccaatttactgtgctcatttaaggatttaaattttctccaaaaatatcgttctataatctg

SEQ ID NO: 1108 - DNA, 1541 bp, Hordeum vulgare
acggtccttccccaagaaaagagccactccgtcccaagaaaagaaaattccgtgagaaactcgccgccgtctcctctcctctctactagtacttgtttctcaagaaggaacgctaccaagcacccaccccgtgtagaaatagaaacaagggcttcaaactccgatccgcttccgccgacacgatgtttctcacgaggacggagtacgaccgtggggtcaacaccttctccccggaggggcggctgttccaggtcgagtacgccatcgaggccatcaagttgggctccactgccatcggcttgatgactaagtatggtgttgtcctggctgttgagaaacgcgtcacctcaccgctgctggaacctagcagtgtggagaaaatcatggaaattgatgagcatgttggctgtgcaatgagtggccttattgctgacgccagaacacttgttgagcatgctcgtgtcgagactcagaatcataggttctcatatggggagccaatgacagtagaatctaccacacaagctatctgtgacttggctttgcgctttggtgaaggtgatgaagaatcaatgtcacggccgtttggagtctctctccttattgctggtcatgatgaaaatggacccagcttgtactacacggacccatctgggaccttctggcagtgcaatgccaaggcaattgggtcgggctctgaaggagctgatagctcattacaagagcagtacaacaaggaattgacaatcgctgaggcagagaccatagccctttctatcctgaagcaggttatggaagaaaaggtgaccccaaacaatgttgacattgcgaatgtctcccccagctaccacctctacactcctgcagaggttgaagcggtcatcgcgaggttgtgaaggattgccactttgtgagacagcctcttgaagggatagtagtgcctgccaggtcgttgcatctgaattctcatatgccagtccagtcattcgtttgtttacagtagcactaagacgttgtaccaccaaaaagaattatttttcagcattccagccagcgcgtaggtatcaccggctgcatttgtgtgtgtttggttcgtaaaacatctctactactaaaggcgacttggtgatggtttaaaaaaagggcgagttggtgtttgtactccatcggttcctaaatataagaccttttagagttttcactagaaaactacatacggagcaaaatgagtgaatttatacattataaaatatgtctatgtacatccgtatgaagcttataatgtaatttctaaaaggtcttatatttaggaacggagggagtactatataagcagatgcatgctttgccgtcgacttgacccatttgatttgccttatgccgtccaaatgaagatcggatcacaaaatcattctacatcgacttccttttttatgtatatgtcttttagtagtccatttttaaaatttatttgtatgcttcgctaaattagggtaaactcaagaaaatacgagtggtgtgaagtcagggaaaacaaaccg

SEQ ID NO: 1109 - DNA, 1448 bp, Phaseolus vulgaris
attttagttttgactcttttgagaatgccccttgagcaagcaaattaagctcaaaagcggaaccctctgctgcagtgcggggcagtcacagcattcgcagatcgaatagaagtaatttcaccaaatcttttcggagatgtttctcacaaggactgagtatgaccgaggagtcaacaccttttctcctgaaggtcgattgtttcaggttgaatatgcaattgaagccatcaagctgggatcaactgcaattgggttgaagactaaagagggtgttgtccttgcagttgaaaagcgcataacttcaccactgctggagccaagtagtgttgagaaaattatggaaattgatgagcacataggctgtgcaatgagtggattgattgctgatgctcgaacacttgttgagcatgcacgggtggaaactcagaatcataggttctcctatggtgagccaatgactgttgagtccacaacccaagctctttgcgatctcgccttgcgttttggtgaaggtgatgaagaatccatgtctcgaccatttggagtatctcttctcattgctggccatgatgagaatgggcctagcttatattacactgatccatctggcacattttggcaatgcaatggaaaagcaattggttcagggtcggaaggtgcagacagttctctgcaagaacaattcaacaaggacctgactcttcaggaagccgagactattgctttatccattttgaagcaagttatggaagagaaggttactcccaacaacgttgacattgccaaggtggctccaacatatcatctttataccccctccgaggtggaagctgtgataagtcgtctatgatttccttttcatgacttcctctgttcaacatttgtgtttcctataactctctgtacgtctaattatttagcattctgcggaatatttctttggtggatgatgctatgtagtgctatacttgtgaccaagttgtccactgtaccagattttacagtcatatttgctgcattcggtctagttgaaattgaggactaaaagggttctaatgtttgggaaaatccataactgttaccagaataccgtgcttttcttttactgtgtgaaatattgaggaatgggtccaatttttcgcaccttagaaatatctctgtccattactttttattcaggaataggcatttcagaatatacttttacctattttggaatgagagtaaacagagatacttgtaaggtgcagaaacaaattcaattgatagagaattagccaaaaagaaatgcaaatgatccatgcactgtgtactattaaaaggaaaggaaaaatcaagatacttaaaaaaaaactttcttcctcagtcaattgtatcactgtaatagatgcagttcctgattggttattttctcttaaaatatatatcatttttatcaaatttttcta

SEQ ID NO: 1110 - DNA, 1086 bp, Castanea mollissima
ctctctctctctctctcacacgcaaacacaccattcaatcaaaccggtttttgttaatcgaatcgaatcgaaaatgtttctcacaaggactgagtatgacagaggagtgaacacattttctccagaagggaggttgtttcaggtggaatatgccattgaggccatcaagctgggatcaactgcaattgggttgaagacaaaggaaggagttgtgcttgcagttgagaaacgtatcacttccccactactggaacccagcagtgtggagaaaatcatggaaatagacgagcatttgggctgcgccatgagtggactaattgctgatgctcgaacgctagttgagcatgcgcgtgttgagactcagaaccataggttctcctatggtgagccaatgactgtggagtctacgacacaagctctttgtgatctggccctacgatttggtgaaggtgatgaagaatcgatgtctcgaccatttggagtttctcttctcattgctggccatgatgagaatgggcccagcttatattatactgatccatctggcacattttggcaatgcaatgccaaggctattggttcgggttcagagggtgcagacagctctctgcaagagcaatacaacaaggacatcactcttcaagaagctgaaaccattgctctttccattctgaggcaggttatggaagaaaaggtgacacccaataatgttgacattgcaaaagtggctccaaattaccatctatatacccctgcagaggtggaggcggttattgctcgcctatgagtgcatgtcctcacattgcaaattttagatttgtattgcacttattgaagatgaaatcccttgatggattggtgacaaatgctgtatcattgcgaaaaactaaaacaaaatggaagcatttcatgggaacttgaatagaatacttttgcaattaaatcttgcccggctaatgttggttgcagttaaatgcttggctatctgaacttggtggtttttgatatacagactagaggaatctcaagattatgattgactttattttgttcatgacatatttcattggtagatgcttcgtaatt

SEQ ID NO: 1111 - DNA, 1162 bp, Cichorium intybus
gggagcaattcatcggaagatatcgccggtctcctctctcggtgctaatttaccattaacagagatctattaagccgttaaattcaatcgaagatgtttctaaccaggaccgagtatgatagaggtgttaacaccttctctccagaaggccggttgtttcaggttgaatatgccattgaggccattaagttgggttctactgccatcgggttgaaaactaaggaaggggttgttcttgctgttgaaaagagaattacctcaccactcctggagcctagtagtgttgaaaaaatcatggaaattgatgagcacattggctgtgccatgagtggactaattgcagatgcccgtacactcgttgaacatgcacgagtcgagactcagaatcatcgattctcctatggtgagccaatgaccgtcgagtccaccacccaagccctgtgtgacctggcactccgatttggagaaggagatgaagaatccatgtctcgaccttttggggtgtcccttcttattgctggtcatgatgaaaatggtcccagtctatactatacggatccatcgggcacattttggcaatgtaatgggaaagctattgggtcagggtctgaaggtgctgacagctctctacaggagcaatataacaaggacttgacactaaaagaagctgaaactattgctctttccatcttgaagcaagtcatggaagaaaaggtaactcccaacaatgtggatattgcaaaggtggcgcctacttatcacttgtacacccctgctgaggtggaagctgttattggtcgcctatgaaatgggaggagttttattaagttgtaggcggtcttcctttggtttctttaaaacattgtattttgtactaaattcctaagattttattatgttcctcttcatttgtggtgtttgaacatgagatcctttttatgattgacaaaattggagacctagaacttggtttaaaagttttaatcagcggtttttgacaaccaaatagttttttttaaatactttttagttccttgtttcaaaagacagtaggtttttttttttttttctttttcttaaatgtaattttcataccactgtcagtttagtttatcactttattgtacaagacattaatataaacgaattttttttactgcca

SEQ ID NO: 1112 - DNA, 1216 bp, Coffea canephora
cggccggggggctgccttgcttggcaagaagggcaaacagagagagagagagttctatgtagcttgtgagattgagagagaggaccattcagaaaaccaccccaaagtcccagggtcttcagttgcagctgtaattttttgcttttttgagtcgaagctactaattaattgcatccgacaatgttcctcaccaggactgagtacgacagaggagtcaacacattttctccggaaggtcgattgtttcaagttgaatatgccattgaagctatcaaactggggtcaactgcaattgggttgaagactaaagaaggggttgttctagccgttgagaagcgtattacctctccactcctggagcctagcagcgtggagaaaattatggagatagatgagcatattggttgtgcaatgagtggattaattgctgatgctcgaactcttgttgaacatgctcgagttgaaacacagaatcataggttctcgtatggtgagccaatgactattgaatcaactactcaagctctgtgtgatctagccctgcgatttggtgagggggatgaagaatctatgtctagacctttcggcgtatctcttctcattgctggtcatgatgaaaatggtcccagcttgtattacacagatccatcgggcaccttctggcagtgcaatgcaaaggctattggttctggttctgaaggtgctgacagctccttgcaagagcaatataacaaggacctgactctccaagaagctgaaactattgcgctttccatactcaagcaagttatggaagaaaaggtgacccctaataatgttgacattgcaaaggttgcaccaacctaccatctctacaccccagctgaggttgaggctgtcattacccgcctatgagaagggagccacttcaagcagtttcttggttgttttgcagttctttagtgcttgcatttcacatgtgatgatgttattggattagtattttttttctaatggtcctctctaacgtggcctcaatcagaaactgctgcttgagtgtgttatgccttaccagtcagtctaatggcccaaaccatttccatgatttgtatctcttggaattcctggttactatattcgtacatgtcctctttggttttcatggtttctatacaaaaatattggtacgctcgttgaggggctttattattattattattactatgattttgcacgg

SEQ ID NO: 1113 - DNA, 1155 bp, Gossypium hirsutum
ttttttctacgaaaaataccagcatcgctaagctttctcgttgctgaatctcaccctttgtcacaagttttggtagatctaataagatcaagtcgatccaaacatgtttctcaccaggactgagtatgaccgtggagtgaacacattttctccggaagggagattgttccaggtggaatatgctattgaggccatcaagctgggttcaactgcaattgggttgaagacaaaaaaaggtgtcgttctggctgttgagaagcgtattacttcaccacttttggaacctagcagcgttgagaagattatggaaattgatgagcatataggatgtgctatgagtgggttgattgctgatgcccgtacacttgttgaacatgcacgagttgagactcagaaccacagattctcatatggtgagccaatgacagtagaatccacaacacaagctctttgtgatctggcccttcgatttggtgaaggagatgaagaatcgatgtcccgaccgtttggtgtatcacttctcattgctggtcatgatgagaacgggcctagcttatactatactgatccatctggcacattttggcaatgcaatgcaaaagctataggctctggttctgaaggtgcagatagctctttgcaagagcaatacaacaaggacctaactcttcaagaagctgaaacaattgctctgtccattttaaagcaagtaatggaagaaaaggtgactcccaacaatgttgatattgccaaagtagcaccgacataccatctgtacaccccttcagaggtggaagcagtcatcagtcggctatgagagaaatgctttgttataaactatcatcccatgcagcatgagttaaggggattcaaactgtgaacccttattttttggtgtcgtgcaaaattccagtacgtcttcactcggatattttagttacacctcatcaggaaaaggaacctttgattttggatttagtttgcatgtgggttgcctctttcattcctcattgctcgcatttgtgaaataacaagaatgattagtatagactaatatattttctaattatctaaagtttagtcaaatttaaactaggaaccaaatattgtgagaatgatatggaaacctcaaaatcatatctttgatagttttga

SEQ ID NO: 1114 - DNA, 1419 bp, Vigna unguiculata
ccattttacttttgactcttttgagaatgccccttgagcaagcaaattaagctcaaaagccgaaccctctgctgcagtgcggggcactcatttggcattagcagatcgaaaaggagtaatttaaccaaatcgtatcagagatgtttctcacaagaactgagtatgaccgaggagtcaacaccttctctcctgaaggccgtttgtttcaggttgaatatgcaattgaagccatcaagctgggatcaactgcaattgggttgaaaactaaagagggtgttgtccttgctgttgaaaagcgcataacttcaccactgctggagccaagtagtgttgagaaaattatggaaattgatgagcacataggttgtgcaatgagtggattgattgctgatgcccgaacacttgttgagcatgcacgggtggaaactcagaatcataggttttcctatggtgagccaatgactgttgagtctacaacccaagctctttgtgatctcgccttgcgtttcggtgaaggtgatgaagaatccatgtctcggccatttggagtatctcttctcattgctggccatgatgagaatggacctagcttatattacaccgatccatctggcacattttggcaatgcaacggaaaagcaattggttcagggtcggaaggtgcagacagttccctgcaagaacaattcaacaaggacctaactcttcaggaagccgagactattgcattatccattttgaagcaagttatggaagagaaggtcactcccaacaacgttgacattgccaaggtggctccaacatatcatctttacaccccctccgaggtggaagctgtgataagtcgtctatgattttcttttcgtgacatcctctgttcaacatttgtgtttcctatacctcttgtctgtacgactaattatttagcatttgaggaatatttctttggtggatgatgatgctatgcagtgctgcacttgtgatcaagtggtccactgtttcagattatactgtcatatttgttgcattcggtctagttgatattgaggaccaaaaaaaaccacaattaatacccgaataccgtgctttttatttcctactgaatgaaattttaaggaatgggtccaatttatcgcaccttacaaatatattttttattctggaataggcatttcagaatatactttcccattttgggagtgaacagagatatttgtaaggtgcagaagcaaattcagatggagcaaaaagaaatgcaagtgatccataggcattgtgtgcactattggaagaaaaggaaaaatcaagatactttaaaaacaaattatttcctcagtcgattgtatcactgtaatagatgtagttcctgcctgatttgttagttcctttaacaactataacatcgttaaaattttctac

SEQ ID NO: 1115 - DNA, 1054 bp, Taraxacum officinale
tgctggcttgcttccaagaagggcttatactcgaatatatagactaaggacagagagaatcggaagcactttcgaccggaatttggagctaatttaccaccgacagagatctactaagccgctaaattcaatcgaagatgtttctaaccagaaccgagtacgatagaggtgttaacaccttctctcccgaaggccggttgtttcaggttgagtatgccattgaggccattaagttgggttcaactgctattgggttgaagaccaaggaaggagttgttcttgctgttgaaaagagaattacctctccactcctggagcctagtagtgttgagaaaatcatggaaattgatgaacacattgggtgtgccatgagtggattaattgcagatgcccgtacactcgttgaacatgcacgagtcgagactcagaatcatcgattctcttatggtgagcctatgacagttgagtccaccacccaagccctgtgtgacctggcactccgatttggtgaaggagatgaagaatctatgtcacgaccttttggggtgtctcttcttattgctggacatgatgaaaatggtcccagtctatactatacggatccatcaggcacattttggcaatgtaatgggaaagctattgggtcagggtctgaaggtgctgacagctctcttcaggagcaatacaacaaggacttgacactaaaagaagctgaaactattgctctttccatcttgaaacaagtcatggaagaaaaggtgactcccaacaatgtggatattgcaaaggtggcgcctacttaccacttgtacacacctgctgaggtggaggctgttattggtcgcctatgaaatgggaagagttttaagttgtagacttttcgtttggtttcgttaaaacatgtattttgtactaaattgctaagattttattatgttttctcttcatttgtggtattggaacatgagatccctatcttttttatgatttttaaaatcatggaattaaaattggagacctacaaggctacaaccttgtttagaagttttaccat

SEQ ID NO: 1116 - DNA, 1001 bp, Eschscholzia californica
gaggcgtcttcctagttcctaccttgcttcacaagtcgaacaaccaaataaacacaaggagagcgcgcgagagagttttctttgagcagaagaaacttgagagcaattatttaagaatcagggtttatctttttctgcagatctccgaggatccaatcaaattaaacatgtttcttaccaggaccgagtatgatagaggtgttaataccttctcacctgaaggtcgtctttttcaagttgaatatgccattgaggcaatcaagttgggttcaactgcaatagggttgaagaccaaggagggagttgtgcttgcagttgagaagcgtatcacttcaccattactggaacctagtagtgtcgaaaaaattatggaaattgatgagcacattgggtgtgcaatgagtggattaattgctgatgctcgcactcttgtggaacatgcacgagttgaaacacagaaccacaagttttcgtatggtgaaccgatgactgttgagtccactacccaagctctgtgtgatcttgccttacgatttggtgaaggcgatgaagaatccatgtcccgcccttttggtgtatcacttctcattgctggtcatgatgagaatgggcctagcttatactacacagatccttctggcacattttggcagtgcaacgcgaaagcaataggttcaggctcagaaggagcagacagctctttgcaggagcaatttaacaaggagatgacacttcaagaagccgaaacggtagctctatcaatcttgaagcaagtgatggaagagaaggtgactcctaacaatgttgatatcgctaaggtcgctccaacttaccatctctattctcctgctgaggtggaagctgtcattggccgcctatagtctgattagcttcttgcagttaattcctcttgcttgcaccctgaattggtaccaccttttgtaagaacttgtgcctgaaagttttttttcacttacttatattgttgggattttgaccaa

SEQ ID NO: 1117 - DNA, 960 bp, Euonymus alatus
aaaacccagacgaaaagcaaatacgagacgtgttgtttctctcggcgtaaagaggctttcgagcttgggatctagatcgaactgaaaaatgtttctaacaaggactgagtatgatagaggagtcaacaccttctctccagaaggcagattgtttcaagtggaatatgccattgaagctatcaagcttggttcaaccgctattggattgaagacaaaagaaggtgtggttcttgcagtcgagaagcgtattacttcgccactgctggagccaagcagtgtagaaaaaattatggaaattgatgagcatattggatgtgctatgagtggattgattgctgatgctcgtacacttgttgagcatgcacgagttgaaactcagaaccatagattctcatatggtgaaccaatgactgtagagtccacaacacaagcactctgcgatctcgcccttcgatttggtgagggtgatgaagaatccatgtcccgaccctttggggtatctcttctgattgctggtcatgatgaaaatggccccagcttgtactatacagatccatctggcactttttggcaatgcaatgctaaggctattggttctggttcagaaggtgctgacagctctctgcaagagcagtataacaaggagctgactcttcaagaagctgagacaattgctctgtctattctgaagcaagttatggaagagaaggtaactccaaacaatgtcgatattgcaaaggtatctccaacttaccacctatataccccttctgaggtcgaggcagtcattagtcgtctatgagagcatctcaaaatgcaacgtagaaggaaaggagtcattaatactattgaaccagatattgggtttgcaattcgaaaatactgatggatttattagacgagttcttcttcttttttcttcttatccatatgtaacttgtattgcatgtgtcccctctt

SEQ ID NO: 1118 - DNA, 1328 bp, Gossypium raimondii
gtcattatgctacggcgtgatgcggcgacgttttaacagcctgccttgttttgctttgcaagagcaaacgaaggccagaaccgaaggtattttttttctacgaaaaataccagcatcgctaagctttctcgttgctgaatctctccctttgtcacaagttttggtagatctaataagatcaagtcgatccaaacatgtttctcaccaggactgagtatgaccgtggagtgaacacattttctccggaagggagattgttccaggtggaatatgctattgaggccatcaagctgggttcaactgcaattgggttgaagacaaaagaaggtgtcgttctggctgttgagaagcgtattacttcaccacttttggaacctagcagcgttgagaagattatggaaattgatgagcatataggatgtgctatgagtgggttgattgctgatgcccgtacacttgttgaacatgcacgagttgagactcagaaccacagattctcatatggtgagccaatgacagtagaatccacaacacaagctctttgtgatctggcccttcgatttggtgaaggagatgaagaatcgatgtcccgaccgtttggtgtatcacttctcattgctggtcatgatgagaacgggcctagcttatactatactgatccatctggcacattttggcaatgcaatgcaaaagctataggctctggttctgaaggtgcagatagctctttgcaagagcaatacaacaaggacctaactcttcaagaagctgaaacaattgctctgtccattttaaagcaagtaatggaagaaaaggtgactcccaacaatgttgatattgccaaagtagcaccgacataccatctgtacaccccttcagaggtggaagcagtcatcagtcggctatgagagaaatgctttgttataaactatcatcccatgcagcatgagttaaggggattcaaactgtgaacccttattttttggtgtcgtgcaaaattccagtacgtcttcactcggatattttagttacacctcatcaggaaaaggaacctttgattttggatttagtttgcatgtgggttgcctcctcattgctcgcatttgtgaaataacaagaatgattagtatagactaatatattttctaattatctaaagtttagtcaaatttaaactaggaaccaaatattgtgagaatgatatggaaacctcaaaatcatatctttgatagttttgaacaaaaaaagaaaagaaaaatcatttcttgtcaatgaaaccgggtttcaggtcgggttaaactaaataagttaatttcgatttaaagtta

SEQ ID NO: 1119 - DNA, 954 bp, Heritiera littoralis
ggctcggctgctctttgacaagttttgttagatctaagtctaatcaatccaaacatgtttctcaccaggactgagtatgaccgtggggtgaacacattttctccggagggaagattgttccaggtcgaatatgcaattgaagccatcaagcttggttcaactgcaattgggataaagacaaaagatggtgtcgtgctggctgtcgagaagcgtatcacttcacccctgttggaacccagcagtgttgagaagattatggaaattgatgagcatataggatgtgctatgagtggcttgattgctgatgcacgtacacttgttgaacatgcacgagttgagactcagaaccacagattctcctatggtgagccaatgactgtagagtctacaacacaagctctctgtgatctggcccttcgatttggtgaaggagatgaagaatccatgtcccgaccatttggggtgtctcttctcattgctggtcatgatgagaatgggcctagcttgtactatacagatccatctggcacattttggcaatgcaatgcaaaagctataggttcaggttctgaaggtgcggacagctctttgcaagagcaatacaacaaggagctaactcttcaagaagctgaaacaattgctctgtccattttaaagcaagtgatggaagaaaaggtgactcccaacaacgttgatattgccagggtggcaccaacataccatctatacaccccttcagaggtggaagctgtcattactcgcctatgagaacgctttgtcatgaacaatcttcccatgcaacaacactctttcctgtcataatgatgcatgagttggggtagaggcttgtatttgtttctgagaattcgagctttgaaaccttatttttggtgtggtactgaactcatatactcttcagttggataatttgattacacctgatcagaaaacaac

SEQ ID NO: 1120 - DNA, 1082 bp, Lactuca sativa
gggcttatactcgaataaatagactagtaaagaaaatttgaagcaatttcgatcggagtacgtcgccaatctcctctttcggagctaatttaccaacaacagagatctattaagccgttaaattcaatcgaagatgtttctaaccaggactgagtatgatagaggtgttaacaccttctctccagaaggccggttgtttcaggttgaatatgccattgaggccattaagttgggttcgactgctattggattgaagacgaaggaaggagttgttcttgctgttgaaaagagaattacctctccactcctggagcctagtagtgttgagaaaattatggaaattgatgagcacattgggtgtgccatgagtggattaattgcagatgcacgtacacttgttgaacatgcacgagttgaaactcagaatcatcgattctcctatggtgagccaatgactgttgagtcaaccacccaagctctctgtgatctggcactgagatttggtgaaggagatgaagaatctatgtctcgaccttttggtgtctcccttcttattgctggccatgatgaaaatggtcccagtctatactatacggatccatcaggcacattttggcaatgcaatgggaaagctattgggtcagggtctgaaggtgctgacagttctcttcaggagcaatacaacaaggatttgactttaaaagaagctgagactattgctctttccatcttgaagcaagtcatggaagaaaaggtaactcccaacaatgtggatattgcaaaggtggcgcctacttatcacttgtacacccctgctgaggtggaagctgttattggtcgcctatgaaatgggaagagttttattgacaagttgtagacttttttcgtttggtttccttaaaaaatatgtattttgtactaaattgccaagattttattatgtttctgttcatttatggtatttgaacatgagaccctttttttatgattgtcaaaaatcatggaattaaaattggagacctagaactttgtttaaaagatttaacgagtgttgttgaaaaacatatagcttcttttacaga

SEQ ID NO: 1121 - DNA, 1052 bp, Lotus japonicus
acaaaccacagtcagtatcagtagtctcagaaagcaagcaaaacccagttcctctctttttgcagtgatttcatcgaatcgaatccaccatgtttctcacaaggactgagtatgaccgaggagtcaacaccttttcccctgaaggccgtttgtttcaggttgaatatgcaattgaagccattaagctgggatcaactgctattgggttgaagacgaaagagggtgttgtccttgcagttgaaaagcgtattacttcaccgctgctggagcctagcagtgtggagaaaattatggaaattgatgcgcatataggttgtgcaatgagtggattgattgctgatgctcgaacacttgttgagcatgcacgagttgaaactcagaatcataggttctcttacggtgaaccaatgactgtagagtccacaactcaagctctttgtgatctagccttacgttttggtgaaggcgatgaagagtccatgtctcgaccatttggagtgtctctcctcattgcaggccatgatgagaatggacctagtctatattatactgatccgtctggcacattttggcaatgcaatgcaaaagccattggttcaggatcagaaggtgctgacagttctctgcaagaacaatacaacaaggaactaactcttcaagaagctgagactattgctttatccattctgaaacaggttatggaagagaaggttactcccaacaacgtggacattgccaaggtttctccaacatatcatctctatacacccgctgaggtggaagctgtgataagtcgcctatgatttcctttagtgcgatttgctctcttcagcatttgtttcctattcttcctgcatgtactcctatttactagttttgcactgaaccttttgtggtggatgttactagcattgctacacgtgtggctaagttgtactctataatagattctcatgtcatatttgctacattcagtcaagttggaattgaggactaaaggtttcagtgtttgagaaaaaacattacatgagtgcactcgtctttaactgtgg

SEQ ID NO: 1122 - DNA, 1179 bp, Quercus alba
agggggattatacttcttcgttttcaatcagagtaaagctctctcactctctctctctctctcacacgcaaacacaccattcaatcaaaccgggttttttgttaatcgaatcgaatcgaaaatgtttctcacaaggactgagtatgacagaggagtgaacacattttctccagaagggaggttgtttcaggtggaatatgccattgaggcaatcaagctgggatcaactgcaattgggttgaagacaaaggaaggagttgtgcttgcagttgagaaacgtatcacttccccactactggaacccagcagtgtggagaaaatcatggaaatagacgagcatttgggctgcgccatgagtggactaattgctgatgctcgaacgctagttgagcatgcgcgcgttgagactcaaaaccataggttctcctatggtgagccaatgactgtggagtctacaacacaagctctttgtgatctggccctacgattcggtgaaggtgatgaagaatcgatgtctcgaccgtttggagtttctcttctcattgctggccatgatgagaatgggcccagcttatattatactgatccatctggcacattttggcaatgcaatgccaaggctattggttcgggttcagagggtgcagacagctctctgcaagagcaatacaacaaggacatcactcttcaagaagctgagaccattgctctttccattctgaggcaggttatggaagaaaaggtgacacccaataacgttgacattgcaaaagtggctccaaattaccatctatatacccctgcagaggtggaggcggttattgctcgcctatgagtgcaagtcctcacattgcaaattttagatttgtatcgcacttgttgaagatgaaatcccttgatggattggtgacaaatgctgtatcattgcgaaaactaaatcaaaatggaagcatttcatgggaacttgaatagaatacttttgcaattaaatcttgcctggctaatgttggttgcagttaaatgcttggctatctgaacttggtggtttttgatatacagactagaggaatctcaagattatgattgactttattttgttcatgatatattccattggtagatgcttcgtaccttgtttttgggttactgaaaaaaatagttaatgttttatggccatgc

SEQ ID NO: 1123 - DNA, 1064 bp, Helianthus annuus
cgggggggcttcttctttctactggagtaaatagagtaaacctacaacaggcaaacgcaaaacaagaagagatctatcatccattcgttaaactgaatcgaagatgtttctaaccaggaccgagtatgacaggggtgtaaacaccttctctccggaagggcggttgtttcaggttgaatatgccattgaggccattaagttgggttccacagctattgggctgaagaccaaggaaggggttgttcttgctgttgaaaagcgtattacctccccactcttggaacctagtagtgttgagaaaattatggaaattgatgaacacattggctgtgccatgagtggattaattgcagatgcccgaacactagttgaacatgcacgggttgagactcagaatcataggttttcctatggtgagccgatgactgttgagtcaaccacccaagctctgtgtgatctggcactgcgatttggtgaaggagatgaagaatccatgtctcgaccttttggggtatctcttcttattgcaggccatgatgaaaatggtcccagtttatactatacggatccatcaggcacattctggcaatgtaatgcaaaagctatagggtcagggtctgaaggtgctgacagctctctgcaggagcaatttaacaaggacttgagtctaaaagaagctgaaacaattgctctttccattttgaagcaagtgatggaagaaaaggtaactcctaataatgtggatattgcaaaggtggctcctacttatcacttgtacaccccggctgaggttgaagctgttatcagtcgtttatagactagagtctgatatggcttaataaaatttgtatttgtacttgaaactgttgagatttttattctgttacccttcaggtatggcatttgaacacaggatctttggggttgtgttgttcatctgttttatgttttcttgtaatgtttgacatctgacttgtcactatccgtgttcaggattttgtttgttttgaactgctcaagtgattttttagattatagctagggctgtaaacgaaacaaacgtc

SEQ ID NO: 1124 - DNA, 1065 bp, Tabernaemontana elegans
aagctgagttttaagactataaaccgcagtgcatagaggaggagacgactcaaaacgacattcccaaccgaagttcttttctcttcttctccagttgaatttcttccagttttcttgaagattgtctattttattccgaagttttttaatcgaagctcgtaattgatcgattcgacaatgttcctcaccaggactgagtacgatagaggagtcaacaccttctctcccgaaggtcgattgtttcaagtggaatatgccattgaagcaatcaagttgggttcaacggcgattgggctaaagactaaggaaggagttgtccttgccgttgagaagcggattacctctccgctcctggagcccagcagtgtggagaaaattatggagattgatgaacatataggctgtgcaatgagtggattaattgctgatgcccgaacactggttgagcatgcaagagttgagactcagaaccatagattctcctacggtgagccaatgactgttgaatccactacccaggctctctgtgatcttgccctccgatttggtgaaggggatgaagaatccatgtctagaccttttggtgtatctcttctcattgctggtcatgatgagaatggtcccagcttgtactatacagatccatctggaactttctggcaatgcaatgcaaaagctattggttcaggttccgaaggtgctgacagctccttgcaagagcaatataacaaggatctaactcttcaagaagctgaaactatagccctttccatccttaagcaagttatggaagaaaaggtaactcctaataatgttgatattgcaaaggtcgcaccaacttaccatttgtacaccccttctgaggtcgaggctgtcattactcgcctataaaaggagatcttccagccagtttcttgatccaattcctgttcttcaatgcttgaattccttctgtactatttggttggatgaacattcgtttttggcactttttaattatggaatttccagtagaaactgctcgtgtgttaaaccatatcattcagtctaatgaacaatatattt

SEQ ID NO: 1125 - DNA, 973 bp, Tragopogon dubius
ggggcttgtactcgaatatatagactaacgagacagagtcggaggcactttcgatcggagaacatcgtcgatctcctctgtcggagctaatttaccgtccacagatagctattaagccgttaaattcaatcgaagatgtttctaaccaggaccgagtatgataggggtgttaacaccttctctccagaaggccgtttgtttcaggttgaatatgccattgaggccattaagttgggttcaactgctatcgggttgaagaccaaggaaggggttgttcttgctgttgaaaagcgaattacctcacctctcctggagcctagtagtgttgagaaaattatggaaattgatgagcacattggatgtgccatgagtggattaattgcagatgcccgtacactcgttgaacatgcacgagttgagactcagaatcatcgattctcatatggtgagccaatgactgttgagtccactacccaagccctgtgtgatcttgcactccgtttcggtgaaggagatgaagaatcaatgtctcgaccttttggggtttctcttcttattgctggccatgatgaaaatggtcccagtctatactatacagatccatctggcacattttggcaatgcaatgggaaagctattgggtcaggctctgaaggtgctgacagctcactacaggagcaatataacaaggatttgacactaaaagaagctgaaacaattgctctttctatcttgaagcaagtcatggaagaaaaggtgactccaaacaatgtggatattgcaaaggttgcgcctacttatcacttgtacaccccggctgaggttgaagctgttatcggtcgcctatgaaatgtgaggagttagttttatttgacttggtttccttcaaaacatgtattttgtactaaatttacaagattttattatgtttttctcatttatggtatttggaaacacgagattaaggaattaa

SEQ ID NO: 1126 - DNA, 867 bp, Vinca minor
cttaaattaatcaaatccacaatgtttctcaccaggactgagtacgataggggagtcaacaccttctctcctgaaggtcgattgtttcaagtcgaatatgccattgaagctatcaagctgggttcgacagccattggattaaagaccaaggagggagttgtcctagctgttgagaagcgtattacatctccgctcctggagcccagcagtgtggagaaaattatggagattgatgaccatataggctgcgccatgagcggattaatagctgatgcccggacactggttgagcatgcacgagttgagactcagaatcatagattctcatacggtgagccaatgactgttgaatcaactacccaggctctttgtgatcttgccctccgatttggtgaaggagacgaagaatccatgtctagacctttcggtgtatctcttctcattgctggtcatgatgaaaatggtcccagcttatattatacggatccatctggaactttctggcaatgcaatgcaaaagctatcggttcaggttctgaaggtgctgacagctccttgcaagagcaatataacaaggacctaactcttcaagaggctgaaacaatagccctctctatccttaagcaagttatggaagaaaaggttactcctaataacgttgatattgcaaaggttgcgccaagttaccatttgtacacccctgctgaggtcgaggctgtcattactcgcctataagagaatattttccgagaagtttcttgatcctatttcttgttctccaatacttgaatttgttttcgttggatgattgtatctttgtggtactgttttaaattatgaaatttctgtcagaagctactttgaaac

SEQ ID NO: 1127 - DNA, 913 bp, Vinca minor
accgaagctcttaattaatcaaatccacaatgtttcttaccaggactgagtacgataggggagtcaacaccttttctcctgaaggtcgattgtttcaagtggagtatgccattgaagcaatcaagctgggttcgacggcaattggattaaagactaaggaaggagttgtacttgctgttgagaaacgtattacctctccactgctggagcccagcagtgtggagaagattatggagattgatgaccatataggctgcgcaatgagcggattaattgctgatgctcgcactctggttgagcatgcacgagttgagactcagaatcatagattctcatacggtgaaccaatgactgttgaatcaactacccaggctctttgtgaccttgccctccgttttggtgagggggaggaagaatccatgtctagacctttcggcgtatctcttctcattgccggtcatgatgaaaatggtcccagcttatattatacagacccatcgggaactttctggcaatgcaatgcaaaagctattggttcaggttctgaaggtgctgacagctctttgcaagagcaatataacaaggacctaactcttcaagaggctgagacaatagcactttccattcttaagcaagtaatggaagaaaaggtaactcctaataatgtcgatatcgcaaaggttgctccaagttaccatctgtacacacctgctgaggttgaggctgtcattgctagcttatgagtgaagatcttccaagtagagtcttgatccccatgcttgaattacttgtgtactactttatttgatgattattcctttatgatactccttagattatgaaattttctctcggaaactgcttcaagtttgttaaaccccatatttttaagtcaacgaactttttaactttt

SEQ ID NO: 1128 - DNA, 1158 bp, Prunus mume
ggagaggaagaaaaaggaaaaacccttcttctccaacacgaaagcatatcataaatcaccatctctctgcagaaggagctctcatcgcagtgaagcaaatcacatactaattcgatcaatctcaaagttccaatcaaaccaagatgtttctcacaaggactgagtatgacagaggagtaaacaccttctcccctgaaggcaggttgtttcaggttgagtatgccattgaggccatcaagttgggttcgactgctattgggttaaagacaaaagagggtgttgtgcttgctgtggaaaaacgtatcacttcgcctttactggaacccagcagtgtggagaaaataatggaaattgatgaccatataggatgtgccatgagtggactgattgctgatgctcgtacactggttgagcatgcacgcgttgaaactcagaatcataggttctcctatggtgagccaatgactgtggaatctacaacacaagctctttgtgatctggcccttcggtttggtgaaggtgatgaagagtccatgtctcgaccatttggagtatctcttctaattgcaggtcatgatgagcatgggcccagcttgtactatactgatccatctggcacattttggcaatgcaatgcaaaagctattggctcaggttcagaaggtgcagacagctctctgcaagagcaatacaacaaggagttgactcttcaagaagctgagacaattgctctgtctattcttaagcaagttatggaagaaaaggtgactcccaataatgttgatatcgcaaaggttgctccaacataccatctgtataccccttctgaggtggaggctgtcattagtcgcctataagctctcgtgtttttccgaactgaatttgtttctgtatttgttaagttacagaaaaggatttcggatttgtttatggttgatgattttgaccagtaagccaagaatattatcatccgactttgatgagcagatgccatcctgtgctctaatgaaagatttcatgtgaactgatgaaaattttgcagttattttgtttggcgcacaattctcccattatcttctagagtggtggcatgttgtgtttaatgcaggctgtttacccaatggtggttagttggcggtgcaatttttttccctttta

SEQ ID NO: 1129 - DNA, 956 bp, Ambrosia trifida
tagccaagaggcagacagaagcaaaagaagaagaagaagaaagagatctatctatttactactctaatcgcgaagatgtttctaacgaggacggagtatgacaggggtgtgaacactttctctccagaagggcggttgtttcaggtagagtatgcgattgaggcgattaagttgggttcgactgctattggcctcaagaccaaggaaggggttgttcttgctgttgaaaagcgtattacctccccactcttggaacccagtagtgttgagaaaattatggaaattgatgaacacattggctgtgccatgagtggattaattgcagatgccagaacgctagttgaacatgcacgggttgagactcagaatcataggttttcctatggtgagccaatgactgttgagtcaaccacccaagctctgtgtgatctggcactgcgatttggtgaaggagatgaagaatccatgtctcgaccttttggggtatctcttcttattgcaggccatgatgaaaatggtcctagtctatactatacggatccatcaggcacattttggcaatgcaatgcaaaagctatagggtcagggtctgaaggtgctgatagctctctgcaggagcaatttaacaaggacttgagtctaaaagaagctgaaacaattgctctttccatcttgaagcaagtgatggaagaaaaggtaactcctaataatgtggatattgcaaaggtggctcctacttatcaattatacacccctgctgaggttgaagctgttatcagtcgtctatgaactggagtctgatatggctttataaaatatgtagtttgcaattaaaactgtttagtattctgttcccttcaggcatggcatttgaacacaggatctttggggttgtggtgcccatctgttttatgttttcgtgtaatgtttgtcatctgacttgcaggattttcttt

SEQ ID NO: 1130 - DNA, 853 bp, Ambrosia trifida
aataagagttaaccggacaggcggacagaacgcaaaagaagaagaagaaagagatctaaaatcatcatcctgaatcgaagatgtttctaacgaggacggagtatgacagaggtgtgaacactttctctccggaagggcggttgtttcaggtggaatatgctattgaggcgattaagctgggttccactgctattggactcaagaccaaggaaggcgttgttcttgctgttgaaaagcgtatcacctccccactcttggaacccagtagtgttgagaaaattatggaaattgatgaacacattggctgtgccatgagtggcttaattgcagatgcccgaacactagttgaacatgcacgggttgagactcagaatcataggttttcctatggtgagccgatgactgttgagtcgaccacccaagctttgtgtgatctggcactgcgatttggtgaaggagatgaagaatccatgtctcgaccatttggggtatctcttcttattgcaggccatgatgaaaatggtcctagtctatactatacggatccatcaggcacattttggcaatgcaatgcaaaagctatagggtcagggtctgaaggtgctgacagctctctgcaggagcaatttaacaaggacttgagtctaaaagaagctgaaacaattgctctttccatcttgaagcaagtgatggaagaaaaggtaactcctaataatgtggatattgcaaaggtggctcctacttatcaattatacacccctgctgaggttgaagctgttatcagtcgtctatgaactggagtctgatatggctttataaaatatgtagtttgcaattaaaactgttttaagta

SEQ ID NO: 1131 - DNA, 1073 bp, Arnica chamissonis
gcgtcttctcttacagactgacataatcacgtgagtatcacctagcttagacccggttcgctttaccaacaaggtggcttgctttgcaagaagggctagtttatactggaataatcggaggaaatcggtaacatatcatcaacagccaacagaaactcgatcgaagatgtttctaaccaggaccgagtatgataggggtgtcaacaccttctctccggaaggccgcttgtttcaggttgaatatgccattgaggccattaagttgggttcgacagctattgggttgaagaccaaggaaggggttgttcttgctgttgagaagcgtattacctcaccactcttggaacccagtagtgtggagaaaattatggaaattgatgaacacattggctgtgccatgagtggattaattgcagatgcacgcacacttgttgaacatgcacgggttgagactcagaatcataggttttcctatggtgagccgatgactattgagtcaactacccaagccctgtgtgatttggcactgcgatttggtgaaggagatgaagaatccatgtctcgaccttttggggtatctcttcttattgcaggccatgacgaaaatggtcccagtctatactatacagatccatcaggcacgttttggcaatgtaatgcaaaagccatagggtcagggtctgaaggtgctgacagctctctgcaggagcaatataacaaggacttgactctaaaagaagctgaaaccattgcgctttccattttgaagcaagtgatggaagaaaaggtaactcctaataatgtggatattgcaaaggtggctcctacctatcatttatacaccccggctgaagtcgaagctgttatcagccgtctataaaatcgcagtctgttgttctgatttggttaccttatgaagcatgtattttgtacttaatttgctgagattttattctgtccccttcaggtatggtctttgaacacaggatcattttttttaattatgtttatgttcgagaaaatcatggtggagacctagaacttgtttaactagaaaaccaagtaagcttcat

SEQ ID NO: 1132 - DNA, 1096 bp, Musa acuminata
cgcggacggcggattgcccaaacctcgactaccgccgtcatcgccgactgctctctccctctctatctctctcagattcgtcgagatgttcctcaccaggaccgaatacgatcgaggtgtcaacactttctctcccgaggggaggttgttccaggtcgagtacgccatcgaggccatcaagttgggctcgactgccattgggttgaggacgaaggaaggcgtagtgcttgcggtcgagaagcgcgtgacctcgcccttgctggaaccaagcagtgtagagaagattatggagattgatgagcacataggttgtgcaatgagtggactgatagctgatgcacgaactcttgtagagcatgcccgtgttgaaactcagaatcataggttttcatatggtgagcctatgactgttgagtccactacccaagcactgtgtgatcttgctcttcgatttggtgaaggagatgaagagtccatgtcacgaccttttggggtatctcttctgattgctggtcatgacgaacatggacccagcttgtactacacagatccgtctggcacattctggcagtgcaatgcgaaagcaattggttcaggatccgaaggagctgatagctctcttcaagagcagtacaacaaggatctaacccttcaagaagctgaaaccatagcactttccatcttgaagcaagtcatggaagaaaaggtgactccaaataatgtggacattgcaaaggtagctcccacttatcatctctatacaccttctgaggtggaagctgtcattgctcgcctataaaatgtttggcgatgtactcttcctcgcccatttttctctccatctcaacatatttgccagagtacgcaccattatttgcttggatgctgttagtacttgtgttttggttgcttagtaatggaattatcattcagtaaacaactctgtgaatgatcgaactgctacttttgtttcttaagagaaaacaagtattcaagctttgacggctggtgaaatgtcatggtattgcctgttgtaattttgatttttgggacgaatggatttctcgttgtgttaatggctcaagttcaatgctac

SEQ ID NO: 1133 - DNA, 1636 bp, Theobroma cacao
ccaatgtcatgctgtgccaataacatgacgattgctgtgccaacagcttacctctatcttcaaattattttggttgtgacccaccacaaggaacttgtcttttttttcctttagcaagcacaaggaacttttctgcttgtggaccaattcttttacaagtcgtttgtaaattctttcccctggtagctcttataacgcactgattattgcactgatgtagacctgaagctggatttcatactagattttggtttccgttcctctatgcgaatctttcaatctaggaccggaggtgactttattgcttacattctcactggagatcacgtgattgaagaaaataatcaactactcaccatcaaaagcccagcccaagtgaaacgcagccgttttaccctggcttgtttcgcaagaagtctagaagacctttacaaaaagcacgagcttctctgtcttcgctcggctgctctttctctctcagacactcattcacaaagttttgttagatctaattctaatcgatccaacatgttcctcaccaggactgagtatgatcgtggggtgaacacattttctcctgagggtagattgttccaggtggagtatgcaattgaggctatcaagctgggttcaactgcaattgggataaagacgaaagacggtgtcgtgctggctgttgagaagcgtattacttcaccactgttggaacccagcagtgttgagaagattatggaaattgatgcgcatataggatgtgccatgagtgggttgattgctgatgcacgtacacttgttgaacatgcacgagttgagactcagaaccacagattctcatatggtgagccaatgactgtggagtccacaacacaagctctttgtgatttggcccttcgatttggtgaaggagatgaagaatccatgtctcgaccatttggggtgtctcttctcattgctggtcatgatgagaatggaccaagcttatactatactgatccctctggcacattttggcaatgcaatgccaaagctataggttcaggttctgaaggcgcagacagctctttgcaagagcaatataacaaggacctaactcttcaagaagctgaaacaattgctctgtccattttaaagcaagtaatggaagaaaaggtaactcccaacaatgttgatattgccaaggtagcaccaacataccatctatacaccccttctgaggtggaagctgtcattacccgtctatgagaatacttggtcataatcaatcttcccatgcaagaactgcctttcctttcataattatgcatgagttggggaagaggcttgtatttgtttctttttggtgtggcattaaactaatctacacttcagttggatgatttagttacacctgatcagaaaagaaccttttaattggatttcattgcattctcaaattctagcttgtggttaccgaatttgcattgttgctttctagagtcattgtttggccctcatttttgtggaatagcaagaatgataagtatagagggtaaacttgattgctttgatgttggtaaaggagctttgatggtttcattgtcacttcaatctcattttacaaattgcacaggataggaaatacattttttgataatct

SEQ ID NO: 1134 - DNA, 934 bp, Catharanthus roseus
cagtttttggatcgaaacggttaattaattgaatccacaatgttcctcaccaggaccgagtacgataggggagtgaacaccttctctcctgaaggtcgattgtttcaagtggaatatgccatagaagcaatcaagctgggttctactgcaattggactaaaaactaaggaaggagtcgtccttgctgttgagaagcgtattacctctccccttctggaacccagcagtgtggagaaaattatggagattgatgaacatattggctgtgcaatgagtggattaattgctgatgcccgaacactggttgagcatgcacgagttgagactcagaatcatagattctcatatggtgagcctatgactgttgaatccactactcaggctctttgtgatcttgccctccgatttggtgagggcgacgaagaatccatgtctagaccttttggtgtctctcttctcattgctggtcatgatgagaatggtcccagcttatattatacagacccatctggaactttctggcaatgcaatgcaaaagctattggttcaggttctgaaggtgctgacagctccttgcaagagcaatataacaaggacttaactctccaagaagctgaaacaatagcactttccatccttaaacaagttatggaagaaaaggtgactcctaataatgttgatattgcaaaggtctctccaacttaccatttgtacaccccttctgaggttgaggccgtcattactcgcctatgagagacgagacctttcaagcagtttcttcatcctatttttctcttcttcaatgcttgaattccttgtgtactatctggttggatgagtatttctctttggtactataattatgaaatttccatcagaagctgctccaattgtgttaagaccatattattcagtcagtctaatgaaccattta

SEQ ID NO: 1135 - DNA, 946 bp, Gossypium hirsutum
gctctcattattcagttttgttagatttaaatataatcgatccaaacatgtttctcacaaggactgagtatgatcgtggggtcaacacattttctccggaaggaagattgttccaagtggaatatgcaattgaggccatcaagctgggttcaactgcaattgggctaaagacgaaagacggtgtcgttttggctgtggagaagcgtattacttcaccattgttggaacccagtagtgttgagaagattatggaaattgatgagcatataggatgtgctatgagtgggttgattgctgatgcacggacccttgttgaacatgcacgagttgaaactcagaaccatagattctcatatggtgagccaatgaccgtggagtctacaactcaagctctttgtgatctggcccttcgattcggtgaaggagatgaagaatccatgtcccgaccatttggggtatctcttctcattgctggtcatgatgagaatgggactagcttatactataccgatccctctggcacattttggcaatgcaatgcaaaagctataggttcgggttccgaaggtgctgatagctctttgcaagagcaatacaacaaggacttaactcttcaagaagctgaaacaattgccctgtcgattttaaagcaagtaatggaagaaaaggtgactcccaacaatgtcgatatcgctcgagtagcaccgacataccatctatacaccccgtcagaggtcgaagctgtcattactcgtctatgagaacacattgtaccatgttttctgctgtaacgatgctcaagtcgggatcaaggctcgtatttgtttttggggattcaagctgtgaaaccttatgtttggtttggcactacaaactcatccatctcatcatttggattgtttgattacaaaaatagaacctttaattggatttagtatttgccttt

SEQ ID NO: 1136 - DNA, 1038 bp, Gossypium hirsutum
ttaatactctcttcacaaggttttgttagatctaacatccaatcgatccaagatgtttctcaccaggactgagtatgaccgtggggtgaacacattttctccggagggaagattgttccaggtagaatatgctattgaggccatcaagctgggttcaactgcaattgggttaaagacgaaagaaggtgttgtgttggctgtcgagaagcgtattacttcgccattgttggagcccagcagtgttgagaagattatggaaattgatgaacatataggatgtgctatgagtggcttgattgctgatgcccgtacacttgttgaacatgcacgagttgagactcagaaccacagattctcatatggcgagccaatgactgtagagtccacaacacaagctctttgtgacctggcccttcgatttggtgaaggagatgaagaatccatgtcccgtccatttggggtgtctcttctcattgctggtcatgatgagaatgggcctagcttatactatactgatccctctggcacattttggcaatgcaatggaaaagctataggctcaggttccgaaggtgcagacagctctttgcaagagcaatacaacaaggacctgactcttcaagaagctgaaactattgctctgtccattttaaagcaagtaatggaagagaaggtgactcccaacaatgttgatattgccaaagtagcaccaacataccatctatacaccccttcagaggtggaagctgtcattactcgcctatgagaatgcgctgccatcatacgatcttaccatgcaacaacctgctttactgtcataatgatgcatgacttgagggggagaagcttgtatttgtttcttgggattcaagctgtgaaacgttatttttggtgtggcactaaactcatctactctttcagttggataatttaattacaccagatcagaaaaaagaaccttttttaattggatattatgttctcgaattcttggactcggttacccatattattgctttttaatgtgaatttggcctt

SEQ ID NO: 1137 - DNA, 1266 bp, Gossypium raimondii
gttttacaagaagccatttacaaaaacaccgaaccttgcttcatttcatttacttatttatttttctttgctcgacggctctcattattcagtaaaatctctcttaattattttttcgttttttcctggttgattttcgtattaaaaacatattaatttttctgggttttaaaaaaaatttctttaggttttgttagatttaaatataatcgatccaaacatgtttctcacaaggactgagtatgatcgtggggtcaacacattttcaccggaaggaagattgttccaagtggaatatgcaattgaggccatcaagctgggttcaactgcaattgggctaaagacgaaagacggtgtcgttttggctgtggagaagcgtattacttcaccattgttggaacccagtagtgttgagaagattatggaaattgatgagcatataggatgtgctatgagtgggttgattgctgatgcacggacccttgttgaacatgcacgagttgaaactcagaaccatagattctcatatggtgagccaatgaccgtggagtctacaactcaagctctttgtgatctggcccttcgattcggtgaaggagatgaagaatccatgtcccgaccatttggggtatctcttctcattgctggtcatgatgagaatgggactagcttatactataccgatccctctggcacattttggcaatgcaatgcaaaagctataggttcgggttccgaaggtgctgatagctctttgcaagagcaatacaacaaggacttaactcttcaagaagctgaaacaattgccctgtcgattttaaagcaagtaatggaagaaaaggtgactcccaacaatgtcgatatcgctcgagtagcaccgacataccatctatacaccccgtcagaggtcgaagctgtcattactcgtctatgagaacacattgtaccatgttttctgctgtaacgatgctcaagtcgggatcaaggctcgtatttgtttttggggattcaagctgtgaaaccttatgtttggtttggcactacaaactcatccatctcatcatttggattgtttgattacaaaaatagaacctttaattggatttagtatttgcctttctcaatttctagcaagtcttggtttgcctttacttccatgtttttagaattttaccagtagtctgagtaaaaacattaaaaatttatttaaaaaaaaaaactcggttcaactgattttttaattagttcaaccgaatcactgtttaa

SEQ ID NO: 1138 - DNA, 1160 bp, Gossypium raimondii
gctcagttgctctctcttaatactctcttcacaagtaaatcatctttctctcttttttctttttaagttaattttcttttcagaaataagctaaaaaattgtgggtttttttgttctttggggttttgttagatctaacatccaatcgatccaagatgtttctcaccaggactgagtatgaccgtggggtgaacacattttctccggagggaagattgttccaggtagaatatgctattgaggccatcaagctgggttcaactgcaattgggttaaagacgaaagaaggtgttgtgttggctgtcgagaagcgtattacttcgccattgttggagcccagcagtgttgagaagattatggaaattgatgaacatataggatgtgctatgagtggcttgattgctgatgcccgtacacttgttgaacatgcacgagttgagactcagaaccacagattctcatatggcgagccaatgactgtagagtccacaacacaagctctttgtgacctggcccttcgatttggtgaaggagatgaagaatccatgtcccgtccatttggggtgtctcttctcattgctggtcatgatgagaatgggcctagcttatactatactgatccctctggcacattttggcaatgcaatggaaaagctataggctcaggttccgaaggtgcagacagctctttgcaagagcaatacaacaaggacctgactcttcaagaagctgaaactattgctctgtccattttaaagcaagtaatggaagagaaggtgactcccaacaatgttgatattgccaaagtagcaccaacataccatctatacaccccttcagaggtggaagctgtcattactcgcctatgagaatgcgctgccatcataagatcttaccatgcaacaacctgctttactgtcataatgatgcatgacttgagggggagaagcttgtatttgtttcttgggattcaagctgtgaaacgttatttttggtgtggcactaaactcatctactctttcagttggataatttaattacaccagatcagaaaaaagaaccttttttaattggatattatgttctcgaattcttggactcggttacccatattattgctttttaatgtgaatttggccttgcattgataagaaagataa

SEQ ID NO: 1139 - DNA, 1103 bp, Humulus lupulus
atatcctcactctaaactcttcttcacttcttctccgatctctctctccggcgattacatctttcttccgtcaccggcttcggctggattcttcgtctacgttgtttctttaggtttttaatccaatcaagcaaaaatgtttcttacaaggaccgagtatgatagaggggtgaacaccttttctcccgaaggtcgattgtttcaggttgagtatgccattgaggccattaagttgggatcaactgcaattgggttgaagacgaaagaaggtgtggtgcttgcagttgagaagcgaatcacttcaccattactggaaccaagcagtgttgaaaagataatggaagtcgatgagcacattggatgtgccatgagtggattgattgctgatgcccggacacttgttgaacatgctcgggtggaaactcagaatcatagattctcatatggtgagccaatgactgtagagtccacaacgcaggctctttgtgatttggctctgcggtttggtgagggtgatgaagaatccatgtctcgtccctttggagtttctcttctcattgctggtcatgatgagaatggcccaagcttatactacaccgatccatccggcacattttggcaatgcaatgcaaaggccataggttccggttcagaaggagcagacagctctctgcaagagcaatacaacaaggacctaactcttaaggaggctgagaccattgctctttctattctcaaacaagtcatggaagagaaggtgacaccaaacaacgtcgacatagcgaaggtggcgccaacataccatctgtacactcctgctgaggtagaagctgtcattactcgcctataagttccaaatccagaccaccatggccgccgccggaaccttttccgcttaccgacgattgcttctctaaacttgttgtctttgcttctctaaatttctgggaatgatgatgaggatgatttgcctttgcttccgattggtgttcttggttgttggatctgatgcaaaggcttcgaacattgtttccaagttagaaaaattatacattatggtggatctttagaacggttaacattttgatacaattatattttct

SEQ ID NO: 1140 - DNA, 995 bp, Medicago truncatula
acactgcgaaaatcgaagcaaaccaaaaacccagcgatagagagagtcttttagtgatctatttcatcgattcaaatcaaatcaaaccaaaccaaaccaaaccaaaccaacatgtttctcacaaggaccgagtatgaccgtggagtcaacactttttctcccgaaggacgtttgtttcaggttgaatatgcaattgaagccattaagcttggatcaactgcgattgggttgaaaaccaaagagggtgtggttcttgcagttgaaaagcgtattacttcgcctctactggagcctagcagtgtggagaaaattatggaaattgatgaccacattggctgtgcaatgagtggattgattgctgatgctcgtacacttgttgagcatgcacgagttgaaactcagaatcacaggttctcttatggtgaaccgatgactgtagagtctacaactcaagctctttgtgacctagccttgcgctttggtgaaggtgatgaagaatccatgtctcgaccatttggagtgtctctcctcattgctggccatgacgagaatggacctagcctatattacactgatccttctggcacattttggcaatgcaatgcaaaggctattggttcaggatcagaaggcgctgacagttctctgcaagaacaattcaacaaggacttaactcttcaagaagctgagactattgctttatcaatcctgaagcaagttatggaagagaaggtcactcccaacaacgttgacattgccagggttgctccagcgtatcatctttataccccgtctgaggtggaagctgtgataagtcgcctatgatttccatctatttaaatgatttgatttgtgctgtacgtctatttaactggtctgctacatgtagtgctgctttatcgccaagttgtatgcaatactagattctcctaccatattttctgatattcagtctagttgaaattgaggactaaaatagtatcacagcgtttggc

SEQ ID NO: 1141 - DNA, 1161 bp, Momordica charantia
aaagggtctgcttaaagcacaaagacaacactgaagaaacttgcagttgctgcttcttctccttcctccggtgtctcagaatccaggcggggttttttgattgaatcggaaaatgtttcttaccaggactgagtatgataggggtgtgaataccttctctcccgaaggtcgattgttccaggttgagtacgcgattgaggctatcaagcttggttcgacggcaattggtttgaaaacaaaggaaggggttgtgcttgcggttgagaaacgtattacatctccactactggaaccaagtagcgtggaaaagatcatggaaattgatgagcatataggatgcgccatgagtggattaattgctgatgcccacacacttgttgaacatgctcgagttgagacccagaatcatcggttctcatatggtgaaccaatgaccgtggagtccacaacacaagctctttgtgacctagccctaagatttggtgaaggcgacgaggagtccatgtctcgaccatttggagtagcgcttcttattgccggccatgatgagaaggggcccagcttgtactatactgatccatctggcacattttggcaatgcaatgctaaagctatcggttcaggttctgaaggtgcagacagctctctgcaagaacaatataacaaggagctaactcttctagaagctgaaaccatagcactttcaattctgaagcaggttatggaagagaaggtgactcccaacaatgtcgatattgcgaaggtggctccaacgtaccatttgtacacccctgcggaggtggaggcagtcattggccggctatgagaaggtcctttcgaaaatcctccgaactgttgttatgtttcttgtcactgggcatgtatttgtactcttctttgtctggtgagggagaatctcgggttttcgcctactttagaagctcttggtgatgcgtttaccgatagcttacagattaattatgggacattcttgatggtttattgcgaacttagatgaacaatttgattagtacttttacggaagctttctgaacataattctgatactgcaattgcgccattttgaacacaatgtgagaatatcttgtggctaacaggtaacattcgagagagctgcaagcaaattcattctccttttct

SEQ ID NO: 1142 - DNA, 994 bp, Tropaeolum majus
gctacagtctctacctttacctcatatccttcaacataatcaacacacgaaggttatagatccaactcgaaaacaatgtttcttaccagaaccgagtacgacagaggtgttaacaccttttctcccgagggcagattgtttcaggtcgagtatgctattgaggccattaagcttggttcaactgcgattgggttgaagactaaagaaggtgtcgtgcttgctgttgagaagcgtatcacttcaccattgctggagcccagtagtgtggagaagattatggagatcgatgagcatattggatgtgctatgagcggtttaattgctgatgcccgtacacttgtagagcatgcacgagtagagactcagaaccacaggttctcatatggtgagccgatgacagtggagtctacgacacaagcactgtgtgacttggctctaagatttggagaaggtgatgaggaatccatgtcccgaccatttggagtgtctcttctcattgctggtcatgatgagaatggacccagcctctattatacagatccgtctggcacattctggcaatgcaatgggaaggctattggttctggttcagaaggcgctgacagctctcttcaagagcaatacaacaaggatttaactcttcaagaagctgagacaattgctctctctattctcaagcaagtaatggaagagaaggtaactccaaataatgtcgatatcgcaaaggtagctccgacttaccatctgtatactccttcagaggtggaggccgtgattagccgcttatgaggtgaccacagagtttacttactctttcacttttaattatgctgtggagtattgttttggcctggaatctgagtctaaacctgaacttgtttttatgtcatgactcaaaactcttcatattatcttttatattatgccatgtgccactgattattggattctaatggtggttcatgaaggattattcccaaggaatttggatttt

SEQ ID NO: 1143 - DNA, 1008 bp, Papaver somniferum
agacttggattctcagtcgaagctcaaatggtataattaaacccaccaatcgttgaatgattttaatttaaaccctaactgaagatgtttcttacaaggactgagtatgatagaggtgtgaatactttctcacctgaaggtagattgtttcaggttgagtatgctattgaagctattaagcttggatcaactgccataggcttgaaaactaaagaaggtgtagtgcttgctgttgagaagcgcatcacttctccattgctggagccaagtagtgtagagaaaattatggaaatcgatgagcatataggttgtgcaatgagtggactaattgctgatgctcgtacacttgtcgaacatgcacgagtcgaaactcagaatcacaagttctcatatggggagcctatgactgttgaatccacaacacaagctttatgtgatcttgccctacgatttggcgaaggcgaagaagagtccatgtctcggccttttggtgtatcacttctcattgctggtcatgatgaaaatgggccaagcctatactacacagacccgtctggcacattttggcagtgtaatgcaaaagcaataggatcaggttctgagggagcggacagctctttgcaggagcaattcaacaaggagatgacactccaagaagccgaaacagttgctctttcgatcttgaagcaagtaatggaagagaaggtgactcccaacaatgttgacattgcaaaggttgctccaaagtaccatttgtattctccttctgaggtggaggctgtcatcgctcgtttatagaaagaaaatccttaatcattctcttcggcaaggttttcctgtcttacttcccaccgccttcaagtgatgacttcgttaggagataaactttggtattcttttaaattactttggtattcttgatcatgagtgtcacattttacattcacttggttgacatgaaaacattggaagttaagattcccaaatgaaaagttatgattcttatga

SEQ ID NO: 1144 - DNA, 1023 bp, Prunus persica
ggaagaaaaaggaaaaacccttcttctccaacacgaaagcatatcataaatcaccatctctctgcagaaggagcactcatcgcagtgaagcaaatcacatactaattcgatcaatctcaaagttccaatcaaaccaagatgtttctcacaaggactgagtatgacagaggagtaaacaccttctcccctgaaggcaggttgtttcaggttgagtatgccattgaggccatcaagttgggttcgactgctattgggttaaagacaaaagagggtgttgtgcttgctgtggaaaaacgtatcacttcgcctttgctggaacccagcagtgtggagaaaattatggaaattgatgaccatataggatgtgccatgagtggactgattgctgatgctcgtacacttgttgagcatgcacgcgttgaaactcagaatcataggttctcctatggtgagccaatgactgtggaatctacaacacaagctctttgtgatctggcccttcggtttggtgaaggtgatgaagagtccatgtctcgaccatttggagtatctcttctaattgcaggtcatgatgagcatgggcccagcttgtactatactgatccatctggcacattttggcaatgcaatgcaaaagctattggttcaggttcagaaggtgcagacagctctctgcaagagcaatacaacaaggaattgactcttcaagaagctgagacaattgctctgtctattcttaagcaagttatggaagaaaaggtgactcccaataatgttgatatcgcaaaggttgctccaacataccatctgtataccccttctgaggtggaggctgtcattagtcgcctataagctctcgtgttaatctgaattgaatttgtttctgtatttgttaagttacagaaaaggatttcggatttgtttatggttgatgattttgaccagtaagccaagaatattatcatccgactttgatgagcagatgccatcctgtgctctaatgaaagatttcatgtgaactga

SEQ ID NO: 1145 - DNA, 1319 bp, Glycine max
aacccagatgtgtatgggccatatgagcccatgccatttaggcagagtgaggagcaagcaaattaagtgcccttcctttgggtaactcgcactctcgcagtatcccctgactcacccaaacaaaaaaacaaacgcacgcttctcattctctctctactcgttcagaagatgtttctcacaaggactgagtatgaccgaggagtcaacaccttttctcccgaaggccgtttgtttcaggttgagtatgcaatcgaagccatcaagctgggatcaactgcgattgggttgaagaccaaagaaggagttgtccttgcagttgaaaagcgcatcacatcgccgctcctggagcctagtagtgttgagaaaattatggaaattgatgagcacatcggttgtgcaatgagtgggttgattgcagatgctcgaacacttgttgagcatgcacgggtggaaactcagaatcacaggttctcctatggtgagcctatgactgttgagtccaccacccaagctctttgtgatctagccttgcgttttggtgaaggtgatgaagagtccatgtcccgaccatttggagtatctctcctcattgctggtcatgatgagaatggacctagcttatactacactgatccatctggcacattttggcaatgcaatggcaaagctattggttcagggtcagaaggtgcagacagttctctacaagaacaattcagcaaggacctaacccttcaagaagccgagactattgctttatccattttgaagcaagttatggaagaaaaggtcactcccaacaacgttgacattgccaaggtggctccaacgtatcatctttatacaccgtctgaggtggaagctgtgataagtcgtctatgattatctctattcagcattgtttcctatccttcctgccgtacgtctaattatttagtatcatggggaacttcttgtggatgatgctacacttgtggcaaagttgtatactgtacgagattctggtgttatatttgcatttagtctagttgaaattgaggactaaaaaggcttcaatggttgggaaaatttagaactattacccgattgggggaggcaatgaagggaaaaaagatttacacaacgatctctatgcattatgtatattttattggaagaatgaagatttatttttaccgttttctaaactttgaagtctaagaaaattgctcacctctatcaaatatataataaagatagtttgctattggatttttttttttaaaaaaaactttgtaataatggtttttattataaatttttagaatctgattataatc

SEQ ID NO: 1146 - DNA, 1319 bp, Glycine max
aacccagatgtgtatgggccatatgagcccatgccatttaggcagagtgaggagcaagcaaattaagtgcccttcctttgggtaactcgcactctcgcagtatcccctgactcacccaaacaaaaaaacaaacgcacgcttctcattctctctctactcgttcagaagatgtttctcacaaggactgagtatgaccgaggagtcaacaccttttctcccgaaggccgtttgtttcaggttgagtatgcaatcgaagccatcaagctgggatcaactgcgattgggttgaagaccaaagaaggagttgtccttgcagttgaaaagcgcatcacatcgccgctcctggagcctagtagtgttgagaaaattatggaaattgatgagcacatcggttgtgcaatgagtgggttgattgcagatgctcgaacacttgttgagcatgcacgggtggaaactcagaatcacaggttctcctatggtgagcctatgactgttgagtccaccacccaagctctttgtgatctagccttgcgttttggtgaaggtgatgaagagtccatgtcccgaccatttggagtatctctcctcattgctggtcatgatgagaatggacctagcttatactacactgatccatctggcacattttggcaatgcaatggcaaagctattggttcagggtcagaaggtgcagacagttctctacaagaacaattcagcaaggacctaacccttcaagaagccgagactattgctttatccattttgaagcaagttatggaagaaaaggtcactcccaacaacgttgacattgccaaggtggctccaacgtatcatctttatacaccgtctgaggtggaagctgtgataagtcgtctatgattatctctattcagcattgtttcctatccttcctgccgtacgtctaattatttagtatcatggggaacttcttgtggatgatgctacacttgttgcaaagttgtatactgtacgagattctggtgttatatttgcatttagtctagttgaaattgaggactaaaaaggcttcaatggttgggaaaatttagaactattacccgattgggggaggcaatgaagggaaaaaagatttacacaacgatctctatgcattatgtatattttattggaagaatgaagatttatttttaccgttttctaaactttgaagtctaagaaaattgctcacctctatcaaatatataataaagatagtttgctattggatttttttttttaaaaaaaactttgtaataatggtttttattataaatttttagaatctgattataatc

SEQ ID NO: 1147 - DNA, 1225 bp, Glycine max
gagaaggctcattgaacaagcaaaattaagcacaaaagcccaaccctctctctcgctgctggtctcccccatttggcattcgcagatcgaatacgagtaatttcactgaatcttattgaagatgtttctcacaagaactgagtatgaccgaggagtcaacaccttttctcctgaaggccgtttatttcaggttgaatatgcaatcgaagccatcaagctgggatcaactgcgattggattgaagacgaaagagggtgttgtccttgcagttgaaaagcgcatcacttcaccactgctggagccaagtagtgttgagaaaattatggaaattgatgagcacataggatgtgcaatgagtggattgattgctgatgctcgaacacttgttgagcatgcacgggttgaaactcagaatcataggttctcctatggtgaaccaatgactgttgagtccacaacccaagctctttgtgatctagctttgcgttttggtgaaggtgatgaagaatccatgtctcgaccatttggagtatctcttctcattgctggccatgatgagaatggacctagcttatattacactgatccatctggcacattttggcaatgcaatggaaaagctatcggttcagggtcagaaggtgccgacagttctctgcaagaacaatacaacaaggacctaactcttcaagaagctgagactattgctttatccattttgaagcaagttatggaagagaaggtcactcccaacaatgtcgacattgccaaggtggctccaacatatcatctttataccccctctgaggtggaagctgtgataagtcgtctatgattttcttttcgtgactttctctattcaacatttgtgtttcctatcattcctgcctgacgtctaattattgagtattatgcggaaacttttttggtgggtgatgtttacatgtgctacacttgtggccaagttgtacactgtacgagattctggtgtcatttgctgcattcggtctagttgaaattgagtactataagggtttcaatgtttttgggaaaatcgtaatctattacccgaataccgagctagatttttactgtatgagatattaaggaacggggagacgatggaggaaaaaagaattacacaaagtatctatatgcattatgtgtatactattgaaagaattaggatttattttaaccatcttttattcctcgtagtcaaagc

SEQ ID NO: 1148 - DNA, 1312 bp, Glycine max
taaagagaaaaggtctgtggtctcaatttacctttatttttacaacatattttttgttagttttgagaaggctcattgaacaagcaaaattaagcacaaaagcccaaccctctctctcgctgctggtctcccccatttggcattcgcagatcgaatacgagtaatttcactgaatcttattgaagatgtttctcacaagaactgagtatgaccgaggagtcaacaccttttctcctgaaggccgtttatttcaggttgaatatgcaatcgaagccatcaagctgggatcaactgcgattggattgaagacgaaagagggtgttgtccttgcagttgaaaagcgcatcacttcaccactgctggagccaagtagtgttgagaaaattatggaaattgatgagcacataggatgtgcaatgagtggattgattgctgatgctcgaacacttgttgagcatgcacgggttgaaactcagaatcataggttctcctatggtgaaccaatgactgttgagtccacaacccaagctctttgtgatctagccttgcgttttggtgaaggtgatgaagaatccatgtctcgaccatttggagtatctcttctcattgctggccatgatgagaatggacctagcttatattacactgatccatctggcacattttggcaatgcaatggaaaagctatcggttcagggtcagaaggtgccgacagttctctgcaagaacaatacaacaaggacctaactcttcaagaagctgagactattgctttatccattttgaagcaagttatggaagagaaggtcactcccaacaatgtcgacattgccaaggtggctccaacatatcatctttataccccctctgaggtggaagctgtgataagtcgtctatgattttcttttcgtgactttctctattcaacatttgtgtttcctatcattcctgcctgacgtctaattattgagtattatgcggaaacttttttggtgggtgatgtttacatgtgctacacttgtggccaagttgtacactgtacgagattctggtgtcatttgctgcattcggtctagttgaaattgagtactataagggtttcaatgtttttgggaaaatcgtaatctattacccgaataccgagctagatttttactgtatgagatattaaggaacggggagacgatggaggaaaaaagaattacacaaagtatctatatgcattatgtgtatactattgaaagaattaggatttattttaaccatcttttattcctcgtagtcaaagcaaattgctcacctcagtcaaata

SEQ ID NO: 1149 - DNA, 1142 bp, Glycine max
ggccccttgaacaagcaaaattaagcacaaaagcccaaccctctctctcgctgttggtctctcctatttggcattcgcagatcgattacgaagtaatttcactgaatcttattgaagatgtttctcacaaggactgagtatgaccgaggagtcaacaccttttctcctgaaggccgtttatttcaggttgaatatgcaatcgaagccatcaagctgggatcaactgcaattgggttgaagacgaaagagggtgttgtccttgcagttgaaaagcgcatcacttcgccgcttctggagccaagtagtgttgagaaaattatggaaattgatgagcatataggttgtgcaatgagtggattgattgctgatgctcgaacacttgttgagcatgcacgggttgaaactcagaatcataggttctcatatggtgaaccaatgactgttgagtccacaacccaagctctttgtgatctagccttgcgttttggtgaaggtgatgaagaatccatgtctcgaccatttggagtatctcttctcattgctggtcatgatgagaatggacctagcttatattacactgatccatctggcacattttggcaatgcaatggaaaagctattggttcagggtcagaaggtgccgacagttctctgcaagaacaatacaataaggacctaactcttcaagaagctgagactattgctttatccattttgaagcaagttatggaagagaaggtcactcccaacaacgtggacattgccaaagtggctccaacatatcatctttataccccatctgaggtggaagctgtgataagtcgtctatgattttctttttgtgactttctgtattcaacatttgtgtttcctatcattcctacccgtacgtctaattattgagtattacgcggaaacttttttggtggatgatgtttgcatgtgctacacttgtggccaagttgtacactgtacgagattctggtgtcatatttgctgcattcagtctagttgaaattgagtactaaaagggtttcaatgattttgaggagacgatgaggaaaaaaaaagaattacacatctatatgcacattatgtgtatactattgaaagaaataggatttatttaatccttgcagtca

SEQ ID NO: 1150 - DNA, 1329 bp, Glycine max
aggaaaagcgaccttgccatcctaataaggatcacacgatcttaaaacccacataaagtcctcaaatcgaacgggtaaagagaaaaagttcgtggtctcaatttacgtctatttatttttttgttagttttgagaaggccccttgaacaagcaaaattaagcacaaaagcccaaccctctctctcgctgttggtctctcctatttggcattcgcagatcgattacgaagtaatttcactgaatcttattgaagatgtttctcacaaggactgagtatgaccgaggagtcaacaccttttctcctgaaggccgtttatttcaggttgaatatgcaatcgaagccatcaagctgggatcaactgcaattgggttgaagacgaaagagggtgttgtccttgcagttgaaaagcgcatcacttcgccgcttctggagccaagtagtgttgagaaaattatggaaattgatgagcatataggttgtgcaatgagtggattgattgctgatgctcgaacacttgttgagcatgcacgggttgaaactcagaatcataggttctcatatggtgaaccaatgactgttgagtccacaacccaagctctttgtgatctagccttgcgttttggtgaaggtgatgaagaatccatgtctcgaccatttggagtatctcttctcattgctggtcatgatgagaatggacctagcttatattacactgatccatctggcacattttggcaatgcaatggaaaagctattggttcagggtcagaaggtgccgacagttctctgcaagaacaatacaataaggacctaactcttcaagaagctgagactattgctttatccattttgaagcaagttatggaagagaaggtcactcccaacaacgtggacattgccaaagtggctccaacatatcatctttataccccatctgaggtggaagctgtgataagtcgtctatgattttctttttgtgactttctgtattcaacatttgtgtttcctatcattcctacccgtacgtctaattattgagtattacgcggaaacttttttggtggatgatgtttgcatgtgctacacttgtggccaagttgtacactgtacgagattctggtgtcatatttgctgcattcagtctagttgaaattgagtactaaaagggtttcaatgattttgaggagacgatgaggaaaaaaaaagaattacacatctatatgcacattatgtgtatactattgaaagaaataggatttatttaatccttgcagtcaaagaaaattgctcacctcagtcaaatacttgattggatattttctcttata

SEQ ID NO: 1151 - DNA, 1066 bp, Trigonella foenum-graecum
cccattaccaaacctcaaaacccatcatcgcacacttgcttctccctttctactaatttcttcagcttacgccatttgatctcctaaatttgaatccaacatgtttctcacaaggactgaatatgatcgtggagtcaacactttttctcctgaaggccgtttgtttcaggttgaatatgcaatcgaagccatcaagcttggatcaaccgcgattgggttgaagaccaaagagggtgtggttcttgctgttgaaaagcgtatcacttcgcctctactggagccgagcagtgtcgagaaaattatggaaattgatgaccacattggttgtgcaatgagtggattgattgctgatgctcgtacactagttgagcatgcacgagttgaaactcagaatcacaggttctcttatggtgaaccgatgactgttgagtctacaactcaagctctttgtgacctagccttgcgctttggtgaaggtgacgaagaatccatgtctcgaccgtttggagtgtctctactcattgctgggcatgatgagaatggacctagcttatattacactgatccttctggcacattttggcaatgcaatgccaaagctattggttcaggatcagaaggtgctgacagttctctgcaagaacaattcaacaaggacttaactcttcaagaagctgagactattgctttatcaattctgaagcaagttatggaagagaaggtaactcccaacaacgttgacattgccagggttgctccagcatatcatctttataccccttctgaggtggaagctgtgataagtcgcctatgatttccatctatttgcatgatttgtttcgtgtactagtcttctgctgaaatttttttggtcgatgatgctacatgtagtactgttttatggccaagttgtatgctatactagattctcctgtcatattttctgacattcagtctagttgaaattgaggactaaaatagtgtcacaatgtttgggaaaacaaaatacattattgtcttcacaaggtccatgctatatttttattgagatgagatgagatactat

SEQ ID NO: 1152 - DNA, 1275 bp, Triticum aestivum
ccaagaaaagaaaactccgtccctaccccttgtataaaaagaaaagaagaagaagaaaactctatcccaaggagaaactcgccgccgtctcctctcctctctactagtacttggttcccaagaagaaaccccaccaagcacccaccccgtgtagtagaaatagaatcaagtgcttcgaattccgatccgcatccgccgacgcgatgtttctcacgaggacggagtacgaccgtggggtcaacaccttctccccggaggggcggctgttccaggtcgagtacgccattgaggccatcaagttgggctccactgcaatcggcttgatgactaaggatggtgttgtactggctgttgagaaacgtgtcacctcaccgctgctggaaccaagcagtgtggagaaaatcatggaaattgatgagcatgtcggctgtgccatgagtggccttattgctgacgccagaacactggttgagcatgctcgtgttgagactcagaatcataggttctcatatggggagccaatgacagtagaatctaccacacaagctatctgtgacttggctttgcgctttggtgaaggtgatgaagaatcaatgtcacggccgtttggagtctctctccttattgctggtcatgatgaacatggacccagcttgtattacacagacccatcggggaccttttggcagtgcaaggccaaggccattgggtcgggctctgaaggagctgatagctcattacaagagcagtacaacaaggaactgaccatcgctgaggcagagaccatagccctttctatcctgaagcaggttatggaagaaaaggtgaccccgaacaacgttgacattgcgaaggtctcccctagctaccacctctacaccccttctgaggttgaagcggtcatctcgaggttgtgaaggattgccactttgtgagacagctcttgtattcccatgaaccctaaggcacaatgaactatgaactctgttgtgggtttgggttgtctgcctactgttgaagggatattagtgcctgcttgggcgttgcatctgattctcatctcccagtccagtcatttgtttgtagcactaagacgttgtgtcaccaaaaagaattagtacacataattttcagcatctagcaagtgcgtaggtatcactggctgcatttgtgtgcatttggtttgtaaacatctctactgttaaggggagttggtgtttgtactagtggcgtgtttggttgcttgcattaagctctgccaggcctgtgcgggaa

SEQ ID NO: 1153 - DNA, 1005 bp, Trifolium pratense
ctcttcttcaatttcttaacccttcgcaccagttttatacactgatctaatcgaatccgatctaaaatgtttctcacaaggactgaataatgatcgtggagtcaataccttttctcccgaaggccgtttgtttcaggttgaatatgcaatcgaagctatcaagctgggatcaaccgcgattgggttgaagacgaaagaaggtgttgttcttgctgttgaaaagcgtatcacttcgcctctactggagcctagcagtgtggagaaaataatggaaattgatgaccacattggctgtgcaatgagtggattgattgctgatgctcgtacacttgttgagcatgcacgagttgaaactcagaatcataggttttcatatggtgaaccaatgactgttgagtctacaactcaagctctttgtgatctagccttgcgctttggtgagggcgatgaagaatccatgtctcgaccatttggagtgtctctcctcattgctggccatgacgagaatgggcctagcctatattacactgatccttctggaacattctggcaatgcaatgcaaaagctattggttcaggatcagaaggtgctgacagttctctgcaagaacaattcaacaaggacttgactcttcaagaggctgagactattgccttatctattctgaagcaagttatggaagagaaggtcactcccaacaacgttgacattgccagggttgctccagcatatcatctttacactccttctgaggtggaagctgtgataggacgcctatgatttccatctatttgtgtgatttgtccggtggctgtacgtctatacaactagtctttggttgatgatgctgcatgtagttctgctttatggaagttgtacgctatattagattctcctgtcatattttttgtcattcagtctagttgaaattgaggactaaactaatgttacgatgtttgggaaaacaaaatacattattaatgttatgtcgagcgccaaaaaaa

SEQ ID NO: 1154 - DNA, 1145 bp, Tripterygium wilfordii
caaatccgctctgtcaaatggcccgaggattgaaatttgcaattaagctcatgtacggcccatattaacgttacccgtttcgcccggatacccgaattccgatccaaacagtatccgccactgcttgacttgcttctcaagaagagcccttgaaaacccaaacgaaaagcaaatacgagacattgtttctctcggcgtaaagaggtttttgagcttggcatctggatctggatcgaattgaaaaatgtttctcacaaggaccgagtatgatagaggagtcaacaccttctctccagaaggtagattgtttcaggttgaatatgccattgaagctatcaagctgggttcaactgctattggattgaaaacaaaagaaggcgtggttcttgcagtcgagaagcgtatcacttcaccactgctggagccaagcagtgtagaaaaaattataggaaattgatgagcatattggatgtgctatgagtggattgattgctgatgcccgtacacttgttgagcatgcacgagttgaaactcagaaccatagattctcatatggtgaaccgatgactgtagagtccacaacacaagcactctgcgatctcgccctgcgatttggtgagggtgatgaagaatccatgtctcgaccctttggggtatctcttctgattgctggtcatgatgaaaatggccccagcctgtactatacagatccatctggcactttttggcaatgcaatgctaaggctattggttctggttcagaaggtgctgacagctctctgcaagagcagtataacaaggagctaactcttcaagaagctgagacaattgctctgtctattctgaagcaagttatggaagagaaggtaactccaaacaatgtcgatattgcaaaggtgtctccaacataccacctatataccccttctgaggtggaggcagtcattagtcgtctatgagagcacatctcatgaatgcctgctttctcatctgtatgtttgcgagaattgttgtgtttttctgtttaaatttgatcttagactggccattcccattttgtttgtgtgcctaaaatgcacttgttagtttgcgctgtacaactgggacatggattaagctttaatgaaaacctaaaattttcagga

SEQ ID NO: 1155 - DNA, 816 bp, Ambrosia trifida
gcaaaagaagaagaagtaaaaagagatctatctatttactactctaatcgcgaagatgtttctaacgaggacggagtatgacaggggtgtgaacactttttctccagaagggcggttgtttcaggtagagtatgcgattgaggcgattaagttgggttcgactgctattggcctcaagaccaaggaaggggttgttcttgctgtcgaaaagcgtattacctccccactcttggaacccagtagtgttgagaaaattatggaaattgatgaacacattggctgtgccatgagtggattaattgcagatgccagaacgctagttgagcatgcacgggttgagactcagaatcataggttttcctatggtgaaccgatgactgttgagtcgaccacccaagctctgtgtgatctggcactgcgatttggtgaaggagatgaagaatccatgtctcgaccttttggggtatctcttcttattgcaggccatgatgaaaatggtcctagtctgtactatacggatccatcaggcacattttggcaatgcaatgcaaaagctatagggtcagggtctgaaggtgctgacagctctctgcaggagcaatttaacaaggatttgagtctaaaagagctggaacaattgctctttccatcttgaagcaagtgatggaagaaaaggtactcctaataatgtggatattgcaaaggtggctcctacttatcacttgtacaccccggctgaggttgaagctgttatcggtcgtctataaactgaagtcggatatggattaataaaatatgtagtttggaattaaaact

SEQ ID NO: 1156 - DNA, 975 bp, Arabidopsis lyrata
ttgtttttctagggttttgattccgttgtgcgaaggacttagaggtttcgcagatcgaaatcgcaaaagaagaagaagatgtttctcactagaactgagtatgacagaggagtcaacactttttctccagaaggaaggctatttcaagtggaatatgccattgaagctatcaagcttggttctactgcaattggagtaaagacaaaagaaggagttgtgcttgctgtcgagaagcgtatcacttcgccattgctggaaccgagcagtgtggagaagattatggaaattgatgaccatattggttgtgctatgagcggtttaattgctgatgcgcgtacacttgttgagcatgctagagttgagactcaaaaccatagattctcgtatggtgaaccaatgactgtagagtccacaacacaagcactgtgtgatctggctttacggtttggtgaaggagaggaagaatcaatgtctcgtccatttggagtatcacttctcattgctggtcatgatgaaaacggaccaagcttgtactacacagatccttcaggaacattctggcagtgcaatgcaaaggcaattggttcaggctcggaaggagctgatagctctctccaagagcaattcaacaaagatttatctctacaagaagctgagacgattgctgtatcgatcctcaagcaagttatggaagaaaaggtgactccaaataatgtggatattgccaaggtagcaccagcttatcatctctacactccacaagaagtcgaagcagtcatcgctcgtctatgatggaaaaatctcaatttgggtaatttacctatccgcttgtgtcacaaaacttgttacttttgtctgtcagattgaggattcatatcagatttttagtctgttgtgtaagagaatcttttgtttgtctcccatgtcattcaataacctctcggatttgtgattagaaaatttcctttcctacca

SEQ ID NO: 1157 - DNA, 1033 bp, Arabidopsis thaliana
gaagtgcgtctttgaaagctaaaaagagagcaaaagcttctgtttcttctccgattcgcagatcaattagctgggttttgattccgttgtgcgaaggactttaagaggttttgcagatcgaaatcggaagagaagaagaagatgtttctcactagaactgagtatgacagaggagtgaacactttttctccagaaggaaggctatttcaagtggaatatgccattgaagctatcaagcttggttctactgcaattggagtaaagacaaaagaaggagttgtgcttgctgtcgagaagcgtatcacgtcgccattgctggaaccgagcagtgtggagaagattatggaaattgatgaccatattggttgtgctatgagcggtttaattgctgacgcgcgcacacttgttgagcatgctagagttgaaactcaaaaccatagattctcgtatggtgagccgatgactgtagagtccacaacacaagcactgtgtgatctggctttacggtttggtgaaggagaggaagaatcaatgtctcggccgtttggagtatctcttctcattgctggccatgatgaaaatggaccaagcttgtactacactgatccttcaggaacattctggcagtgcaatgcaaaggcaattggttcaggttctgaaggagctgatagctctcttcaagagcaattcaacaaagatttgtctctacaagaagctgagactatcgctgtatctatcctaaagcaagttatggaagaaaaggtgactccaaataacgtggatattgccaaggtagcaccagcttatcatctctacactccacaagaagtcgaagcagtcatcgctcgtctttgattgaaaaaactcaatttgggtaatttacctatcagcttgtgtcacaaaacttgttacttttgtctgttagattgaggatcatgtcacattttagtcggttgtgtaagagaatcttttggctcccatgtcattcaataacctttcggatttgtgacttataaaatttcctttcctacca

SEQ ID NO: 1158 - DNA, 1052 bp, Arabidopsis thaliana
gagtgcttgtctacgggagctaaaaaggaactgggaagagtttgtttcttcgattcgtagatcaattctcagctgacattgaggtttatctcagatcgaaatcgagaagaagatgtttctcactaggactgagtatgacagaggagtcaatacattttctcctgaaggtcgtctctttcaggttgagtatgccattgaagctatcaagcttggttctactgctattggtgtaaagacgaaagagggagttgttcttgcagtcgagaagcgtattacttcgcctttactggagccgagtagtgttgagaagattatggaaattgatgaccatataggttgtgctatgagtggtctgattgctgacgcgcgaacacttgttgagcatgcacgagtagagacccagaaccacaggttctcgtatggtgagccaatgactgtagaatctacaacacaagctttgtgtgatcttgctttacggtttggtgaaggagaggaagagtcaatgtctcgtccatttggagtatcccttctcattgctgggcatgatgaaaatggaccgagcctgtactacacagatccatcgggaacattctggcaatgcaatgcaaaggcaattgggtctggctcagaaggagctgatagttctctccaagagcaattcaacaaggatataactcttcaagaagctgaaacaatagctgtatctatcctaaagcaagtaatggaagaaaaggtgactccaaacaatgtcgacattgccaaagtcgcaccagcttatcacctctacactcctcaggaggttgaagccgtcatcagtcgtctatgaagaaataaaccgccattctcttcctgttatcttaccttgtctgttcggtaatttatcaggcttctgtctgcttccggttctctaaaccaaaaattagtttcgtttaatcagataatggattttatcgagttgagttttattgagctttctatctacatttttttgtcgttttcaacaagaagttaaaactaataaatatctgtccaaaagaaaaaatcagaacttg

SEQ ID NO: 1159 - DNA, 1227 bp, Aristolochia fimbriata
tatataaaagccccttggaaagtctgcacttcgcaagaccagtttctttgctcatagaaggggggttacttcgtccgcaatccagctgattttggtctctattaagttactgaggctttaaggttgcgaacgagttcaggatgtttcttaccaggaccgagtatgatagaggtgtcaataccttttctcctgaaggtcggctttttcaagtcgagtatgctattgaggcgatcaagttgggttcgactgcaatcggtttgaagacgaaggaaggagttgttctggctgttgaaaagcgaattacttcacctctactagaacctagtagtgtcgaaaaaattatggagatagatgagcatattgggtgtgctatgagtggtcttattgctgatgctcggaccttggttgagcatgcacgtgttgaaactcagaatcacaggttctcatatggtgagccgatgactgtcgagtcaactacacaggcattatgtgatcttgcccttcgttttggtgaaggcgatgaagaatcaatgtctcgaccttttggggtgtctcttctaattgctggccatgatgaaaatggccccagtttatactacacagatccatctgggactttctggcagaccaatgctaaggcaataggctcaggttcggaaggtgctgatacctctttgcaggagcaatacaacaaggaacttactctccaagaagctgaaactatagccctgtccatcctgaagcaagtcatggaggaaaaggtgacaccaaataatgttgacatcgcgaaggttgctccaacgtaccatctctattctcctgctgaagtagagactgtcatcagtcgcctatgattagaaagatcagagttacccatttttctcacacgcccccccccccccttaatgagacttgttacacaagcaaatttgggcagagaatttatttttgggcgaaaactttctgacttgtgctgtgaatgatttcatcgaatcttttgggggaacagtagtatcaacagctgaacatataacatctagcccaagaactttttgatgattgctgttagctgattatgaaatattaatcaggttgatgaatggtaagtgtactctgcaatagaagggtgtctgtctcaaagttgcctacggctggcgaaagatatgatatggttggttgaattgtctctactttcagctgtgtatctttttacgaaaaaaaaaaaaa

SEQ ID NO: 1160 - DNA, 997 bp, Centaurea maculosa
cgcggggggcttatctcgaataatatactttcaatcgaaggaaatcgcaaatctcttcgatcggagctaatctatcatcaatcaacagagatctatttgagcttttaaactgaatcgaagatgtttctaaccaggactgagtatgatagaggtgttaacaccttctctccagaaggccggctatttcaggttgaatatgccattgaagccatcaagttgggttcgacagccattggtttgaagaccaaggaaggggttgttcttgctgttgagaagcgtattacctcgccacttctggagcctagtagtgttgagaaaattatggaaattgatgagcacattggctgtgcaatgagtggattaattgcagatgcccgaacactcgttgaacatgctcgtgtcgagacccagaatcataggttttcctacggtgaaccaatgactgttgagtccactacccaagccctgtgtgatctggctctgcggtttggtgaaggagatgaagaatctatgtctcggccttttggggtgtctcttcttattgctggccatgatgaaaatggtcctagtctatactatacagatccatcggggacattttggcaatgcaatgggaaagccataggctcaggctctgaaggtgctgacagctctctgcaggagcagtataacaaggacttgacgctaaaagaagctgaaataattgctctttccatcttgaagcaagtcatggaagaaaaggtaaccccaaataacgtggatattgcgaaggttgctcctacttatcacttgtacaccccggctgaagttgaagctgtcatcagtcgcctatgaaatggcaataagttgtagacggtctttgtttggttttcttgaacttgtattttgtactaaattgctgatatgttattctgtttcccatcaactatggtatttgaacacaaggtcttttctatgtttgacaaaatcatggattaaggtttaaaaattatttagc

SEQ ID NO: 1161 - DNA, 957 bp, Chelidonium majus
tcaggagcttgaacactttaagaatcagatttctagaacttcgatcgaattgaaaatgtttcttaccaggactgaatatgatagaggtgtgaacaccttctccccagaaggccgattatttcaggtcgagtatgccatagaagcaatcaagttgggttcgacagcaatagggttgaagaccaaagaaggagttgtgcttgccgtcgagaagcgcatcacttctcccctactggaacctagtagtgtggagaaaattatggaaattgatgagcacatagggtgtgcaatgagtgggctaattgctgatgctcgtacacttgttgaacatgcacgagttgaaactcagaatcacaagttctcatatggtgaaccaatgactgttgagtccacaacacaagctctatgtgatcttgccctacgatttggtgaaggagatgaagagtccatgtctcgcccttttggtgtatctcttctcattgctggtcatgatgagaacggtcctagcttgtactacacagacccatctggcacgttttggcagtgcaacgcgaaggcaataggttcagggtctgaaggagctgacagctctctacaggagcaatttaacaaggagatgacacttcaagaagctgaaacggtagctctttcaatcttgaagcaagtgatggaagaaaaggtcacccctaacaatgtggatattgcaaaggttgctccaacttaccatctctattctccttctgaggtggaggctgtcatcagtcgcctataaaagaaaatcttccatccatatcttgcaaactctcaaatttttcgttttctaccttccaccctgaataggtaatacaggtgtacctttgtgtaagaacttctatgggaaaaagaattaattgcttctggttaatcctaatcagggaacctgtttcttttttatttaaattccttgttggagtagatttt

SEQ ID NO: 1162 - DNA, 1161 bp, Cicer arietinum
cttttctctttccgtcttcatttctattttctttcgccaccgtcatttttttttgtttttgcagcagttatttcaccgattcgaagaatccaacatgtttctcacaaggactgagtatgaccgaggagtcaacaccttttctcccgaaggccgtttgtttcaggttgaatatgcaatcgaagccatcaagcttggatcaaccgcaattgggttgaagaccaaagagggcgtggttcttgctgtcgaaaagcgtattacttcacctctactggagcccagcagtgtagagaaaattatggaaattgatgaccacataggttgtgcaatgagtggattgattgctgatgctcgtacacttgttgagcatgcacgagttgaaactcagaatcataggttctcttacggtgaaccgatgacggttgagtccacaactcaagctctttgtgacctagccttgcgctttggtgaaggtgatgaagaatccatgtctcgaccatttggagtgtctcttctgattgctggtcatgacgagaatggacctagtctatactacactgatccttctggcacattttggcaatgcaatgcaaaagctattggctcaggatcagaaggtgctgacagctctctgcaagaacaatacaacaaggacttgactcttcaagaagctgagactattgctttatccattctgaagcaagttatggaagagaaggtcactcccaacaacgttgacattgccagggtggctccaacataccatctttataccccttctgaggtggaagctgtgataagtcgcctatgatttccatttgcgtgatttgcttcgagctttcatttcctattcctcctgcctgtacgtctatttaactagtgctgtgcctgaacttttttggtcgattattatacatgtagtgctgctttgtggccaagttgtacgctatactagattctcctgtcagatttgctgccattcagtctagttgaaattgaggactaaaatgccgtttctgatgtttactgaaaacacattataatgtctttcaagagccattcacaagatcggtgctaatatattatttttaatgtttctactatacaaaactacgtagggtaaactttaaaaaatgaaggtggaaaatggctcccagtagtttt

SEQ ID NO: 1163 - DNA, 1867 bp, Cicer arietinum
tatcgaataaaacattttgattgacgtcaaataaaataagaaaacttttcgatgtaacataaaattgaaggaacattttgacatacgtttacaatttgaggaaacaaattggcagtttacttttcaaaaaactctacccaaaaattacaatataaatttagtggtaatgtatcttcacttttgagactatttaagccgactacaatattaattaaattgatattaaaacgtccaatattttatcttatttttggatctaatttataaaaactattaggtaaatatttttttacatcattaattaatcataattttcatatcattaaaaatatttgacttttatttataactattttttaaatcatactcataattaattgatcgtaatttgtcaatgtataaaaattgaactatctttcacattaaatatttagtaattttgcaattagaggactctaaaaatagtacaaagaaaacaatatttttggtttgattgatttttaaaaaagtttatatgtaatttttacaagccccttgttgagcaagaaagcatacaataataaaataaaataaaaagcaaaagcccacacatatttcctcacaactaaaccacagtgaaagaaagagcaaacccaccgagccagtcatcgtcctttaggtaactcaactcccatctcaaaccaaaccaaacttttctctttccgtcttcatttctattttctttcgccaccgtcattttttttttgtttttgcagcagttatttcaccgattcgaagaatccaacatgtttctcacaaggactgagtatgaccgaggagtcaacaccttttctcccgaaggccgtttgtttcaggttgaatatgcaatcgaagccatcaagcttggatcaaccgcaattgggttgaagaccaaagagggcgtggttcttgctgtcgaaaagcgtattacttcacctctactggagcccagcagtgtagagaaaattatggaaattgatgaccacataggttgtgcaatgagtggattgattgctgatgctcgtacacttgttgagcatgcacgagttgaaactcagaatcataggttctcttacggtgaaccgatgacggttgagtccacaactcaagctctttgtgacctagccttgcgctttggtgaaggtgatgaagaatccatgtctcgaccatttggagtgtctcttctgattgctggtcatgacgagaatggacctagtctatactacactgatccttctggcacattttggcaatgcaatgcaaaagctattggctcaggatcagaaggtgctgacagctctctgcaagaacaatacaacaaggacttgactcttcaagaagctgagactattgctttatccattctgaagcaagttatggaagagaaggtcactcccaacaacgttgacattgccagggtggctccaacataccatctttataccccttctgaggtggaagctgtgataagtcgcctatgatttccatttgcgtgatttgcttcgagctttcatttcctattcctcctgcctgtacgtctatttaactagtgctgtgcctgaacttttttggtcgattattatacatgtagtgctgctttgtggccaagttgtacgctatactagattctcctgtcagatttgctgccattcagtctagttgaaattgaggactaaaatgccgtttctgatgtttactgaaaacacattataatgtctttcaagagccattcacaagatcggtgctaatatatatttttaattgtttctactatcaaaactactgggagccattttccaccttcattttttaaagtttcccaaaatttctcacctcatttaaataggaa

SEQ ID NO: 1164 - DNA, 1011 bp, Cirsium arvense
atagtcggaagcactttcaatcggaggaaatcgcaaatctcctcgatcggagctaatctatcatcaacagagatctattaagcttttaaactgaatcgaagatgtttctaaccaggactgagtatgatagaggtgttaacaccttctctccggaaggccggttatttcaggttgaatatgccattgaagccatcaagttgggttcgacagccattggtttgaagaccaaggaaggggttgttcttgctgttgagaagcgtattacctcgccacttctggagcctagtagtgttgagaaaattatggaaattgatgagcacattggctgtgcaatgagtggattaattgcagatgcccgaacactagttgaacatgctcgtgttgagacccagaatcataggttttcctacggtgagccaatgactgttgagtccactacccaagccctgtgtgatctggctctgcggtttggtgaaggagatgaagaatctatgtctcggccttttggggtgtctcttcttattgctggccatgatgaaaatggtcctagtctatactatacagatccatcggggacattttggcaatgcaatgggaaagctataggctcagggtctgaaggtgctgacagctccctccaggagcaatacaacaaggacttgacgctaaaagaagctgaaataattgctctttccatcttgaagcaagtcatggaagaaaaggtaacccccaataatgtggatattgcgaaggttgctcctacttatcacttgtacaccccggctgaagttgaagctgtcatcagtcgcctatgaaatgggaataagttgtagacggtctttgtttggttttcttgaacttgtattttgtactagattgccgagatgttattctgtttcccatcaactatggtatttgaacacaaggtcttttctatgtttgacaaaatcatggattaagttttaaagattatttagcactgatcttatctgaccaaaaaagaaaaaagta

SEQ ID NO: 1165 - DNA, 957 bp, Cirsium arvense
atcatcaatcggaggacatcgccaatctcttctctcggagctaatctatcatcaatagagatctgctaagctgttaaactgaatcgaagatgtttctaaccaggaccgagtatgataggggtgttaacaccttctctccagaaggccggttatttcaggttgaatatgccattgaagccatcaagttgggttcgacagccattggtttgaagaccaaggaaggggtcgttcttgctgttgaaaagcgtattacctcgccacttctggagcctagtagtgttgagaaaattatggaaattgatgagcatattggctgtgccatgagtggattaattgcagatgcccgcacactcgttgaacatgcacgtgtcgagacccagaatcataggttttcctatggtgagccaatgaccgttgagtccactacgcaagcgctgtgtgatctggctctgcggtttggtgaaggagatgaagaatctatgtctcggccttttggggtatctcttcttattgctggccatgatgaaaatggtcctagtctatactatacagatccatcgggcacattttggcaatgcaacgggaaagctataggctcaggctctgaaggtgctgacagctctctgcaggagcaatataataaggacttgacactaaaagaagctgaaataattgctctttccatcttgaagcaagtcatggaagaaaaggtaacccccaataatgtggatattgcgaaggttgctcctacttatcacttgtacaccccggctgaagttgaagctgtcatcagtcgcctatgaaatgctaataagttgtagacggtctttgtttggtttcgttgaacatgtatttgtactaaattgccgagatagtattctgtttccgcatcaagtatggtatttgaacacaatatcctgtttatgttgacaaaatcttggatttagttttaaagaa

SEQ ID NO: 1166 - DNA, 1088 bp, Citrus clementina
gtctttcctcaattgaactctcgctctaacacagttccggtatcgactcttaagctcaggtttccagatccaatcagcaacaaaacatgttccttacaaggactgagtatgatagaggagtgaacactttctctccagaaggaagattgtttcaggtcgaatatgctattgaggccattaagctgggttcaactgcaattgggttgaagacgaaagaaggggttgtgcttgctgtcgagaaacgcattacttcaccactgctggagcccagcagtgtggagaagattatggaaattgatgagcatataggatgtgctatgagtggattgattgctgatgctcgtacacttgttgaacatgcaagggttgaaactcagaatcatagattctcatatggtgagccaatgaccgtagaatctactacacaagcactctgtgacctggcgctacgctttggtgaaggcgatgaagaatccatgtctcgaccatttggagtatcccttcttattgctggatccgacgagaatggacctagcctgtactatacagatccatctggcacattctggcaatgcaatgcaaaggctattggttcaggttcagaaggagctgacagttctctccaagagcaatataacaaggatttaacccttcaggaagcagagacaattgctctatcaattttgaagcaagttatggaagaaaaggtcactccaaacaatgttgatatcgcaagggtagctccaacgtatcatctctataccccttctgaggtggaggctgtcatcaatcgcctatgagtatccagagaaaatcatctttaaaatttcttccctggcttcagtggtgtttcttcagttctttgcagtgcaagtgcacttcgtagtttgtttgttaggggaaacaattatatttgtttatgattgggattgcacccatttgaacctttctgttttggtgctgggtttgagctgcctatcataaccccgaaatctgtgtccgtgcagaactgaagtacttctcagttgtatgaacgatatgaacctaatggaaatttagattaaaatcttgtttttaagttaaacaca

SEQ ID NO: 1167 - DNA, 1155 bp, Vigna unguiculata
gcgtcttgagcaaggtaattaagctcagtgaggagcgagtgagcaagtaaatcaagttcctttcgaaatctggcgacccaaacaaaaaacttcaatctccactcgtctgtttagttccttcttctgaattctgaagatgtttctcacaaggaccgagtatgaccgaggagtcaacaccttttctcccgaaggccgtttgtttcaggttgaatatgcaattgaagcaatcaagcttggatcgactgcaattgggctgaagacgaaagagggtgttgtccttgcagttgaaaagcgcatcacttcacctctgctggagcctagtagtgttgagaaaattatggaaattgatgaccacataggttgtgctatgagtggattgattgctgatgctcgaacacttgttgagcatgcgcgggttgaaactcagaatcataggttctcctacggtgaaccaatgactgttgaatccaccactcaagctctttgtgaccttgccttgcgttttggtgaaggtgatgaagaatccatgtctcgaccatttggagtatctctcctcattgctggccatgacgagaatggacctagcttatattacaccgatccatctggcacgttttggcaatgcaatggaaaagctattggttctgggtcagaaggcgcagacagttctctacaggaacaattcaacaaggacctaacccttcaagaagccgaaaccattgctttatccattttgaagcaagtcatggaagaaaaggtcactcccaacaacgttgacattgccagggtagctccaacatatcatctttataccccctctgaggtggaagctgtgataagtcgtctatgatcttcttttcgtgatttttccttatttttaagtattatgcgggaactttttcgtggatgatgctacatctggtgctacacttgtggccatgttgtatgctgtacgagattctggtgtcttatttgctgcattcaggatgaaattgagaactagaggaaggattacaaggcgaaggaaaaacgaattaaaaaatatgctattaaaagaattttttaagatttatttttaaccgctttttagtcgtcgttgtcgaagaaaattactcagcttgatcaattatatcatcttaaatacggtttgatgtt

SEQ ID NO: 1168 - DNA, 1002 bp, Cynara scolymus
  misc_feature (4)..(4): n is a, c, g, or t
  misc_feature (8)..(11): n is a, c, g, or t
  misc_feature (13)..(19): n is a, c, g, or t
  misc_feature (21)..(22): n is a, c, g, or t
  misc_feature (24)..(24): n is a, c, g, or t
  misc_feature (27)..(30): n is a, c, g, or t
  misc_feature (32)..(32): n is a, c, g, or t
  misc_feature (34)..(40): n is a, c, g, or t
  misc_feature (42)..(48): n is a, c, g, or t
  misc_feature (918)..(918): n is a, c, g, or t
  misc_feature (971)..(971): n is a, c, g, or t
  misc_feature (990)..(991): n is a, c, g, or t
  misc_feature (995)..(995): n is a, c, g, or t
tcgngggnnnntnnnnnnnannancannnncntnnnnnnncnnnnnnnatcttttctcttggagctatctatcatcaacaaacagagatctattaagctgttaaactgaatcgaagatgtttctaaccaggaccgagtatgataggggtgttaacaccttttctccagaaggccggttatttcaggttgaatatgccattgaagccatcaagttgggttcaacagccattggtttgaagaccaaggaaggggtcgttcttgctgttgaaaagcgtattacctcaccacttctggaacctagtagtgttgagaaaattatggaaattgatgagcatattggctgtgccatgagtggattaattgcagatgcccgcacactcgttgaacatgcacgtgttgagacccagaatcataggttttcgtatggtgagccaatgactgttgagtccactacccaagccctgtgtgatctggccctgcgatttggtgaaggagatgaagaatctatgtctcggccttttggggtatctcttcttattgctggccatgatgaaaatggtcctagtctatactatacagatccatcgggcacattttggcaatgcaacgggaaagctataggctcaggctctgaaggtgctgacagctctctgcaggagcaatataacaaggacttgacgctaaaagaagctgaaataattgctctttccattttgaagcaagttatggaagaaaaggtaacccccaataatgtggatattgcgaaggttgctcctacttatcacttgtacaccccggctgaagttgaagctgtcatcagtcgcctatgaaatgcgaataagttgtagacgggctttgtttggtttccttgaacatgtattttgtactaaattgcttagatattattctgtttctgcntcaagtatgatatttgaacacaagatcctatttatgttgacaaatcatggatnaagtttttaacaatgtttnnttcnaaacagc

SEQ ID NO: 1169 - DNA, 942 bp, Flaveria ramosissima
aagaagggtttgtttaagcatatagactagagagagtatagagagatcatatagagtgacgaaacacaaggacacgagatcgcttcgctgctaatcgggagctaatatatcaccaccagaaaagatctattcatcaatcgaagatgtttctaacaaggactgagtatgataggggtgttaacaccttctctccagaaggccggttgtttcaggttgaatatgccattgaggccattaagttgggttccacagctattgggttgaagaccaaggaaggggttgttcttgctgttgaaaagcgtattacctctccgctcttggaacctagtagtgttgagaaaattatggaaattgatgaacacattggctgtgccatgagtggattaattgcagatgcccgtacactcgttgaacatgcacgggttgagacacagaatcataggttttcctatggtgagccaatgactgttgagtcaactacccaagccttgtgtgatctggcactgcgatttggtgaaggagatgaagaatctatgtctcgaccttttggggtatctcttcttattgcgggtcatgatgaaaatgggcctagtctatactacacggatccatcaggcaccttttggcagtgcaatgcaaaagccatagggtcaggctctgaaggtgctgacagctctctacaggagcaatataacaaggacttgagtttaaaagaagctgaaacaattgctctttccatcttgaagcaagtcatggaagaaaaggtaactcctaataatgtggatattgcaagggtggctcctacttatcacttgtacaccccggcagaggttgaagctgttatcagtcgtctataaaattgagtctgttctcgtttggtttaataaagtgtgtattttgtacttgaactgctgagattattttatgttccctttaggtatg

SEQ ID NO: 1170 - DNA, 834 bp, Flaveria ramosissima
attcatcaatcgaagatgtttctaacaaggactgagtatgatcggggtgttaacaccttctctccggaaggccggttgtttcaggttgaatatgccattgaggccattaagttgggttcgacagctattgggttgaagaccaaggaaggggttgttcttgctgttgaaaagcgtattacctcgccactcttggaacctagtagtgttgagaaaattatggaaattgatgaacacattggctgtgccatgagtggattaattgcagatgcccgtacactcgttgagcatgcacgggttgagacgcagaatcataggttttcctatggtgagccaatgactgttgagtcgactacccaagccttgtgtgatctggctctgcgatttggtgaaggagatgaagaatctatgtctcgaccttttggggtatctcttcttattgcgggtcatgatgaaaatggtcctagtctatactacacggatccatcaggcaccttttggcagtgcaatgcaaaagccatagggtcaggctctgaaggtgctgacagctctctacaggagcaatataacaaggacttgagtttaaaagaagctgaaacaattgctctttccatcttgaagcaagtcatggaagaaaaggtaactcctaataatgtggatattgcaagggtggctcctacttatcacttgtacaccccggcggaggttgaagctgttatcagtcgtctataaaattgcagtctgttctcatttggtttaataaagcgtgtattttgtacttgtactgctgagattttttatatgttcccttcaggtatggcattcgaacacaggatc

SEQ ID NO: 1171 - DNA, 1010 bp, Flaveria ramosissima
atagagagaaaggaaacagaaggagaggagatcgctgctaatacaatacaatttatcaccctccaacagaacagatctattctattttgttctattctattcatcaatcgaagatgtttctaacaaggaccgagtatgataggggtgtcaacaccttctctccagaaggccggctgtttcaggttgaatatgccattgaggccattaagttgggttcaacagctattgggttgaagaccaaggaaggggttgttcttgctgttgaaaagcgtattacctccccactcttggaacctagtagtgttgagaaaattatggaaattgatgaacacattggctgtgccatgagtggattaattgcagatgcccgtacactcgttgaacatgcacgggttgagacgcagaatcataggttttcctatggtgagccaatgactgttgagtcgactacccaagctttgtgtgatctggcactgcgatttggtgaaggagatgaagaatctatgtctcgaccttttggggtatctcttcttattgcaggtcatgatgaaaatggtcctagtctatactatacggatccatcaggcaccttttggcagtgcaatgcaaaagccatagggtcaggctctgaaggtgctgacagctctctgcaggagcaatataacaaggacttgagtttaaaagaagctgaaacaattgctctttccatcttgaaacaagtcatggaagaaaaggtgactcctaataatgtggatattgcaagggtggctcctacttatcacttgtacaccccggcagaggttgaagctgttatcagtcgtctataaaattgcactctgttgtttggtttaataaagcgtgtattttgtacttaaaaactgcggagtattttttatgttcccttcaggtatggcatttgaacacaggatctttcttttattgtgtatgtttgagaaaaatttatagtaaatttaaatggtggtagacctttgaaccttttacaactaaag

SEQ ID NO: 1172 - DNA, 967 bp, Flaveria ramosissima
tcgctgctaatatttcaccaacagaacagagatctattctattctattcatcaatcgaagatgtttctaacaaggaccgagtatgataggggtgtcaacaccttctctccagaaggccggttgtttcaggttgaatatgccattgaggccattaagttgggttcaacagctattgggttgaagaccaaggaaggggttgttcttgctgttgaaaagcgtattacctcgccactcttggaacctagcagtgttgagaaaattatggaaattgatgaacacattggctgtgccatgagtggattaattgcagatgcccgtacacttgttgaacacgcacgggttgagacacagaatcataggttttcctatggtgagccaatgactgttgagtcgactacccaagccttgtgtgatctggcactgcgatttggtgaaggagatgaagaatctatgtctcgaccttttggggtatctcttcttattgcaggtcatgatgaaaatggtcctagtctatactatacggatccatcaggcacattttggcagtgcaacgcgaaagccatagggtcaggctctgaaggtgctgacagctctctgcaggagcaatataacaaggacttgagtttaaaagaagctgaaacaatagctctttccattttgaagcaagtcatggaagaaaaggtaactcctaataatgtggatattgctagggtggctcctacttatcacttgtacacccccgcagaggtcgaagctgttatcagtcgtctataaaattgcagtctgttctcgtttggtttaataaagcgtgtattttgtacttgaactgctgagatttttttatgttcccttcaggtatggcatttgaacacaggatccttttttattgtgtatgtttgagaaaatcatggaattaaatggtggagaccttgaacttttttaacttgaaaaccaagtttcttgttga

SEQ ID NO: 1173 - DNA, 1052 bp, Actinidia deliciosa
  misc_feature (862)..(862): n is a, c, g, or t
  misc_feature (887)..(887): n is a, c, g, or t
ttgtcttgcctcgcaagaagggttctttctgaaaagcaaccgcatctaattcagagtgtcgagtttttgatcaaatcgaagatgtttctcacaaggactgaatacgatagaggagttaacaccttctctccggaaggtaggttgtttcaggttgaatatgcaattgaggccattaagctgggttctactgcaattgggttgaagaccaaggaaggagttgtgcttgctgttgagaagcgtatcacttcaccgctcctggagcccagtagcgtggagaaaattatggaaattgatgagcatattggatgtgctatgagtgggttgattgctgatgctcgtacgctagttgaacatgcacgagtcgaaactcaaaatcataggttttcatatggtgagcccatgaccgttgagtctactacacaagctctatgtgatttggccctgcgatttggtgaaggggatgaagaatctatgtctcgaccattcggagtgtctcttctaattgctggccatgatgagaatggaccgagcttatactacacggatccatctggcacgttctggcaatgcaatgcgaaagctattggatcaggttctgaaggtgctgacagctctttgcaggagcagtataacaaggacataacacttcaagaagcagaaacaatagccctttccatcctgaaacaagttatggaagaaaaagtgacccccaataatgttgacattgctaaggtttctccgacctaccatctctataccccttctgaggtggaggccgtaatcagtcgcctatgagaacagaatcccattaatatccatgatttgagatgactgtgttgggattatgttttattttctcacnagtactggatcttaagcttggagtntttttggagtgttgacttgtctgtactttttgatggacgtaaaaacctttcaagatactgccaagggtagtgcaaataggcactgaaaaagtacctgtttttaaaattgttgccattcatcttctgaataattagaattggatttagaatgtcaaaaaaaaaaaa

SEQ ID NO: 1174 - DNA, 1086 bp, Elaeis guineensis
cgtcagcgccgatctttagggttcgggcttccaatcctttcatccgatatgttcctcaccaggacggagtacgaccgaggggtcaataccttctcgccggagggaaggttgttccaggtcgaatacgctatcgaggccatcaagttgggttcgacggcgattggtttgaagacgaaggagggcgtggtgcttgcggtcgagaagcgcgtgacctcccccctgctggagccaagcagtgtggagaaaattatggagattgatgagcacattggttgtgcaatgagtggattgattgctgatgcacgaactcttgttgagcatgctcgcgttgaaactcagaatcacaggttttcttatggtgagccaatgactgttgagtcgactacgcaagctctatgtgatcttgctcttcgatttggtgaaggagatgaagaatccatgtcacgaccttttggagtgtctcttctgattgctggtcatgatgaaaatgggcccagcctgtaccacacagacccatctggcactttttggcaatgcaatgcaaaagcaatagggtcaggttcagaaggagctgacagctctcttcaggagcaatacaacaaggacttgacccttctagaggctgaaacaatagctctttctattttgaagcaagtgatggaggagaaggtaactccaaacaatgttgatattgccaaggttgctccaacttatcatctatactccccttctgaggttgaggctgtcattgctcgcctataaactatccatacaccttggtgttgtctgtttgccttctccaccataaacgtatatttgttaccaacatttttattttggagaacatttttgctgctgctgctgctggtggtggtggtagaatggcaacaggatctagtcttgtttgatggaagaaacttcttttaatacattagcatgcaatgtttgatatggtagagttctacagagttctaccgccaatgcttgaacgtcttttgttagtcaagtagcactagcattgaccatactgatgatacaaataaatcccttcattagttctcggtttgcaaaaaaaaaaaaaaaaaa

SEQ ID NO: 1175 - DNA, 1101 bp, Citrus sinensis
gtctttcctcaattgaactctcgctctaacacagttccggtatcaactcttaagctcaggtttccagatccaatcagcaacaaaacatgttccttacaaggactgagtatgatagaggagtgaacactttctctccagaaggaagattgtttcaggtcgaatatgctattgaggccattaagctgggttcaactgcaattgggttgaagacgaaagaaggggttgtgcttgctgtcgagaaacgcattacttcaccactgctggagcccagcagtgtggagaagattatggaaattgatgagcatataggatgtgctatgagtggattgattgctgatgctcgtacacttgttgaacatgcaagggttgaaactcagaatcatagattctcatatggtgagccaatgaccgtagaatctactacacaagcactctgtgacctggcgctacgctttggtgaaggcgatgaagaatccatgtctcgaccatttggagtatcccttcttattgctggatccgacgagaatggacctagcctgtactatacagatccatctggcacattctggcaatgcaatgcaaaggctattggttcaggttcagaaggagctgacagttctctccaagagcaatataacaaggatttaacccttcaggaagcagagacaattgctctatcaattttgaagcaagttatggaagaaaaggtcactccaaacaatgttgatatcgcaagggtagctccaacgtatcatctctataccccttctgaggtggaggctgtcatcaatcgcctatgagtatctggagaaaataattaaaaattcttccctggctttagcggtgtttcttcagttctttgcagtgcaagtgcacttggttgtttgtttgttaggggaaacaaatatatttgtttatgattgggattgcacccatttgaacctttctgttttggtgctgggtttgagctgcctatcatacccccgaaatctgtgtccgtgcagaactgaagtacttctcagtagtatgaacgatatgaacctttgcatgtgttaatcttgtttttagattaaaatttagattaaaatcttgtttttaagt

SEQ ID NO: 1176 - DNA, 917 bp, Pisum sativum
caaacctcaagtgtgaagactgaagagcacagagaaacaacccacaaacgtcttttagtgatctaatctaatcgaatccaaaatgtttctcacaaggactgagtatgaccgaggagtcaacaccttttctcctgaaggccgtttgtttcaggttgaatatgcgattgaagccatcaagcttggatcgaccgcaattggtttgaagacgaaagaaggtgtggtccttgcagttgaaaagcgtattacttcccctctactggagcctagcagcgttgagaaaattatggaaattgatgaccatattggttgtgcaatgagtggattgattgctgatgctcgtacacttgttgagcatgcacgagttgaaactcagaatcataggttctcttacggtgaaccgatgactgtagagtccacaactcaagctctttgtgacctagctttgcgcttcggtgaaggcgatgaagaatcaatgtctcgaccatttggagtgtctctcctcattgctggccatgacgagaatggacctagcctatattatactgatccttctggcacattctggcaatgtaatgcaaaagctattggttcaggatcagaaggtgctgacagttctcttcaagaacaatacaacaaggaattatctcttcaagaagctgagactattgctttatccattctgaagcaagttatggaagagaaggttactccaaacaatgttgacattgccagggtggctccagcatatcatctttataccccttctgaggtggaagctgtgataagtcgcctatgattttcatccattcgggtgatttgtttcgtgcctttgtttctcctgtacgactatttaattagctgtgcgctgaaacttttatgttgcatgtaatgctgctgcctttatgcccaagtttgta

SEQ ID NO: 1177 - DNA, 1186 bp, Cajanus cajan
gagaaatccccttgcacaagcaaattgagcacaaaagccgaaccctctctactcccagacacagcaacacaaaccccactctcagagtctctctccgtcatttcctcgattcctatccaagatgtttctcaccaggactgagtatgaccgaggagtcaacaccttttctcccgaaggccgtttgtttcaggttgaatatgcaattgaagccatcaagctgggatcaactgcgattgggttgaagaccaaagagggtgttgtccttgctgttgagaagcgcatcacttcgcccctgctggagcccagtagtgtcgagaaaataatggaaattgatgcacacataggttgtgcaatgagcggattgattgctgatgctcgaacacttgttgaacatgcacgggtggaaactcagaatcacaggttctcctatggtgagccaatgacagttgagtccacaactcaagctctttgtgatttagccttgcgttttggtgaaggtgatgaagaatccatgtcccgaccatttggagtatcccttctcattgctggccatgatgagaatggacctagcttatattacactgatccatctggcacattttggcaatgcactgcaaaagctattggttcagggtcagaaggtgctgacagctccttgcaagaacagtacaacaaggacctaacacttcaagaagccgagactatagctttatccattttgaagcaagttatggaagagaaggtcactcccaacaacgttgacattgccaaggtggctccaacatatcatctttataccccctctgaggtggaagctgtgataagtcgtctatgattttcttttcatgattttctctatttctgcccgtacctctaattatgcggaaacttttttggtggatgatgctacatgtagtgctacacgtgtggccaagttgtactctggtgtcatatttgctgcattcaatctagttggaattgaggactaaaagggtttcaatgtttagaaagccgagaactatacctgaataccgtgctttattttttttaactgtagaagatataaaggatgggagacgttgcagataaaaagatttgttcaacaatctatgcgcattatctacatactattaaaagaattaagttttatttttttaccatcttttaatccttgaagtaaagaaaa

SEQ ID NO: 1178 - DNA, 1127 bp, Papaver somniferum
cagacaactccttcactactaaacttatttcacaagtccgaaatccctcacacacccacacgaagaagaagacttgaatcctcagttgaaggtcatatgatttaaatttaaaccataactgaagatgtttcttacaaggactgagtatgatagaggtgtgaatactttctcacctgaaggtagattgtttcaggttgagtatgcgattgaagctattaagcttggatcaactgcgataggcctgaaaactaaagaaggtgtagtgcttgctgttgagaagcgtgtcacttctccattgctggagccaagtagtgtagagaaaattatggaaatcgatgagcatataggttgtgcaatgagtggactaattgccgatgctcatacacttgttgaacatgcacgagttgagactcagaatcacaagttctcatatggggagcctatgactgttgaatccacaacacaagctttatgtgatcttgccctacgatttggtgaaggcgaagaagagtccatgtctcggccttttggtgtatcacttctcattgctggtcatgacgaaaatgggccaagcctatactacacagacccgtctggcacattttggcagtgtaatgcaaaagcaataggatcaggttctgagggagcagacagctctttgcaggagcagttcaacaaggagatgagactccaagaagccgaaacagttgctctttcgatcttgaagcaagtgatggaagagaaggtgactcccaacaatgttgacattgcaaaggttgctccaaagtaccatttgtattctccttctgaggtggaggctgtcatcgctcgtttatagaaagaaaacccttaatcattctcttcggcaaggttttcctgtctttacttcccaccgccttcaagggatgacttcgttaggagataaactttggtattcttttaaattactttggtattcttgatcatgagtgtcagattttacaatcacttggttgacatgaaaacattggaagttaagattcccaaatgaaaagttatgatgcttatgatggttgttcttggtgtttgctgtctgcgtttgttttttaccttttccgtgttgacagaatgccatggatgttacgaaa

SEQ ID NO: 1179 - DNA, 902 bp, Carthamus tinctorius
cggggatagtcggaggtgtttgaatcggaggaatcgcaaatctcctcgcttggagctaatctatcatcaacagagatctattaagcttttaaactgaatcgaagatgtttctaaccaggaccgagtatgataggggtgttaacaccttctctccagaaggccgcttatttcaggttgaatatgccattgaagccatcaagttgggttcgacagccattggtttgaagaccaaggaaggcgttgttcttgctgttgaaaagcgtattacctcgccacttctggagcctagcagtgttgagaaaattatggaaattgatgagcatattggttgtgcaatgagtggattaattgcagatgcccgcacactcgttgaacatgcacgtgttgagacccagaatcataggttttcctatggggagccaatgactgttgagtccactacccaagccctgtgtgatctggccctgcgatttggtgaaggggatgaagaatctatgtctcggccttttggggtatctcttcttattgctggacatgatgaaaatggtcctagtctatactatacagatccctcggggacattttggcaatgcaacgggaaagctataggctcaggctctgaaggtgctgacagctctctgcaggagcaatacaacaaggacttgacgctaaaagaagctgaaataattgctctttccatcttgaagcaagtcatggaagaaaaggtaacccccaataatgtggatattgcgaaggttgctcctacttatcacttgtacaccccggctgaagttgaagctgtcatcagtcgcctatgaaattccaataagttgtagacggtctttgtttggttttcttgaacttgtattttgtactaaaatgctgagatgttattctgtttc

SEQ ID NO: 1180 - DNA, 972 bp, Scabiosa columbaria
catataattcaagtacgagatcaactttgcaatctcgaatccttctccttctcatctgctcaaggtatttgcaactgcaattgcagcaagttctaggctttttaaatctaattgaagatgtttctcaccaggactgagtacgatagaggtgttaataccttctcaccggaaggccgattgtttcaagttgaatatgccattgaagccatcaagttgggttctacggcaattgggttgaagaccaaggaaggggttgttctcgctgttgagaagcgtattacctccccacttctggagcccagcagcgtggagaagattatggaaattgatgagcatattggctgtgcaatgagtggcttgattgctgatgcacgtacacttgttgaacatgcacgggttgaaacgcagaatcataggttttcttatggtgaacctatgactgttgaatccaccacacaagctctttgtgatttggccttgcgatttggggaaggtgatgaagaatcaatgtctcgaccttttggtgtttctctacttattgctggtcatgatgagaatggccccagcttatactatacagatccttctggcacattttggcaatgcaatggaaaagcaattggttcaggttcagaaggtgctgatagctctttgcaggaacagtataacaaggatttgacactaaaagaagctgagacaatagctctttccatcctgaagcaagttatggaagagaaggtgactcccaataatgttgacattgcaaaagtcgcccctagttatcatttatacacgcctgctgaggtggaggaagtgatcagccgcctgtgaagagtttatgtactcatcagctaagaggggtggctattatgaacttgatttgtatatcttcttattgttcttgaagtgaaccatgcaatagtttgctcatttagtttcaccaaataacaaatcttccctgtatgttggtcg

SEQ ID NO: 1181 - DNA, 943 bp, Valeriana officinalis
ttccaaatctgacgactgcaactctctctcgaagctaatcgatttttacagctagattttaaaccgaagatgtttctcaccaggaccgagtatgatagaggtgtcaacaccttctcacccgaaggtcgattgttccaggttgaatatgcgattgaggcaattaagttgggttctactgcaatcgggttaaagaccaaggaaggggttgttcttgcagttgagaagcggattacgtcgccactactggagcctagtagcgtggagaaaatcatggaaatcgatgagcatattggctgtgcaatgagtgggttaattgctgatgcccgcacacttgttgaacatgcacgagttgaaacacagaatcataggttctcttatggcgagccgatgactgtcgagtcaaccactcaagccttgtgtgatttggctttgcgattcggtgaaggcgaagaagaatctatgtctcgaccttttggggtatctcttctaatcgccggacacgacgagaatggccccagcctgtactacacagatccttctggtacattttggcaatgcaatgggaaagcaatcgggtctggttccgaaggtgctgatagttctttgcaagagcaatacaacaaggatttgacacttaaagaagctgaaacaatagctctttcaatccttaagcaagttatggaggaaaaggttaccccaaataacgtggatatcgcaaaggttgctcctaaataccatttgtacaccccttctgaagtggaggatgtcatcaaccgcctatgagaaccaaatgcttattcttctgttcgggcttcccttatcacttatgaggataatacattttatgcagacttcagtactacttttctattttggaatctgatggaaacttttgcgacttaaatgacctgtaatctgaatatttctttattgctgcattttc

SEQ ID NO: 1182 - DNA, 1199 bp, Citrullus lanatus
gcaagaaagggtctgcttaaagcttactgaacaaagctgttgctgctgcttcttcttcttcttcttcttcttcttcagaatctagccgtttacttcaattgaatcgcaaaatgtttctcaccaggaccgagtatgataggggtgtgaacaccttctctcctgaaggtcgattgtttcaggttgagtacgcgattgaggctattaagcttggttcgacggctattggtttgaaaacaaaggatggcgttgtgcttgcggttgagaaacgtattacatctccactactggaaccaagtagtgtggaaaaaatcatggaaattgatgagcatataggatgtgcaatgagtggattaattgctgatgctcacacacttgttgaacatgctcgagttgagacacagaaccatcgattctcatatggcgaaccgatgactgtggagtctacaacacaagctctttgtgatttagccctaagattcggcgaaggcgacgaggagtccatgtctcgaccatttggtgtagctcttctcattgctggccatgatgagaaggggccgagcttattctacactgatccatctggcactttctggcaatgcaatgctaaagctatcggttcaggttctgaaggtgcagatagctctctgcaagagcaatacaacaaggacctaactcttcaagaagctgaaacaatagcactttccattctgaagcaagttatggaagagaaggtaactcccaacaatgtcgatattgcaaaggtggctccaacataccatctgtacacccctgcagaggtggaggcagtcattagccggctatgagaggttctttcgaaaatgttgtggactgctgttatgtttcttgtcactggcatgtatttgtactcttctttgtctggtgagggagaatctcatgttttcggctactttctaagctattggtgatgtgtttatcgatagcttacagattaattatgggacattcttgatgggttattgcaaacctggatgaacaatttgattagtccttttacgaaagctccaaacgttatattctgatgcgccattttgtttcaaaacgtgagaatatcttgtgggaaacaggaaacattcgagttaacagcatgcagattcaacgtctatattcttgttcgtctttcttcaattcttttgtttttgttttgaatgtgaccctta

SEQ ID NO: 1183 - DNA, 833 bp, Antirrhinum majus
aagcactaaacccacaaaagataataatctcagagatctgcttcttcttcattcaattcgaatttgaaaattcataaacctaatcgaaaatgttcctcacaaggactgagtatgatagaggagtgaacactttctcgccggaaggtcgattgtttcaagttgaatatgcaattgaagctatcaagttgggatccactgcgattgggttgaagactaaggaaggagtagttctggctgttgagaagcgaattacatcgccgcttttggagcctagcagtgtggagaaaattatggaaattgatgaacatatcgggtgtgccatgagtggcttaattgctgatgcccgtacgttggtggaacacgcccgagttgaaactcagaatcataggttctcatatggcgagccaatgaccgttgagtctactacgcaagctctctgtgatcttgccttgcgatttggtgagggtgacgaagaatccatgtcgagacctttcggtgtttcccttcttattgctggtcatgatgagaatggccctagcttgtactatactgatccttctggtacattctggcaatgcaatgcaaaggccattgggtcaggttctgaaggtgctgacagctctttgcaggagcagtataacaaggatctaactcttaaagaagctgaaccattgcactctctattctaaagcaagttatggaggaaaaggttacaccaaacaatgttgatattgcgaaggtatcgccaacataccatctttactcccctgctgaagttgaagcagttatcagtcgcctatgagaagtactgtctgttgcatttgttactgctt

SEQ ID NO: 1184 - DNA, 991 bp, Sarracenia psittacina
ctcaaggagggttcggccagaggttcctctctttttcttccccaattctcaaagctttctttctcatctaacacagacaaattctagagcttttgatcgaatcgaagatgtttctcacaaggactgaatacgataggggagtcaatacattctctccggagggtcgactgtttcaggttgaatatgccattgaggccatcaagctaggatccaccgcaattgggttgaagaccaaggaaggagttgtgcttgctgttgagaagcgtatcacttccccctcctggagcccagcagtgtggagaaaattatggaaattgatgagcacattggatgtgcaatgagcgggctgattgctgatgctcgtacacttgtcgaacatgcacgagtggaaactcaaaatcataggttctcatatggagagcccatgaccgttgagtctactacacaagctctgtgtgatttggccctgcgatttggtgaaggggacgaagaatctatgtctcgaccatttggagtatctcttctaattgctggctatgatgagaatggacccagcttatattacacagatccatctggcacattctggcaatgcaatgcaaaagctattgggtctggttctgaaggtgctgacagctctttgcaggagcagtataataaggacattacacttaaagaagcagaaacaatagccctttccatcctgaaacaagttatggaagaaaaggtgaccccaaataatgttgacattgcgaaggttgctccttcttaccatctgtatacccctgctgaggtggaagctgtaatcagtcgcctatgagatgaaaaacccgtcaatatctttcagtcattggttgggttttaattacaggtgctcttgcatacattttagatgattttgccgggattatgatttatttttcttagtattcattttatcccaggaattgtgtgttactcaatacgtactctaatggatgtaaaaacttat

SEQ ID NO: 1185 - DNA, 1089 bp, Phaseolus vulgaris
agtgaggagcgagtgagagagcaagcaaatcaagtgcccttttggtacctcgtgacccgaacaaaaagcttctcattctcatctcttctattttgcttctccttctgaattctgaagatgtttctcacaaggactgagtatgaccgaggagtcaacaccttttctcccgaaggccgtttgtttcaggttgaatatgcaattgaagcaatcaagcttggatcgactgcgattgggctgaagaccaaagagggtgttgtccttgcagttgaaaaacgcatcacttctcctctgctggagcctagtagtgttgagaaaattatggaaattgatgaccacattggttgtgctatgagtggattgattgcggatgctcgaacactcgttgagcatgcacgggttgaaactcagaatcataggttctcctatggtgaaccaatgaccgttgagtccactacccaagctctttgtgatctagccttgcgttttggtgaaggtgatgaagaatccatgtctagaccatttggagtatctctcctcattgctggacatgacgagaatggaccttgcttatattacactgatccatctggcacgttttggcaatgcaatggaaaagctatcggttctgggtcagaaggcgcagacagttctctacaagagcaattcaacaaggacctaacccttcaagaagccgagaccattgctttatccattttgaagcaagttatggaagagaaggtcactcccaacaacgttgacattgccagggtggctccaacatatcatctttataccccctctgaggtggaagctgtgataagtcgtctatgattttctttcgtgatttttcctaatttttaagtcttatgcgggaactttttttcgtggatgatgctacatgtggtgctacacttgtggccaagttgtacgctgtacgagattatggtgtcttattgaggactagccaaggattacaacttccaatgatcccggatgggggaaaccaaggaaaaacgaattacaaaatatgctattaaaaaaatttaagattttttttttcagccgttttttaatccttgtggaagaaaa

SEQ ID NO: 1186 - DNA, 989 bp, Arabidopsis lyrata
gagtgcttgtcttcgggagctaaaaaggaactgggaagagttgtttcttcgatttcgtagatcaattttcagctgacattgaggtttgtgtcagatcgaaatcgagaagaagatgtttctcactaggactgagtatgacagaggagtcaatactttttctcctgaaggtcgtctctttcaggttgagtatgccattgaggctatcaagcttggttctactgctattggcgtaaagacgaaagagggggttgttcttgcagtcgagaagcgtattacttcgcctttgctggaaccgagcagtgttgagaagattatggaaattgatgaccatataggttgtgccatgagtggtctgattgctgatgcgcgaacacttgttgagcatgcacgagtagagacccaaaaccacaggttctcgtatggtgagccaatgactgtagaatctacaacacaagctttgtgtgatcttgctttacggtttggtgaaggagatgaagagtcaatgtctcgtccatttggagtatcccttctcattgccgggcatgatgaaaatggaccgagcctgtactacacagatccatcgggaacattctggcaatgcaacgcaaaggcaattgggtcaggctcagaaggagctgatagttctctccaagagcaattcaacaaggatataactcttcaagaagctgaaacaatcgctgtatctatcctaaagcaagtaatggaagaaaaggtgactccaaacaatgtcgacattgccaaagtagcacccgcatatcacctctacactcctcaggaggttgaagccgtcatcagtcgtctatgaagaaataaaccggcattctcttcatgttatcttacctggtctgtcgggtaatttagcaggcttggtatgcttccggttatctaaaccaaagaccttctttcacaaatggcacaaaataatcctatcgagttgagttttattgagctttctatctacatttttt

SEQ ID NO: 1187 - DNA, 1153 bp, Phaseolus vulgaris
tcttgggaagctaactaggctcagtgaggagcgagtgagagagcaagcaaatcaagtgcccttttggtacctcgtgacccaaacaaaaagcttctcattctcatctcttctattttgcttctccttctgaattctgaagatgtttctcacaaggactgagtatgaccgaggagtcaacaccttttctcccgaaggccgtttgtttcaggttgaatatgcaattgaagcaatcaagcttggatcgactgcgattgggctgaagaccaaagagggtgttgtccttgcagttgaaaaacgcatcacttctcctctgctggagcctagtagtgttgagaaaattatggaaattgatgaccacattggttgtgctatgagtggattgattgcggatgctcgaacactcgttgagcatgcacgggttgaaactcagaatcataggttctcctatggtgaaccaatgaccgttgagtccactacccaagctctttgtgatctagccttgcgttttggtgaaggtgatgaagaatccatgtctagaccatttggagtatctctcctcattgctggacatgacgagaatggaccttgcttatattacactgatccatctggcacgttttggcaatgcaatggaaaagctatcggttctgggtcagaaggcgcagacagttctctacaagagcaattcaacaaggacctaacccttcaagaagccgagaccattgctttatccattttgaagcaagttatggaagagaaggtcactcccaacaacgttgacattgccagggtggctccaacatatcatctttataccccctctgaggtggaagctgtgataagtcgtctatgattttctttcgtgatttttcctaatttttaagtcttatgcgggaactttttttcgtggatgatgctacatgtggtgctacacttgtggccaagttgtacgctgtacgagattatggtgtcttattgaggactagccaaggattacaacttccaatgatcccggatgggggaaaccaaggaaaaacgaattacaaaatatgctattaaaaaaatttaagatttttttttcagccgttttttaatccttgtggaagaaaattgccttgatcgaatgtattatcttaaatacagtttgatgtta

SEQ ID NO: 1188 - DNA, 826 bp, Fagus grandifolia
cagtctctcacacaccaacacatcaatcaaaacgggtttattatcgaatcgattggaaaatgtttctcacaaggactgagtatgacagaggagtgaacaccttctctccagaaggccggctgtttcaagtcgagtatgccattgaggcaatcaagctgggttcaactgcgattgggttgaagacaaaagaaggagttgtgcttgcagttgagaaacgtatcacttccccgctactggaacccagcagtgtggagaaaattatggagattgatgagcatataggatgtgctatgagtggattgattgccgatgctcgaacacttgttgagcatgcacgggtggaaactcagaaccataggttctcctatggtgagccaatgactgtggagtctacaacacaagctctttgtgatctggccctacgatttggcgaaggtgatgaagaatcaatgtctcgaccatttggagtttctcttctcattgccggccatgatgagaatgggcccagcttatactatactgatccatcgggcacattttggcaatgcaatgcaaaagctattggttcaggttcagagggcgcagacagctctcttcaagagcaatacaacaaggacatcactcttcaagaagcggaaaccattgctctttccattctgaggcaggttatggaagaaaaggtgacgcccaataatgttgatattgcaaaggtggctgcaacataccatctatataccccttcagaggtggaggctgtcattaatcgcctatgagtgcaagccctgcatgacaatctgtctccaattgttcaatactgcgttaatat

SEQ ID NO: 1189 - DNA, 1039 bp, Fagus grandifolia
tttcaatcagagtaaagctcttcagtctctcacacaccaacacatcaatcaaaacgggtttattatcgaatcgattggaaaatgtttctcacaaggactgagtatgacagaggagtgaacaccttctctccagaaggccggttgtttcaagtcgaatatgccattgaggcaatcaagctgggttcaactgcgattgggttgaagacaaaagaaggagttgtgcttgcggttgagaaacgtatcacttccccgctactggaacccagcagtgtggagaaaattatggagattgatgagcatataggatgtgctatgagcggattgattgccgatgctcgaacacttgttgagcatgcacgggtggaaactcagaaccataggttctcctatggtgagccaatgactgtggagtctacaacacaagctctttgtgatctggccctacgatttggcgaaggtgatgaagaatcaatgtctcgaccatttggagtttctctcctcattgccggccatgatgagaatgggcccagcttatactatactgatccatcgggcacattttggcaatgcaatgcaaaagctattggttcgggttcagagggtgcagacagctctcttcaagagcaatacaacaaggacatcactcttcaagaagcggaaaccattgctctttccattctgaggcaggttatggaagaaaaggtgacgcccaataatgttgatattgcaaaggtggctgcaacataccatctatataccccttcagaggtggaggctgtcattaatcgcctatgagtgcaagccctcgcatgacaatctgtctcctattgtttcaatactgcgtttaattattttgatgaggaaaagattgtgtttgtttcttggggattcaaactagtttacaattatgcaatgtggtattgaagagtgctgcctagttgagggtagcataattttatagcacttagtgaaagtaaaatctcttgatggattgatgacaaacgctgtatcattatgaaaaactaaaacaaaatggaag

SEQ ID NO: 1190 - DNA, 1204 bp, Vaccinium corymbosum
gtctcaggtggccattacgccggggggagcgcacacatagaattagctgtttcactctctcccaccgtagttgcttgcacagcaagaagaaggattccattcagcaaagcgcacgcacataaattagctgctctcttatctcccgcaaaaatctcgacatctactgtcctctgctaacagaaaccgactttgaggtttttgagcgaatagaagatgtttctcactaggactgaatacgatagaggggtcaataccttctctccagaaggtcgattgtttcaggttgaatatgccattgaggcaattaagctgggttccactgcaattgggttgaagaccaaggagggcgttgttcttgctgttgagaagcgtatcacttctccactcctggagcccagcagtgtggagaaaattatggaaattgatgatcatattggctgtgcaatgagtgggctgattgctgatgctcgtactctcgttgaacatgctcgagttgaaactcaaaatcacaggttctcatatggtgagcccatgactgttgagtctactacgcaagctctatgtgacttggccttgcgatttggtgaaggggatgaagaatctatgtctcgaccatttggagtatctcttctgattgctggccatgatgagaatggacctagcctatactacacagatccatctggtactttctggcaatgcaatgcgaaagctattggttcaggttctgaaggtgctgacagctctttacaggagcaatataacaaggacataacacttaaagaagccgaaacaatagctctttccatcttgaagcaagttatggaagaaaaggttacacccaataatgtggacatcgcaaaggttgctccgacttaccatttgtataccccttctgaggtggaggctgtaataactcgcctatgagaagaaagtccccttgttatctcctatttgttggttgggcgtttagttacagttacggatgcgtatgatttaaatcgctttgttgggtgcttgttatttgctttttgtattggactctttgacaaggcaatcgtttttgttttgttacacaatcacgtacttggatgtaataacttctttcaagatcttgaaccaaaatctttgaggcttgtggcttcttgttaaggaagcaatgcataaaggcagacgagctaggcagtggatacagaattgaaac

SEQ ID NO: 1191 - DNA, 999 bp, Vaccinium corymbosum
aaatcgttacaagttcgtcctcagtaatcatctttgtcatcgctgattctacagtaattgacctaatcgaggatgtttctcacaaggactgagtacgatagaggtgtcaataccttctctccagaaggtcgattgttccaagttgaatatgccattgaggccatcaagctgggatccaccgcaattgggttgaagaccaaggaaggggttgtgcttgctgttgagaagcgtatcacttcaccactcttggagcccagcagtgtggagaaaattatggaaattgatgatcatattggatgtgcaatgagtggattgattgctgatgctcgtacactagtcgaacatgcacgagtggaaactcaaaaccataggttttcatatggtgagcccatgactgttgagtctactacacaagctctgtgtgatttggccctgcgatttggtgaaggggatgaagagtctatgtctcgaccatttggagtatctcttctcattgctggccatgacgagaatggtcctagcttgtattacacagatccatcaggcacattctggcagtgcaatgcgaaagctattggatcaggttctgaaggtgctgacagttctttacaggagcagtataacaaggacattacacttaaagaagcagaaacaatagctctttcaatcctgaaacaagttatggaagagaaggtgacccccaataatgtcgacattgcaaaggttgctccaagttatcatctgtataccccttctgaggttgaggctgtcataagtcgtttatgagaggaaatcccatcaaaaccttccagtggttggttggcctttttatcagtgctacttatacatgaatttgagatgacactgctgggattatggttaagttttttccgaatattggattttaaccagagaattgttattgagttgttactcaaccatgtattctaatgaatgtagaatttttctgaagataatgaatttgcagacctgtgttgg

SEQ ID NO: 1192 - DNA, 987 bp, Cleome spinosa
ggcaggagcagactgacgaagaaagcagcatacttcggttcgcagatcgaggaacggggtttcactcctttgtgctgacactaaggcttttcagatcgaattctgagaagaagatgttcctcaccaggactgagtatgacagaggtgtcaacaccttttctcctgaaggtcggctgtttcaagtcgagtatgccattgaagccatcaagcttggctctactgctattggagtaaagaccaaggaaggagttgtgcttgctgtcgagaagcgtatcacctcgcctcttctggagccgagcagtgtggagaaaattatggaaattgaccagcacataggatgtgccatgagcggtctgattgctgatgcccgtacactagttgagcatgcacgtgttgaaactcaaaatcacaggttctcgtatggtgagccaatgactgtagagtctacaacacaggctctttgcgatcttgctttaagattcggtgaaggagatgaagagtcaatgtcacggccattcggagtatctcttctcattgctggtcacgacgaaaatggaccgagcctatactacacagatccatcaggcacattctggcagtgcaacgctaaggccattggttcagggtcagaaggggctgacagttccctgcaagaacaattcaacaaggatttgactctccaagaagctgaaactattgccatgtccatcctcaagcaagtgatggaagaaaaggtgactccaagtaacgtggacatcgccaaggtggcacccggataccatctctacactccacaagaggtggaggcagtcatcacccgtctttgatgaaaaaatcttccggtgggaatcttcgaatttccggtgagtgatttctcaacttgtgtctgcttctggatctgagaccaagaaactgtcttttgcacctatggaaacaaacaaacattttcacctattgtctgtcaaatggtgaatgtcaaaacactca

SEQ ID NO: 1193 - DNA, 1006 bp, Eschscholzia californica
gtttcttaccaggaccgagtatgatagaggtgtaaacaccttctctcctgaaggtcgtttatttcaagttgaatatgccattgaggcaatcaagttgggatcaactgcaattgggttgaagaccaaagaaggagttgtgcttgctgtcgaaaagcgtatcacttcaccacttctggaacctagtagcgtggagaaaattatggaaattgatgagcatatagggtgtgcaatgagcggattgattgctgatgctcgtactctcgttgaacatgcacgagttgaaacacagaatcacaagttctcatatggtgaaccaatgactgttgaatcgacaacacaagctctatgtgatcttgccctacgttttggtgaaggtgacgaagaatccatgtctcggccttttggtgtatctcttctgattgccggtcacgatgaaaatggacctagcctatactacacagacccatccggcacattttggcagtgcaacgcaaaagcaataggttcaggttctgaaggtgcagacagctctttgcaggagcaatttaacaaggaaatgacacttcaggaagctgaaacagttgctctttcgatcttgaagcaagtgatggaagagaaggtcactcccaacaatgtcgacattgcaaaggtttcaccaacttaccatctttattctcctgcggaggtggaagctgtcatcgctcgtctatgagaaaacctctttcgagtttcatccatgtcagggaaaagctcatatattgttcttctctaccttctaccctaattggtatacctatctgtaagaacttagatgaggaaggatttgtcgtgaatgatgtagtcaactattcaaccgaggaacctatatctcgtgattgagtttcatttcggaatggaaacttttgtcttcaaaaacatggtagggcaatatcaataacttgaaatttggtgatgtatgggttatgaccaaaatcttataacatggtgatgattatggcaaattttt

SEQ ID NO: 1194 - DNA, 1035 bp, Euphorbia peplus
aaaagccgaagtaaacagactctactcttctcccttctcttcattctccaaggatccgactgccattttagatcgaatcaaacatgtttctcaccaggactgaatatgatagaggagtcaacactttctctccggaaggaagattgtttcaggttgaatatgccatcgaagctattaagcttggttcaactgctattgggttaaagacaaaagaaggtgttgttcttgcagttgagaagcgtatcacttccccattgctggagcctagcagtgtggagaaagttatggaaattgatgagcatattggatgtgctatgagtgggttaattgcagatgctcgtacacttgttgaacatgctcgtgttgaaactcagaaccatagattctcttatggtgagcccatgacagtggagtctacaacacaagctctttgtgatctggctctacggtttggtgaaggtgatgaagaatccatgtctcggccttttggagtttctcttctcattgctggtcatgatgagcatggtcctagcctttattatacagatccatctgggacattttggcaatgcaatgcaaaggctattggttccggctcagaaggtgcagatagctccctgcaagagcaatataacaaggacatcacacttcaagaggctgagacaatcgccctttccattttgaaacaagttatggaagaaaaggtgacacctaacaatgttgacattgcgagggtagctcccacatatcatttgtatacccctgctgaggtggaaacagtcattggacgcctatgagaagaaaagaatggtgttatggaatttcacatgtattttccaattgttggtattgtcattcccgtgagggtagcagaagattggaactcgtagaatctttatggttttcttgaattgggactcaaattgtgctctttgattgtcaattatgtacttcaaacttgtcggaatgaaacaccaaccccgttagactttgttcggttagaaattgaagtaccactagtgttgttctcaaaaa

SEQ ID NO: 1195 - DNA, 1213 bp, Elaeis guineensis
gcctcctcatctgctttgcctctccgagtagcagcctacctttatatcgcgcggcggatccaagaaaaccccttcacagtcctctttctctctccccctccctcgaccgatctctaggattcgcgcttccaatcctttcttcgagatgttcctcaccaggactgagtacgaccgaggggtcaacactttctcgccggagggaaggttattccaggtcgagtacgccatcgaggctatcaagttggggtcgacggcgattggattgaagacgaaggaaggcgtggtgcttgcggtcgagaagcgggtgacttcccccctgctggagccgagtagtgtggagaaaattatggagattgatgagcagataggttgtgcaatgagtgggttgattgctgatgcacggactcttgttgagcatgctcgtgttgaaactcagaatcacaggttttcttatggtgagccaatgactgttgagtcgaccacacaagctctttgtgatcttgctcttcgatttggtgaaggagatgaagaatccatgtcacgaccttttggggtgtctcttctgattgctggtcatgatgaaaacgggcccagcctctactacacagatccatctggcacgttttggcaatgcaatgcaaaagcaataggatcaggttcagaaggagcggacagctctcttcaggagcaatacaacaaggacttgacccttcaagaggctgaaaccatagctctctctattttgaagcaagtgatggaagagaaggtgactccaaacaatgttgacattgccagggttgctccaacttatcatctttactccccttctgaggtcgagtctgtcatcactcgcctataaattaaccatttatcttcttcttgtttatttgccctccaccataacttgcctttgtttccaacatttttatttggagaatgtttctgatggtggtggtggtggtagaatgggaagaaaaactagtcttgttcaacagaaaggattttcttttgctgtagcattagcatgcggtgtttgacatggtaaagatttatactgccaatgcctggttctcttttgctagtcatgtgtcagtagcattgactattctgttacaaataaatccattcattgatactcaaaaaaaaaaaaaagagacgtacgaccgaacggacaaccgaacggaagggggtaaaggtaagggagacagagaga

SEQ ID NO: 1196 - DNA, 1122 bp, Arachis hypogaea
gagcaagcaaagcaaagccaagccaataagcaaaagcccacatcgccgctcttcactcctcagaggcgcaaagatcaagacacagtataagctgaggaagttgaagccatttttgggtaagtgtgatttcatcgaatcaaatcgaagatgttccttacaaggaccgagtatgaccgaggagtcaacaccttttctcctgaaggccgtttgtttcaggttgaatatgcaattgaggccatcaagctgggttcaactgctattgggttgaagacaaaacacggtgttgtccttgcagttgaaaagcgtatcacttcaccgctactggaacctagcagtgtggaaaagataatggaaattgacgaacatataggttgtgcaatgagtggattgattgctgatgctcgaacacttgttgagcatgcacgagtggaaactcagaatcataggttctcctatggtgaaccgatgactgtagagtctaccacccaagcactttgtgatttggccttgcgttttggtgaaggcgatgaagagtccatgtctcgaccatttggagtttctcttcttattgctggacgtgatgagaatggacctagtttatattacactgacccatctggcacattttggcaatgcaatgcaaaagctattggatcagggtcagaaggagcagatagttctctgcaagaacaatacaacaaggaccttactcttgaagaagcagagactattgctttatccattctgaagcaagttatggaagagaaggtaactccaaacaacgttgacatcgctaaggtgtccgaaaaatatcatctttatactccggctgaggtggaagctgtgataagtcgcctatgaattacttttgtgtgatttgctatcattgccatttgttcccataccttgaacccctgccttacctacagtctgttttaatagctttgcgctcaaactttttcgatactacacttgtggccaaattgtactctctatctgattctcaagtgtccaatttgctaaattcagtttagttactatatatttattggacaatttggaaacgccacatgaatatgctctcatgagattgtttgccgtgatattgatgactttactgag

SEQ ID NO: 1197 - DNA, 881 bp, Salvia sclarea
gggtcgatgttcagatccacttattattatttttaacattatcgaatataacttggagttcatcttagtgcagatagtttgaagctgtgttttattcggttcgaaaatgtttctcacgaggactgagtatgatagaggagtgaacacattttctcctgaaggccgattgtttcaagttgaatatgctattgaagctattaagctgggatcaactgcaattgggctaaagactaaggagggagtggttcttgctgtggagaagcgcatcacttcaccccttttggaacctagcagtgtggagaaaatcatggaaattgatgaacatattggatgcgccatgagtggcttgatcgctgatgcgcgcacactggttgaacatgcacgagttgaaactcagaatcataggttctcttatggtgagcccatgacagttgagtctacaacccaagcactttgtgatcttgctttgcgatttggcgagggggatgaagaatccatgtcaagaccttttggtgtgtccctactaatagctggtcatgatgagaatggtccttgcttatactatacagacccatctgggacattctggcagtgtaatgcaaaagccataggatcaggttccgaaggagctgacagctccttgcaagagcagtataacaaggaactaactctcaaagaagctgaaaccatagcactttccattctcaagcaagttatggaggaaaaggttactccgaacaatgtggatattgcgaaggtatcaccaacatatcacctttactctccttctgaggttgaagcagttatcaatcgcctatgaaaatgtaccactctagtttgtgattattttttagtggtgatctatatatgctcccatcata

SEQ ID NO: 1198 - DNA, 925 bp, Sesamum indicum
tttttgggtcgaaaatgttcctcacaaggactgagtatgacagaggagtgaacactttctctccggaaggccgattgtttcaagtcgaatatgccattgaagctatcaagttgggttcaactgctattggaataaagactaaggaaggagtggttcttgctgttgagaagcgaatcacgtcgccacttttggagcctagcagcgttgagaaaattatggaaattgatgaacatattggttgtgccatgagcggcttaattgctgatgcacgtacactggttgaacatgcacgagtcgaaactcagaatcataggttctcatacggtgagcccatgacagttgagtccactacacaagctctctgtgatcttgccttgagatttggtgagggggatgaagaatcaatgtcaagaccttttggtgtatctcttctcattgctggtcatgatgagaatggtcccagcttatactacactgatccttctggcacattctggcaatgtaacgcaaaagccattggatcagggtctgaaggtgctgatagctctttgcaagagcagtataacaaggatttaaccctcaaagaagctgagaccattgcactttccatcctgaagcaagttatggaggaaaaggttacacccaacaatgttgatattgcaaaggtatcacctacttaccatctttacacccccactgaagttgaagcagttatcactcgtctatgagaagtccaatctgtttttcagacgtttgcctgtgatccacattccattattccatgcttgaacacgtttgtaagacttagatattttgccaatttcaaaattaaactgggaagctggttttttctctgtcaaccttcttatatgcattgaaaaattatatcgacctatttctgtggatttctgggcattcattgacc

SEQ ID NO: 1199 - DNA, 1135 bp, Eutrema parvulum
cgatcaatctagctggtgtgacttcctaatctcaacgagttcttagtgattatctcccttttgatttgatcctgactgtttagatttacccagatctgttaagtttctagggttttgattctgttgtgcagacactaaggttttatagatcgaagtcgcggaagaagaagatgtttctcactaggaccgagtatgacagaggagtcaacactttttctcccgaaggcaggctattccaagtcgagtatgccattgaagctatcaagcttggttctactgcaattggagtaaagacaaaggagggagttgtgcttgctgtcgagaagcgtatcacctcgccattgctggaaccgagcagtgttgagaagattatggaaattgatgaccatattggttgtgccatgagtggtttaattgctgatgcgcgtacacttgttgagcatgcaagagttgagactcaaaaccacagattctcttacggtgagcctatgaccgtagagtctacaacccaagcactgtgtgatctggcactacgatttggtgaaggagatgaagagtcaatgtctcggccatttggagtatctcttctcatagctggtcatgatgaaaacggacctagcttgtactacacggatccatcaggaacattctggcagtgcaatgcaaaggcaattggttcaggctcagaaggagctgatagttctcttcaagagcaattcaacaaagatctgtcacttcaagaagctgagacgatcgctgtatcaatcctcaagcaagttatggaagaaaaggtaactccaaataatgtggacattgccaaggtagctccagcgtaccatctctacactccacaagaagtcgaagcagtcattagtcgtctttgaggaagattctcaatgcgggtgatgtagcagctatcggccttgtgtctagttcggattttgaaaccaagagactttctttcacattgtctgttagattgatggttcatgtcacattttactttcttgtgtaagagaatcttttctctcccatgttattcaataacctctcggatttgcggactccaaaatatccatgacttcgttctttataagctgatcttagccggaagcaaggtaatgggcttcactgt

SEQ ID NO: 1200 - DNA, 1202 bp, Malus domestica
gacgaaggaagaggaaaaacccttcttctccatcacgaaagcatatcataaatcagaccatccctctctgcagaagcagcactcatcgcattgaagcaaatcgcgtactaattcgatcaatctcaaagttccaatcagaccaaaatgtttctcacaaggactgagtatgacagaggagtaaacactttctcccccgaaggcaggttgtttcaggttgagtatgccatcgaggccatcaagttgggttcgactgcaattgggctaaagacgaaagaaggtgttgtgcttgctgtggagaagcgcatcacttcgcctttgctggaacccagcagtgtggagaaaattatggaaattgatgaccatataggatgtgccatgagtggactgattgctgatgctcgtacacttgttgaacatgcacgagttgaaactcagaatcataggttctcctatggtgagccaatgactgtggagtctacaacacaagctctttgtgaccttgccctacgatttggtgaaggtgatgaagagtccatgtctcgaccatttggggtatctctcctaattgctggtcatgatgagcacgggcccagcttgtaccacactgatccatctggcacattttggcagtgcaatgcaaaagctattggttcaggttcggagggagcagacagctctcttcaagagcaatacaacaaggacttgactcttcaagaagctgagacaattgctctgtctatccttaagcaagttatggaagaaaaggtgacacccaacaatgtagatatcgcaaaggtttctccaacatatcatctgtataccccctctgaggtggaggccgtcattgctcgcctataagttctcgtgtttctctgaatcgaatttgtttctcgtcactgctgtttttgctaagtttaaagaaatggatttcggatttgtttctggttaaccagtaaaatcatgcggcagtgcagtacaatgctaaacatattccaaggatattatcatcttactttgatgagcagatgccttcctgcgctctaatgaaggatttcatgtgaactcgaaactttttggctgtcattttgttttgtgcacaaatctgtggtcaatgcagggtggcagttgaaatgtgatgccttttatcttacttgcatgttgaagtcggtttccgtttgtgtttcaactgaatgcttggaata

SEQ ID NO: 1201 - DNA, 910 bp, Brassica juncea
cagtttcttcgattcgccgatcaatcaatcagctgctatgattatctaatctcaacaagttcttccttgattacactccctttcttttgttcccgagttcttacattcatccagatcttttaatttttctaaggttttgattctgttggtgataactgataaggttttacagatcgaagaagaagatgtttctcacaaggaccgagtacgacagaggagtcaacactttttctcctgaaggaaggctattccaagtcgagtatgccattgaagctatcaagctgggttctactgcaattggagtaaagacaaaggatggagttatgcttgctgtcgagaagcgtatcacctcacctttgctggagccgagcagtgtggagaagattatggaaattgatgaccatattggctgtgccatgagcggcttaattgctgatgcgcgcacacttgttgagcatgcaagagttgagactcaaaaccacagattctcgtatggtgagccaatgactgtagagtccacaacgcaagcgctgtgtgatctggctttacggtttggtgaaggagatgaagaatcaatgtctcggccatttggagtctctcttctcattgctggtcatgatgaaaacggaccgagcttgtactacacggacccgtctggaacattctggcagtgcaacgcaaaggccattggttcagggtcagaaggagctgatagttctcttcaagagcaattcaacaaagatctgtcactcagtgaagctgagacgattgcggtttccatcctcaagcaagttatggaagagaaggtgactccgaacaatgtggacatcgccaaggtagcaccagcgtaccatctctacactccagaggaagtggaagcagtcattagtcgtctatgaggatgatgcta

SEQ ID NO: 1202 - DNA, 821 bp, Brassica juncea
aacattcacaaacttgtaaaagggagccatcccaagtttcttcggaatcgccgatcaatcagctggttttacagatcgaagtcgtggaagaagaagaagaagaagaagatgtttctcactaggaccgagtatgacagaggagtcaacactttctctcctgaaggcaggctcttccaagttgagtatgctattgaagctatcaagcttggttctactgcaattggagtgaagacaaaagaaggagttgtgcttgctgtcgagaagcgtatcacctctcctttactggagccgagcagcgtggagaagattatggaaattgatgaccatattggctgtgccatgagcggcttaattgctgatgcgcgcacacttgttgagcatgcaagagttgagactcaaaaccacagattctcgtatggtgagccaatgactgtagagtccacaacccaagcgctgtgtgatctggctttacggtttggtgaaggagatgaagaatcaatgtctcggccatttggagtctctcttctcattgctggtcatgatgaaaacggaccgagcttgtactacacggacccgtctggaacattctggcagtgcaatgcaaaggcgattggatcagggtcagaaggagctgatagttctcttcaagaacaattcaacaaagatctgtcacttgaggaagctgagacgattgctgtatctatcctcaagcaagttatggaagaaaaggtgacaccaaataatgtggacattgccaaggtagctccagcgtaccatctctacaccccacaggaagtggaagcagtcattagtcgtctttg

SEQ ID NO: 1203 - DNA, 801 bp, Brassica juncea
ttttacagatcgaagtcgaagaagaagatgtttctcactaggaccgagtatgacagaggagtcaacactttctctcctgaaggtaggcttttccaagtcgagtatgccattgaagctataaagcttggttctactgcaattggagtgaagacaaaggaaggagttgtgcttgctgtcgagaagcgtatcacctctcctttactggagccgagcagtgtggagaagattatggaaattgatgaccatattggctgtgccatgagcggtttaattgctgatgcgcgtacacttgttgagcatgcaagagttgagactcaaaaccacagattctcgtatggtgagccaatgactgtagagtccacaacccaagcgctgtgtgatctggctttacggtttggtgaaggagatgaagaatcaatgtcgcggccatttggagtctctcttctcattgctggtcatgatgaaaacggaccgagcttgtactacacggacccgtctggaacattctggcagtgcaacgcaaaggccattggttcagggtcagaaggagctgatagctctcttcaagagcaattcaacaaagatctgtcactcagtgaagctgagacgatcgctgtgtctatcctcaagcaagttatggaagaaaaggtgactccaaacaatgtggatattgccaaggtagctccagcataccatctctacactccagaggaagtggaagctgtcattagtcgtctttgaggatgaccgctcaatatgagtgatgtgtttatccgcattgttctagttcgtaattttgaa

SEQ ID NO: 1204 - DNA, 1155 bp, Brassica juncea
ttcgtatgatcttctcctctcaacaacttctcagttgattacattccatctttgtagattcacccagatctgttaatttgtctaggattttgtttctgttaagggttctacagatcgaaatcgcggaataagaagaagaagaagaagatgtttctcactaggaccgagtatgacagaggagtcaacactttctctcctgaaggcaggctcttccaagttgagtatgctattgaagctatcaagcttggttctactgcaattggggtgaagacaaaagaaggagttgtgcttgctgtcgagaagcgtatcacctctcctttgctggagccgagcagtgtggagaagattatggaaattgatgaccatattggttgtgccatgagtggtttaattgctgacgcgcgtacactcgttgagcatgcaagagttgaaactcaaaaccacagattctcatacggtgagccaatgactgtggagtccacaacacaagcgctgtgtgatctggctttacggtttggcgaaggagatgaagaatcaatgtcgcggccatttggagtatctcttctcattgctggtcatgatgaaaacggaccgagcttgtactacacggacccgtctggaacgttctggcagtgcaatgcaaaagcgattggatcaggatcagaaggagctgatagttctcttcaagagcaattcaacaaaggtctgtcacttgctgaagctgagacgatcgctgtatctattctcaagcaagttatggaagaaaaggtgactccaaacaatgtggatattgcaaaggtagcaccagcataccatctctacacaccagaggaagtggaagctgtcattagtcgtctttgaggatgaccgctcaatatgagtgatgtgtttatccgcattgttctagttcgtaattttgaaacaaagactttctttcacttttatctgttagattcgatgtttcatgtgacattctaagtattgttatgtgagagaaccttttgtttcccactctcattcaagactcctctcggattttggggtgactaagaattttcccgtacaaattagcagtgaactggaaaagggggataagtcgatgaatacaaactttgatttctgacagaaaatcaatttttccaattctgtacccgc

SEQ ID NO: 1205 - DNA, 1640 bp, Brassica rapa
ttttttttttttttcaaaattttctttttataatttaaaaatactttttgaaactgtttttaaaatttttattttttattttagtatttattttttataaaattttaaaccctaattccaaaaccccaccccttaactctaaaccctaaggttaagattaattaacccaaggggtataagtgtatatttacctctttaataaaacctatttttgtgactttgaaccttgaatgctactttgagaacaaaaacttggtttggtgctatcatagtctttttctcattttaaatcctaccaataacccaactaaaactccagctcattatcaaaattaagagcaaaaaggtagggcctacttgtggccaatgaataagatagttaggcctatgaaagcccattttaaaacgacgggtttgggatccatctaacttgttgttcaagtagtgaacttgtacaaagcatctcagtttcttcgattcgccgatcaatcaatcagctgctatgattatctaatctcaacaagttcttccttgattacactccctttcttttgttcccgagttcttacattcatccagatctgttaatttttctaaggttttgattctgttggtgataactgataaggttttacagatcgaagaagaagatgtttctcacaaggaccgagtacgacagaggagtcaacactttttctcctgaaggaaggctattccaagtcgagtatgccattgaagctatcaagcttggttctactgcaattggagtaaagactaaggagggagttgtgcttgctgtcgagaagcgtatcacctcccctttgctggagccgagcagtgtggagaagattatggaaattgatgaccatattggctgtgccatgagcggtttaattgctgatgcgcgtactcttgttgagcatgcaagagttgaaactcaaaaccacagattctcgtatggtgagccaatgactgtagagtccaccacgcaagcgctgtgtgatctggctttacggtttggtgaaggagatgaagaatcaatgtctcggccatttggagtctctcttctcattgctggtcatgatgaaaacggaccgagcttgtactacacggacccgtctggaacgttctggcagtgcaatgcaaaggcgattggttcaggctcagaaggagctgatagttctcttcaagagcaattcaacaaagatctgtcgctcagtgaagctgagacgatcgctgtatctatcctcaagcaagttatggaagaaaaggtgactccaaataatgtggacattgccaaggtagctccagcgtaccatctctacactccacaagaagttgaagcagtcatcagtcgtctttgaggaagatgctttgcgtctacttcgaatattgacaccaagtggctttctttcattttgtctgttagagactgatgtttaatgagacaagtttagtctcttgtgtaagagaatcttttatctcccatgtcattctataacctctcggatggatttgtggctcaattcggattcagaaggggttttacacatcactaaaaccgatcgcatatcaaagtaaatttaaaactaaattatataaaactcggaaaaatataaatgcatatatataaaatgaat

SEQ ID NO: 1206 - DNA, 1131 bp, Brassica rapa
tctaacttgttgttcaagaagtgaacctttacaaaaacttgtaaaagccatcccagtttcttccaattcgccgatcaatcagctgactctaacaaggttttacagatcgaagtcgaagaagaagatgtttctcactaggaccgagtatgacagaggagtcaacactttctctcctgaaggcaggctcttccaagtcgagtatgccattgaagctatcaagcttggttctactgcaattggagtgaagacaaaggaaggagttgtgcttgctgtggagaagcgtatcacctctcctttactggagccgagcagtgtggagaagattatggaaattgatgaccatattggctgtgccatgagcggtttaattgctgatgcgcgtacacttgttgagcatgcaagagttgaaactcaaaaccacagattctcgtatggtgagccaatgactgtagagtccacaacgcaagcgctgtgtgatctggctttacggtttggtgaaggagatgaagaatcaatgtctcggccatttggagtgtctcttctcattgctggtcatgatgaaaacggaccgagcttgtactacaccgacccgtctggaacattctggcagtgcaacgcaaaggccattggttcagggtcagaaggagctgatagttctcttcaagagcaattcaacaaagatctgtcactcagtgaagctgagacgattgcggtttccatcctcaagcaagttatggaagagaaggtgactccgaacaatgtggacatcgccaaggtagcaccagcgtaccatctctacactccagaggaagtggaagcagtcattagtcgtctatgaggatgatgcttctcatgggtgatgtgtttatccccgccttgttctagttcggattttgaaacaaaagactttctttcacttctgtctgttagattcgatgtttcatgtgacatttaagtcttgtttatgtaagagaaccttttctttcccttttcagactcagggcttcgttttgttagctgctattgggttggaatcgcgttaatgggccttgcttttgtattgactataaacccattcggcccgagtaacaaaaatcatatatcacccttacaggctgaacttgtttaata

SEQ ID NO: 1207 - DNA, 1062 bp, Brassica napus
ggttcaagaagtgaacttgtacaaagcatctcagtttcttcgattcgccgatcaatcaatcagctgggttttgattcttttggtgatagctgataaggttttacagatcgaagaagaagatgtttctcacaaggaccgagtacgacagaggagtcaacactttctctcctgaaggaaggctattccaagtcgagtatgccattgaagctatcaagctgggttctactgcaattggagtaaagactaaggaaggagttgtgcttgctgtcgagaagcgtatcacctcccctttgctggagccgagcagtgtggagaagattatggaaattgatgaccatattggctgtgccatgagcggcttaattgctgatgcgcgtactcttgttgagcatgcaagagttgagactcaaaaccacagattctcgtatggtgagccaatgactgtagagtccaccacgcaagcactgtgtgatctggctttacggtttggtgaaggagatgaagaatcaatgtctcggccatttggagtctctcttctcattgctggtcatgatgaaaacggaccgagcttgtactacacggacccgtctggaacgttctggcagtgcaatgcaaaggcgattggttcaggctcagaaggagctgatagttctcttcaagagcaattcaacaaagatctgtcgctgagtgaagctgagacgatcgctgtatctatcctcaagcaagttatggaagaaaaggtgactccaaacaatgtggacattgctaaggtagctccagcgtaccatctctacactccacaagaagttgaagcagtcatcagtcgtctttgatgaagattctcgaatacggttgatgtctacttcgaatctccgacaccaagtggctttctttcattttgtctgttacagacttgatgtttaatgagacagtttagtctcttgtgtaagagaatctttaatctcccatgtcattctataacctctcggatggatttgtggctcaattcggattcagaaggggttttacacatcactgtctaaaaccgatcgccatcaaagt

SEQ ID NO: 1208 - DNA, 1125 bp, Brassica napus
ctttacaaaaacttgtaaaagccaatcccagtttcttccaattcgccgatcaatcagctgactctaacaagatcgaagtcgaggaagaagatgtttctcactaggaccgagtatgacagaggagtcaacactttctctcctgaaggcaggctcttccaagttgagtatgccattgaagctatcaagcttggttccactgcaattggagtgaagacaaaagaaggagttgtgcttgctgtggagaagcgtatcacctctcctttactggagccgagcagtgtggagaagattatggaaattgatgaccatattggttgcgccatgagcggtttaattgctgatgctcgtacacttgttgagcatgcaagagttgagactcaaaaccacagattctcgtatggtgagccaatgaccgtggagtccacaacacaggcgctgtgtgatctggctttacggtttggtgaaggagatgaagaatcaatgtcccggccatttggagtatctcttctcattgctggccatgatgaaaacggaccgagcttgtactacacggacccgtctggaacattctggcagtgcaacgcaaaagcaattggttcagggtcagaaggagctgatagttctcttcaagagcaattcaacaaagatctgtcactcagtgaagctgagacgatcgctgtgtctatcctgaagcaagtcatggaagagaaggtgactccgaacaatgtggacattgccaaggtagctccagcgtaccatctctacactccagaggaagtggaagcagtcattagtcgtctttgaggatgatgcttatcatgggtgatgtgtttatccccgccttgttctagttcagattttgaaacaaaagactttctttcacttctgtctgttagattcgatgtttcatgtgacattctaagtattgtttttatgtaagagaaccttttctttcccatttgtcattcaagaacggtcgcatccgaagttttcagtctcagactctgcgggtcttcgtttgtagttgctattgggtctgatcgtgtatgggcctagctttgcttcactataaaccccttcggcccgagtaacgacaatcaaacagtatctcctaagtcaattagg

SEQ ID NO: 1209 - DNA, 1126 bp, Brassica napus
tcacaaaaacttgtaaaaagccatcccagtttcttccaactcgccgatcaatcagctgacttttaaggttttacagatcgaagtcgaagaagaagatgtttctcactaggactgagtatgacagaggagtcaacactttctctcctgaaggcaggctcttccaagtcgagtatgcaattgaagctatcaagcttggttctactgcaattggagtgaagacaaaggaaggagttgtgcttgctgttgagaagcgtatcacctctcctttactggagccgagcagtgtggagaagattatggaaattgatgaccatattggttgtgccatgagcggtttaattgctgatgcgcgtacacttgttgagcatgcaagagttgaaactcaaaaccacagattctcatatggtgagccaatgactgtagagtccacaacgcaagcgctgtgtgatctggctttacggtttggtgaaggagatgaagaatcaatgtctcggccatttggagtgtctcttctcattgctggtcatgatgaaaacggaccgagcttgtactacacggacccgtctggaacattctggcagtgcaacgcaaaggccattggttcagggtcagaaggagctgatagttctcttcaagagcaattcaacaaagatctgtcactcagtgaagctgagacgatcgctgtgtctatcctgaagcaagtcatggaagagaaggtgactccgaataatgtggacatcgccaaggtagcaccagcgtaccatctctacactccagaggaagtggaagcagtcattagtcgtctttgaggatgatgcttatcatgggtgatttgtttatccgccttgttctagttcggattttgaaacaaaagactttatttcacttctgtctgttagattcgatgtttcatgtgacagtccaagtcttgtttatgtaagagaaccttttctttccctattgtcattcaagaaccctctcggatttgactgactcggaaggtttcagactcggggcttcgttttgttagctgctattgggtcggaatcgcgttaatgggccttgcttttgtcttgactattaacccattcggcccgagtaacaaaaatacatatatcaaccttgc

SEQ ID NO: 1210 - DNA, 917 bp, Cleome spinosa
aggcagactggtgaaggagtcttgttcttcgattcgcaaatcaacgaactgggttttactcttttgtgccgacgtcagggcttttcagatcgagatctaagaagaagatgttcctcaccaggactgagtacgacagaggtgtcaacaccttttcccctgaaggtcggctgttccaagtcgagtatgccattgaagccatcaagcttggttctactgctattggagtaaagacgaaggagggagtagtgctcgctgtcgagaagcgtatcacctcgcctctgctggagccgagcagtgtagagaaaattatggaaatcgaccagcacataggatgcgccatgagcggtctgattgctgatgctcgtacactggtggagcatgcacgagttgaaactcaaaaccacaggttctcctatggtgagccaatgactgtagagtccacaacacaagctctgtgtgatcttgctttaagattcggtgaaggagatgaagagtcgatgtctcggccatttggagtatctcttctcatagctggtcatgatgaaaatggaccgagcctatactacaccgatccttcgggaacgttctggcaatgcaatgcaaaggcgattggttcgggctcggaaggcgctgacagttccttgcaagaacaatacaacaaggatttgactctccaagaggcagaaacgatcgcaatgtctatcctcaagcaagttatggaagaaaaggtgactccaagcaatgtggacattgccaaggttgcacccgagtatcatctttacactcctcaagaggtggaagcagttatcagtcgtttatgatgccgacgggggaacatgcttctctgcctccaggaatcttggtttgtcgggttatttctcgggttgtctgattccgatttctgaaccaggagactg

SEQ ID NO: 1211 - DNA, 957 bp, Cucurbita pepo
attgaatcgcaaaatgtttctgaccaggactgagtatgataggggtgtgaataccttctctcctgaaggtcgattgttccaggttgagtacgccattgaagctattaagcttggttcgactgcaattggtttgaaaacaaaggagggcgttgtgcttgctgttgagaaacgtattacatccccactactggaaccaagtagcgtggaaaaaatcatggaaattgatgagcatataggatgtgcaatgagtggattaattgctgatgctcacacacttgttgaacatgctcgagttgagacccagaaccatcggttctcatatggtgaaccaatgactgtggagtctacaactcaagctctttgtgatctagccctaagatttggtgaaggcgatgaggagtccatgtctcgaccatttggtgtagctcttctcattgccggccatgatgagaagggtcccagcttattctacactgatccatctggcactttctggcaatgcaatgctaaagctatcggttcaggttctgaaggtgcagatagttctctgcaagagcaatacaacaaggacctaactcttaaagaagctgaaaccatagcactgtctattctgaagcaagttatggaagagaaggtgactcccaacaatgtcgatatcgcgaaggtggctccgacatatcatctgtacactcctgcagaggtggaggcagtcattagccggctatgagaagaggttcttttgaaaatcttcccagctgttatgtttcttgtcactggcttgtatttgtacactctttgtctggtgagggagaatctcaggtttttggctactttcgacgctattggtgatgtgtttatcgattaattatgggacattcttgatggtttattccgaactttagacgcacagtttgattagtccttttacgaaagctctgaacacgattcttatgcgcc

SEQ ID NO: 1212 - DNA, 1095 bp, Eucalyptus grandis
tcgctaaaaggcaaagccacactgaatcaggaaagcacgaagcctctccaatcactccaagcaacggcactcgagaacccctgaaatctccacggttccgtgagtcgagctcgccgccgccgggatgtttctcacgaggactgagtacgataggggagtgaacaccttctctccggaaggtagattgtttcaagttgaatatgccattgaagccatcaagcttggttcgactgcgatcggattgaagacgaaggaaggtgttgtgctcgctgtcgagaagcgtattacttcgcccctgctggagccgagcagtgttgagaaaatcatggaaattgatgaccatattggatgtgccatgagtggcttgattgccgatgcccgcactctagtagaacatgctcgggtggaaactcagaaccataggttctcatatggtgagccaatgacaattgaatcatccacccaagccatttgtgatcttgctttgcgatttggtgagggtgacgaagaaacaatgtcccgtcctttcggagtctctcttctcattgctggacatgatgaaaatggacccagcttatactacacagatccctctggcacattttggcagtgcaacgcaaaagccattgggtcaggttcagaaggagcagatagctcattgcaggagcaatataataaggacttaactcttgcggaagctgagacgattgctctttccatcctcaagcaggtcatggaagaaagggtgacacccaacaatgtggacattgcgaaggtggctcctgcataccatctctacacgcctgctgaggtggaggcggtcattagtcgactatgaggagaatctacatggaacttcacgtttaaagtaatgttcttggcatgtgcccacccatgcgtgcttttgaagaattcttgcctgtaattgtactttgcaaagccagaaattgaaactgtcgtcctattttggctgggttatcattccgggactaatgttgtgattatacaatttctgcccctcgtttgaatggaatacagtgtagacaatttcaaccgcaggcagtttatgggtggcccatgaaatcttttgctttg

SEQ ID NO: 1213 - DNA, 816 bp, Euphorbia peplus
gtttctgaccaggactgaatatgatagaggagtcaacactttttcacctgaaggaagattgtttcaggttgaatacgccatcgaagctattaagttaggttcaactgcaattgggttgaagacaaaacatggtgttgttcttgcagttgagaagcgtattacttccccattactggagcccagcagtgtcgaaaaagttatggaaattgatgagcatattggatgtgctatgagtgggttgattgcagatgctcgtacacttgttgaacatgctcgtgttgaaactcagaaccatagattctcttatggtgagcccatgactgtggagtctacaacacaagcactttgtgatctggctctacgatttggtgaaggtgatgaagaatccatgtctcggccatttggagtttctcttctcattgctggtcatgatgagcacggtcctagcctttattatacagatccatctgggacattttggcaatgcaatgcaaaggccatcggttcaggttcagaaggtgcagatagctccctgcaagagcaatataacaaggacatcacacttcaagaggctgagacaattgcactttccattttgaaacaagttatggaggagaaggtgacacctaacaacgttgacatcgctagggtagctccgacatatcatttgtatacccctgcagaggtggagaccgtcattggccgcctatgagaagagaatggtgtcgtggaatttcatatgtatttctcaattgttggtattgtcgttcctgtgaggatagcagaagattggactcgtagaatctttatggtttt

SEQ ID NO: 1214 - DNA, 1085 bp, Fagopyrum esculentum
ctctcccgcacaggtttttaaagtctctgaaatcccgcaaaatgtttctcacaaggactgagtatgacagaggagtcaataccttctctcctgagggcaggctttttcaggtcgagtatgcaattgaagccatcaagttgggttcaactgcaattgggattaagaccaaggatggcgttgtgcttgctgttgaaaagcgtatcacctctcccttgctggagcccagtagtgttgaaaaaatcatggaaattgattcgcacataggatgtgctatgagtggattgattgctgatgctcgtacacttgttgagcatgcacgtgttgagacccagaatcatagattctcatttggtgagcccatgactgtggagtccacaacccaggctttgtgtgaccttgcactgaggttcggtgaaggtgatgaagagtctatgtctcgtccatttggagtttctcttctcattgctggccatgatgagaatggaccaagtttatactacacagatccatctggtactttctgggaatgcagtgccaaggcaataggttcaggttcagaaggagcagacagctcattgcaggagcagtacaacaaggagttgagtctccaggaagctgaaacaattgcactctcaatcttgaagcaagtgatggaggagaaggtgacacccaacaacgtcgacattgccaaagtggccccgggttaccatctctacaccccatctgaggtggaagctgtcattagccgcttgtaagcacacaacccgatcaggtgccgttttccatgattccgatcccttccattagacatgcttgaactcatgatgtttttaacacctcaatgaagatcgatccctgcaaaacttcgttttactatgaaaagtgtcagtcttgatgttgttcgaactgtatggcacatttgaggacttgaattttcaagtgaagattttacttctagtagttatccaagtatttaagtccaagctatcatgttcagtaaccagttacgctattggtgtacaatccatatacgtagaactcgttgcgtggcaaaaatatttgttgtagtaagagtcgtataaact

SEQ ID NO: 1215 - DNA, 844 bp, Flaveria ramosissima
ctaacaaggactgagtatgatcggggtgttaacaccttctctccggaaggccggttgtttcaggttgaatatgccattgaggccattaagttgggttcgacagctattgggttgaagaccaaggaaggggttgttcttgctgttgaaaagcgtattacctcgccactcttggaacctagtagtgttgagaaaattatggaaattgatgaacacattggctgtgccatgagtggattaattgcagatgcccgtacactcgttgagcatgcacgggttgagacgcagaatcataggttttcctatggtgagccaatgactgttgagtcgactacccaagccttgtgtgatctggcactgcgatttggtgaaggagatgaagaatctatgtctcgaccttttggggtatctcttcttattgcaggtcatgatgaaaatgggcctagtctatactacacggatccatcaggcaccttttggcagtgcaatgcaaaagccataggctcaggctctgaaggtgctgacagctctctacaggagcaatataacaaggacttgagtttaaaagaagctgaaacaattgctctttccatcttgaagcaagtcatggaagaaaaggtaactcctaataatgtggatattgcaagggtggctcctacttatcacttgtacaccccggcagaggttgaagctgttatcagtcgtctataaaattgagtctgtcctcgtttggtttaataaagcgtgtattttgtacttgaactgctgagattattttatgttccctttaggtatggcatttgaacacaggatcttttttattgtgtatgtttgagaaaattatgaa

SEQ ID NO: 1216 - DNA, 1027 bp, Orobanche aegyptiaca
ttgctcgacaagaaggaaaacctcctttctaactctaaaacttcataattccgctccagtttcctttcatttacttcaattgaaactaagtgaattttgaagccctaattcgttgaatcgaaaatgttcctcacaagaactgagtatgatagaggagtgaacactttctcccctgaaggccgattgtttcaagttgaatatgcgattgaggctatcaagttggggtcaactgcaattgggattaagaccaaagaaggagttgttcttgctgttgagaaacgcattacgtcaccacttttggagccaagcagtgttgagaaaattatggagattgattcacatattggctgtgccatgagtggtttaatagctgatgcacgtacactagtcgaacatgcccgagttgaaactcagaatcataggttctcgtatggtgagcccatgacagttgagtcaacaacccaagctctttgtgacctcgccttgcgatttggtgaaggagacgaagaatcaatgtccagaccatttggtgtgtctcttctcattgctggtcatgatgagaatggtcccagcttatactatactgatccgtctggcacattctggcaatgtaatgcaaaagccattggatcgggttccgaaggtgctgacagctctttgcaggagcagtttaataaggacctaactctcaaagaagctgaaacaattgcactttccatcctcaagcaagttatggaggaaaaggttacgccgaataatgttgatatcgcgaaggtctcaccaacgtaccatctttactctccgtccgaggttgaagcagttattagtcgtctatgagaaggagtttccggtctcctttttcttcctacgatttatgtttccattgttgtcatgctcgaacaagttttgtactatttttaacgatcttctaattgtcgatttatgcatgaaaaccgaactcaaagtgaattcgtaaaacgtttcaccggcctttttggcgttatattatttttatccatgttttatc

SEQ ID NO: 1217 - DNA, 1094 bp, Phalaenopsis aphrodite
gccgaaggcaacacagccttccgagctgttggcgaactaggagtcgctttgacagcccagttaaaagtggcatcgccgggcgtttctcactccctgggttcttggaactcatttggacttagggttttacactttcacctgcggagaactagggcgctctgaaggtttcaaaaatgtttcttacgaggaccgagtatgatagaggagtcaacaccttctcccccgaaggtaggctgtttcaggttgaatatgccattgaggctataaagcttggttcgacagcaatcgggataaagaccaaaggaggggttgtgttggcggttgagaagcgcgtgacctctcctctgctggaaccaagcagtgtggaaaaaatcatggagattgatgagcatataggatgtgccatgagcggattgatagctgatgcccgcacactggttgaacacgcacgtgttgaaacacagaatcacaggttttcatatggcgagccaatgactgttgaatctaccactcaagctctttgtgatcttgctctacgatttggtgagggtgatgaggaatctatgtcgaggccttttggagtgtctcttcttattgctggtcatgatgagaatgggcctagtttatactacaccgatccttctggtacattttggcaatgcagtgcgaaagctatagggtcgggttctgaaggagctgacagctccttgcaggagcagtataacaaggaaatgactctcgaggaagccgaaactgttgctctgtccatcctgaagcaagtcatggaagagaaggtgactccaaacaacgtcgacattgcgaaagtcgctccgtcgtatcacctctatgctcctcctgaggtagaagctgttatcaatcgcttatagaggatcaataattactttcaaattatgctttcttccccttatttgccactctgagcattttcccccttattatatctctactttattattttttcttaatacatgacatgaaaatatttagcaactacattgtttaattgagatttacttgcaacacagttcatattcaccgtttgtttttttagttttatcaacaattgatttggg

SEQ ID NO: 1218 - DNA, 879 bp, Platanus occidentalis
tgtttcttaccaggaccgagtacgatagaggtgtgaacaccttttctcccgaaggtcgattgtttcaggttgaatatgccattgaggcgatcaagttgggttccactgctattgcgttgaagacgaaggaaggcgttgtgcttgcggttgagaagcgtattacttcacctttgctggagcctagcagtgtagagaaaattatggaaattgatgaacatatagggtgtgctatgagtgggttgattgctgatgctcgtacgctggttgaacatgcacgagttgaaactcagaatcacaggttctcatatggtgaaccaatgaccgttgagtctacaacacaagctctatgtgatcttgcactacgatttggtgagggtgatgaagagtccatgtctcgaccatttggggtctctcttttaattgctggtcatgatgagaacgggcctagcttatactacacagatccatctggcacattctggcagtgcaatgcgaaagctataggttcaggttctgaaggagcagacagctctttgcaagagcaatataacaaggacattactcttcaggaagctgaaacaatagctctttcaatcttgaagcaagtgatggaagaaaaggtaactccaaacaatgttgatattgcaaaggtggctccaacttaccatctctactctccttctgaggtggaggctgtcatcagtcgtctatgaagagttgaacttcccatcattatctcccctgtagtctgcctgtcttgtggttgtgcgtataagaaatttgttgggggaagaattttatttcacatatggttgggaattttaatcaggaaatatttttcttcttttagcatctgaatttctgtcttaactggttcag

SEQ ID NO: 1219 - DNA, 1229 bp, Papaver somniferum
cccgaacaaatactgccttcgctgctaactttaatcacaagttcgaaatctcaacgaagaagaagaaaattcttctcgaagctcaaaggattttcatctaaacccataacggaagatgtttcttacaaggaccgagtatgatagaggggtgaatactttctcacctgaaggtagattgtttcaggttgagtatgcaattgaagctattaagcttgggtccacggcaattgggataaagactaaagaaggagtagtgcttgctgtcgagaagcgtattacttcgccattactggagcctagtagtgtggagaaaatcatggaaatcgatgagcatgtaggctgtgcaatgagtggactaattgctgatgctcgtacacttgttgatcatggacgagttgaaactcagaaccataggttctcatatggtgagcccatgactgttgaatccacaactcaagctttatgtgatcttgcactacgatttggtgaaggtgaagaagagtccatgtctcggccttttggtgtgtcacttctcattgctggtcatgacgaaaatgggccaagcctatactacacagacccgtctggcacattttggcagtgcaatgcgaaagcaataggatcgggttctgagggggcagacagctctttgcaggagcagttcaacaaggatatgacacttctagaagccgaaacagctgctctttcaatcttgaagcaagttatggaagagaaggtgactcccaacaatgttgacattgcaaaagttgctccaaagtaccatttgtattctccttctgaggtggaggctgtcatcgctcgattatagaaagaaaacccttgatccttcccaccgccaatgttttcctgtcttgcttcccaccgccttcatgtgatgacatcattaggagataaacttcattgtggtatggttattagatcatgaaacctactcccttctctttgccaaggttttcctgtcttacttagcgaggccttcatgtaatgacatctttaggagaaacttcgttgcgacctggttattagatcatggaatctgctccactcccttatgatctttatgaaattagatttgttgttggagtagagttcctattgacagatatactctggtattcttgataattagtgtcagattttagaatcacttggttgacatgatgacattggaagttgagattcctttaaaaaaattatgatgcttataa

SEQ ID NO: 1220 - DNA, 1082 bp, Raphanus sativus
  misc_feature (231)..(231): n is a, c, g, or t
ggaaaacttgtaaaaaagccatccatcccagtttcttccaattcgccgatcaatcaactgacatttaaggggtttatcagatcgaagtcgcggaagaagaagaagaagaagatgtttctcactaggaccgagtatgacagaggagtcaacactttctctcctgaaggcaggttgttccaagttgagtatgccattgaagctatcaagcttggttctactgcaattggagtnaagacaaaggaaggagttgtgcttgctgtcgagaagcgtatcacctctcctttgctggagccgagcagtgtggagaagattatggagattgatgaccatattggttgtgccatgagcggtttaattgctgatgcacgtacacttgttgagcatgcaagagttgaaactcaaaaccacagattctcgtatggtgagccaatgactgtagagtccacaacgcaagcgctgtgtgatctggctttacggtttggtgaaggagatgaagaatcaatgtctcgcccatttggagtatctcttctcattgctggtcatgatgaaaacggaccaagcttgtactacacggacccatcaggaacattctggcagtgcaacgcaaaggccattggctcaggctcagaaggagctgatagttctcttcaagagcaattcaacaaagatctgtcactcagtgaagctgagacgatcgcggtgtctatcctcaagcaagttatggaagaaaaggtgactccgaataatgtggacattgccaaggtagctccagcttaccatctctacactccagaagaagttgaagcagtcattagtcgtctttgaggatgatgatactctcaatacgagtgatgtgtttatccgccttgttctagttcggattttgaaacaaagactttctttcacttttgtccgttagattggatgttttatgtgacatttaaagtcttgtttatgtaagagaacctcttatttcccattttcattcaagaatcgtctcggatttggttgactcaaaagttttcagtctcagggcttcgttttgttagttgttattgggtcggaatcccgttaatgggcca

SEQ ID NO: 1221 - DNA, 1026 bp, Euphorbia esula
  misc_feature (395)..(395): n is a, c, g, or t
  misc_feature (856)..(856): n is a, c, g, or t
aaaagccgaagtaaacagactctactcttctcccttctcttcattctccaaggatctgatagatcgaatcaaacatgtttctcaccaggactgaatatgatagaggagtcaacactttctctccggaaggaagattgtttcaggttgaatatgccatcgaagctattaagcttggttcaactgctattgggttaaagacaaaagaaggtgttgttcttgcagttgagaagcgtatcacttccccattgctggagcctagcagtgtggagaaagttatggaaattgatgagcatattggatgtgctatgagtgggttaattgcagatgctcgtacacttgttgaacatgctcgtgttgaaactcagaaccatagattctcttatggtgagcccatnacagtggagtctacaacacaagctctttgtgatctggctctacggtttggtgaaggtgatgaagaatccatgtctcggccttttggagtttctcttctcattgctggtcatgatgagcatggtcctagcctttattatacagatccatctgggacattttggcaatgcaatgcaaaggctattggttccggctcagaaggtgcagatagctccctgcaagagcaatataacaaggacatcacacttcaagaggctgagacaatcgccctttccattttgaaacaagttatggaagaaaaggtgacacctaacaatgttgacattgcgagggtagctcccacatatcatttgtatacccctgctgaggtggaaacagtcattggacgcctatgagaagaaaagaatggtgttatggaatttcacatgtattttccaattgttggtattgtcattcccgtganggtagcagaagattggaactcgtagaatctttatggttttcttgaattgggactcaaattgtgctctttgattgtcaattatgtacttcaaacttgtcggaatgaaacaccaaccccgttagactttgttcggttagaaattgaagtaccactagtgttgttctcaaaaa

SEQ ID NO: 1222 - DNA, 1250 bp, Nicotiana tabacum
  misc_feature (334)..(334): n is a, c, g, or t
  misc_feature (733)..(733): n is a, c, g, or t
  misc_feature (811)..(811): n is a, c, g, or t
  misc_feature (823)..(823): n is a, c, g, or t
  misc_feature (1040)..(1040): n is a, c, g, or t
  misc_feature (1062)..(1062): n is a, c, g, or t
  misc_feature (1082)..(1082): n is a, c, g, or t
  misc_feature (1099)..(1099): n is a, c, g, or t
  misc_feature (1107)..(1107): n is a, c, g, or t
  misc_feature (1110)..(1110): n is a, c, g, or t
gggttgagaaaatccgacccggtaaagaccgaagctaccttggttttgcagaaatggcttgtcactcaagtaaaaacaagtactagagcaaatcaattctccgtctaaaataaaacagtcacttcttagctactaaggatttgtttttctaaagctgtaataaatctgatcaaagatgtttctcactagaactgagtatgatagaggtgtgaacacattctctcctgaaggaagattgtttcaagttgaatatgctattgaagccattaagttgggatcgacggcaattgggataaagactaaggaaggcgttgttcttgctgttgagaagcgnattacctctccacttctggagccaagcagtgtggagaaaattatggaaattgatgagcatattggctgtgcgatgagtggattgatagctgatgcaaggactcttgttgaacatgcacgagttgaaactcagaaccacaggttttcttatggtgagcccatgactgttgagtccacaacacaagctctgtgtgatttggccctgcgatttggggagggtgatgaagagtctatgtccagaccttttggtgtatcacttctcattgctggccatgatgagaatggtccgagcctatattatactgatccttctggcactttctggcaatgcaatgcaaaagccattggttcaggttcagaaggtgctgacagctctttgcaggagcaattcaacaagganctcacccttaaggaggctgaaacgattgcactgtcaattctaaagcaagtgatggaagagaaggtgactcccaataangttgatattgcnagggtatctccaacttatcatctctactcgcctgctgaggtggaaactgttatcagccgcctataagaaagctctattgttacgcttgttacccatttctctattatgggcaatgtttacttccaactgttctagaatttgtggattggattgcccggtgtagcatgttaaattattagagcattatgagtcatagacaaatggtcaatccctttangttgcttggaaattccctaggntgggatggattgttttctgncgaggtctaagattcangtatggtnganaagatacgttttccatagaaaggcttgagttactttctatgcaatattgtgtctgacgagatgcttaaaattcccctagatgtgcctgttacctaaagaaaaatatgttattaatggccttttgttatgtggctcttcaa

SEQ ID NO: 1223 - DNA, 962 bp, Triphysaria pusilla
agtgcatttcgaagctttaatctgcaaaatgttcctcacaaggactgagtatgatagaggagtaaacactttctccccggagggccgattgtttcaagttgaatatgcgattgaggctatcaagttgggttcaactgctattgggattaagaccaaggaaggagtggttcttgctgttgagaagcgcataacttcgccacttttggagccgagcagtgttgagaaaattatggaaattgatgcacatattggttgtgccatgagtggtttaatagctgatgcacgtacactagttgaacatgcccgagttgaaactcagaatcataggttctcatatggtgaacccatgactgttgagtccactacacaagctctttgtgatcttgccttgcgatttggtgagggggacgaagaatcaatgtccaggccatttggtgtgtctcttctcattgctggtcatgatgagaatggtcccagcctattctatactgatccatctggcacattctggcaatgtaatgcaaaagctatcggatcaggttcggaaggcgctgacagctctttgcaagagcagtttaataaggatctaactctaaaagaagctgaaaccattgcactttccatccttaagcaagttatggaggaaaaggttacacccaacaacgttgatattgctaaggtgtcaccaacataccatctttactccccttctgaggttgaagcagttatcggacgcctatgataaaagatgagtccgtctatctgttctttagccttttcgcctatgatcctcatttttatttatgtaatgcttgaacgagttttgtactcttttaaatgttttgccaagcgtcgaataactgcggtttagtctgtttaactttctcaagatttctcatcactcaactgtattcgtaaaacttcttatcagacattttttctggtctttctggtggaatgtt

SEQ ID NO: 1224 - DNA, 1058 bp, Triphysaria pusilla
gaagaagtattaaggtgagtaaagctctcaattcagatctaatttgctgttgcttaattttctcaaaattaactcgcaccttatagttctcgccagtacatttcgaagctttaatttgctggatcaaaatgtttctcacaagaactgagtatgatagaggagtaaacactttctccccggagggccgcttgtttcaagttgaatatgcgattgaggctataaagttgggttcgactgcaattgggattaagaccaaggaaggagtggttcttgctgttgaaaagcgcattacgtcaccacttttggagccaagcagtgtcgagaaaattatggaaattgatgcacatattggttgcgccatgagcggcttaatagctgatgcacgtacgcttgttgaacatgcccgggttgaaactcagaatcataggttttcatatggtgaacccatgactgttgagtccactacacaagctctttgtgatcttgccttgcgttttggtgagggggacgaagaatcaatgtccaggccatttggtgtgtctcttctcattgctggtcatgatgagaatggtcccagtctatactatactgacccgtctggtacattctggcaatgtaatgcaaaagccatcggatcaggttcggaaggcgctgacagctcattgcaagagcagtttaataaggatctaactctgaaagaagctgaaacaactgcactttccatcctcaagcaagttatggaggaaaaggttacgcccaacaacgtcgatattgctaaggtatcaccaacataccatctttactccccttctgaggttgaagcagttatcggacgcctatgagaaaagattgtgcccttctatcagtctttttaaccttttctgcctatgatacacatttttatttatgtaatgcttgaaacgagctttgtactactactttaaatgttttgccaagtttcgaataactgtgatttagtctgttaactttctcaagatctctcatcactcgacttgactgaattcgtaaacaacttatcgcaaaaaaaaaaaaaaaaa

SEQ ID NO: 1225 - DNA, 1054 bp, Olea europaea
ctaatcttattattattatgttttcttttgctccaagaaattggggttttaatacgacgaatttgtggttgaaatttctaaatttctgtcattttgagttatttgcagcaaattctgaggctataattaatcgactcgaaaatgtttctcacaaggactgagtatgatagaggagtcaacactttctctccggaaggccgattgtttcaagtcgaatatgccattgaagctatcaagttgggttcgacagcaatagggttaaaaactaaggaaggggtggtccttgctgttgaaaagcgtattacctcgcctcttttggagcctagcagcgttgagaaaattatggaaattgatgatcatatcggttgtgccatgagtggcttaattgctgatgcccgtacactggttgaacatgcacgagttgaaactcagaatcataggttctcatatggtgagcccatgacagttgagtccactacacaagctctctgtgatcttgccctgcgatttggtgagggtgatgaagaatctatgtctagaccttttggtgtctcccttctcattgctggtcatgatgagaatggacccagcttgtactataccgatccttctggtactttctggcaatgcaatgcaaaagccattgggtcaggttctgaaggtgcagacagttctttgcaggagcagtacaacaaggatcttaccctgaaagaagcagaaaccattgcgctttccatcctgaagcaagtgatggaagaaaaggttacacccaacaatgttgatattgcaaaggtagcaccaacttaccatctgtactcgccttctgaggttgaacaggttatcagccgcctataagaaaaggccatcaatttcctttgctgattttcattgcaaaatcactttcccaatattcgtatgcttgaattcaatatgaactattaagaggatttgttttggctttgatgagcaaactactgtggacttgtgaacatattttctgttaaatgaatcatttgtgaacctattttctgttaaatgaatcaatgtttctttc

SEQ ID NO: 1226 - DNA, 887 bp, Panax ginseng
caaattcaatacagttgcatctccctcaagtcttagctaactttattcaccgatttttaagttctcattagatcgaagatgtttctcaccaggaccgagtacgacagaggtgtgaataccttctctcccgaaggccgattgtttcaggttgaatatgctattgaggctatcaagttaggttcaactgcaattggattgaagactaaggaaggggttgttcttgctgttgaaaagcgtatcacctcaccactcttggagcctagcagtgtggaaaaaattatggaaattgatgagcacattggttgtgcgatgagtggattgattgctgatgcccgtacactagtggaacatgcacgagttgaaactcagaatcataggttctcatatggtgagccaatgactgttgagtccactacacaagcactctgtgatttggcattacgatttggtgaaggggatgaagaatctatgtctcgaccatttggggtatccctactcattggtggtcatgacgagaacggtccgagcttatactatacagatccttcaggcacattttgggaatgtaatgggaaagctattggttcaggctctgaaggtgctgacagctctttacaggagcaatataacatgacttaaccctcaaagaagctgaaacaatagctctttccatattgaagcaagttatggaagaaaaggtgacacctaataacgtggatattgcaaaggtagctccaacttaccatttgtacacccctgctgaggtggaggctgtcatcagtcgcctataaaaaagaacttccatcttccatcgaaaagttctggtcttgatgtggcttttgattatattacaatttctgatatactttttgtactgatcttctggg

SEQ ID NO: 1227 - DNA, 1104 bp, Sarracenia psittacina
gagcttagctttcttctccaaatctcaagcctctctatctacaaacagaaatccggggtttgattgaatcgaagatgtttctaacaaggactgaatacgatagaggtgtcaataccttctctccagaaggtcgattgtttcaggttgaatatgccattgaggccattaagctaggttccacagcaattgggttgaagacgaaggaagggttgtgcttgccgttgagaagcgtatcacttcacctctcctggagcccagcagtgtggagaaaattatggaaattgatgaacatattggatgtgcaatgagtgggctgattgctgatgcacgtactcttgttgaacatgcacgagttgaaactcaaaatcataggttttcatacggtgagcctatgactgttgagtctactacacaagctctgtgtgacttggccctgcgatttggtgaaggggatgaagaatctatgtcccgaccatttggtgtatctcttctcattgctggttatgatgagaatgggcctagcttatactatacagatccatccggtacattttggcaatgcaatgcaaaagctattggttcaggttctgaaggtgctgacagctctttgcaggagcaatataacaaggacataacacttaaagaagctgaaacaatagccctttccattttgaagcaagttatggaagaaaaggtgacacccaataacgtcgacattgcaaaggttgctccgacttaccatttgtacaccccttcagaggtggaggctgtaataagtcgcctatgagaagaaaatcccatcaatgatatctgcagtcatttgttgaccttttaattatgctcacaatttatattatgttggttgagtttagctggattttaactgggaaatcattttttgttctgttattgaactatgttctccgatggatgtaataacttctttcaaggtagagaactaaaagcttatccatgattctggaggtgttattggtggcttttgttgtccgaagcacaaaacgggtaaatgatgcttgtggaaagaagctggctactttgcagtctatgggatggactgcgaagtctagtttgggcaaagtgtga

SEQ ID NO: 1228 - DNA, 1238 bp, Ricinus communis
ggactgaaataaatgagcttaaaactactttggataaattgagctctaaatgtaaccggaacgtttcggtacggcgacctgtcttgttaaacaagtagagaactttacaaaatcacaagaaagagaacacacaaagcaaacagaccctactctctctcactttctctctcttgctctctctcaaagatctgaggttccaatcgaagcaaagatgtttctcacaaggaccgagtatgatagaggagttaacactttctctccagaagggagattgtttcaggttgaatatgctattgaagccatcaagttaggttccactgcaattgggttaaagacaaaagaaggtgttgtgcttgctgttgagaagcgtatcacctcacctctgctggaacctagtagtgtggagaaagttatggaaattgatgagcatattggatgtgctatgagtggtttgattgcagatgctcgtacacttgttgagcacgcacgtgtggaaactcagaaccatagattctcatatggtgagcccatgacggtggaatctacaacacaagcactttgtgatctggctctacgatttggggaaggcgatgaagactccatgtctcgtccatttggggtgtcactccttattgctggtcatgatgagaatggtcccagcctgtattatactgatccatctggaaccttttggcaatgcaatgcaaaggctattggttcaggttcagaaggtgcagatagctctttgcaagagcaatataacaaggacatcactcttctggaggccgagacaattgcactttccattctgaagcaagttatggaagaaaaggtgactccaaacaatgttgacattgcaagggtggccaaaacctatcatctttatacccctgcagaggtggaggctgtcattagtcgcctatagataggaagaaagacaatgccgtgaaagtcgttcttgacatggcccacattccctattgttatcttttactgtaaggcttcttatttgttgggggaagcagaggattgggttagacccgtacaaatattttttctggaatgctgtaaaactgtcaacttcttgttagttgcgtcacttgatttcatgccgtcaaatgaaacaaaaaattttccataattctcttgatgtcagttcctagtgctattaatgtttcattttcagttcagcagtagtgtgagaaatatgatgcatctttggctgtgtttaaatatta

SEQ ID NO: 1229 - DNA, 1151 bp, Mimulus guttatus
tcttcttcgttgtgttaattaaggttagtcggattcagatccgcctcaatcctccatttttactgattttgtttttctctacagattatcagttatttatcctctcaattttaactgttgattttgaatctgtagcttgcttcaatcgaaaatgttcctcacgaggacggagtatgatagaggagtcaatactttctctcctgaaggcagattgtttcaagtcgaatatgccattgaagctattaagttgggttcaactgcaataggggtaaagactaaggaaggagtagttcttgccgtggagaagcgcattacctcgccgcttttggagcctagtagtgtggagaaaattatggaaattgatcaacatatagggtgtgccatgagtggcttaattgccgatgctcgaacactcgtcgaacatgcacgggttgaaactcagaaccataggttctcgtatggtgagcccatgacagtcgagtcaacaactcaagctctttgtgatcttgccttgcgatttggtgagggggatgaagaatcaatgtcaagaccttttggtgtctctcttctcattgctggtcatgatgagaatggtcccagcctttactatacagatccttccggtactttctggcaatgcaatgcgaaagccattggatcaggttccgaaggtgctgacagctctttgcaggagcagtataacaaggacctgactctgaaagaagctgaaaccattgcactctccatcctgaagcaagttatggaggagaaggttacagccaacaatgttgatattgccaaggtgtcaccaaattaccatctttactcccctactgaagtggaagcagttatcgctcgactatgaaaaaaaaaacacaaaatccatcactgtgatttgttttcattcttcccttgacctacagtttcggttattcacgtgcttggacctgttttgtgctgccgctactcttataatcttatggcttttgcgaataccaaattcgatgagaaaactgttgtcctgagtatatgttaactttctcatgagttgaatgaatttaaaatacttcatttgagacatatttctctggcaagaattctcatgattgattattcagtgcatgatgatatttatattaaaacattattat

SEQ ID NO: 1230 - DNA, 953 bp, Brassica oleracea
gggaagctaaaagacggagccgaacgcatccagtttcctcgattcgcccaccaatcagctcacagacactaaaggggttttacagatcgaagccgccggagaagaagaagaagatgtttctcacgaggactgaatacgacagaggagtcaacactttctctcctgagggtaggctattccaagtcgagtacgccattgaagctatcaagcttggttctactgcaattggagtaaagacaaaggaaggagttgtgcttgctgtcgagaagcgtatcacctcgcctttgctggagccgagcagtgtggagaagattatggaaattgatgaccatattggctgtgccatgagcggtttaattgctgatgcgcgtactcttgttgagcatgcaagagttgagactcaaaaccacagattctcgtatggtgagccaatgactgtagagtccactacacaagccctgtgtgatctggctttacggtttggtgaaggagatgaagaatcaatgtctcggccatttggagtttctcttctcatcgctggtcacgatgaaaacggaccgagcttgtactacacagacccgtccggaacattctggcagtgcaatgcaaaggcgattggttcagggtcagaaggagctgatagttctcttcaagaacaattcaacaaagatctgtcacttgaagaagctgagacaatcgctgtatctatcctcaagcaagttatggaagaaaaggtgactccgaataatgtggacattgccaaggtagctccagcgtaccatatctacactccgcaggaagttgaagcagttattagtcgtctttgaggaagatgctcaaatacgggtgatgtatctcttatccgcctctgtgtttacttcggatttataaaccaagagatttttatttcacctggtctgttagatttgatgtttcatttgacgtttttaatt

SEQ ID NO: 1231 - DNA, 1073 bp, Brassica rapa
gttcaagaagtgaaccttcggaagctaaaagacgagagccaaacgcatccagtttcctcgattcgccgatcaatcagctcacagacacttaaaggggttttacagatcgaagtcgccggagaagaagatgtttctcactaggactgagtatgatagaggagtcaacactttctctcctgaagggaggcttttccaagtcgagtacgccattgaagctatcaagcttggttctactgcaattggagtaaagacaaaggaaggagttgtgcttgctgtcgagaagcgtatcacctcacctttgctggagccgagcagtgtggagaagattatggaaattgatgaccatattggctgtgccatgagcggtttaattgctgatgctcgtactcttgttgagcatgcaagagttgagactcaaaaccacagattctcgtatggtgagccaatgactgtagagtccactacacaagccctgtgtgatctggctttacggtttggtgaaggagatgaagaatcaatgtctcggccatttggagtctctcttctcattgctggtcatgatgaaaacggaccgagcttgtactacacagacccgtccggaacattctggcagtgcaatgcaaaggcgattggatcagggtcagaaggagctgatagttctcttcaagaacaattcaacaaagatctgtcacttgaggaagctgagacgatcgctgtatctatcctcaagcaagttatggaagaaaaggtgactccaaataatgtggacattgccaaggtagctccagcgtaccatatctacactccacaggaagtggaagcagtcattagtcgtctttgaggatgatgcttcagatacggttgatgtatctctatcctcctttgtgtctgtctacattcggatttataaaccaagagaatttactttcacttcggtctgttagatttgatatttttttgaagtttttagttgtgttgtgtaagataatctttctttcccatgccaatcaataacctatcggattttgtgacagaaaattactgatgcaattgaccttatcttttcttgaaac

SEQ ID NO: 1232 - DNA, 1005 bp, Brassica napus
gaacgcatccagtttcctcgattcgcccaccaaccagctcacagacactaaaggggttttacagatcgaagaagaagatgtttctcacgaggactgagtacgacagaggagtcaacactttctctcctgagggtaggctattccaagtcgagtacgccattgaagctatcaagcttggttctactgcaattggagtaaagacaaaggaaggagttgtgcttgctgtcgagaagcgtatcacctcgcctttgctggagccgagcagtgtggagaagattatggaaattgatgaccatattggctgtgccatgagcggtttaattgctgatgcgcgtactcttgttgagcatgcaagagttgagactcaaaaccacagattctcgtatggtgagccaatgactgtagagtccactacacaagccctgtgtgatctggctttacggtttggtgaaggagatgaagaatcaatgtctcggccatttggagtttctcttctcatcgctggtcacgatgaaaacggaccgagcttgtactacacagacccgtccggaacattctggcagtgcaatgcaaaggcgattggttcagggtcagaaggagctgatagttctcttcaagaacaattcaacaaagatctgtcacttgaagaagctgagacaatcgctgtatctatcctcaagcaagttatggaagaaaaggtgactccgaataatgtggacattgccaaggtagctccagcgtaccatatctacactccgcaggaagttgaagcagttattagtcgtctttgaggaagatgctcaaatacggttgatgtatctcttatccgcctctgtgtttacttcggatttataaaccaagagatttttatttcacctggtctgttagatttgatgtttcatttgacgtttttaattgtgttgtttaagagaatctttctttcaatcaataaccgatcggatttgtgacagaaaatttctgatgcaaatgaccttatcttttctt

SEQ ID NO: 1233 - DNA, 1124 bp, Brassica napus
cggaattactgactccgtgccacaggcccgaccctgatttcccatgtccacccgggcgtgcgaatcaatcagctgctatgattatctaatctcaacaagttcttccttgattacactccctttcttttgttcccgagttcttgcattcatccagatctgttaatttttctaaggttttgattctgttggtgataactgataaggttttacagatcgaagaagaagatgtttctcacaaggaccgagtacgacagaggagtcaacactttttctcctgaaggaaggctattccaagtcgagtatgccattgaagctatcaagcttggttctactgcaattggagtaaagactaaggagggagttgtgcttgctgtcgagaagcgtatcacctcccctttgctggagccgagcagtgtggagaagattatggaaattgatgaccatattggctgtgccatgagcggcttaattgctgatgcgcgtactcttgttgagcatgcaagagttgaaactcaaaaccacagattctcgtatggtgagccaatgactgtagagtccaccacgcaagcgctgtgtgatctggctttacggtttggtgaaggagatgaagaatcaatgtctcggccatttggagtctctcttctcattgctggtcatgatgaaaacggaccgagcttgtactacacggacccgtctggaacgttctggcagtgcaatgcaaaggcgattggttcaggctcagaaggagctgatagttctcttcaagagcaattcaacaaagatctgtcgctcagtgaagctgagacgatcgctgtatctatcctcaagcaagttatggaagaaaaggtgactccaaataatgtggacattgccaaggtagctccagcgtaccatatctacactccacaggaagtggaagcagtcattagtcgtctttgaggatgatgcttcagatacggttgatgtatctctatcctcctttgtgtctgtctacattcggatttataaaccaagagaatttactttcacttcggtctgttagatttgatatttttttgaagtttttagttgtgttgtgtaagataatctttctttcccatgccaatcaataacctatcggattt

SEQ ID NO: 1234 - DNA, 1045 bp, Brassica napus
atgggcaattcgatagactggacgagctgatttacgtggagagccaaacgcatccagtttcctcgattcgccgatcaatcagctcacagacacttaaaggggttttacagatcgaagtcgccggagaagaagatgtttctcactaggactgagtatgatagaggagtcaacactttctctcctgaagggaggcttttccaagtcgagtacgccattgaagctatcaagcttggttctactgcaattggagtaaagacaaaggaaggagttgtgcttgctgtcgagaagcgtatcacctcacctttgctggagccgagcagtgtggagaagatcatggaaattgatgaccatattggctgtgccatgagcggtttaattgctgatgctcgtactcttgttgagcatgcaagagttgagactcaaaaccacagattctcgtatggtgagccaatgactgtagagtccactacacaagccctgtgtgatctggctttacggtttggtgaaggagatgaagaatcaatgtctcggccatttggagtctctcttctcattgctggtcatgatgaaaacggaccgagcttgtactacacagacccttccggaacattctggcagtgcaacgcaaaggcgattggttcagggtcagaaggagctgatagttctcttcaagaacaattcaacaaagatctgtcacttgaggaagctgagacgatcgctgtatctatcctcaagcaagttatggaagaaaaggtgactccaaataatgtggacattgccaaggtagctccagcgtaccatatctacactccacaggaagtggaagcagtcattagtcgtctttgaggatgatgcttcagatacggttgatgtatctctatcctcctttgtgtctgtctacattcggatttataaaccaagagaatttactttcacttcggtctgttagatttgatatttttttgaagtttttagttgtgttgtgtaagataatctttctttcccatgccaatcaataacctatcagattgtgacagaaaattat

SEQ ID NO: 1235 - DNA, 992 bp, Cleome gynandra
tcggggtaagtcttagaaaggagcagactgacaaagaggtattccaagctctttcttcgattctcccagatcaaaacgaacttatcattaaggcttttcagatcgaaatcttagacgacgatgtttctcaccagaactgagtatgacagaggtgtcaacaccttttctcctgaaggtcggctattccaagtagagtatgccattgaagccatcaagcttggttctactgctattggtgtaaagacgaaggagggagttgtgcttgctgttgagaagcgtataacctcgccactgctggagccgagcagtgtagagaaaattatggaaattgatcagcacataggatgtgccatgagtggtctgattgctgatgctcgtacacttgtagagcatgctcgagttgaaactcaaaatcacaggttttcgtatggtgagccaatgactgtggagtctacaacacaagctctgtgtgatcttgctttacgattcggtgaaggagatgaagagtcaatgtctaggccatttggagtatctcttcttattgcaggtcatgatgaaaatggaccaagcctatactacacagatccgtcaggaacattctggcaatgcaacgctaaggcaattggttcaggctcagaaggcgctgacagctccttgcaagaacaatacaacaaggatttgactctccaagaagcggagataattgcattgtcgatcctcaaacaagttatggaagaaaaggtgactgcaagcaatgtagacattgccaaggttgcaccggagtatcatctgtacactcctcaagaggttgaggcagtcatcagtcgtctatgatgaaaatcctccgatgcaaacagaacttctactatgtctggtgaatcttcgtatctccaatgagttgttatagcttgtgtcatcttctgattccgaatcaagtgactgtcttttcatctgtggcacggaaccacttcactttgttctgttcagatgat

SEQ ID NO: 1236 - DNA, 1188 bp, Cucumis sativus
aagaaagggtctgcttaaagcttactgaacaacgctgttgttgctgcttcttcttcttcttcctatactgcttcagaatctaccaggtttcttcatttcaattgcaaaaatgtttctgaccaggaccgagtatgataggggtgtcaataccttctctcctgaaggtcgattgttccaggttgagtacgcgattgaggctattaagctgggttcgacggctattggtttgaaaacaaaggaaggcgttgtgcttgccgttgagaaacgtattacatctccactactggaaccaagtagcgtggaaaaaatcatggaaattgatgagcatattggatgtgcaatgagtggattaattgctgatgctcacacacttgttgaacatgctcgagttgagacccagaaccatcggttctcatatggtgaaccaatgactgtggagtctacaacacaagctctttgtgatctagccctaagattcggcgaaggcgatgaggagtccatgtctcgaccattcggagtagctcttcttattgctgggcatgatgagaaggggccaagcttattctacactgatccatctggcactttctggcaatgcaatgctaaagctatcggttcgggttctgaaggtgcagatagctctctgcaagagcaatacaacaaggacctaacacttcaagaagctgaaaccatagcactttccattctaaagcaagttatggaagagaaggtaactcccagcaatgttgatattgcgaaggtgtctccaacataccatctgtacacccctgcagaggtggaggcggtgattagccggctatgaggggggttctttcgaaaatcttctggactgctgttatgtttcttgtcactggcatgtatttgtactctttgaatggtgagggagaatctgaggttttcggctactttcgaagctattggtgatgtgtttactgatagcttacaaattaaatatgggacattcttgatgggttattgcaaacttagatgaacaatttgattagtccttttacgaaagccctgatcattatattctgaaacgccattttgtttcaaaacgtgagaatatcttgtggcaaacaggaaatattcgagttagcagcaagcagattcattgtttctatactttttcttcgtcttcacatttttgttttagtgttactctta

SEQ ID NO: 1237 - DNA, 1076 bp, Cucurbita pepo
cttcttcttcttcttcctttgtagaatctagacgaatttcttccattgaaccgcaaaatgtttctgaccaggactgaatatgatagaggtgtgaatactttctctcctgaaggacgattgttccaggttgagtacgcgattgaggctattaagcttggttcgacggcaattggtttgaaaacgaaggaaggcgttgtgctggcggttgaaaaacgtattacatctccactactggaaccaagtagcgtggaaaagatcatggaaattgatgagcatttaggatgtgcgatgagtggattgattgctgatgctcacacacttgttgagcatgctcgagttgagacccagaaccatcggttctcatatggtgaggcaatgactgtggagtctacaacacaagctctttgtgatctagccctaagatttggcgaaggcgacgaggagtccatgtctcgaccatttggtgtagctcttcttattgccggccatgatgagaaggggcccagcttattctacactgatccatccggcactttctggcaatgcaatgctaaagctatcggttcaggttctgaaggtgcagatagctctctgcaagagcaatacaacaaggacctaactcttctagaagctgaaaccatagccctttccattctcaagcaagttatggaagagaaggtgactccgaacaacgttgatattgcgaaggtggctccgacataccatctatacacccctgccgaggtcgaggcagtcattagcaggctatgagaggttctttccaagatcctccgaactgctgtcatgttccttgtcacttgcatgtagttgtactcttctttgtctggtgagggagaatctcaggttttcagctactttacgaactttcggtgcatcgttttactgatagcttacagattaattatgggacattcttgatggtttattagatgaacatgattctgatgcgccattttgttccaagacgtgagaatgaataccttccaacaggagacattctagttaccagcaagcaaatttattgtccctacacttcctcgtccttgttcatttaa

SEQ ID NO: 1238 - DNA, 1045 bp, Carpinus betulus
aaacgctcgttcttcagctctctttctctcacactcacacatatcattcaaaccgattctaggacttttatcgaattgaaccggaaatgtttctcacaaggactgagtatgacagaggagtgaacaccttctctccagaagggcggttgtttcaggttgagtatgccattgaggccatcaagttgggttcaactgcaattgggttgaagacgaaagaaggagttgtgcttgcagttgagaaacgtatcacttcgccactactggaacccagcagtgtggagaaaattatggaaattgatgaccatattggatgtgccatgagtggattgattgctgatgctcgaacacttgttgagcatgcgcgggtggaaactcagaaccataggttctcctatggtgagccaatgactgtggagtctacaactcaagctctttgtgatctggccctacgatttggcgaaggtgatgaagaatccatgtctcgacctttcggagtttctcttctcattgctggccatgatgagaatgggcccagcctatactataccgatccatctggcactttttggcaatgcaatgcaaaagctattggttcgggttcagagggtgcagacagctctctgcaagagcagtacaacaaggacatcactcttaaagaagctgaaaccattgctctttccattttgaggcaggttatggaagaaaaggtgactccaagtaatgttgatattgcgaaggtggctccatcataccatctatataccccttctgaggtggaggctgtcatcaatcgcctatgagcacaagcccttgcatgagcaattatctccaacttactgttgaaatatttgtgttaaattattttgctggggaaaaaagattgtattttattctgtcttttggatatgttgaggggcccttgacttttctggcacttattgaagatgaaatctcttgatggttgatgatattgctgtcccttgacagaatggaagcatttcatgggaacaagaatagagaacttttgaattaaatattgcatggt

SEQ ID NO: 1239 - DNA, 1046 bp, Ipomoea nil
ggcgaaacggcgagagtaaaaggcattgtttgctccttcaactgcgacgacacgatctaaattttgaagctctactgaatcatatcggcaatgtttctcacaagaaccgagtatgatagaggtgtcaacactttttcgcccgagggccgattgttccaagttgaatatgctattgaagccatcaagctcggttcaacggcaatcgggataatgactaaggaaggggttgttcttgctgtcgagaagcgcatcacttctcccctcctggaacctagcagtgtggagaaaattatggagattgatcagcatattgggtgtgcaatgagtggattaattgctgatgcacggacgcttgtagagcatgcacgtgtggagactcagaatcacaggttctcctatggtgaacctatgactgttgagtctaccacccaagctctctgtgatttagctctgcgatttggtgagggtgatgaagaatctatgtcaagacccttcggtgtatctcttctcattgctggtcatgatgagaatggtcccagcttatactatactgacccatctggtacattctggcaatgcaatgcaaaagctataggctcgggatctgaaggtgctgacagctctttgcaagagcagtacaacaaggaccttactttgaaggaagccgaaacgatagcactatccatcctcaagcaagttatggaagaaaaggtgactcccaacaacgttgatattgcaaaggttgctccagattatcacctgtacactccaagcgaggtggaggctgtccttagccgcctataagacgagctcccagttaattttcctttcatccattctcctgttactggcattgaaccgtggcattggcatttattctgtagttccaagattcttgccttgttactttagtttatgactttgggtttatggggtttgaacacaaatgcatctctgctttaagagagtgttatgttttattgccaattacacaaaagaatgatttctttccatgagaagtttgatggtttaacacaactctgatc

SEQ ID NO: 1240 - DNA, 1188 bp, Cucumis melo
aagaaagggtctgcttaaagcttactgaacaaagccttgttgctgcttcttcttctttcttcgctgcttcagaatctaccaggtttcttcaattctatcgcaaaaatgtttctcaccaggaccgagtacgataggggtgtcaataccttctcacctgaaggtcgattgttccaggttgagtacgcgattgaggctattaagctgggttcgacggctattggtttgaaaacaaaggaaggcgttgtgcttgccgttgagaaacgtattacatctccactactggaaccaagtagcgtggaaaaaatcatggaaattgatgagcatattggatgtgcaatgagtggattaattgctgatgctcacacacttgttgaacatgctcgagttgagacccagaaccatcggttctcatatggtgaaccaatgactgtggagtctacaacacaagctctttgtgatctagccctaagattcggtgaaggcgatgaggagtccatgtctcgaccatttggagtagctcttcttattgctggacatgatgagaaggggccaagcttattctacacagatccatctggcactttctggcaatgcaatgctaaagctatcggttcgggttctgaaggcgcagatagctctctgcaagagcaatacaacaaggacctaactcttcaagaagctgaaaccattgcactttccattctgaagcaagttatggaagagaaggtaactcccagcaatgtcgatattgcaaaggtgtctccaacataccatctgtacacccctgcagaggtggaggctgtcattagccggctatgaggggggttctttcgaagatcttctggactgctgttatgtttcttgtcactggcatgtatttgtattcttctttgtctggtgagggagaatctgaggttttcggctactttcgaagctattggtgatgtgtttactgatagcttacaaattaattatgggacattcttgatgggttattgcaaacttagatgaacaatttgattagtccttttacgaaagccctgaacattatatgctgaagcgccattttgtttcaaaacgtgagaatatcttgtggcaaacaggaaatattcgagttagcagcaagcagattcattgtttctatactctttctttgttttcacatttttcttttaacgtgactcttaa

SEQ ID NO: 1241 - DNA, 976 bp, Lippia dulcis
agattaaggttggttggatttcgatccactaaatcgttgttagctaacctcaatttaactctcaattcaatctttctgcaggaaatcctcaagctctagtttattgggtcgaaaatgttcctcacaaggactgagtatgatagaggagtgaacactttctctccggaaggccgattatttcaagtcgaatatgcgattgaagctatcaagctgggttcgactgcaattgggataaaaactaaggaaggagtggttattgctgttgagaagcgcattacttcaccgcttttggagcccaacagtgttgagaaaataatggaaattgatgaacatattggctgtgcgatgagtggcttaattgctgatgcacgtactctagttgaacatgcacgggttgaaacacagaatcataggttctcttatggtgagcccatgacggttgagtccactacccaagctctttgtgatcttgccttgcgttttggtgagggggatgaagaatcaatgtcgagaccttttggcgtgtctcttctcattgctggtcatgatgagaatggccccagcctatactatactgatccatccgggacattctggcaatgtaatggaaaagccattggatcaggttcagaaggtgctgatagctccttacaagaacagtttaacaaggatctaactctcaaagaagctgaaactattgcactttcaattctgaagcaagttatggaggaaaaggttacaccaaacaacgtggatattgctaaggtggcaccaacctaccatctttactccccttctgaggtggaagctgttatcaatcgcctatgaggaaacttcacattccgttattccccttcttgattgaatatgtttctgcgacttccttacatgttttagtagaacaagaaaattgctgtttagtctgtcaactttctgtgctttgaatgaatttggaatgttctcttgaccaaaaaag

SEQ ID NO: 1242 - DNA, 1063 bp, Papaver somniferum
aaggactgagtatgatagaggtgtgaatactttctcacctgaaggaagattgtttcaggtcgagtatgcaattgaagctattaagcttggatcaactgcaattgggttaaagactaaagagggagtagtgcttgctgtcgagaagcgtattacttcgccattgctggaacctagtagtgtggagaaaatcatggaaatcgatgagcatataggctgtgcgatgagtggactaattgctgatgctcgtacacttgttgaacatgcacgagtcgaaactcagaaccacaagttctcatatggtgagcccatgactgttgaatccacaacacaagctttatgtgatcttgccctacgatttggtgaaggcgaagaagagtccatgtctcggccttttggtgtatcacttctcattgctggtcatgacgaaaatgggccaagcctatactacacagacccgtcaggcacattttggcagtgtaatgcaaaagcaatcggatcaggttctgagggggcagatagctctttgcaggagcagttcaacaaggagatgacactccaagaagccgaaacagctgctctttcgatcttgaagcaagtgatggaagagaaggtgactcccaacaatgttgacattgcaaaggttgctccaaagtaccatttgtattctccctctgaggtggaggctgtcatagctcgcctatagaaagaaaatcattctcttcggcaaggttttcctgtcttacttcccgccgccttcatgtaatgacttagtcaggagataaaacttcactgtgatctggttttccccgtcttacttcccaccgccttcgagtaatgacttcgttaggagataaacttcatcgtgatctggtttttcctaccgccttcaagcaggagataaacttcattgtgatttggttatggaacctactcccttgtgattcttttttaaatttacttttttttgttggtagtagtagttccttctttcttaggtcgagataaactcatacttaggtggttggtcgggtcgtccgtctctaaggcgacacgagggagtagg

SEQ ID NO: 1243 - DNA, 1030 bp, Raphanus sativus
gggaaccttcggaaagctaaaaagagcgagccaaacgcatccagtttctccgattcgccgatcaatcagctcacagacacttgaaagagggttttacagatcgaagaagaagaagatgtttctcactaggactgagtatgacagaggagtcaacactttctctcctgaaggcaggctcttccaagtcgagtacgccattgaagctatcaagcttggttctactgcaattggagtgaagacaaaagagggagttgtacttgctgtcgagaagcgtatcacctctcctttgctggagccgagcagtgtggagaagataatggaaattgatgaccatattggctgtgccatgagcggtttaattgctgatgcgcgtactctcgttgagcatgcacgagtcgagactcaaaaccacagattctcgtatggtgaaccaatgactgtagagtccactacacaagccctgtgtgatctggctttacggtttggtgaaggagatgaagaatcaatgtctcggccatttggagtctctcttctcatcgctggtcatgatgaaaacggaccgagcttgtactacacggacccatctggaacattctggcagtgcaatgcaaaggcgattggttcaggctcagaaggagctgatagttctcttcaagaacaattcaacaaagatctgtcacttgaagaagctgagacgatcgctgtatctatcctcaagcaagttatggaagaaaaggtgactccgaataatgtggacattgccaaggtagctccagcgtaccatatctacactccacaggaagtcgaagcagtcattagtcgtctttgaggaagatactcaaatgcggttgatgtatctctatccccctttgtgtcttcttcggatttataaacaaagagaatttatttttcacctggtctgctagatttgatgtttcatttgacgttttagttgtgttgtgtaagagaatcttttctttaccatgtcattcaataacctatcggattttctgacagaaaatttccgtta

SEQ ID NO: 1244 - DNA, 985 bp, Raphanus sativus
catcccagtttcttccagttcgccgatcaatcaactgatatttaaggggtttatcagatcgaagtcgcggaagaagaagaagaagaagatgtttctcactaggaccgagtatgacagaggagtcaacactttctctcctgaaggcaggttgttccaagttgagtatgccattgaagctatcaagcttggttctactgcaattggagtcaagacaaaggaaggagttgtgcttgctgtcgagaagcgtatcacctctcctttgctggagccgagcagtgtggagaagattatggagattgatgaccatattggttgtgccatgagcggtttgattgctgatgcgcgtacacttgttgagcatgcaagagttgaaactcaaaaccacagattctcttatggtgagccaatgactgtagagtccacaacacaagcgctgtgtgatctggctttacggtttggcgaaggagatgaagaatcaatgtctcggccatttggagtatctcttctcattgctggtcatgatgaaaacggacccagcttgtactacacggacccatcaggaacattctggcagtgcaacgcaaaggccattggctcaggctcagaaggagctgatagttctcttcaagagcaattcagcaaagatctgtcactcagtgaagctgagacgatcgcggtgtctatcctcaagcaagttatggaagagaaggtgactccgaataatgtggacattgccaaggtagctccagcttaccatctctacactccagaagaagttgaagcagtcattagtcgtctttgaggatggttctcattacgagtgatgtgtttatccgccttgttctagttcggattttgaaacgaagatttctttcacttttgtccgttagattggatgttttatgtgacatttgaagtcttgttttatgtaagagaacctcttatttcccattctcattcaagaatctcggatttggttgactca

SEQ ID NO: 1245 - DNA, 927 bp, Raphanus sativus
  misc_feature (49)..(49): n is a, c, g, or t
  misc_feature (198)..(198): n is a, c, g, or t
  misc_feature (405)..(405): n is a, c, g, or t
  misc_feature (450)..(450): n is a, c, g, or t
  misc_feature (477)..(477): n is a, c, g, or t
  misc_feature (525)..(525): n is a, c, g, or t
  misc_feature (750)..(750): n is a, c, g, or t
  misc_feature (759)..(759): n is a, c, g, or t
  misc_feature (839)..(839): n is a, c, g, or t
  misc_feature (869)..(869): n is a, c, g, or t
  misc_feature (900)..(900): n is a, c, g, or t
catcccagtttcttccaattcgccgatcaatcaactgacatttaagggntttacagatcgaagtcgcggaagaagaagatgtttctcacaaggaccgagtatgacagaggagtcaacactttctctcctgaaggcaggttgttccaagttgagtatgccattgaagctatcaagcttggttctactgcaattggagtnaagacaaaggaaggagttgtgcttgctgtcgagaagcgtatcacctctcctttgctggagccgagcagtgtggagaagattatggagattgatgaccatattggttgtgccatgagcggtttaattgctgatgcgcgtacacttgttgagcatgcaagagttgaaactcaaaaccacagattctcgtatggtgagccaatgactgtngagtccacaacacaagcgctgtgtgatctggctttacggtttggngaaggagatgaagaatcaatgtctcgnccatttggagtatctcttctcattgctggtcatgatgaaaacggaccnagcttgtactacacggacccatcaggaacattctggcagtgcaacgcaaaggccattggctcaggctcagaaggagctgatagttttcttcaagagcaattcaacaaagatctgtcactcagtgaagctgagacgatcgcggtgtctatcctcaagcaagttatggaagagaaggtgactccgaataatgtggacattgccaaggtagctccagcttaccatctntacactccngaagaagttgaagcagtcattagtcgtctttgaggatgatgatgctcaatacaagtgatgtgtttttatccgacttgttntagttcggattttgaaacaaagactttctntctgttagatttgatgtttcatgtgacattntaagcattgttatgtaagagaaccttt

SEQ ID NO: 1246 - DNA, 989 bp, Raphanus sativus
gcgagccaaacgcatccagtttctcagattcgccgatcaatcagctcacagacagttaagggagggttttacagatcgaagaagaagatgtttctcactaggactgagtatgacagaggagtcaacactttctctcctgaaggcagacttttccaagtcgagtacgccattgaagctatcaagcttggttctactgcaattggagtgaagacaaaagagggagttgtgcttgctgttgagaagcgtatcacctctcctttgctggagccgagcagtgtggagaagattatggaaattgatgaccatattggctgtgccatgagcggtttaattgctgatgcgcgtacactcgttgagcatgcaagagttgagactcaaaaccacagattctcgtatggtgagccaatgactgtagagtccactacacaagccctctgtgatctggctttacggtttggtgaaggagatgaagaatcaatgtctcggccatttggagtctctcttctcattgccggtcatgatgaaaacggaccaagcttgtactacacggacccgtctggaacattttggcagtgcaacgcaaaggcgatcggttcaggctcagaaggagctgatagttctcttcaagaacaattcaacaaagatctgtcacttgaagaagctgagaccatcgctgtatctatcctcaagcaagttatggaagaaaaggtgactccgaataatgtggacattgccaaggtagctccagcgtaccatatctacactccacaggaagttgaagcagtcattagtcgtctttgaggaagatactcaaatgcggttgatgtatctctatccccctttgtgtcttcttcggatttataaacaaagagaatttatttttcacctggtctgctagatttgatgtttcatttgacgtttttagttgtgttgtgtaagagaatattttctttaccatgccattcagtaacctatcggattttgtgaca

SEQ ID NO: 1247 - DNA, 1085 bp, Solanum phureja
ataccgaagcaagtaacactccaaatacgctatttctgcagaaatggcttgtcactcaagttaaaaacaagtagaacaaatcgattctcagtcagttcttagctatcgcggattctcaaagctgtgacgaatcagatcgaagatgtttctcactagaactgagtatgatagaggtgtcaacactttctctcctgaaggaaggttgtttcaagttgaatatgctattgaagccattaagttgggttcaacggcaattgggataaagaccaaggaaggagttgttcttgctgttgagaagcgaattacctctccacttctggagccaagcagtgtggagaaaattatggaaattgatgagcatattggatgtgcaatgagtggattgatagctgatgcaaggactctcgttgaacatgcacgagttgaaactcagaatcacagattctcttatggcgagcccatgactgttgagtccacaacacaagctctgtgtgatttggccctgcgatttggtgagggtgatgaagagtctatgtccagaccttttggagtatcacttctcattgctggtcatgatgagaatggtcctagcttatactatactgatccttctggcactttctggcaatgcaacgcaaaagccattggttcaggttcagaaggtgctgacagctctcttcaggagcaattcaacaaggaccttaccctcaaggaggccgaaaccatagcgctgtcaattctgaagcaagtgatggaagaaaaggtgactcccaataacgttgatattgcgagggtatcaccaacttatcacctctactccccttctgaggtggaagatgttatcagccgcctataagaagaaaaacgctcttgttatgcttgtacttgattctatgttatgggcaatgtttgctttcaattgttctagaatttgtgaattgtttttgccccttcaagcatgatacatttttagctttgagttacattttccttcaaggacaaaactcaaaccctttatgttgcttgacgaaatttgatacaatgggatagattatttggcgatgaggcttaagattgcagaaaaa

SEQ ID NO: 1248 - DNA, 1052 bp, Solanum lycopersicum
aacgggtcaaaagcccaacaaacaaagaagtagagcaacaatgtcttgttaatcaagtttaaaaacaaaagaagaagaagaagaaggaataatcttcagttcaaacaaaatctgaacaaagggtttttggatctgtagcaaaatttcaacaaagatgtttcttacaagaactgagtatgatagaggtgttaacactttctcgcctgaaggacgattgtttcaagttgaatatgctattgaagctatcaagttgggttcaactgcaattggattgaagactaaggaaggagttgttcttgctgtggagaagcgcattacttcaccacttctggagccaagcagtgtggagaaaattatggaaatcgacgagcatattggctgtgcaatgagtggattgatagctgatgcacggactcttgtggaacatgcacgggttgaaactcagaaccatagattctcttatggcgagcccatgactgttgagtccactacccaagctctctgtgatttggcgttgcgatttggtgagggcgatgaagaatctatgtccaggccttttggtgtgtcccttctcattgctggtcatgatgagaatggtcccagcttgtactatactgatccttctggtacattctggcaatgcaatgctaaagctattgggtcaggttctgaaggtgctgatagctctttgcaggagcagtataacaaggaccttacccttaaagaggctgaaaccatagcactgtccattctcaagcaagtgatggaagagaaggtgactcccaataatgttgatattgcgagggtatctccaacttaccatctatactcaccatcggaggtggaagaggttatcagccgcctataagaaagcatgtgatcacgctcgttatgatatttttcttgtatgacaaaaacacttgcttgttgctgcagccctggagcctggaggtcattggattgttttttccttcttccaaggctaggaattgattcagacaagtgttttctgtatgctcattacattatttgcttcaaggatttaagtccat

SEQ ID NO: 1249 - DNA, 1153 bp, Solanum lycopersicum
gggcccaaatttccccacccccttcctatgtaaccgggttagaaaatctgacccggaaataccgaagcaagcaacactccaaatacactatttctgcagaaatggcttgtcactcaagttaaaaacaagtagaacaaatcgattctcagtcagttcttagctatcccggactctcaaagctgtgacgaatcagatcgaagatgtttctcactagaaccgagtatgatagaggtgtcaacactttctcgcccgaaggaaggttgtttcaagttgaatatgctattgaagccattaagttgggttcaacggcaattgggataaagaccaaggaaggagttgttcttgctgttgagaagcgaattacctctccacttctggagccaagcagtgtggagaaaattatggaaattgatgagcatattggatgtgcaatgagtggactgatagctgatgcaaggactctggttgaacatgcacgagttgaaactcagaatcacagattctcttacggcgagcccatgactgttgagtccacaacacaagctctgtgtgatttggccctgcgatttggtgagggtgatgaagagtctatgtccagaccttttggagtatcacttctcattgctggtcatgatgagaatggtcctagcttatactatactgatccttctggcactttctggcaatgcaatgcaaaagccattggttcaggttcagaaggtgctgacagctctcttcaggagcaattcaacaaggaccttaccctcaaggaggctgaaaccatagcgctgtcaattctgaagcaagtgatggaagaaaaggtgactcccaataatgttgatattgcgagggtatcaccaacttatcacctctactccccttctgaggtggaagatgttatcagccgcctataagaagaaaatgctcttgttatgcttgtacccaattctctgttatgggcaatgtttgctttcaattgttctagaatttgtgaattgttttgccccttcaagcatgatatattgttagctttgagttccattttccttcaaggacaaagctcaaaccctttatgttgcttgacaaaattcggtataatgggataagattatttggctacgggcttaagattgcagtaaaattacgttttaat

SEQ ID NO: 1250 - DNA, 1163 bp, Populus trichocarpa
actccgttttattcagcccaaaaacgccaccgttggggcaaacaaatctcgaaacgtttcggacttgctgtcttgtaaaacaagtccagagagctcaacgcctcaacccacctgactacatacaaaagcaaagcagctctgtctctcaagagcaagaaattgttaagcaatttagatccaatcaaagatgtttctcacaaggactgagtatgatagaggagtcaacactttctctccagaaggaagattgtttcaggttgaatatgctattgaagccatcaagcttggttcaactgcaattggtttaaagacgaaagaaggtgttgtgcttgcagttgagaagcgtatcacttcacctctgctggagcccagtagcgtggagaaagtcatggaaattgatgaatgtattggatgtgctatgagcggactaattgcagatgctcgtacacttgttgagcatgcccgggttgaaactcagaaccacagattctcgtacggtgagcctatgacagtggagtctacaacacaagcactctgtgatctggccctgcgatttggtgaaggtgatgaagaatccatgtctcgtccatttggggtgtctcttctcattgctggtcatgacgagaaaggacccagcttgtattacacagatccatctggcacattttggcagtgcaatgcaaaggctattggttcagggtcagaaggtgcagacagtactctacaggagcaatataacaaggacctcactcttaaagaagctgagacaatcgctctttctattctaaagcaagtcatggaagaaaaggtgactcccaacaatgtcgacattgccaaggtggcacctgtataccatttatacacccctgctgaggtggaggaagtcattagccgcctttgaaaacaatgttaatttccttatgatatccctgttgcctaaattttgcttgaacagttcaatttttctctaaactgggctatattatgggatttggatcacgtggtgactccacttgagtgataaatgttttattttgaccggtaactggtgtgagtcgatgtttttcttcaattttaaggtcaatctggtgtgaatcaatgttattccttcaactttaaggtcaatctagatatttagccaatggtatggttttctgattgtc

SEQ ID NO: 1251 - DNA, 731 bp, Manihot esculenta
ggtaatttgtgtgattttgaaggaccgagtatgaccggggagtgaacactttctctcccgaaggcagattgtttcaggttgaatatgctattgaagccattaagctaggttcaactgcaattgggttaaagacaaaagaaggtgtcgtgcttgcagttgagaagcgtatcacttcaccactgctggagcccagtagtgtggaaaaagttatggaaattgatgagcatattggatgtgccatgagtggattaattgcagatgctcgtacacttgttgagcatgcacgtgtggaaactcagaaccatagattctcatatggtgagcccatgacagtggagtccacgacccaagctctctgtgatcttgctttacgatttggtgaaggcgatgaagaatccatgtctcgtccatttggggtgtcacttctcattgctggtcatgatgagaatggtcctagcctgtactacacagatccatctggaacattttggcaatgcaatgcaaaggctattggttcaggatcagaaggtgcagatagctctttgcaagagcaatacaacaaggacctcacacttcaagaggctgagacaattgcactttccattctgaagcaagttatggaagaaaaggtgactccaaacaatgttgatattgcaaaggtggctccaacatatcatttgtatacccctgcagaggtggagacggtcattagtcgtctataagaacaccat

SEQ ID NO: 1252 - DNA, 1147 bp, Fagopyrum esculentum
agaaagttaaatgtgaaaaagctcagaagagtggcatctctagcttcagagtttctctcccgcacaggtttttaaagtctgtgaaatcacgcaacatgtttctcacaaggactgagtatgacagaggagtcaacaccttctctcctgagggcaggctttttcaggtcgagtatgcaattgaagccatcaagttgggttcaactgcaattgggattaagaccaaggatggcgttgtgcttgctgttgaaaagcgtatcacttctcccttgctggagcccagcagtgttgaaaaatcatggaaattgattcgcacataggatgtgctatgagtggattgattgctgatgctcgtacacttgttgagcatgcacgtgttgaaacccagaatcatagattctcattcggtgaacccatgactgtggagtccacaacccaggctttgtgtgacctggcactgaggtttggtgaaggtgatgaagagtctatgtcccgtccttttggggtttctcttctcattgctggccatgatgagaatggaccaagtttatactacacagatccatctggtactttctgggaatgcagtgcgaaggcaataggttcaggttcagaaggagcagacagctcattgcaggagcaatacaacaaggagttgagtctccaggaagctgaaacaattgcactctcaatcttgaagcaagtgatggaggagaaggtgacacccaacaatgtcgacattgccaaagttgcccctggttaccatctctacaccccatctgaggtggaagctgtcattagccgcttgtaagcacacccgatcaggtgccgttttccatgattccgatcccttccgttaggcatgcttgaactcctgatgtttttaacacctcaatgaagatcgatccctgcaaaactttgtttattatgaaacgtgtcagtcttgatgttgttcaaactgtatggcacatttgaggacttgaattttcaagtgaagattttacttctagtagttatccaagtatttcagtccaagctattatgttcagtaaccagttacgctattggtgtacaatctgctattggtgtacaatccatatacgtagaacccgttgcgtggcaaaaagatttgtttggtattgttgtacta

SEQ ID NO: 1253 - DNA, 904 bp, Fraxinus spp
gtcatttcgagttatttacagcaaattctgaagctataattgactcgaaaatgttcctcacaaggactgagtatgatagaggagtcaacactttctctccggaaggccgattgtttcaagtcgaatatgccattgaagctatcaagttgggctcgacagcaataggggtaaaactaaggaaggggtggttcttgctgttgaaaagcgcattacctcgcctcttttggagcctagcagcgttgagaaaattatggaaattgatgatcacatcggttgtgccatgagtggcttaattgctgacgcccgtacactggttgaacatgcacgtgttgaaactcagaatcacaggttctcatatggtgagcccatgacggttgagtccactacacaagctctctgtgatcttgccctgcgatttggtgagggtgacgaagaatctatgtctagaccttttggtgtatcccttctcattgctggtcatgatgagaatggacccagcttgtactataccgatccttctggtactttctggcaatgcactgcaaaagccattggatcaggttctgaaggtgctgacagttctctgcaggagcagttcaacaaggatcttaccctgaaagaagcagaaaccattgcgctttccatactgaagcaagtgatggaagaaaaggttacacccaacaatgttgacattgcgaaggtagcaccaacttaccatctgtactcgccttctgaggttgaagaggttatcagccgcctataagaaaaggccatcaatttgcattattgctgattttcactgcaacgtcactttcccaatattcctatgcttgaattcaatatgtactattaagaggtatttttttggctttgatgagagcaaatactatggacttgtaaacat

SEQ ID NO: 1254 - DNA, 918 bp, Fraxinus spp
cctcagagaaattagggttttaatacgacgaattcgtggttggaatttctaaatttatgtcatttcgagttatttacagcaaattctgaagctataattaattgactcgaaaatgttcctcacaaggactgagtacgatagaggagtcaacactttctctccggaaggccgattgtttcaagtcgaatatgccattgaagctatcaagttgggttcgacagcaataggggtaaaaactaggaaggggtggttcttgctgttgaaaagcgcattacctcgcctcttttggagcctagcagcgttgagaaaattatggaaattgatgatcatatcggttgtgccatgagtggcttaattgctgatgcccgtacactggttgaacatgcacgtgttgaaactcagaatcataggttctcatatggtgagcccatgacagttgagtccactacacaagctctctgtgatcttgccctgcgatttggtgagggtgacgaagaatctatgtctagaccttttggtgtatcccttctcattgctggtcatgatgagaatggacccagcttgtactatacggatccttctggtactttctggcaatgcactgcaaaagccattggatcaggttctgaaggtgctgacagttctctgcaggagcagttcaacaaggatcttaccctgaaagaagcagaaaccattgcgctttccatactgaagcaagtgatggaagaaaaggttacgcccaacaatgttgatattgcgaaggtagcaccaacttaccatctgtactcaccttctgaggttgaagaggttatcagccgcctataagaaaaggctatcaatttgcattattgctgattttcactgcaacttcactttcccaatattcctatgcttgaattcaatatgtactattaagag

SEQ ID NO: 1255 - DNA, 815 bp, Platanus occidentalis
gagggtgcttgtgtgtgctgaccgccgggttttaatcgaatcgaagatgtttcttaccaggactgagtatgatagaggtgtgaacaccttctctccggaagggcgattgtttcaggttgaatatgccatcgaggccatcaagttgggtcaaccgcaattgggtgaagacgaaggaaggcgttgtgcttgcggttgagaagcgaatcacttcaccattgctggagcctagcagtgtggagaaaattatggaaattgatgatcacatagggtgtgcaatgagtggattaattgctgatgctcgtacgcttgttgaacatgcacgagttgaaactcagaatcacaggttctcatatggtgaagcaatgactgttgagtctactacgcaagctctatgtgatcttgccctgaggtttggtgagggagatgaagattccatgtctcgaccttttggagtatctcttctcattgctggtcatgatgagaatggacctagcttgtattacacagatccatctggcacgttctggcagtgcaatgcgaaagccataggttcaggttctgaaggagcggacagctctttgcaggagcaatataacaaggagataactcttcaggaagctgaaacaatagctctttccatcttgaagcaagtgatggaagaaaaggtaaccccaaacaatgtggatattgcgaaggtggctccaacttatcacctctactctccttccgaggttgaagctgtcattagtcgcttatgaaggagaggaaccccccccatattatgtttttctatcacctttatgccatgcatatgg

SEQ ID NO: 1256 - DNA, 1223 bp, Mimulus guttatus
ctcaaaacatcaaaaaagaaaaaacccatatgaaaactaattcctgctaagctgcttcttcttctcgattcaaaattaaggtggattagggttcacagatccgcttagttcttggattatcacagttttactcgtaaaaccctagtctctctcctcctccgcgcagcgtcgaaaatgtttcttacaaggactgagtatgataggggagtgaacactttctcccctgaaggccgattgtttcaagtcgagtacgccattgaagctatcaagttgggttcgactgcaattggggttaaaaccaaggagggagttgttcttgctgttgagaagcgcataacatcgccacttttggagcctagcagtgttgagaaaattatggaaatcgaccaacacattggttgtgccatgagcggcttgattgccgatgcacgtaccctagttgagcatgcgcgagttgaaactcagaatcataggttctcgtatggtgagcccatgacagttgaatccactactcaagctctctgcgatcttgctttgcgttttggtgaaggagatgaagaatcaatgtcgagaccttttggtgtctctcttctaattgctggtcacgatgagaatggtcccagcctatactataccgatccatctggcacattctggcaatgtaatgcaaaagcaattggatcaggttccgaaggtgctgacagctctttgcaggagcagtacaacaaggatctaactatcagcgaagctgaaacgattgcactttcgatcctgaagcaagttatggaggaaaaggttacaccgaacaatgttgacattgcaaaggtatcgcctacataccatctttactcgccttctgaagtcgaagcagttatcgcccgcctatgagaagaaaactccttcgatctatttttaacgatcttttatgtacggacattgattttgtagtattactatgttaaatgatttgtctaagtttcggattatacaagaatacgcgtgtttagggttatgttaaactttctcatcactttaagaatttgatttttttttttatttggacttattatcctgctcttctttgtgagatgtttttttcgggttttcgtgtttgatttttgctaattgtttcactttactggtaagattaagatctctcaagcttaaaattgagttgaaatggcatttttaccctcgatgtatatgatgaaatattttgtgta

SEQ ID NO: 1257 - DNA, 1036 bp, Nicotiana benthamiana
gctaatcaagtttaaaggagaggaagaagaaaaaagtgatctccagttcaaacagaactcggtttaactgggcaaagctattgcactacttctctttacagagattctgaatctgtaacaaatatcagcagagagatgtttctcactagaactgagtacgatagaggtgttaacaccttctctcctgaaggccggttgtttcaagttgaatatgctattgaagccatcaagctgggttcaactgcaattggattaaagactaaggaaggagtcgttcttgctgtggagaagcgcattacttcacctcttctggagccaagcagtgtggagaaaattatggaaattgatgagcatattggttgtgcaatgagtgggttgattgctgatgcacggactcttgtggaacatgcgcgagttgaaactcagaaccatagattctcttatggtgagcccatgactgttgagtccactacacaagctctctgtgatttagccttgcggtttggtgagggtgatgaagaatccatgtccagaccttttggcgtgtcccttctcattgctggtcatgatgagaatggtcccagcttgtactacactgatccttctggtacattctggcaatgcaacgctaaagctattgggtcaggttctgaaggtgctgacagctctttgcaggagcaacataacaaggaccttacccttaaagaggctgaaaccatagccctgtctattcttaagcaagtgatggaagagaaggtgactcctgataatgttgatattgcaagggtatctccaacttaccatctgtactcaccatctgaggtggaagaggttatcagccgcctataagaaagaatgctataatgcttgcccctggagttcttttattgtattttcccttcttccagggctggaaattgattgagacagtgttttctgtatcttcattacattatctgctcacggatttaagagtttttcggtccatcccttgttgctcatgaagtgggattagtttttacatcctgaagaaaat

SEQ ID NO: 1258 - DNA, 1259 bp, Nicotiana benthamiana
gggttgagaaaatccgacccggcaaagttcgaaactaccttggttttgcagaaatggcttgtcgctcaagaaaaaacaagtactagaacaaatcatttctctcttgtctaaaataaaataccaacaaagcagtcgcttcttagctactaaggatttgtttttctaaagctgtaataaatcagatcaaagatgtttctcacgagaactgagtatgatagaggtgtgaacacattctctcctgaaggaagattgtttcaagttgaatatgctattgaagccattaagttgggatcgacggcaattgggataaagactaaggaaggcgttgttcttgctgttgagaagcgaattacctctccacttctggagccaagcagtgtggagaaaattatggaaattgatgagcatattggctgtgcgatgagtggattgatagctgatgcaaggactcttgttgaacatgcacgagttgaaactcagaaccacagattttcttatggcgagcccatgactgttgagtccacaacacaagctctgtgtgatttggccctgcgatttggggagggtgatgaagagtctatgtccagaccttttggtgtatcacttctcattgctggccatgatgagaatggtccgagcttatattatactgatccttctggcactttctggcaatgcaatgcaaaagccattggttcaggttcagaaggtgctgacagctctttgcaggagcaattcaacaaggacctcagcctaaaggaggctgaaacgattgcactgtcaattctaaagcaagtgatggaagagaaggtgactcccaataacgttgatattgcgagggtatctccaacttatcatctctactcgccttctgaggtggaaactgttatcagccgcctataagaagaaagctctcttgttacgcttgttagccattcctctattatgggcaatgtttacttccaactgttttagaatttgtggattgtattgccccttctagcatgttaaattgcattccgactcatagacaaatggtcaatccctttatgttgcttggaaattccctagggtgggatgattgtgtctgacgaggtctaagattcaggtatggttgaaaagataccttttccatagaaaggcttgcgttactttctatgcaatattgtgtctgacgaaatacttaaaaatcccctagatatgtctgttacctaaagaaaaatatgttattagtggccttttgttatgtggctcttcaa

SEQ ID NO: 1259 - DNA, 892 bp, Fraxinus spp
ctctaataatcgaattgagaatgttcctcacaaggactgagtatgatagaggagttaacactttctctccggaaggccgattgtttcaagttgaatatgcgattgaagccatcaagttgggttccactgcgatcgccataaaaactaaggaaggggtggttcttgcagtcgagaagcgcattacctctccacttttggagcctagcagtgtggagaagattatggaaatcgatgagcatattggctgtgctatgagtggtttaattgctgatgcccgaactctggttgaacatgctcgagttgaaactcagaatcataggttctcttatggcgaacccatgacagtcgagtcaactacacaagctctctgtgaccttgccctgcgatttggtgaaggagacgaagaatcaatgtctagaccgtttggtgtatctcttcttatcgctggtcatgatgagaatggtccctgcttgtactatactgatccttctggcacattctggcaatgcaatgcaaaagccattggttcaggttctgaaggtgctgacagctctttgcaagagcagtataacaaggatctaaatcttaaagaagctgagaccatagcactttccattttgaagcaagttatggaagaaaaggttacccccaataatgttgatattgctagtgtggccccaagatatcatctttacaccccatctgaggttgaagctgttattaatcgcctatgagaagggcatctagcagttccagtgttgatctttactatgattcagttcccattattgccatgttggcttcatgtgtaatgcaaatctcagatttcgcttccagtttacattcgagtagaaatgactttagaaatgtagctaaaactgtactttctaag

SEQ ID NO: 1260 - DNA, 934 bp, Zingiber officinale
  misc_feature (901)..(901): n is a, c, g, or t
gactttcatcgccgccggttcccgcatccccagatcccccctcaaatcgctcgaaatgttcctcaccaggaccgagtacgatcgtggcgtcaacactttctccccggaggggaggttgttccaggtcgagtacgccatcgaggccatcaagttgggctctacggccattggattgaggacgaaggaaggcgttgtgcttgctgtagagaagcgtgtgacctcacccttactggaacccagcagtgtggaaaagattatggagattgacgagcacataggctgtgcaatgagtggattgatagctgatgcacgaactcttgtagaacatggtcgtgttgaaactcagaatcacaggttttcgtatggtgaagcaatgactgttgagtcagctacccaagcactatgtgatctggctcttcaatttggtgaaggagacgaagaatctatgtcacgaccatttggagtatctcttctgattgctggttatgatgagaatggacctagcttgtactatactgatccatctggcacattctggcaatgcaatgcaaaagcaatagggtcaggatctgaaggagctgatagttctcttcaagaacaatacaacaaggacctaacccttcaggaagctgaaactatagctctttcaatcctgaaacaagtcatggaggaaaaggtgacccctaataatgtcgacattgcaaaggttgcccctacttaccatctatacacacctgatgaggtcaaagctgtcatcactcgcctctgattggcttggctatttatcttttatttgtgtttttgtacttggtactaatggctagattgctctaaaatgtgctggatgttgtggccttattacttgttggttgcttatccactgaaccaatttaagcattcnaagaagtgctaaagatagttcttctttcttgtg

SEQ ID NO: 1261 - DNA, 953 bp, Jatropha curcas
ctctttcgcgcaaggatctgccattgagatcaagcaaagatgtttctcacaaggactgagtatgatagaggagtgaacactttctctccagaaggtagattgtttcaggttgaatatgctatcgaagcaatcaagctaggttcaactgcaattgggataaagacaaaagaaggtgttgtgcttgcagttgagaagcgtatcacttcaccactcctggagcccagtagtgtggagaaagttatggaaattgatgagcatattggatgcgctatgagtggattaattgcagatgctcgtacgcttgttgagcatgcacgtgtggaaactcagaaccatagattctcttatggtgagcccatgacagtggagtccacaacacaagcactttgtgatctcgctctacgatttggtgaaggcgatgaagaatccatgtctcgtccgtttggtgtgtcacttctcatagctggtcatgatgagaatggtcctagcctgtattatactgatccatctggcacactttggcaatgtaatgcaaaggctattggttcgggttcagaaggtgcagatagctctttgcaagagcaatacaacaaggacatcacgcttctagaggctgagacaatcgcactttcaatcctgaagcaagtcatggaagaaaaggtcactcccgacaatgttgacattgcaaaggtggctccaacatatcatttgtatacccccgcagaggtggaggtcgtcattaatcgtctataagaagaaaactatgtcgtgaaattcattatcgagacattttggattccctattgttgcttaaactgcttgtcgtctttttagttggggaagcagaggattggacctatacaatcttttttctgtaatggtgcctacaactgtgctgcttaattcagtcctgtaacttgatttcatctcaaaaatgaagcactgttttccct

SEQ ID NO: 1262 - DNA, 1084 bp, Mimulus guttatus
ctcaaaacatcaaaaaagaaaaaacccatatgaaaactaattcctgctaagctgcttcttcttctcgattcaaaattaaggtggattagggttcacagatccgcttagttcttggattatcacagttttactcgtaaaaccctagtctctctcctcctccgcgcagcgtcgaaaatgtttcttacaaggactgagtatgataggggagtgaacactttctcccctgaaggccgattgtttcaagtcgagtacgccattgaagctatcaagttgggttcgactgcaattggggttaaaaccaaggagggagttgttcttgctgttgagaagcgcataacatcgccacttttggagcctagcagtgttgagaaaattatggaaatcgaccaacacattggttgtgccatgagcggcttgattgccgatgcacgtaccctagttgagcatgcgcgagttgaaactcagaatcataggttctcgtatggtgagcccatgacagttgaatccactactcaagctctctgcgatcttgctttgcgttttggtgaaggagatgaagaatcaatgtcgagaccttttggtgtctctcttctaattgctggtcacgatgagaatggtcccagcctatactataccgatccatctggcacattctggcaatgtaatgcaaaagcaattggatcaggttccgaaggtgctgacagctctttgcaggagcagtacaacaaggatctaactatcagcgaagctgaaacgattgcactttcgatcctgaagcaagttatggaggaaaaggttacaccgaacaatgttgacattgcaaaggtatcgcctacataccatctttactcgccttctgaagtcgaagcagttatcgcccgcctatgagaagaaaactccttcgatctatttttaacgatcttttatgtacggacattgattttgtagtattactatgttaaatgatttgtctaagtttcggattatacaagaatacgcgtgtttagggttatgttaaactttctcatcactttaagaatttgatttttttttttatttggacttattatcctgctcttctttg

SEQ ID NO: 1263 - DNA, 964 bp, Orobanche aegyptiaca
caagaagaaaaggggaaaacactcagcagcagatatataattcacactcttcattaagtatctcaacaaaatttgttatcctttttcatctttagatttggagttaaagggaatatagtttatcgaaaatgttcctcaccaggactgagtatgatagaggagtgaataccttctctcctgaaggccgattgtttcaagtcgaatatgccattgaggctatcaagttgggttcaactgcaattgggataaagactaaggagggagttgtacttgctgttgaaaagcgcattacttcgcctcttttggagcctagtagtgttgagaaaattatggaaattgatgatcatatagggtgtgccatgagtggcttaattgctgatgcacgtactatggttgaacatgcacgagtcgaaacacagaatcataggttctcatatggtgagccgatgaccgttgagtctactactcaagctctctgtgaccttgccttgcgcttcggcgagggggatgaagaatcaatgtcgagaccttttggtgtatctcttctaattgctggtcatgatgagaatggtcccagcttatactatactgatccctcaggtactttctggcaatgcaatgcaaaagctatcggttcaggttctgaaggtgccgacagctctttacaggagcagtttaacaaggatctgactctcaaggaagctgaaaccattgccctttctatcctgaagcaagttatggaggagaaggtaacagccaacaatgttgatattgctaaggtgtcgccaagctaccatctttactctccttctgaagtcgaagccgtcatcagtcgtctatgacgagtccatcaatcatcactatttacgttattaccgtgcttgaactgaacgaatttcgtaccgctgtgcgacttattgtcgaaattctgatgttgctgaatatgtcaaactatctggaactt

SEQ ID NO: 1264 - DNA, 1017 bp, Capsicum annuum
ctaatcaagtttaaaggagaagaagaaaaagtaagagggcaaagctattatttacttctctgcatagggcttctgaatctgtaacaaatctcaacaaacatgtttctcactagaactgagtatgatagaggtgttaacaccttctcccctgaaggccgattgtttcaagttgaatatgctattgaagctatcaagttgggttcaactgcaattggattgaagactaaggaaggagttgttcttgctgtggagaagcgcattacttcgccacttctggagccaagcagtgtggagaaaattatggagattgacgagcatattggttgtgcaatgagtggattgatagctgatgcacggactcttgtggaacacgcgcgagttgaaactcagaaccatagattctcttatggtgagcccatgactgttgagtccactacacaagctctctgtgatttggccctgcgatttggtgagggcgatgaagaatctatgtccagaccttttggtgtgtcccttctcattgctggtcatgatgagaatggtccctgcttgtactatactgatccttctggtacattctggcaatgcaatgctaaagctattggatcaggttctgaaggtgctgacagctctttgcaggagcaatataacaaggatcttacccttaaagaagctgaaaccatagcactgtctattcttaagcaagtgatggaagagaaggttactcccaataatgttgatattgcaagggtatctccaacttaccatctctacttaccatcggaggtggaagaggttatcagtcgcctataagaaagatgcgagcttactctcgttactggtattttcttgtacgacaatgcttgcttgcagcccttgagttcgttggattgtattttcccttctttcagggatggaaattgatttagacaagtattttctgtatggtcattacatttgctcaaggatttaagaactttttggaccgtttatctctcgctgctttatgaattcgga

SEQ ID NO: 1265 - DNA, 899 bp, Lippia dulcis
gtttaagggatcgaaaatgttcctaacaaggacggagtacgacagaggggtcaatactttctctccggaaggtcggttgtttcaagtggagtatgccattgaggctatcaagctgggatcaactgcaattgcgctgaagactaaggaaggagtggttcttgctgttgagaagcgcattacttctccgttgttggagcctagtagtgtggagaaaataatggaaattgattcacatattgggtgtgccatgagtggcttaattgctgatgcccgcactctggttgagcatgcacgagttgaaactcagaatcataggttctcatatggtgagcccatgactgttgagtctacgactcaagctctctgtgatcttgctttgcgatttggtgaaggggatgaagaatcaatgtcaagaccttttggtgtctctcttctcattgctggtcatgatgagaacggtcccagcttatactacaccgacccctcgggcactttctggcaatgcaatgcaaaagccattggctcaggttccgaaggtgccgacagctctttgcaggagcagttcaaccaggatctaactctgaaggaagctgagaccattgcactctccatcctaaagcaagtgatggaggaaaaggttacacccaacaatgttgatatcgcgaaggtgtcaccgacataccatctttactctccttctgaagtcgaggaagttataagtcgcctatgagaaaacacgagtacatctctctgttcccttatgttcttgtccgtgaacacattttgtattgcaaagttgatgatttgggttcatgaagagaactaatgttgaaccttctgagtatttgatcactttgatgatgtctgaaacctcctcagaatgattttgatttgataca

SEQ ID NO: 1266 - DNA, 994 bp, Populus trichocarpa
cgaaacgtttcggacttgctgtcttgtaaaacaagtccagagagctcaacgcctcaacccacctgactacatacaaaagcaaagcagctctgtctctcaagagcaagaaattgttaagcaatttagatccaatcaaagatgtttctcacaaggactgagtatgatagaggagtcagcactttctctccagaaggaagattgtttcaggttgaatatgctattgaagccatcaagcttggttcaactgcaattggtttaaagacgaaagaaggtgttgtgcttgcagttgagaagcgtatcacttcacctctgctggagcccagtagcgtggagaaagtcatggaaattgatgaatgtatcggatgtgctatgagcggactaattgcagatgctcgtacacttgttgagcatgcccgggttgaaactcagaaccacagattctcgtacggtgagcctatgacagtggagtctacaacacaagcactctgtgatttggccctgcgatttggtgaaggtgatgaagaatccatgtctcgtccatttggggtgtctcttctcattgctggtcatgacgagaaaggaccgagcttgtattacacagatccatctggcacattttggcagtgcaatgcaaaggctattggttcagggtcagaaggtgcagacagtactctacaggagcaatataacaaggacctcactcttaaagaagctgagacaatcgctctttcaattctaaagcaagtcatggaagaaaaggtgactcccaacaatgtcgacattgccaaggtggcacctgtataccatttatacacccctgctgaggtggaggaagtcattagccgcctttgaaaacaatgttaatttccttgtgatacccctgttgcctaaattttgcttgaacagttcaatttttctctaaactgggctatattatgggatttggatcacgtggtgactccacttgagtgataaatgttttattttgaccggt

SEQ ID NO: 1267 - DNA, 1015 bp, Populus trichocarpa
gagttcaacccatctatctgattacctacaaaagcaaagcaaagcaaggttttcactcccaagaacacgtaattgttaaagcattttagatccaatcaaagatgtttctcacaaggactgagtatgatagaggagtgaacactttctctccagaaggaagattatttcaggttgaatatgccattgaagccatcaagcttggttcaactgctattggcttaaagacgaaagaaggtgttgtacttgcagttgagaagcgtatcacttcacctctgctggagcccagtagtgtggagaaagtcatggaaattgatgatcatattggatgtgctatgagtggattgattgctgatgctcgtacacttgttgagcatgcacgggttgaaactcagaaccatagattctcatacggtgagcccatgacagttgagtccacaacgcaagcactctgcgatttggccctgcgatttggtgaaggtgatgaagaatccatgtctcgaccatttggggtgtctcttctcattgctggtcatgatgagcatggacccagcttgtattacacagatccatccggcacattttggcagtgcaatgcaaaggctattggttcaggttcagaaggtgcagacagcactctgcaggagcaatataacaaggaccttactcttaaagaagctgaggcaatcgctctctctattctaaagcaagtcatggaagaaaaggtgactcccaacaacgtcgacattgccaaggtggcacccacataccatttatacacccctgctgaggtggaggaagtcattagccgcctttgaaaacaatcttctgaaatttccttgaagaattttccctgttgtttcctaaactgattgaacagggtacccttttttttctaaattgtgtgatgttatgggatttggggactcaacttgagtgagagctaaatgttttattttgactggtaactgatgtgagtccatgcttatcttctattttcaagtccctaaccccaaaa

SEQ ID NO: 1268 - DNA, 1084 bp, Populus trichocarpa
aacaccaatcccgaaacgtttcggatttgttgtcttgtgaaacaagtcgagcgaggctagagagttcaacccatctatctgattacctacaaaagcaaagcaaagcaaagcaaggttttcactcccaagaacacgtaattgttaaagcattttagatccaatcaaagatgtttctcacaaggactgagtatgatagaggagtgaacactttctctccagaaggaagattatttcaggttgaatatgccattgaagccatcaagcttggttcaactgctattggcttaaagacgaaagaaggtgttgtacttgcagttgagaagcgtatcacttcacctctgctggagcccagtagtgtggagaaagtcatggaaattgatgatcatattggatgtgctatgagtggattgattgctgatgctcgtacacttgttgagcatgcacgggttgaaactcagaaccatagattctcatacggtgagcccatgacagttgagtccacaacgcaagcactctgtgatttggccctgcgatttggtgaaggtgatgaagaatccatgtctcgaccatttggggtgtctcttctcattgctggtcatgatgagcatggacccagcttgtattacacagatccatccggcacattttggcagtgcaatgcaaaggctattggttcaggttcagaaggtgcagacagcactctgcaggagcaatataacaaggaccttactcttaaagaagctgaggcaatcgctctctctattctaaagcaagtcatggaagaaaaggtgactcccaacaacgtcgacattgccaaggtggcacccacataccatttatacacccctgctgaggtggaggaagtcattagccgcctttgaaaacaatcttctgaaatttccttgaagaattttccccgttgtttcctaaactgattgaacagggtacccttttttttctaaattgtgttatgttatgggatttggggactcaacttgagtgagagctaaatgttttattttgactggtaactgatgtgagtccatgcttatcttctattttcaagtccctaaccccaaaacat

SEQ ID NO: 1269 - DNA, 788 bp, Rosa hybrid cultivar
tcgctcccgacccaaatcaaatttctcctcagatcaatctccagggtttcgtatcaaccaagatgtttctcacaagaactgagtatgacagaggagtaaacactttctccccagaaggtagactttttcaggttgaatatgccattgaggccattaagctcggttcgactgctattgggttgaagacaaaagaaggtgttgtgcttgctgtggagaagcgtatcacttcgcctttgctggaacccagcagtgtggagaaaattatggaaattgatgaccatattggatgtgccatgagtggattgattgctgatgctcgtacacttgttgaacatgcacgagtggaaactcagaaccacaggttctcctatggtgagccaatgaccgtggagtctacaacgcaagcactttgtgatctggcactacgatttggtgaaggtgatgaagagtccatgtctcggccatttggggtatctcttctcattgcaggtcatgatgagcatgggcccagcttatactatactgatccatctggcacattttggcaatgcaatgcaaaagctataggttcgggttcagaaggtgcagacagctctctgcaagagcaatacagcaaggacttgactcttaaagaagctgagacaattgctctttccattcttaagcaagtcatggaggaaaaggtgactcccaataatgttgatattgcaaaggtttcgcccacatatcatctatataccccttctgaggtggaggaggtcatcagtcgcctatgagtcctgtgaatc

SEQ ID NO: 1270 - DNA, 1107 bp, Salvia sclarea
ctactagaccttggctgtcactcaaaaaaaaaagctcagttgcagagttaattaaaattgaattccaccccaaatttatcaaaaattcaaataagtttaggtctgctcagctatccctcttcttcattggtgagttaaggaagtttgagattctggttttgcgagatcgaaaatgtttcttacaaggactgagtatgacaggggagttaatactttctcccctgaaggccggttgtttcaggttgaatatgccattgaggcgattaagttgggttcaactgcaattggtgtgaagactaaggagggagtcgttcttgctgtcgagaagcgcattacttcacctctcttggagcctagcagtgtggagaagattatggaaattgatgaacatatagggtgtgccatgagtggcttgattgctgatgcccgcacactggttgaacatgcacgagttgaaactcagaatcacagattctcatatggtgagccaatgacagttgaatccactactcaagctctctgtgatcttgcattgagatttggtgaaggggatgaagaatcaatgtcgagaccttttggcgtatctcttctcattgctggtcatgatgagaatggcccctgcttgtactacactgacccatctggcactttctggcaatgcaatgcaaaagctatcgggtcaggttccgaaggtgctgacagctccttgcaggagcagtacaacaaggaactgaccctcagtgaagctgaaaccatagcactttccattctaaagcaagttatggaggagaaggtgacagccaacaatgtggatattgctaaggtatcaccaaaataccatctttactctccttctgaagtggaagaagttatcagtcgcttgtgagaagggatcggtctgtttcagttgacatctttcctgtgattggcgtttcctttgttgctactcttcctttgctttcgccatattgtcatttttctattaaagcacttaagctatgaaatactagccattaaaagaaacatctccaatatcaactgtaagggatttgaaaagctcatttagctaattacatgcaacctgcagtatctacaattcacttttcc

SEQ ID NO: 1271 - DNA, 1225 bp, Fragaria vesca
gctgaagccaaagcaaaaacccttcttctccaacacgaaagcatctcataaatccagactgtagtaccagaaatcagagcactctctcaaatcacaatactcttcctcagatcaatctctagggtttcgtatcagccaacatgtttctcacaagaactgagtatgacagaggagttaacactttctccccggaagggaggctgtttcaagttgaatatgccattgaggctattaagctgggttcaactgccattgggttgaagacaaaagaaggtgttgtgcttgctgtggagaagcgtatcacttcgcctttgctggaacccagcagtgtggagaaaattatggaaattgatgcccatatcggatgtgccatgagtggattgattgctgatgctcgtacacttgttgaacatgcacgagttgaaactcagaaccacaggttctcctatggtgaaccaatgactgtggagtctacaacacaagctctttgtgatctggcgctacgatttggtgaaggtgatgaagagtccatgtctcggccatttggggtttctcttcttattgcaggtcatgatgagcatgggcccagcttgtactacactgatccatctggcacattttggcaatgcaatgcaaaagctatagggtcgggttcagaaggtgcagacagttctctgcaagagcaatacagcaaggacttgactcttaaagaagccgaaactattgctctctccattcttaagcaagtcatggaggaaaaggtgactcccaataatgttgatattgcaaaggtttctcccacataccatctatataccccttctgaggtggaggaggtcatcagtcgcctgtgaatcatctcgacttgaatctgttcttggcactgtacttgttgtttggaggagagtcattaattgcccataaggatatttggatttgtttcctgttggtgatttcaatgctaaacttaaaccctctcctgtggcctaaatgaaatattggaacctaatgaaaatttcatctgaactgaggaaagtttattttaccatcttgatttttcttcatagagttactgccttttatggtaaatgctgactgtttatccaattgtgattagcagttgcctgtgcaaattcttcatattctctataatttgatgctagccatgttggatctgcaaattagcaaaatgataactgattgtcttcccatgtttggttctaat

SEQ ID NO: 1272 - DNA, 1101 bp, Nicotiana tabacum
  misc_feature (30)..(30): n is a, c, g, or t
  misc_feature (36)..(36): n is a, c, g, or t
  misc_feature (49)..(49): n is a, c, g, or t
ggccattacggccgggggctaatcaagttnaaagangaagaaaaaagtnatcttcagttcaaacagaactcggcttaactgggcaaagctattacagtacttctctgcatagagattctgaatctgtgacagatatcaacagagagatgtttctcactagaactgagtacgatagaggtgttaacaccttctctcctgaaggccggttgtttcaagttgaatatgctattgaagccatcaagctgggttcaactgcaattggattaaagactaaggaaggagtcgttcttgctgtggagaagcgtattacttcaccccttctggagccaagcagtgtggagaaaattatggaaattgatgagcatgttggttgtgcaatgagtggattgatagctgatgcacggactcttgtggaacatgcacgagttgaaactcagaaccatagattctcttatggtgagcccatgactgttgagtccactacacaagctctctgtgatttggccttgcggttcggtgagggcgatgaagaatctatgtccagaccttttggtgtatcccttctcattgctggtcatgatgagaatggtcctagcttgtactacactgatccttctggtacgttctggcaatgcaatgctaaagctattgggtcaggttctgaaggtgctgacagttctttgcaggagcaatataacaaggaccttacccttaaagaggctgaaaccatagccctgtgtattcttaagcaagtgatggaagagaaggtgactcccaataatgttgatattgcaaggatatctccaacttaccatctgtactcaccatctgaggtggaagaggttatcagccgcctataagaaagaatgctataatgctcacctggagttcttttattgtattttcccttcttccagggctggagattgattgagacagtgttttctgtatgttcattacattatttgctcaaggatttaagagttttttggtccatcccttgttgcttatgaagtgggattggtttttacatcctgaagaacataaacgatcttttctgatgatcgtttatagaaatgcatatttttggggtttaacaac

SEQ ID NO: 1273 - DNA, 1144 bp, Eutrema halophilum
aaaagaagagcaaactggtaaaggctacggtttcttcgattcgcagatcaatcgactgacactaaggttttacagatctaagtcgcggaagaagaagatgtttctcactagtcgtggtttttgcttatcgtaatttccgattttgttattcgaaggactgagtatgacagaggagtcaacactttttctcctgaaggcaggctattccaagtcgagtatgccattgaagctatcaagcttggttctactgcaattggagtaaagacaaaggagggagttgtgcttgctgtcgagaagcgtatcacgtcgcctttactggagccgagcagtgtggagaagattatggaaatcgatgaccatattggttgtgccatgagtggtttaattgctgatgcgcgtacacttgttgagcatgcaagagttgagactcagaaccacagattctcgtatggggagccaatgactgtggagtccacaacacaagcactgtgtgatctggctttacgatttggtgaaggagatgaagaatcaatgtctcggcccttcggagtatctcttctcattgctggtcatgatgaaaacggaccgagcttgtactacacggatccgtcagggacattctggcagtgcaatgcaaaggcaattggttcaggctcagaaggagctgatagttcccttcaagagcaattcaacaaagatctgtcacttcaggaagctgagacgatcgctgtatcgatcctgaagcaagttatggaagaaaaggtgactccaaataatgtggacattgcgaaggtagcaccagcttatcatctctacactccacaagaagtcgaagcagtcattagtcgtctatgaggaagattctgtaatcgggtaatgtatccatccgacgtgtgtctactttggattttgaagccaagagacttttctttcactttgtctgttggattgatggatcatgtcacattttactctgttgtgtaagagaatctttcgtctcccatgtcattcaataacctctcggattttatgactcagaaatttcccttcttatcacttgcgttttataagttgctcttggccggaagcacggtaatggaccttgctttagtcctctcccggagcccatatggccctagtaaca

SEQ ID NO: 1274 - DNA, 1020 bp, Nicotiana benthamiana
gtctgattatatttgcctttacagaaatgcttgttagtcattgatgaagccattagttctcagtgaagaagatttgtcaaaaccagtgactaacggcatcgaagatgtttctcacaagaactgagtacgatagaggtgttaacactttctctcctgaaggccgcctatttcaagtcgaatatgcaattgaagccattaagctgggttcgaccgcaattgggttaaagacaaaggaaggagtcgttcttgctgttgagaagcgcattacctcacctctcttggaaccaagtagtgtggagaaaattatggaaattgatgagcacattggttgtgctatgagtggactaatagctgatgccaggacacttgttgaacatgcacgggttgaaactcagaaccatagattctcctatggtgaaccaatgacagttgagtccaccacacaagctttatgtgacttggccctgcgatttggagagggtgatgaagaatccatgtccagaccttttggcgtatctcttcttattgctggtcacgatgagaatggtcccaacttatactatactgatccttctggaacattctggcaatgcaatgcaaaagctattggttcaggttctgaaggtgctgacagctctttgcaggagcaatataacaaggaccttacccttaaagaagctgaagccatagcactctctattcttaagcaagtgatggaagaaaaggtgactccaaataatgttgacattgcaagggtatctccaacttaccatctctactcaccttctgaggtggaagatgttatcagccgcctataagaaagtcgtacttattctcatcaccaactttttcttataacaacgcttgctttgtagtcttgctagatatcctggaatatatttttcttcttcgcaaggttaaaatgatggagatcgtggcttaagatttggtttaagacataaggtccggcctgtgttctgttgttcctggatgaagtactatttgctacatgtcctgcag

SEQ ID NO: 1275 - DNA, 1027 bp, Zostera marina
tatttatacacacacacatagtggtcgaagattagttttgatatcggtaacaaacccttcatactacaaacacaacagatccaagatgtttctaacaaggaccgagtacgatagaggcgtcaatactttctcaccggaggggaggttgtttcaggtcgaatacgcgatcgaggctatcaagcttggttctactgccattggattgaaaacaaaggatggtattgttttggctgttgaaaaacggatcacatcacccttgctggagccaagcagtgtagaaaaaattatggaaatagatgagcatataggttgtgctatgagtggacttatagctgatgcacgcactcttgtggaacatgcacgagttgaaacccagaatcatcgtttttcctatggggaacccatggcagttgaatcaacaacacaagcactgtgtgatcttgctctccgttttggagagggtgatgaagaatctatgtctcgaccttttggtgtgtcgctactgattgccggacatgatgagaatgggccaagcttatattacacagacccttctggaactttctggcaatgcaatgcaaaagcaattggttctgggtcggaaggagcagatagttctcttcaggaagaatacaacaaggaaataagtcttgcagaagcagaaaccatagcactttcaatcttgaagcaagtgatggaagagaaggtaaccccaagcaatgtagacattgcaaaggttgcacccacattccatctttactctccttctgaggtggaagccgtgatcaaccgtctataggagagcagcatgtgcacccatttttatgttctttgctatcgacattggaggtgatttgaaacagctatgtatgtttaataacattcagttaaaatgattaaaccataactaaaattaagtttgatttcactcactttggaatctaaagcaacagtttgttattctgaatttgaatttataattggattgtggtcatgatgggtggcagggtgggtatgcgtcatgtgc

SEQ ID NO: 1276 - DNA, 1053 bp, Solanum melongena
aagcaaacactactctaaatacactatttctgcagaaatggcttgtcactcaagtaaaaatcagtagaaaaacaatcaattgttcggcagttcttagctatcgcggattctcaaagctgtgacggatcgaagatgtttctcactagaactgagtatgatagaggtgtcaacactttctctcctgaaggaaggttgtttcaagttgaatatgctaatgaagccattaagttgggttcaacggcgattgggataaagaccaaggaaggtgtcgttcttgctgttgagaagcgaattacctctccacttctggagccaagcagtgtggagaaaattatggaaattgatgagcatattggatgtgcaatgagtggattgatagctgatgcaaggaccctcgttgaacatgcacgagttgaaactcagaaccacagattctcttatggtgagccaatgactgttgagtccacaacacaagctctgtgtgatttagccctgcgatttggtgagggtgatgaagagtctatgtccagaccttttggagtatcactactcattgctggtcatgatgagaatggtcctagcttatactatactgatccttctggtacattctggcaatgcaacgcaaaagccattggttcaggttctgaaggcgctgacagctctttgcaggagcagttcaacaaggacctttcccttaaggaggctgaaacgatagcactgtcaattctgaagcaagtgatggaagaaaaggtgactcccaataacgttgatattgcaagggtgtcaccaacttatcatctctacccgccttctgaggtggaagatgttatcagccgcctataagaacaaaacactcttgttatgcctctatgcaattctctgttatgggcaatgcttgcattctgttctagaatttgtgaattgttttgccccttgaagcatgatacattgttagctttgagttactttacaaagttcaaaccctttatgttgcttgacggaattccgtacaatgggataagattatttgatgaggctgcttaagattgc

SEQ ID NO: 1277 - DNA, 846 bp, Nuphar advena
gcgatattcgctttctactgctttagacgaacggcaagatgtttctcactaggaccgagtacgatagaggtgtaaacacattctctccagaagggcgattgtttcaggtcgaatatgcgatcgaggcgatcaagttgggttcaactgcaatcggaataaagactaaggaaggagtagtgttggccgtcgagaagagaattacttccccgttactggaacctagcagcgtggagaaaatcatggagatagatgaacatattggatgtgcaatgagtggactgattgcagatgctcgcacactagttgaacatgcacgggttgaaactcagaaccatagattttcgtatggtgaacaaatgactgtggagtccactacgcaagcactttgtgatctagctcttcgatttggtgaaggtgatgaggagtccatgtctcgtccgtttggggtatctctcttgattgctggtcatgatgagaatggacccagcctatactacacagatccatctggcacattctggcagtgcaatgccaaagccattggatctggttctgagggagctgacagttccttgcaagaacagtacaataaggatatttctcttctagaagcagagaaaattgctctgtccatcttgaagcaagtaatggaggaaaaggtaacacctaacaacgttgatattgctaaagttgctccaacataccacctctattctccttccgaggttgaggctgtcattagccgcttgtagaagaattggatgaatgcaaaatttacttctgtgctcatttaattaacattggattattcctgtattttcttgactatattttctcaatattact

SEQ ID NO: 1278 - DNA, 721 bp, Parthenium argentatum
aattgatcatcatcaagtgagattcagtggaagaagatgtttctaacgaggacggagtatgataggggtgtcaacaccttctctccagaaggcaggttgtttcaggttgaatatgctattgaggccatcaagttggggtctacagccatcgggttgaaaaccaaggaaggagttgttcttgctgttgaaaagcgcattacctccccactcctcgagcctagtagtgttgagaaaattatggaaattgatgagcacattggctgtgccatgagtggactaattgcagatgcccgtacactcgttgaacatgcacgagttgagactcagaatcataggttttcctatggtgagccaatgactgttgagtccactactcaagccctgtgtgatcttgcactgcggtttggtgaaggagacgaagaatctatgtctcgaccatttggggtatctcttcttattgcaggccacgatgaaaatggtccaagcctatactatacggatccatcaggcacgttttggcaatgcaatgcaaaagctataggctcaggctctgaaggtgctgacagttctctgcaggagcaatttaacaaggacttgactcttaaagaagctgaaacaattgctctttccatcttgaagcaagttatggaagaaaaggtgactcccaacaatgtggatattgcaaaggttgcgcctacttatcacttgtacaccccggctg

SEQ ID NO: 1279 - DNA, 1176 bp, Phalaenopsis aphrodite
ccaaaacccctccccattcttggatccgtccgccattagtccttttctcctttcttcctccctactccacttcctcgccccttagttaccgaacccttgaacggaggtattcccttcggcgtgcctaggattggaggtcggggtttctgcagatcttgaagatgtttctcacaaggactgagtatgatcgaggggtcaacaccttctcgcctgaagggaggctgtttcaggttgagtacgccatagaggctataaagcttggttcgacagcaattggaataaagacaaaggaaggggtcgtgcttgcggttgagaagcgcgtgacttcacctctactggagccaagcagtgtggagaaaataatggagatcgacgagcacattggatgtgctatgagtggtttgatagctgatgcccgcacactagttgaacatgcacgagttgaaactcagaatcacaggttttcctatggtgaagccatgagcgttgagtccaccacccaagcactttgtgatcttgctcttcgatttggtgagggcgatgaagaatctatgtcacgaccttttggagtctcacttttgattgctggtcatgatgaacatgggcctagtttattttatacagacccttcaggtacattttggcaatgcagcgctaaagctataggctctggctctgaaggagccgacagctctttgcaagagcagtataacaaggatttatctcttcaggaagctgaaacaattgctctctccatcctgaagcaagtcatggaggaaaaggtgacaccgaacaatgttgatattgcaaaggttgctccaacttatcacctctactccccatctgaggtagaagctgtaattagccgcctttaatgtattgataacaagccagtaatttctctgattcttcactggccacttttggaatctacaaccagagtccgttttacttcttttaggatttcaggtgggaactttcagctattggttctgtttgggctgcttttaaaaattggaagagattgaagttattatttctacattttgggtttcaattcttatattcagttaactggagccattctattttgaagtaaaatatattggtgtttgatttattgtattgagcagatgatttattgagtattttggttgggttccctcatcagtctag

SEQ ID NO: 1280 - DNA, 947 bp, Zostera marina
agttttgatatcggtaacaaacccttcatactacaaacacaacagatccaagatgtttctaacaaggaccgagtacgatagaggcgtcaatactttctcaccggaggggaggttgtttcaggtcgaatacgcgatcgaggctatcaagcttggttctactgccattggattgaaaacaaaggatggtattgttttggctgttgaaaaacggatcacatcacccttgctggagccaagcagtgtagaaaaaattatggaaatagatgagcatataggttgtgctatgagtggacttatagctgatgcacgcactcttgtggaacatgcacgagttgaaacccagaatcatcgtttttcctatggggaacccatggcagttgaatcaacaacacaagcactgtgtgatcttgctctccgttttggagagggtgatgaagaatctatgtctcgaccttttggtgtgtcgctactgattgccggacatgatgagaatgggccaagcttatattacacagacccttctggaactttctggcaatgcaatgcaaaagcaattggttctgggtcggaaggagcagatagttctcttcaggaagaatacaacaaggaaataagtcttgcagaagcagaaaccatagcactttcaatcttgaagcaagtgatggaagagaaggtaaccccaagcaatgtagacattgcaaaggttgcacccacattccatctttactctccttctgaggtggaagccgtgatcaaccgtctataggagagcagcatgtgcacccatttttatgttctttgctatcgacattggaggtgatttgaaacagctatgtatgtttaataacattcagttaaaatgattaaaccataactaaaattaagtttgatttcactcactttggaatctaaagcaacagtttgttattctgaatttgaatttataa

SEQ ID NO: 1281 - DNA, 1001 bp, Musa acuminata
ttttccctttcggggtttttgaatcgaaggaccgagtacgatcgaggagtcaacaccttctcccccgagggaaggttgttccaggtcgagtacgccatcgaggccatcaagttgggctcgaccgccatcgggttgaggacgaaggaaggcgttgtgctcgcggtggagaagcgtgtgacatcgcccttgctggaaccaagcagtgttgagaagattatggagattgatgagcacattggttgtgcaatgagtggattgatagctgatgcacggactcttgtagaacatgctcgtgttgaaactcagaatcacaggttttcatatggtgagccaatgacggtcgagtcaactacccaagcactgtgtgatcttgctcttcgatttggtgaaggagatgaagaatccatgtcacgaccctttggagtctctcttctgattgctggtcatgatgagaatggacccagcttgtactacacagatccgtctggtacattctggcagtgtaatgcaaaagcaatcgggtcaggatccgaaggagctgatagctctctacaagagcagtacaacaaggacttaacccttcaagaagctgaaactattgctctttccatcttgaagcaagtcatggaggaaaaggtgaccccaaataacgttgacattgcaaaggtttctccgacttatcatctgtacacaccctctgaggttgaagctgtaattgctcgcttatgaatgccgtgcttgtcatccatacacaccttctgagctcggggttgtcgatcacttgcttatgaatgttttgaatactctgttaattttatttagcatttaaacgattacttagtcggacctcaactcgaattttctacttgtcttctctcttattttctaaactgcccagccattctgagttggaacacattgatcgggaaagatcaaagctaattctcgtgcttaagcaattaagcagcatttgtctattatacatattactagaagctagg

SEQ ID NO: 1282 - DNA, 1039 bp, Secale cereale
tggttcccaagaagatacaccaccaagcaccaccccgtgtagtagaaatagaaacaagggcttcgagtatccgcatccaccgatacgatgtttctcacgaggacggagtacgaccgtggggtcaacaccttctccccggaggggcggctgttccaggtcgagtacgccattgaggccatcaagttgggctccactgcaatcggcttaatgactaaggatggtgttgtactggctgttgagaaacgtgtaacctcaccgctgctggaacctagcagtgtggagaaaatcatggaaattgatgagcatgtcggttgtgccatgagtggccttattgctgatgccagaacactggttgagcatgctcgtgttgagactcagaatcataggttctcatatggggagccaatgacagtagaatctaccacacaagctatctgtgacttggctttgcgtctttggtgaaggtgacgaagaatcaatgtcgcggccatttggagtctctctccttattgctggtcatgatgaaaatggacccagcttgtactacacagacccatcggggaccttctggcagtgcaatgccaaggcaatgggggctgcagcctgatgctcatacaagagcagtacaacaaggaactgaccatcgctgaggcagagaccatagccctttctatcctgaagcaggttatggaagaaaaggtgaccccgaacaacgttgacattgcgaaggtctcccctagctaccacctctacacccctgcagaggttgaagcggtcatcgcaaggttatgaaggattgccactttgtgagacagcctcttgtattcccattgaccctaagacacacttagttcatttctttgtagcactgagacgttgtatcaccaaaaggaattactacacataattttcagcattccagcaagtgcgtaggtatcactggatgcatttatgtgcatttggttcgtaaacaggagtttgtacaagtgacgcctttggttgcttgcattaagctcagctaggcccgcgcaagaagaaa

SEQ ID NO: 1283 - DNA, 885 bp, Olea europaea
tttttgagctcttataatcgaatcgaaaatgttcctcacaaggactgagtatgatagaggagttaacactttctctccagaaggccgattgtttcaagttgaatatgccattgaagccatcaagttgggttccactgcgattgccgtaaaaactaaggaaggggtgattcttgctgtcgagaagcgcattacctctccacttttggagcctagtagcgtggagaagattatggagatagatgagcatattggctgtgctatgagtggtttaattgctgatgcccgaacactggttgaacatgctcgagttgaaactcagaatcataggttctcttatggtgagcccatgacagtggagtcaaccacacaagctctctgtgatcttgccctgcgatttggtgaaggagatgaagagtcaatgtctagaccatttggtgtatctcttcttatcgctggtcatgacgagaatggtccctgcttatactatactgatccttctggcacattctggcaatgcaatgcaaaagccatcggttcaggttctgaaggtgctgatagctctttgcaagagcagtacaacaaggatctaactcttaaagaagcggagaccatagcactttccattttgaagcaagttatggaagaaaaggttacccccaataacgttgatattgcgagtgtggccccaagatatcatctgtacaccccatctgatgtcgaaactgttatcaatcgcctatgagaagggcatctagcagttcccattatggcttcatgcgtaatgcaaatctcaaatttctcttccaatttaaactgtctgttgaaatacttcatttggtgaatgtgcttgcttatacttcatggttatgggttataatttgggcc

SEQ ID NO: 1284 - DNA, 1227 bp, Olea europaea
aagtctgctctctaatttcttaattaagcaactcttttgagctctaataatcgaattgagaatgttcctcacaaggactgagtacgatagaggagttaacactttctctccggaaggccgattgtttcaagttgaatatgccattgaagccatcaagttgggatccactgctatcgccataaaaactgaggaaggggtggttcttgcagtcgagaagcgtattacctctccacttttggagcctagcagtgtggagaagattatggaaatcgatgagcatattggctgtgctatgagtggtttaattgctgatgcccgtactctggttgaacatgctcgagttgaaactcagaatcataggttctcttatggcgaacccatgacagttgagtcaactacacaagctctctgtgaccttgccctacgatttggtgaaggagacgaagaatcaatgtctagaccgtttggtgtatctcttcttattgctggtcatgatgagaatggtccctgcttgtaccatactgatccttctggtacattctggcaatgcaacgcaaaagccattggttcaggttctgaaggtgccgacagctctttgcaagagcagtataacaaggatctaactcttaaagaagctgagactattgcactttccattttgaaacaagttatggaagaaaaggttaccccgaataacgttgatattgctagtgtggccccaagatatcatctgtacaccccatctgaggtcgaaactgttatcaatcgcctatgagaagggcatctagcagttccagtgccgatctttacgatgattcagttcccattattgctgtgttggcttcatgtgtaacgcaaatctcagatttcgcttccaatttacattccagtaggaaaatgctttgaaatgtgttaaaactctaaatgataaactcgaaagatttcatttttgtgtttcctgggtgaatgtgcatgcctatatcgaccccttttattgtattaagtactgatatgtactacctcgaagtgccatttatgttttctactatgataagcataaatgtaacttgatttgccctttccttgtcaggagcttgccctttggactagaacatgaatcgctcactagtaattagaaaatgacactcgtgtcgtgactaccactcgtcttgtactcgaacgcgagacgtcgtctttagttttttacggtaaactttaaatacgtac

SEQ ID NO: 1285 - DNA, 1094 bp, Amorphophallus konjac
ggaattttttggtttcaccacctctctctctctgcgtctgtgcttcttggacgaggtcgccggcgactgccgtctctcttgcttccggctgtcaggatgttcctcaccagaacggagtacgaccggggggtcaacaccttctcccccgagggcaggctgttccaggtcgagtacgccatcgaggccatcaagttgggttcaacagccatcgggatcaagacaaaggagggcgtcgtgcttggggtcgaaaagcgcatcacctcacctctgctggagccaagcagtgtggaaaaaatcatggaaattgatgagcacataggatgtgcaatgagtggacttatagctgatgcacgtactctggtagaacatgcccgtgttgaaacacagaaccacaggttctcatatggagaagcaatgactgtagagtcaactacccaagcattgtgtgatcttgcccttcgctttggtgaaggagatgaagaatctatgtctcgaccttttggtgtctcacttctaattgctggccatgacgagaatggaccaagcctttattacacagatccttctggcacattctggcaatgtaatgcaaaggcaatcggatcaggttctgaaggagctgacagctctttgcaggaacaatacaacaagggcataaccctccaggaagctgaaacaacagccctgtctatcctgaagcaagtgatggaggaaaaggtgaccccagacaatgttgatatcgcaaaggtggcccctacattccatttgtattccccatctgaagtggaggccgttatcaaccgactataacaccagttaccgttgaacccttttgtcatttattctcgtcttcacctcactgtatttttttttttttgtcgagtgctagagtcggggcatattaatttcctgtgtcttctctgtttgggattgcccgataaatatttccttgtttgaattgtacggtggctgcccttttttttttcatcatggttatacattgtgatttgatctagtcggaggatttgcctgcttccacggattcttcttcccactggacaccgttttttaatcttttcatcgtgatggttttg

SEQ ID NO: 1286 - DNA, 937 bp, Antirrhinum majus
  misc_feature (207)..(207): n is a, c, g, or t
  misc_feature (263)..(263): n is a, c, g, or t
  misc_feature (344)..(344): n is a, c, g, or t
  misc_feature (349)..(349): n is a, c, g, or t
cggcacgagcggcacgagcttagagtgagaaactacacaaccaaccctagtaacttccttcacccgatcgaaaatgttcctcacaaggactgagtatgacagaggagtcaacactttttctccggaaggtcgtttgttccaagttgaatacgctattgaggctatcaagttgggctcgactgcaattgggttgaaaacgaaggaagnagtggttcttgctgtcgagaaacgcattacatctccacttttggagcccagcagtntggagaaaattatggaaattgatgatcatattgggtgtgccatgagtggcctgattgctgatgctcgcactctggtcgagnatgcnagagttgaaactcagaaccataggttctcatatggtgagcccatgactgttgagtccaccacgcaagcactttgtgatcttgccttgcggtttggtgagggggatgaagaatctatgtcgagaccttttggtgtttctcttctcattgctggacatgatgagaacggtcctagcttgtactatactgatccttctggcacattctggcaatgtaatgcaaaagccattggatcaggttctgaaggtgctgacagctctttgcaggagcaatataacaaggatctaactctgaaagaagctgagaccattgcactgtccatcctgaagcaggttatggaggagaaggttacccccaacaatgttaatatcgcgaaggtatcaccgacgtaccatctgtactcgccttcggaggttgaagcagttatcagtcgcctatgagaagagaaactccatcaatctgttccatttgctctctttacattatcggcattgccattgttgtcgtaattggacatgtttccccgtactcttggatgctttgccaatatcagattttgatagtaaactgctattaggtccgtcaacttt

SEQ ID NO: 1287 - DNA, 2209 bp, Silene vulgaris
taatctaaccctaatacctcttaaaccctaaaaaacactaataaaaactacaaattacacatttttttttattttttcaaactcgtagtaagtaaatgcttagttcaggagcgccatgacagtcgggattaaccatgtagaaagcctcagaatctctagacccaacaaccctctcaaattgcgctctcatgtacatgagttcgccatctgtacccgacccggacccgttaaatccaggaagaacacctgcccccattgaaatgggctcaactgccttcaatattttagcctcatttggcccaatttctctttttgttgcaaacccacattttttaccgttacaatatgtcctccatctttgctcctccaacaacctcttccttttcgccttcttgctactattattgttattattgttgttattattatcgtccactgacgattcttgcttatcgcattcgagtgcaattctaaccaacccaaatgccatttcattgactaaactagtaattggagtagctagctcaatgaagaacacaggagttgagttatgatccctttgaaacacaaaatgtacatgccctcttcgatacccgaaaagggtacctacaatcttaggacatgaacccaaatgaggaaaacctgatgaagctttgttaatgtgtaaggcagttagaactgacctaatcctcgacaccgcgatttgttgtagtttccttctcctccttgagacaatactcttagactcctcaagtttagggtcactagatgaatgaatatccttaaaactcccttgttttactctgttttcctctgttttttgtgggtttggttcatcttgtattctcctagaggatgaccaagggaaactagccttagacatgttagtaggtgttgttgttgtcttcatttttgtagattttagagggagaatgagttgttttgtgttgtggttggttactagtaagaaaagcgcataccacattcctccattttctccgtcgtctccctttctctctcttccgatatttggttttctgcggtaatcaagatgtttctcacaaggaccgagtatgacagaggagtcaatactttctcacctgaaggccgcttgttccaggttgaatatgccattgaggccatcaagctgggttcaactgcaattgggttaaagactaaggaaggagttgtccttgctgtggaaaaacgcatcacctctccgttgctggaacctagcagtgttgaaaaaatcatggaaattgatgagcatataggatgtgccatgagtggattgattgctgatgctcggacccttgtggagcatgctagggtggagactcagaatcatagattttcatatggggaaccaatgacagttgagtcgactacccaagctctgtgtgatctagctttgcgctttggggaaggtgatgaagagtccatgtctcgtcctttcggtgtgtcgctcctcattgcaggtcatgatgagaatggaccaagcttgtattacaccgacccatctggaacattctggcaatgtagtgcaaaggcgattggttcgggttcagagggtgcagacagctccttgcaggaacaatacagaaatgatttgacttttcaagaagctgagacaatagctctttccattctgaagcaggttatggaggaaaaggtgactccaaacaatgtcgatattgcaagggtttctccaacctaccacttgtactctccatctgaagtggagtcggtgattaatcgactgtaaggacttcctcacccaaattcatctgttgatcttttaggcctctgatgttgcctgcatggagtttcttttggtgattagtgttgaagaattcattgacttctccatctcagttgttgccagaagctgttttatatgttatcccaacattccagtttggttttatgtcttaattgcacgatagtttaatactttaattagcttgcttagttcaaaggggatatggtgctgttactgaaactgtaatgttaattgtgaactaatggctttttcctgactgtcgtggtcttcttctctgatgtttctctcgaaagcctatggggcgttgacgtagagtctgcgctgggtcattgctggtgtatgatatactttggattgggtcaggttatattgtactccctcccattcattataagtgtcccattgtgaggatgtcacgagaattaa

SEQ ID NO: 1288 - DNA, 1051 bp, Cycas rumphii
gtgtacctgtgcccggtggtcgttcaagggcaaagttcaggcttcaaattttgagcaaatagaagatgtttctcacaaggactgagtatgacagaggtgtcaacaccttctctcccgagggtcgattgttccaggttgaatatgccattgaagcgattaagctgggttcgactgcagtggggctgaagacaaagcagggagtggtcttggcggtagagaaacgtatcacgtccccattattggagccaagcagtgtggagaaaattatggagattgatgaacatattgggtgtgccatgagtggattgatagctgatgctcgcacccttgtggaacatgcacgcgttgaaactcagaatcataggttctcctatggcgaaccaatgactgttgagtctacgacccaagctttgtgtgatcttgcacttcgctttggagaaggcgatgaagaatccatgtcacggccttttggagtgtctcttctaattgcaggccatgatgaaaatgggcctagcttatactacacggatccttctggtaccttctggcaatgtgatgccaaagctataggatcaggatctgaaggagcagacagctctttacaagagcattacaataaggatatgactttggaagaagcagagactcttgcactttctatcttaaagcaagtcatggaggaaaaagtgacagctagtaatgttgacattgcaaaagtggccccaaagtaccacctttatataccggcagaggtggagacggttattagtcgtttatgagtaaaattttgttgcaattgtttcagatggatttgaggcacaatttagggcccaaacctttttgtttgaaagaaattaatggattttgtgcccctcttgctatgggaggcttttggttatttgggcaggtttgccattttagctaaacctcgacttcattttatgaaatattaaaaaccttcgaagatttttatggctcatgtccatgtggatttacatgaatgaggatgagattcagctttttggttaaaaaaaaaaaactttggatccac

SEQ ID NO: 1289 - DNA, 896 bp, Nicotiana tabacum
gtctaaatatttgctttacagaaatgcttcttagttattgaagccattagttctcagttgaagaagagttgtcaaaactgcgtcgaagatgtttctcacaagaactgagtacgatagaggtgttaacactttctctcctgaaggccggctatttcaagtcgaatatgcaattgaagccattaagctgggttcgactgcaattgggttaaagacaaaggaaggagtcgttcttgctgttgagaagcgcattacctcacccctcttggaaccaagtagtgtggagaaaattatggaaattgatgagcacattggttgtgcgatgagtggactaatagctgatgccaggacacttgtcgaacatgcacgggttgaaactcagaaccatagattctcctatggtgaaccaatgacagttgagtccaccacacaagctttatgtgacttggccctgcgatttggagagggtgatgaagaatccatgtccagaccttttggcgtatctcttcttattgctggtcatgatgagaatggtcccaacttatactatactgatccttctggaacattctggcaatgcaatgcaaaagctattggttcaggttctgaaggtgctgacagcactttgcaggagcaatataacaaggaccttacccttaaagaagctgaagccatagcactctctattcttaagcaagtgatggaagaaaaggtgactccaaataatgttgacattgcaagggtatctccaacttaccatctctactcaccttctgaggtggaagatgttatcagctgcctataagaaagctctacttattctcatcaccaactttttcttataacaacgcttgctttgtagtcttgctacattttctggaatatatttttctttttcg

SEQ ID NO: 1290 - DNA, 943 bp, Euphorbia peplus
aggactgagtatgatagaggagtcaacactttctctccagaaggaagattgtttcaggttgaatatgccattgaagcaattaagctaggttcaactgccattggattaaagacaaaagaaggcgttgtgcttgcagttgagaagcgtatcacttccccactcatggagcccagcagcgtggagaaagttatggaaattgatgagcatattggatgtgctatgagtgggttaattgcagatgctcgtacacttgttgagcatgctcgtgttgaaactcagaaccatagattctcttatggtgagcccatgactgtggagtctactacacaagcactttgtgatctggctctacgatttggtgaaggtgatgaagaatctatgtctcggccatttggagtttctcttctcattgctggtcatgatgagcatggtcctagcttgtattatacagatccatctgggacattttggcaatgcaatgcgaaggcataggttcgggttcagagggtgcagatagctcccttcaagagcaatataacaaggacatcactcttcaagaggctgagacaattgcactttccattttgaaacaagttatggaagagaaggtgacacccaacaatgtcgacattgcgaaggtagctccaacatatcatttgtatacccctgcagaggtggagaccgtcataagccgcctatgagaagaaaatggtgtcatgaaatttcatatgtaattccctatttggtattgtcaccagtccagtcgggatagcaaaggattagactccatagaatctttttactttcttgaattgatactctattatggtctttaattgtcaattctgaaaacttcaactcctcaaagtgaaacacaaatttggactttgttgagttatatttgtaagtgccactagtgttctctctttggaccactttatat

SEQ ID NO: 1291 - DNA, 1217 bp, Zamia vazquezii
  misc_feature (691)..(691): n is a, c, g, or t
  misc_feature (694)..(694): n is a, c, g, or t
  misc_feature (772)..(772): n is a, c, g, or t
  misc_feature (899)..(899): n is a, c, g, or t
  misc_feature (915)..(915): n is a, c, g, or t
  misc_feature (944)..(944): n is a, c, g, or t
tgggtagcacgtatcctctaaccggaggtaaaacctttgcgtggactagctgatcaaggccaaagctaccctcgattttttgggcgcagggaccatgtttcttaccaggactgagtatgacaggggcgttaacacattctctcccgagggacgtctgttccaggtcgaatatgccattgaagccattaagctgggatctactgctgtgggcctgaagacgaagcagggcgtggtgttggcggtagagaaacgtatcacgtcaccattactggagccaagcagcgtggaaaaaattatggagattgatgaacatattgggtgtgcaatgagtggattgatagctgatgcacgcacacttgtggaacatgctcgcgttgaaactcagaatcataggttctcatatggtgaaccaatgactgttgagtccacaacgcaagctttgtgtgatcttgcccttcgctttggagaaggcgatgaagaatctatgtcacgaccttttggagtatctctattaattgcaggccatgatgaaaatggccctagcttatactacacagatccttctggtactttctggcaatgtgatgctaaagctataggatcaggatcagaaggagcagacagctctttacaagagcattacagtaaggatatgactttggaagaagcagaaaccactgcactttctatnttnaagcaagtcatggaggaaaaggttacggccagtaatgttgacattgcaaaagtggccccaacatatcatctttatacnccagcagaggtggagactgttatttctcgcttatgagttcaattttgttgcagttattctatatggacaggaggcacaatttgggtcccaaactattgcagttgaaagaaattattgcatgtcttcngccatgtgaggcaccngattatttgggcagacttgtcattttggntacacgtcaacttttccttatagacattaataaccagtggatttacatgaatgagattgagctttcttgtttccgttagttactaatgtgattcgtttctcagttaacaactgtgttttgagctttgatgcatttctcagttaacaactgtgttttgagctttcttgttcctgtttgtactagtattaactaatacattgttgcatttgtagtggatgctttttcttttggaaataagatcaaaattaaagaaaaattattctttatcaaaaa

SEQ ID NO: 1292 - DNA, 1232 bp, Eragrostis curvula
tgtgtgcggctcgaagaagctcgcaacaagctagccggggtggagaaggcgacgcagtcctctagcttcgattccgcatccgcgccgccgccgcagccaagatgtttctcacgaggacggagtatgaccggggggtgaacaccttctcgccggaggggcggctgttccaggtcgagtacgccatcgaggccatcaagttgggatcgaccgcgattgggttgaagacaaaggatggtgttgtcctcgctgttgagaaacgtgtgacctcaccactgctggaaccaagcagtgtggagaaaatcatggaaattgatgagcacttaggctgtgccatgagtggacttatcgctgatgctagaacactagtggaacatgctcgtgttgagactcagaatcatagattttcatatggagagccaatgacagtagaatctgccacgcaagctatttgtgacttggctctgcgctttggtgaaggcgatgaagaatccatgtcacggacgtttggagtctctctccttattgctggacatgatgagaatggacctagcttgtactacagtgaaacgtctgggaagtataggaaatgcaaagagaaggaaatggatctggctctgaaggagctgctaggtcatagcaggaacagtacaacaaggaactgaccctccaggaggcagaaaccatagccctttcgatcttgaagcaggttatggaagaaaaggtgaccccaaacaatgttgatatcgcgaaggttgcccccaactaccacctctacactccatctgaggtcgaagctgtcattgcaaggctgtgaaactgtgccaatctctttatttccatgatccagcgttgtatgaatagtgagaccgtgatgtggggttgtctgcttattgttgccaatggctatcatgttcttttaacaaaggatagacgcttgtaggggcttcttgcctttgatagcctcattcacagcccaatcatttgtctgttttcagtagtgttgagaacctgtattaccagaaagaagctacacttgttttacgaatccgattgctgtcttttgataattggtaaaaaaaaaaaaaaaaaaaaaaaaaaaaaattactctggtttaaaacccctgtttaatcaaattcccccggcccccaggggggccggaaaaatgcaaccccgggcccaattccccctaaagggggtcaaattaaaattcccgggccgcctttttaaaaaa

SEQ ID NO: 1293 - DNA, 887 bp, Tripterygium wilfordii
agtcaacaccttctctccggaaggcagattgtttcaggttgaatatgccattgaagctatcaagctgggctcaactgctattggattgaaaacaaaagaaggagtggttcttgcagtcgagaagcgtattacttcaccactgctggagcccagcagcgtagaaaaaattatggaaattgatgagcatatcggatgtgctatgagtggattgattgctgatgcccgtacacttgttgagcatgcacgtgttgaaactcagaaccatagattctcatatggtgaaccaatgactgtagagtccactacacaagcactgtgtgatcttgccctgcgctttggtgagggtgatgaagaatccatgtctcgaccctttggggtatctcttctgattgctggtcatgatgaaaatggccccagcttgtactatacagatccttctggcactttttggcaatgcaatggtaaggctattggttctggttcagaaggtgcagacagctctctgcaagagcagtataacaaggagctaactcttcaagaagctgagacaattgctctgtcaattctgaagcaagttatggaagagaaggtaactccaaacaatgtcgatattgcaaaggtggctccaacgtaccacctatataccccttctgaggtggaggctgtcattagtcgtctatgaaagcatctcaaaatgcctgtttatgtcctatgtagtcccatacatgctcactttctcatatgtatgctggggagagccctgttgggattctgtttaactttgatcttaaagactggattccattttgttttgtctttctaaaatgcacttattagtttgagctgtacaactgggacatggatttagctaaatgaaaacttatatt

SEQ ID NO: 1294 - DNA, 688 bp, Vinca minor
aatccacaatgtttctcaccaggactgagtacgataggggtgtgaacactttctctccagaaggtcgattgtttcaagttgaatatgccattgaagctatcaagctgggttcgaccgcaattggattaaagactaagcagggagttgtccttgctgttgagaagcgtattacctcccccctcctggagcccagcagtgtcgaaaaaattatggagatcgatgaccatattggctgcgcaatgagcggattaattgctgatgctcgaacgctagttgagcatgcacgagttgagactcagaatcatagattctcatacggtgagccaatgactgttgattcaactacccaggctctttgtgatcttgcccttcgatttggtgagggggacgaagaatccatgtctagacctttcggtgtctctcttctcattgctggtcatgatgaaaatggtcccagcttatattatacggatccatctggaactttctggcaatgcaatgcgaaagctataggctcaggctctgaaggtgctgacagctccttgcaagagcagtataacaaggacctaactcttcaagaggctgaaacaatagctctctccattcttaagcaagtcatggaagaaaaggtaactccgaataatgttgatattgcaaaggttgctccgagttaccatttgtacacccc

SEQ ID NO: 1295 - DNA, 919 bp, Musa acuminata
atgacttcacgtccaatacgcacgtgcagatcacgtgcgacgatgtgcttgcttgagaaatgtgttctgcttgcttgcgtgcggggaagccatgttagaggagcacatcgagagctttgtagccccgccgcggcggatccgaagagtacactgaagaagcgtcgatcaccgccacccgttttcgcctctctctccctctcgcacagaattttagagatgttcctcactaggaccgagtactatcgaggcgtcaataccttctcccccgaggggaggctgttccaggtggagtacgccatcgaggccatcaagctgggttcgactgccattgggctgaggacgaacgaaggcgtcgtgctcgccgttgagaagcgcgtgacctcgcccttgctggaaccaagcagtgtggagaagattatggagattgatgaacacataggttgtgcaatgagtggactgatagctgatgcacgaactcttgtagaatatgctcgtaatcacaggttttcctatggggagccaatgactgttgagtccaccacccaagcgctatgtgaccttgctcttcgatttggtgaaggagatgaagagtccatgtcacaaccttttggggtatctcttctgattgctggtcatgatgagaatggacccagcttgtactatacagatccatcaggcacattctggcaatgcagtgcaaaagcaataggctcaggatctgaaggagcagatagctctcttcaagagcaatacaacaaggacttaacccttcaagaagctgaaaccatagccctttccatctcgaagcaagtcatggaggaaaaggtgactccaaataaccttgacatcgcaagggttgccccaacttatcacctttacacacctactgaggtcgaagctgtcattgcccgcctataat

SEQ ID NO: 1296 - DNA, 843 bp, Citrus clementina
agttccggtatcaactcttaagctcaggtttccagatccaatcagcaacaaaacatgttctttacgaggactgagtatgatagaggagtgaacactttctctccagaaggaagattgtttcaggtcgaatatgctattgaggccattaagctgggttcaactgcaattgggttgaagacgaaaaaacgcattacttcaccgctgctggagcccagcagtgtggagaagattaaggaaattgatgagcatataggatgtgctatgagtggattgattgctgatgctcgtacacttgttgaacatgcaagggttgaaactcaaaatcatagattctcatacggtgagccaatgaccgtagaatctactacacaagcactctgtgatctggtgctacgctttggtgaaggcgatgaagaatccatgtctcgaccatttggagtatcccttcttattgctggatctgacgagaatggacctagcctgtactatacagatccatctggcacattctggcaatgcaatgcaaaggctattggttcaggttcagaaggagctgacagttctctccaagagcaatataacaaggatttaacccttcaggaggcagagacaattgctctatcaattttgaagcaagttatggaagaaaaggtcactccaaacaatgttgatatcgccagggtagctccaacgtatcatctctataccccttctgaggtggaggctgtcatcaatcgccctatgagtatccggagaaaatcatctttaaaaattcttccctggcttcagcggtgtttcttcagttctttgcagtgcaagtgcacttcgttgtttgtttgttag

SEQ ID NO: 1297 - DNA, 1026 bp, Citrus sinensis
agttccggtatcaactcttaagctcaggtttccagatccaatcagcaacaaaacatgttctttacgaggactgagtatgatagaggagtgaacactttctctccagaaggaagattgtttcaggtcgaatatgctattgaggccattaagctgggttcaactgcaattgggttgaagacgaaaaaacgcattacttcaccgctgctggagcccagcagtgtggagaagattaaggaaattgatgagcatataggatgtgctatgagtggattgattgctgatgctcgtacacttgttgaacatgcaagggttgaaactcaaaatcatagattctcatacggtgagccaatgaccgtagaatctactacacaagcactctgtgatctggtgctacgctttggtgaaggcgatgaagaatccatgtctcgaccatttggagtatcccttcttattgctggatctgacgagaatggacctagcctgtactatacagatccatctggcacattctggcaatgcaatgcaaaggctattggttcaggttcagaaggagctgacagttctctccaagagcaatataacaaggatttaacccttcaggaggcagagacaattgctctatcaattttgaagcaagttatggaagaaaaggtcactccaaacaatgttgatatcgccagggtagctccaacgtatcatctctataccccttctgaggtggaggctgtcatcaatcgccctatgagtatccggagaaaatcatctttaaaaattcttccctggcttcagcggtgtttcttcagttctttgcactgcaagtgcacttcgttgtttgtttgttaggggaaacaattatatttgtttatgattgggattgcacccatttgaacctttctgttttggtgctgggtttgagctgcctatcatacccccgaaatctgtgtccgtgcagaactgaagtacttctcagttgtatgaacggtatgaacctaatggaaatttagattcaaatcttgtttttaagtt

SEQ ID NO: 1298 - DNA, 1164 bp, Nicotiana benthamiana
ttattttctttttgttactttttctccagaactgagtatgatagaggtgtgaacacattctctcctgaaggaagattatttcaagttgaatatgctattgaagccattaagttgggatcgacggcaattgggataaagactaaggaaggcgttgttcttgctgttgagaagcgaattacttctccacttctggagccaagcagtgtggagaaaattatggaaattgatgagcatattggctgtgcgatgagtggattgatagctgatgcaagaacccttgttgaacatgcacgagttgaaactcagaaccacagattttcttatggtgagcccatgactgttgagtccacaacacaaggtctgtgtgatttggccttgcgatttggggagggtgatgaagagtctatgtccagaccttttggtgtatcacttctcattgctggccatgatgagaatggtccgagcttatattatactgatccttctgggactttctggcaatgcaatgcaaaagccattggttcaggttcagaaggtgctgacagctctttgcaggagcaattcaacaaggacctcaccctaaaggaggctgaaactattgcactgtccattctaaagcaagtgatggaagagaaggtgactcccaataacgttgatattgcgagggtatctccaacttatcatctctactcgccttctgaggtggaaactgttatcagccgcctataagaagaaagctctcttgttacgcttgttagccatttctctattatgggcaatgtttacttccaactgttttagaatttatggattatattgcccgttctagcatgttaaattattagcattctgactcatagacaaatggtcaatccctttatgttgcttggaaattccgtaggatgggatgtggattgttttctgatgaggtctacgattcagatatggtcgaaaagatgccttttccatagaaaggcttgagttactttctatgcaatattgtgtctgacgaaatgcttagaaatcccctagatatgtctgttacctaaagaaaaatatgttataaatggccttttgttatgtggcacttcaagcgagggaattctattattccttagaatgagtttttattcaacacagaagctcatcctttgccaatcaaat

SEQ ID NO: 1299 - DNA, 1211 bp, Aquilegia formosa
aagaagaagaagcagcagcttggatcttttcaacttcagagcaattttttcacaagttcgaggttttttttttcattaacgatcaatcgatttgaacgaagatgtttcttacaaggactgagtatgatagaggtgttaacacattctcacctgaaggaagattgtttcaagttgaatatgcaattgaagctatcaaattgggttcaactgcaataggattgaagacgaaacatggagttgtgcttgcagttgagaagcgtattacttcgccattgctggagcccagcagtgtggagaaagttatggaaattgatgaacacatagggtgtgcaatgagtgggttgattgctgatgctcgtacacttgttgaacacgctagagttgaaactcagaatcacaggttctcatatggtgaacccatgactgtggaatccaccacacaagctttatgtgatcttgccttgcgctttggtgaaggcgatgaagaatctatgtctcgaccttttggggtgtctctcctcattgctggtcacgacgaaaacgggccaagcttatactatacagatccatctggtacattttggcaatgcaatgcaaaagccataggttcgggatctgaaggagcggacagctctttgcaggagcaatataataaggacataactctccaagaagctgaaacaattgcattgtccattttgaagcaagtgatggaagagaaggcaagttatcatattagactttcacaaagacttattgttactccaaacaatgttgatattgcaaaggtggctccgacttaccatctttactctccatctgaagtagaggccgtaatcgctcgcctataagtgaaccatggatttatctcttgcaagcttatttgccatcgacattttcttcgtggatccaacttatttctattaatttgttttgggagaaagggtatttaaatgtgtggagtatggttggctggttgcatactgcagtactacactggcaaatgtgacatgcatgtgagctcccttctggcccgaaaatgtaattaatggttttggattacccctcaccccacccccggggcatgaaaacataattaatggttttggcttgtgctgtttcaaacaatatgtaattggtcagtcattgaacttaaaattttgtttagggagggattgcttactgtttccttttcggcagagtcctaggct

SEQ ID NO: 1300 - DNA, 883 bp, Olea europaea
gctccaagaaattggggttttaatacgacgaatttgtggttgaaatttctaaatttctgtcattttgagttatttgcagcaaattctgtggctataattaatcgactcgaaaatgtttctcacaaggactgagtatgatagaggagtcaacactttctctccggaaggccgattgtttcaagtcgaatatgccattgaagctatcaagttgggttcgacagcaatagggttaaaaactaaggaaggggtggtccttgctgttgaaaagcgtattacctcgcctcttttggagcctagcagcgttgagaaaattatggaaattgatgatcatatcggttgtgccatgagtggcttaattgctgatgcccgtacactggttgaacatgcacgagttgaaactcagaatcataggttctcatatggtgagcccatgacagttgagtccactacacaagctctctgtgatcttgccctgcgatttggtgagggtgatgaagaatctatgtctagaccttttggcgtctcccttctcattgctggtcatgatgagaatggacccagcttgtactataccgatccttctggtactttctggcaatgcaatgcaaaagccattgggtcaggttctgaaggtgcagacagttctttgcaggagcaatacaacaaggatcttaccctgaaagaagcagaaaccattgcgctttccatcctgaagcaagtgatggaagaaaaggttacacccaacaatgttgattttgcaaaggtagcaccaacttaccatctgtactcgccttctgaggttgaacagggtatcagccgcctaaaaaaaaaagccatcaatttgctttgctgattttcattgcaaaatcactttcccaatatt

SEQ ID NO: 1301 - DNA, 968 bp, Petunia hybrida
atcaatttctcagttcacagaaaactcattagcaaacaaatcagttctctgttttcacaaaatcacaatccaagatgtttctcacaagaactgagtatgatagaggagtcaacactttctctcctgaaggccgattatttcaagttgaatatgctattgaagccattaagttgggttcgacggcgattgggataaagactaaagaaggtgttgttcttgctgttgagaagcgaattacctcccctcttctggagccaagcagtgtggagaaaattatggaaattgatgagcatattggctgtgcgatgagtggattgatagctgatgctcggactctcgttgaacatgcacgagttgaaacacagaatcacagattctcttatggtgagcccatgactgttgagtccacaacacaagctctgtgtgatttggccctgcgatttggcgagggtgatgaggagtctatgtccagaccatttggtgtatccctgctgattgctggtcatgatgagaatggtcctagcttatactatacagatccttctggcactttctggcagtgcaatgctaaagccattggttcaggttcagaaggtgctgacagcactttgcaggagcaatttaacaaggatctttcccttaaggaggctgaaaccatagcactttcaatcctaaagcaagtgatggaagaaaaggtgactcccaataacgttgatattgcgagggtgtctccaacttaccatctctactccccttctgaagtggaagatgttatcagccgcctatatgaagaaagcctgttctttgcctgatttcctctcatggcgatgtttgctttcagttgtgctagaattgatggattctgtgtcccttcttgtatgttacattattagctttatgactcgtgatttttattgaaggtccctttttgttgcttgacgaaatccattaatgggatgaaattcttc

SEQ ID NO: 1302 - DNA, 1010 bp, Guizotia abyssinica
aaataccgccattactgacggagagggattggaagtgaaataagtgacatgcattaaggactggaatgtaatttactcttaaactaataataggcaatagagaagtgaatcgtgagtactgactactgagtagtagaagcctagaaggggttgagtaattgggcttaaccaggccgtttatctttttgtttcgggtagaacccgagtatcgacccgggaacaagaacccagagctgggctggcttgcttcgcaagaagggcttcatccgtgcataaatagtcagtctaacgaagcagaaattccgataatcaactgagatctatcaatcaagccgttaaactcaatcgaagatgtttcttaccaggaccgagtatgataggggtgtcaacaccttctctccagaaggccggttgtttcaggttgaatatgctattgaggccatcaagttgggttctacagccattggtttgaagaccaaggaaggggttgttcttgctgttgaaaaacgtatcacctccccactcctggagcctagtagtgttgagaaaattatggaaattgatgagcacattggttgtgccatgagtggattaattgcagatgcccgtacactcgttgaacatgcacgagttgagactcagaatcataggttttcctatggtgagccgatgactgtggagtcaactacccaagccctgtgtgatctagcactgcggtttggtgaaggagatgaagaatcgatgtctcgaccatttggggtgtctcttcttattgcaggccatgatgaaaatggtcctagtctatactatacggatccatctggcacattttggcagtgcaatgcgaaagctataggctcaggctctgaaggtgctgacagttctctgcaggagcaatttaacaaggacttgactctaaaagaagctgaaacaattgctctttccattctaaagcaagttatggaagaaaaggtgactcccaataatgtggatattgcaaaggttgctcc

SEQ ID NO: 1303 - DNA, 700 bp, Parthenium argentatum
gaagagatctatctaatttaattattctgaatcgaagatgtttctgacgaggacggagtatgacaggggtgtcaacaccttctctccggagggccgattgtttcaggttgaatatgccattgaggccattaagttgggttccacagctattgggctcaagaccaaggaaggggttgttcttgctgttgaaaagcgtattacctcaccactcttggaacctagtagtgttgagaaaattatggaaattgatgaacacattggctgtgccatgagtggattaattgcagatgcccgaacactagttgaacatgcacgggttgagactcagaatcatagattttcgtatggtgaaccgatgactgttgagtcaaccacccaagctctgtgtgatctagcactgcgatttggtgaaggagatgaagaatccatgtctcgaccttttggggtatctcttcttattgcaggccatgatgaaaatggtcccagtctatactatacggatccatcaggcacattttggcaatgcaatgcaaaagctatagggtcaggttctgaaggtgctgacagctctctgcaggagcaatttaacaaggacttgagtctaaaagaagctgaaacaattgctctttccatcttgaagcaagtgatggaagaaaaggtaactcctaataatgtggatattgcaaaggtggctcctact

SEQ ID NO: 1304 - DNA, 754 bp, Liriodendron tulipifera
  misc_feature (37)..(37): n is a, c, g, or t
  misc_feature (121)..(121): n is a, c, g, or t
  misc_feature (498)..(499): n is a, c, g, or t
  misc_feature (572)..(572): n is a, c, g, or t
cgtctaaatatggatcccgggctgcaggaatcggcgntctgcaattgcaggctttcagaccaatttcaagatgtttcttaccaggaccgagtacgatagaggcgtcaacaccttctctccnggaaggtcgattgtttcaggtcgagtacgccattgaagcgatcaagttgggttcgactgcgattgggttgaagacgaaggagggcgttgttcttgcagttgagaagcggattacttcgccattgctggagccaagcagtgtggagaaaattatggagattgacgagcatataggatgtgctatgagtggactcattgctgatgcacgcactcttgttgagcatgcacgtgttgaaactcagaaccataggttctcatatggcgaaccaatgaccgttgagtccacgacgcaagccctatgtgatcttgctctccgatttggtgaaggcgacgaagaatcaatgtcacgaccttttggtgtatcccttttgattgcgnnccacgatgagaatgggcctagcttatactacacagacccatctggtacattttggcaatgcaatgcaaaggcnataggttcgggctctgaaggagccgacagctcgttgcaggagcaatacaacaaggacataactcttcaagaagctgaaaccatagctctttccatcttgaagcaagcgatgcaagaaacagtgaccccgaacaacgttgatatcgtaaaggtggttccaacctaccatctctattccccggc

SEQ ID NO: 1305 - DNA, 1107 bp, Secale cereale
tcctcacgaggttagaatcgacccttctcagccaaaaatcttcaacgccccgacccgctgctggattccgcgcccgcggtgttgcccctgctgtgaaattttcatcttatttcgggataaattttgttatggggttgtttcgcgcaggacggagtacgaccgcggcgtgaacaccttctcgccggagggacggctgttccaggtcgagtatgccatcgaggccatcaagttaggatctactgcaatcgggttgaagacgaaggatggggttgttcttgctgtggagaaacgtgtgacgtctccattgctggaacctagcagtgtcgagaaaattatggaaattgatgagcacgtaggctgtgccatgagtggccttattgctgatgcaagaacattggttgagcatgctcgtgtggagacccaaaaccatagattctcatatggggaaccaatgacagttgagtccaccacacaagctatttgcgatctagctcttcgctttggagaaggtgaagaagagtctatgtcacgaccttttggagtttctctccttattgctggtcatgatgaaaatgggccgagcttgtactacactgacccatctggaaccttttggcagtgcaatgccaaggcacagaggagagggagagtgaagtctgggctgttatagagctgacctgcaggtggctgaaaccattgctctatctatcctgaaacaggttatggaagaaaaggtgactccaaataatgtcgacattgccaaggtcgcgccgaactaccacctttacacccctgcagaggtcgaagcagtcatagcacgattgtgaaacgcggaaatctttgtcaaatgtcaaccaggattcatatgttccttgtgctgtgtgtttgacatccggatgccttcaaatcagcagaagcacgattgctctatgatatggacactgatgtctgtctttttttcgtgattatattgtgttggcaaggtgtagaggcctaactgttgttgccttgtcacttgccggtaaggagattgtactacacccttttgtttgatacggagtacgaaggatttgtggcaatagcatgcagtatttcagcaaaaaaaaa

SEQ ID NO: 1306 - DNA, 1239 bp, Ceratodon purpureus
cacactcgcatcgcacactccccacgccatcgccatcgccaatttctccacatcctcgctgcgcgcccgccatgtttctcaccaggagtgagtatgacagaggtgtcaataccttctcgccggagggccggctgttccaagtggagtacgctattgaggctattaagcttggttccacggcggtggggttgaaaactaaggagggcgtggtcctggctgtagagaagcgaattacctcggttttattggagcccaccagcgttgagaagatcatggaaattgatgagcacattgggtgtgctatgagtggtctgactgcggatgctcgcacactagtagagcatggtcgtgttgaaacccagaatcacaggttctcttacaatgagcctatgactgtggagtctactacacaagccttgtgcgatttggctctgcgctttggggaaggcgatgaggaatctatgtcacgtccctttggagtctcactgcttatcgctggacatgatgagactggaccatgcctgtaccacacagatccatctggaacattttggcaatgtgatgccaaggcaatcggttcaggatcagaaggtgctgacacttctctgcaggaacacttcaacaagaacatgacgctggaggaggctgagactttggcactgtctaccttgaagcaagtcatggaagaaaaggtaacgtcttctaatgtggatattgctaaggtggctcccaagtaccatttgtacacacctgaagaagttgaggctgttattcagcgattgtaattatctgggtaaatcaaagcacaaaggtcttcagaagttaagtatgctgttcctttgacagcacttacattttctatatgcactcttttcagacactcgatcatcttttacctagatgcgaattgccacatcggtggcactattcagagttcaatctctgtggctagtgtggccccgatggtttgggcgccattgattggccagagtcaggcattggttttgagcatatccattaatttcaaattgagtgacttctgagactctacctttgagcatattcttttctaaagctctttctactcctaatgtgactcagatttgaaatatatgaacttcaagcggcgtttgtaatcttagtgatctgatccgattctcgtctattcctcaatgttccgtgatgaaagacattgttcagctgttgtatgttgaattttcttgcctcttacgaattaag

SEQ ID NO: 1307 - DNA, 937 bp, Nicotiana benthamiana
tggaattgggtgtgaagaactgagtacgatagaggtgttaacaccttctctcctgaaggccggttgtttcaagttgaatatgctattgaagccatcaagttgggttcaactgcagttggattaaagactaaggaaggagtcgttcttgctgtggagacgcgcattacttcacctcttctggagccaagcagtgtggagaaaattatggcaattgatgagcatattggttgtgcaatgagtggattgatagctgatgcacggactcttgtggaacatgcacgagttgaaactcagaaccatagattctcttatggcgagcccatgactgttgagtccactacacaagctctctgtgatttggccttgcggttcggtgagggcgatgaagaatctatgtccagaccttttggtgtgtcccttctcattgctggtcatgatgagaatggtcctagcttgtactacgctgatccttctggtacgttctggcaatgcaatgctaaagctatcgggtcaggttctgaagctgctgacagctctttgcaggagcaatataacaaggaccttacccttaaagagcctgaaaccatagccctgtctattcttgagcaagtgatggaagagaaggtgactcccaataatgttgatattgcaagggtatcttcaacttacaatctgtactcaccatctgaggtggaagaggttatcagccgcctataagaaagaatgctataacgctcgttgctgatatttttcttgtatgacaatgcttgcttgcccctggagttcttttattgtattttcccttcttccagggctggagattgattgagacagtattttctgtatgttcgttacattattggctcaaggatttaagagttttttggtccatcccttgttgcttaagaagtggaattggtttctgcatcctgaaaaa

SEQ ID NO: 1308 - DNA, 770 bp, Ambrosia trifida
atcgaatcgaataataataataaagagagttaacaggagaacaacagcaagaggcagacagaaagcaaaagaagaagaaagagagatctatttactagtctaatcgcgaagatgtttctaacgaggacggagtatgacagaggtgtgaacactttctctcctgaagggcggttgtttcaggtagagtatgcgattgaggcgattaagttaggttcgactgcgattgggctcaagaccaaggaaggcgttgttcttgctgttgaaaagcgtattacctccccactcttggaacccagtagtgttgagaaaattatggaaattgatgaacacattgggtgtgccatgagtggattaattgcagatgccagaacgctagttgaacatgcacgggttgagactcagaatcataggttttcctatggtgagccgatgactgttgagtcgaccacccaagctctgtgtgatctggctctgcgatttggtgaaggagatgaagaatccatgtctcgaccttttggggtatctcttcttattgcaggccatgatgaaaatggtcctagtctatactatacggatccatcaggcacattttggcaatgcaatgcaaaagctatagggtctgggtctgaaggtgctgacagctctctgcaggagcaatttaacaaggacttgagtctaaaagaagctagaaacaattgctctttccatcttgaagcaagtgatggaagaaaaggtaactcctaaataatgtaggatattgacaaaggtgg

SEQ ID NO: 1309 - DNA, 753 bp, Fraxinus spp
gtcatttcgagttatttacagcaaattctgaagctaataattaattgactcgaaaaatgttcctcacaaggactgagtatgatagaggagtcaacacttctctccgaaggccgatgtttcaagtagaatatgccattgaagctatcaagttgggttcaacagcaatgggttaaaactaagaaggggtggttcttgcagttgaaaagcgcattacctcgccacttctggagccttgcagcgttgagaaaattatggaaattgatgatcatatcggttgtgccatgagtggcttaattgctgatgcccgtactctggttgaacatgcacgagttgaaaactcagaatcataggttctcatatggtgagcccatgactgttgagtccactacacaagctctctgtggtctagccctgcgatttggtgagggtgatgaagaatctatgtctagaccttttggtgtatctcttctcattgctggtcatgatgagaatggacccagcttatactataccgatccttctggtactttctggcaatgcaatgcaaaagccattggatcaggatctgaaggtgctgacagttctttgcaggagcagtacaacaaggatcttaccctgaaagaagcagaaaccattgcgctttccatcctgaagcaagtgatggaagaaaaggttacacccaacaatgttgatattgccaaggtcgcaccaactaccatctgtactcgccttctgaggttgaagaggttatca

SEQ ID NO: 1310 - DNA, 1103 bp, Physcomitrella patens
accttgaacacacgcacagagtgcgggctctgatatttcactgttttgctcaactgtgccgatctgcgtcttcctcgcatcgccgaatccgtcaccatgtttcttaccaggagtgagtatgacagaggtgtcaatacgttctcgccggaggggcgtcttttccaagtggagtatgctattgaagctatcaagcttggttcaacggcagtaggattgaagaccaaggagggtgttgtcttggctgttgagaaacgaattacctcagttttactggaacccaccagtgtcgagaagatcatggaaatcgatgagcatattgggtgtgcgatgagcggactaactgcggatgctcgcacgcttgttgagcatgggcgtgtggaaacgcagaatcacagattctcctacaatgagccaatgagtgtagaatctactacacaagctctgtgcgatctggctttgcgctttggagaaggcgatgaagaatcaatgtcacgtcctttcggagtctcactgcttattgctggtcatgatgaaagtggaccatgcttgtatcacacagacccatctggaacattttggcaatgtgatgctaaggcaatcggttcaggatcagaaggtgccgacacttccctccaggagcacttcaacaagaatatgacgctggaggaagctgagactttggcactgtctaccttaaagcaagtcatggaagaaaaggtaacatcttctaatgtggacattgctaaggtggctcccaagtatcatttgtactcacccgaagaagttgaggctgttatacagcgattgtaatcatctgggtagatcaaaactcgaagtttcagaacttgaggatgcggttcttcggcagcacgtacatttcataagctcttattgcagactcttcaatcctaagattatctttcacttagattcaagcttctacgttcgtggaactgttcagagtgcagagctctgttacaggtggccatggctcggactccagtaattggttaaagttgggtattcattttgagtatatgtactaattcaaattgggtaactggagtccatttttgagaagaccgtttccagtgttctttcta

SEQ ID NO: 1311 - DNA, 1013 bp, Physcomitrella patens
ggggagagctacagacagctcaaagagagctttgagtgattgtagggttccgaggcacagattgctgcgacatagagagcgagagagagagctttctgcttcttcacttggccccaaaccttgctcatcttcatcagccaagcctccaccatgttcctcaccaggagtgagtatgatagaggtgtcaatacgttttctcccgaggggcgcctctttcaagtggagtacgccattgaagctattaagcttggttccacggcagtgggattgaagaccaaggagggagttgttttggccgtcgagaagcgaataacctcagttttgttggaacccaccagtgtcgagaagatcatggaaatcgatgaacatattgggtgtgccatgagtggtctcactgcggatgctcgcacacttgttgaacatggccgtgtggaaactcagaatcataggttctcgtataatgagcctatgagtgtggagtctactacacaagccctgtgtgatctggctttacgttttggggaaggcgacgaagaatcaatgtcacgtcctttcggagtttctctgctcattgctggccatgatgagagtggaccatgcttgtaccacacagatccatctggaacattttggcaatgtgatgctaaggcaattggttcaggatcagaaggtgccgatacttcccttcaggaacatttcaacaagaacatgacgctggaggaagccgagacattggcgttgtctaccttgaagcaagtcatggaagaaaaggtaacttcctgtaatgtggatattgctaaggtggctcccaagtatcatttgtacacacccgaagaagttgaggttgttatacaacgattgtaattatctgggtagttgaatactcgagaatgccgtttttcgattcatgagctatccattcaaatattggtttaattagtagcgaatgtgttcattttctatggtataacttgaaccttctgcactttttttaattaatttttttatggtct

SEQ ID NO: 1312 - DNA, 825 bp, Selaginella moellendorffii
cttgctctacctaggcgccagggcgatgtttctcaccaggagcgaatatgatcgcggcgtcaacaccttctcgccagagggccggctcttccaagtagaatacgccatagaagcaatcaagctcggatcgacagcggtgggtctcaaaacgaatcatggggtcgttcttgctgtcgagaagcggattacttcgccgctactggagcccgccagtgtggagaagatcatggagatcgatacgcacatagggtgtgctatgagcggcctcattgccgatgctcgcacgctggtggagcatgcacgaaacgaaactcagcatcatcgattctcatacaacgagccgatgagtgtggagagcacaactcaggctttgtgcgatttagctcttcgtttcggtgaaggcgatgaggaatccatgtctcgaccttttggtgtatctttgttgattgcgggacacgacgagaagggaccctgcttgtaccacacagatccatccgggacgttttggcagtgcgacgcgaaagccattggctcgggctcggagggtgcggacacatccttgcaagaaagctacaacaaagagatgacccttgaggaggcagagacgcttgctctatcgacgctgaagcaagttatggaagagaaggtaacggcttccaatgtggatatcgcgaaagtggctccagtctttcatctctatacaccagctgaagtggaggttgtcattggccgcttataaactttcagcagtgttgctcttcgttttttgcttgagggactaacttctattcagcccgagtaaatccaatgaaagttctttcttcg

SEQ ID NO: 1313 - DNA, 1015 bp, Cephalotaxus harringtonia
cctacagccaaggccctgccgaagccccttgccaattttcattaatacctgtcatttcctgtactatctgttatattttctgttttgggttattgcacaagaggaaaatatctcagagagcgccctttttttaaagctagaacaccatgtttctaaccaggagcgagtatgacagaggagtcaacactttttcgccggaaggccggttgtttcaggtcgaatacgcaatggaagccatcaagttgggttccactgcagtggggttgaaaacaactcatggagtgatacttgcagtagagaagcgcatcacctcgccgctactggagccaagcagcgtggagaaaatcatggagatcgatgaacatattggatgtgccatgagtggattgatagctgatgctcgcacgcttgttgaacatgcacgagttgaaacgcagaaccataggttttcttatggtgagcctatgagtgcggagtccacaacacaagctctgtgtgatctcgcacttcgttttggagaaggcgatgaggactcaatgtcacgaccatttggagtatctcttctgattgcaggccatgatgagaatgggccttgtttatactatacagacccttccggtacgttctggcaatctgatgcaaaatctataggatctggagttgaagcagcagacatttcattgaaggaacagtatcgtaaggatatgactttggaagaagcagagactgctgcgctttctattttgaagcaagtcatggaagataaggttacagccaataatgttgacattgcaaaagttgctcccacatatcatctatatactccagcagaagtggaggcagttataagtcgtctatgatgacttttctgctgcaatgattttggtagggacacaagtagtatttttggactatacttaatcttggaagtatttttatttgtcaaattttgcttttggtttattgttgaggccataacaatcaaaatatttattctggccaactttagccaaat

SEQ ID NO: 1314 - DNA, 1043 bp, Cryptomeria japonica
  misc_feature (6)..(6): n is a, c, g, or t
  misc_feature (163)..(163): n is a, c, g, or t
  misc_feature (1039)..(1039): n is a, c, g, or t
tgcagncgagactctgcttgttgtcaagtgcctctgggtttttacatcgaagagaattttttttcgtaatcacagagaaaacaccatgtttctgaccaggagcgagtatgacagaggagtcaacactttttcgccggaaggtcggctgtttcaggttgaatangccatggaagccatcaagttgggttctactgcagtgggtttaaagacaaatcatggtgtaatacttgcagtcgagaaacgcatcacctcgccgttactggagccaagcagtgtggagaaaatcatggagattgatgaacatattggatgtgcaatgagtggattgatagctgatgctcgcacacttgttgaacatgcacgagttgaaactcagaaccataggttctcttatggtgagcctatgagtgcagagtccacaactcaagcgttgtgtgatcttgcacttcgttttggagaaggcgatgaagactctatgtcacgaccatttggagtatctcttctgattgcaggtcatgatgagaatgggccttgtttatattatacagacccttcaggtacattttggcaatctgatgcaaaatctatcggatctggagttgaagccgcagacatttccttgaaggaacagtacagtaaggatatgacattggaagaagcggagactgctgcactttctattttgaagcaagtgatggaagataaggtgacagccaataatgtggacattgcaaaagttgcacccacttatcatctatatactcctgcagaagtggaggcagtcataagtcgcctatgattacatttctgctacaatgattttgtagggacaggaggagcattttcggacagtacttaatcttggaactatgttttatttacatctttgctttttgagtttattggtgaagtcattacaatcaagaaaattattctggtcaaatttagccaagtatttattttttctcatcaaatctgatgtaaggtgagaagttccaagacagctttcacatatattcaataaaactaataccgtttnagtc

SEQ ID NO: 1315 - DNA, 1267 bp, Pinus pinaster
attggggaagggtgtcgaagaggtcattaacttgatacaaaagtgctataacaactttccttcgcgcacactccaatatattttctgtcatttgagtgttttgggcttcccttcttagcttagcgcaacaacgaaaggccctgcaactacagatttctgtacaacaattcatcatcatgtttctcaccaggagtgagtatgacagaggagtcaacaccttttctcccgaggggcggctcttccaggtcgaatacgccatggaagcaatcaagcttggttctactgcagtggggttgaaaacaaagcggggaatcatattggcagtggagaagcgtatcacatcgcctttgctggagccaagcagtgtggagaaaattatggagattgacgaacatgttggttgtgctatgagtggattgatagctgatgctcggacacttgtggaacatgcacgtgttgaaactcagaaccataggttctcctatggtgagcctatgagcactgagtcaacaacgcaagctttgtgtgatcttgcgcttcgatttggagaaggtgatgaagattctatgtcacgacctttcggagtatctcttctaattgcagggcatgatgagaatgggccttgtttatactatacagacccttctggtacattttggcaatgtgatgcaaaatccataggatctggagttgaagcagcagatattgccttgaaggaacaatatagtaaggatatgacattggaagaagcagagactcttgcactttctattttgaagcaagtcatggaagataaggtaactgccaataatgttgacattgcaagtgtggctcccacataccatctctataccccagctgaggtggaggctgttataagtcgcttatgagtaatttctactgcaatgcttttgtagagagttgaggcacttttttgggccatgctcaattctgggaagtatttttttcattgcacgctagttttttatttgccattcaagacattgcagttgattgaaactaatctctgggcgagtgagttaaaattttacttttactccagatccacgaggagaatatttttaaccgtcaccatccatattaaaatatcgtaaaatgaagtttcattttcctttctcatatttggagcttgtatgtatttgttatggttaaacatgtccttcaaaattgtgcatctgtgctagcatggactaaccataggaaatgcctctttttggtaaatagaagggttctaaatttttgtact

SEQ ID NO: 1316 - DNA, 1478 bp, Pinus taeda
cggccggggaagggtgtcgaagaggtcattaacttgatacaaaagtgctataacaactttccttcgcgcacactccaatatattttctgtcatttgagtgttttgggctttccttcttagcttcagcgcaacaacgaaaggccctgcaactacagatttctgtacaacaattcatcatcatgtttctcaccaggagcgagtatgacagaggagtcaacaccttttctcccgaggggcggctcttccaggtcgaatacgccatggaagcaatcaagcttggttctactgcagtggggttgaaaacaaagcggggaatcatattggcagtggagaagcgtatcacatcgcctttgctggagccaagcagtgtagagaaaattatggagattgacgaacatgttggttgtgctatgagtggattgatagctgatgctcggacacttgtggaacatgcacgtgttgaaactcagaaccataggttctcctatggtgagcctatgagcactgagtcaacaacgcaagctttgtgtgatcttgcacttcgatttggagaaggtgatgaagattctatgtcacgacctttcggagtatctcttctaattgcagggcatgatgagaatgggccttgtttatactatacagacccttctggtacattttggcaatgtgatgcaaaatccataggatctggagttgaagcagccgatattgccttgaaggaacaatatagtaaggatatgacattggaagaagcagagactcttgcactttctattttgaagcaagtcatggaagataaggtaactgccaataatgttgacattgcaagtgtggctcccacataccatctctataccccagcagaggtggaggctgttataagtcgcttatgagtaatttctactgcaatgcttttgtagagagttgaggcacttttttaggccatgctcaattctggaagtatttttttcattgcacgctagttttttatttgccattcaagacattgcagttgattgaaactaatctctgggcgagtgagttaaaattttacttttactccagatccacaaggagaatatttttaaccgtcaccatccatattaaaatatcgtaaaatgatgtttcattttcctttctcaggagcttatatgtatctgttatggttaaacatgtccttcaaaaatgtgcatctgtgctagcgtggactaaccataggaaaggcctcttttttggaaatagaagtaaaagggttcaaatttttgattaacaaatctcagttgaataattgggatggtatgcttcttactaaagtcctcacaagcttcttcaagtgatatttttgtggcttaagctgacagttgcatttagcagggcataagtttcgtttctaatttttacttgtattgtggaaaatcagaaaatcagctaatgtttgctttatcagcaatcaacaaagtactttcagaataaaaaat

SEQ ID NO: 1317 - DNA, 925 bp, Podocarpus macrophillus
tttttctcgctttggtgttttggtttccgcagtcagtttattacaatgtttctaaccaggagcgagtatgacagaggtgttaacaccttctcccctgagggccgtctgttccaggtcgagtacgccatggaagccattaagctgggttccactgcagtgggcctgaaaaccaatcacggagtcatacttgcagtggagaagcgcatcacctcgccactactggagccaagtagcgttgagaaaattatggagatagatgaacatattggatgtgccatgagtggtttgatagctgatgcccgcacacttgttgaacatgcacgcgttgaaactcagaaccataggttctcttatggtgagcctatgagcgcagagtcgacaacacaagctctgtgcgatcttgcacttcgttttggagaaggggatgaagattctatgtcacgaccttttggagtatctcttcttattgcaggccatgacgagaatggaccttgcttatactatacagacccttctggtaccttttggcaatctgatgcaaaatctataggatctggagttgaagctgcagacattgctttgaaggaacagtatcacaaggaaatgacgttggaagaagcagaaactgttgcactttctattttgaagcaagtcatggaagataaggtgacagccaataatgttgacattgcaaaagtggctccgacataccatttatatactcctgcagaggtggaggcagttataaatcgcctatgaatacgcttctgtaatgacgcttctgtaatgatttttatgtggacatgaggtgcatttttggaccgtggagttataaactattgcatcatactttttgtttgaatccataataatttaaaaatttaatttgaccacatttgtctagatattcaatttctattgaaac

SEQ ID NO: 1318 - DNA, 773 bp, Solanum tuberosum
caacactccaaatacgctatttctgcagaaatggcttgtcactcaagttaaaaacaagtagaacaaatcgattctcagtcagttcttagctttcgcggattctcaaagctgtgacgaatcagatcgaagatgtttctcactagaactgagtatgatagaggtgtcaacactttctctcctgaaggaaggttgtttcaagttgaatatgctattgaagccattaagttgggttcaacggcaattgggataaagaccaaggaaggagttgttcttgctgttgagaagcgaattacctctccacttctggagccaagcagtgtggagaaaattatggaaattgatgagcatattggatgtgcaatgagtggattgatagctgatgcaaggactctcgttgaacatgcacgagttgaaactcagaatcacagattctcttatggcgagcccatgactgttgagtccacaacacaagctctatgtgatttggccctgcgatttggtgagggtgatgaagagtctatgtccagaccttttggagtatcacttctcattgctggtcatgatgagaatggtcctagcttatactatactgatccttctggcactttctggcaatgcaacgcaaaagccattggttcaggttcagaaggtgctgacagctctcttcaggagcaattcaacaaggaccttaccctcaaggaggccgaaaccatagcgctgtcaattctaaagcaagtgatggaagaaaaggtgactccaaataacgttgatat

SEQ ID NO: 1319 - DNA, 952 bp, Sequoia sempervirens
tcgaagagattttttttcgtaaatcgcagagaaaacaccatgtttctaaccaggagcgagtatgacagaggagtcaacactttttcgccggaagggcggctgtttcaggtcgaatacgccatggaagccatcaagttgggttccactgcagtgggtttaaagacaaatcatggtgtaatacttgcagtcgagaagcgcattacctcaccgttactggagccaagcagtgtggagaaaatcatggagattgatgaacatattggatgtgcaatgagcgggttgatagctgatgctcgcacacttgttgaacatgcacgagttgaaactcagaaccataggttctcttatggtgagcccatgagtgcagagtccacaactcaagctttgtgtgatcttgcacttcgttttggagaaggcgatgaagactctatgtcacgaccatttggagtatctcttctgattgcaggtcatgatgagaatgggccttgcttatactatacagacccttctggtacattttggcaatctgatgcaaaatctataggatctggagttgaagccgcagacatttccttgaaggaacagtaccgtaaggatatgacattggaagaagcggagactgctgcactttctattttgaagcaagtcatggaagataaggtgacagccaataatgtggacattgcaaaagttgcacccacttatcatctatatactccagcagaagtggaggcagttataagtcgcctatgattacatttctgctaaaatgattttgtagggacatgaggagcattttcggaccatggttaattacatctttgcttttaatttattggtgaagtcattacaatcaagaaaattgttctggtcaaatttagccaaatatttattttttctcatcaaatcttatgtaaggtgagaagttcctagacggctttcacatatattc

SEQ ID NO: 1320 - DNA, 1500 bp, Picea glauca
gtaaaagcgttgcaaaagagatcattaaattaaatacaaaagtgcaatcacgactttacttcgcgcacactccatatattttctggcattcgagcgttttgggttttacttcttagctttagcgcaagaacagaaggccctgcaactacaaatttctgtacaacaaatacaacattatgtttctcaccaggagcgagtatgacagaggagtcaacaccttttctccggaagggcggctcttccaggtcgaatacgccatggaagcaatcaagcttggttccactgcagtggggttaaaaacaaagcggggaatcatactggcagtggagaagcgtatcacatcacctttgctggagccaagcagcgtagaaaaaattatggagattgacgaacatgttggttgtgctatgagtggattgatagctgatgctcggacacttgtggaacatgcacgcgttgaaactcagaaccataggttctcctatggcgagcctatgagcactgagtccacaacgcaagctttgtgtgatcttgcacttcgatttggagaaggtgatgaagattctatgtcacgaccgtttggagtatctcttctaattgcagggcatgatgagaatgggccttgtttatactatacagacccttctggtacattctggcaatgtgatgcaaaatctataggatctggagttgaagcagcagatattgccttaaaagaacaatatcgtaaggatatgacattggaagaagcagagactcttgcactttctattttgaagcaagtcatggaagataaggtaaccgccaataatgttgacattgcaagtgtggctcccacataccatctctataccccagcagaggtggaggccgttataaaccgcttataagtaatttttatgagcaatttctactgcaatgattttgtagacagttgaggcgcttttttgggccatgctcaattctgggaagttttttttcattgcacgttagatttttgtttttctttcaaggcattgcaattgaaggaaaccaatctctgggcgagtgagccaaaattttacttttactccagatccacaaggagaatatttttaacagtcatcatccatatataaattacggtaaaatgattatcattttccttttctcatatttggatgttgtatatctttgtcatggttaaacatgtccttcaaaattgggcatctgtgctagcatggactatccttaggaaatgtctttttttggaaatagaagtaaaagggctcaaaaatttgattagcaaatctcagttgaatatttgggatgatatgcttcttaattcagtccttagaagcttctgcaagtgatatttatgcggcttaagcttaagcttacaattgcatttagcagggtataagtttcgtttccaatttttacttgtattgtggaggtagaatctcattcataaaattccttaatgttagttatatcaacaatccataaaattactttcag

SEQ ID NO: 1321 - DNA, 1149 bp, Taxus baccata
tcaattttttgcctttcataaaacataaatattattttgcacaaaacttcgatccaaactgcccattctgcacagctctataaacttgctacccaagaaaatgtttataatgaatttctaacgcaactccgaagaaaaattaaaacacatcccaacacttctctgtatttcttctccatactattttcctttgttattcagtgttctgggcttttgtacaccatgtttctaaccaggagcgagtatgacagaggggttaacactttctcgccggaaggccgattgtttcaggtcgaatatgccatggaagccatcaagctgggttccacggcagtggggttaaaaacaactcatggagtgatacttgcagtagagaagcgcatcacctcgccgctactggagccaagcagtgtggagaaaatcatggagatcgatgaacatattggatgtgccatgagtggattgatagctgacgctcgcacgcttgttgaacacgcacgagttgaaactcagaaccataggttttcatatggtgaacctatgagtgcagagtccacaacacaagctctatgtgatcttgcacttcgttttggagaaggcgacgaagactctatgtcgcgtccgtttggagtatctcttctgattgcaggccatgatgagaacgggccttgtttatactatacagacccttccggtacattctggcaatctgatgcaaaatctataggatcaggagttgaagcagcagatatttcgctgaaggaacagtatcgcaaggatatgactttggaagaagcagagactgccgcactttctattttgaagcaagtcatggaagataaggtgacggccaataatgttgacattgcaaaagtggctcccacgtatcatctatatactccagcagaagtagaggcagttataagtcgcctatgattacatttctgctgcaatgaattttgtagggacacaagctgcatttttggaccatacttatcttgaaactatttttatttgcacattttcttttggttaattgtcgagaagccattacaatcaaaataatttaatctgggcaactttagccaaatatgcatttttctcgaacctgtgaaaggtcgacagtattttacatacaaacaatttcgc

SEQ ID NO: 1322 - DNA, 648 bp, Flaveria ramosissima
caatcgaagatgtttctaaccaggaccgagtatgataggggtgtcaacaccttctctcctgaaggccgtttgtttcaggttgaatatgctattgaggccatcaagttgggttctacagccatcggattgaagaccaaggaaggggttgttcttgctgttgaaaagcgtatcacctcgccactcctcgaacctagtagtgttgagaaaattatggaaattgatgagcacattggctgtgccatgagtggattaattgcagatgcccgtacgctcgttgaacatgcacgagttgagactcagaatcatagattttcctatggtgagccaatgactgtcgagtccactacccaagccctgtgtgatcttgcactgcgatttggtgaaggagatgaagaatctatgtctcgaccatttggggtatctcttcttatcgcaggccatgatgaaaatggtccaagtctatactacacggatccatcaggtacattttggcaatgcaatgcaaaagctataggctctggttctgaaggcgcggacagttctctgcaggagcaatttaacaaggatttgactctaaaagaagctgaaacagttgctctttccatcttgaagcaagtcatggaagaaaaggtgactcccaataatgtg

SEQ ID NO: 1323 - DNA, 1184 bp, Pseudotsuga menziesii
aagtccaatcgctactttccttcgcggacaatccatatatatattttctgtcattcgagtgtgtagggttttacttcatagcttagcacaacaacgaaagttctgcaactacaaatctctgtacaacaaatacaacaacatgtttctcaccaggagcgagtatgacagaggagtcaacaccttttctccggaagggcgtctcttccaggtcgaatacgccatggaagcaatcaagcttggttccactgcagtggggttgaaaacaaagcggggaatcatactggcagtggagaaacgtatcacatcgcctttgctggagccaagcagtgtagagaaaattatggagattgacgaacatattggttgtgctatgagtggattgatagctgatgctcggacacttgtggaacatgcacgcgttgaaactcagaaccataggttctcatatggtgagcctatgagcactgagtccacaacgcaagctttgtgtgatcttgcacttcgatttggagaaggtgatgaagattctatgtcacgacctttcggagtctctcttctaattgcagggcatgacgagaatggaccttgtttatactatacagacccttctggtacattctggcaatgtgatgcaaaagctataggatctggagttgaagcagcagatattgccttgaaagaccaataccgtaaggatatgacattggaagaagcagagactctagcactttctattttgaagcaagtcatggaagataaggtgaccgccaataatgttgatattgcaagtgtggctcccacataccatctctatacccctgcagaggtggaggctgttataaaccgattatgagtgatttctactgcaatgattttgtaaggagttgagcgctattttgagccatgctcaattctgggaagtatttttccattgcacgctagttttttgtttttcattcaagacattgcatttgaaggaaactaatctgggcgaatgagcccaaattttacttttattccagatccataaggataatattttaacaaccatcatccaaatataaattacggtaaaatgatcatttcctttttctcatttttggatgttgtatgtctttgccatggttaaacatcttcttcaaaaattgggtgtgtgctacatggactcctaaataaatatcaca

SEQ ID NO: 1324 - DNA, 1123 bp, Pteridium aquilinum
cgtcttcgtcttcgtgagctttcaagatgtttctcaccagaagcgagtatgacagaggagtaaacactttctcgccagaggggcgcctctttcaagttgaatatgccatcgaagcaatcaagcttggttcgactgcggtgggtttaaagacaaaagagggagtggtgttggctgtcgaaaaacgcatcacatcaacacttctggagccaaccagcgttgagaaaataatggagatagactctcatgtttgggtgtgccatgagtggtttaacagcagatgccaggacgctagtggaacacgcacgggtagagactcagaatcacaggttttcttacaatgaaccaatgggagtggagtccatgactcaagctttatgcgaccttgcattacgttttggagagggtgacgatgaatccatgtcacgaccttttggagtttcactgcttattgctggctacgatgagcacggaccttgtttgtatcacactgatccatctggtacattttggcaatgcaatgggaaggcaataggatcaggttcagaaggggctgatacatctcttcaagagcattatacaaaggagatgacgttggaagaagctgagacacttgctttgtcaaccttgaaacaagttatggaggagaaggtaactccttccaatgttgatattgcaaaagtggcacccacatatcatctgtattcgccgagtgaggttgaagcagtgattgccaggctatgaccgaattttgcagagctctagcttgagtaactagttgcacatttttggcatgaaaggatacacttttgaaagatatgctgtttaatttatacaagttcgcaagccttctaatgaacatccattacctttaggctgtgaaactcagtggggcattgagctcaatatgtttgtggtgcaactgagtaaagtaactttctacaggttggttattgtgcattgtatgatcaaccttcaaacctcctctgatgttgaaacttcatgctgctgtttttgcgcttctttgtagcacatctttgaggtttatatatttttaaggtagggtgatacttgtgcatgacaatatgaatcagaataggagtcttatcactttttgaaaaaagaa

SEQ ID NO: 1325 - DNA, 1528 bp, Marchantia polymorpha
gctgctgctgccctcgagctttgtcgtcctccgtgcaattggagtgcagggcgactcgcctcgcgcgcattgtcgacctcgtaggttgcgtttcttggagaaagaagcttcgtgcattttgtgcctggcagatgtgttttaggggtttaggggtgctgtgtcttgattgcgagtgagtgagacctgggactgaaaggaagagagaaagagagaggaggatttttcgatttctccacctccgcagggttctggaaaattgcgcgtcggacgtctgtcaggcccggctgcccgtccggtgttggagctttgtgagcagcgagcgagcgagttagccagccagcatgtttcttacgaggagtgagtatgaccgaggagtcaacaccttctcgccggaagggcgtttgttccaggtcgagtatgctatcgaggctatcaagctgggctccactgccgtaggcttgaagaccaagtttggcgttatattggcagtggagaagcgaattacctcgactctgctcgagcccagcagtgtcgataagattatggaaattgactcgcatatcgggtgcgctgccagtgggcttacagccgatgccccgactttagtggagcatgggcgtgtcgaaactcagaaccatagattctcttacaacgagcccatgagcgttgaatccaccactcaagctctttgtgacctagctctgcgcttcggtgagggagacgaagattccatgtcgagaccattcggagtttcacttctcatagccggtcacgatgagactggtccctgtctgtatattacggatccatccgggacgttctgggagtgtgatgctaaagccatcggatccggatcggagggtgctgattcgtcacttcaggaacactacaacaaggaaatgactttggaggaagctgaattgctggctttatctacactcaagcaggttatggaggaaaaggtcactgcttctaatgtggacattgcgaaagttgcccctacgtatcacctgtacactcccgctgaggttgaggctgtaattgggcggttgtaggttttgttattaaggtcaaattcccgaatcatcaaaactggaggatcggggacacatttcagaacatagcgatttgaggttgcagacgagggtatttttcacagcacagcaccagttttgtaaagtggccgatcaatgctctctctcgcattgcgctttcggtgacattgaactgaacatgctcctaaagttagaaggccattttgggtcacagaaagttcatgtcatgaagtgtcagatagatggcttctgctggcagcaaataaataggttgagatacctagccgatgatcaggggatgaagtcatgtagagtgtccacagtctggcaggaacattgaaagattcttctaacggtcctcaggggtatcgttgaaattgctgactatcatttccattttgcacctctagcaaaccttgttggaatagaacaaatcaaaattgtcaaatttgtcgttagaatcaaaaaaaaaa

SEQ ID NO: 1326 - DNA, 1029 bp, Sciadopitys verticillata
attttttgggtttctccattcaatacagcagagaggaaaaaggggcttgtaactgtacactgacgaatacaccatgtttctaaccaggagcgagtatgacagaggagttaacaccttctctccagaaggccggcttttccaggtcgaatacgccatggaagccattaaattgggttccactgcagtggggctgaaaacaaaactcggagtcatacttgctgtagagaagcgcatcacctcgtctctactggagccaagcagtgtagagaaaatcatggagattgatgaacatattggatgtgctatgagtggattaatagctgatgctcgtacgcttgttgaacatgctcgcgtcgaaactcagaaccataggttctcctatggtgagcctatgagtgcagagtccacaacacaagctctttgtgatcttgcacttcgttttggagaaggcgatgaagattctatgtcacgaccttttggagtatctcttctgattgcaggctatgatgagaatgggccttgtttgtactatacagatccttctgggacattctggcaatctgatgcaaaatctataggatctggggttgaagcagcagacattgccttgaaagaacagtataacaaggatatgacgttggaagaagcagagactgcagcactttctattttgaagcaagtcatggaagataaggtgacagccaataatgttgacattgctaaagtagctcccacatatcatctatatagtccagcagaggtggaggcagttataaatcgcctatgattacatttctgttgcaatgattttgtagggaagtgaggtgcatttttggaccattcttaatcttggaagaatttatatttgcacatttgctttagatttatttttggagttgttacaattaaaataattttatatggccaagtttagccaaatatgaatttttctcattgaacttgtgtaaggagaagagatgaagtccccattaatacctatttatctaaaaacaaagctgttttccatgc

SEQ ID NO: 1327 - DNA, 944 bp, Abies balsamea
ctcagctagcaccacaacggaaagccctgtaactacaaatctctgtacaacaaatacaacatcatgtttctcaccaggagcgagtatgacagaggagtcaacaccttttccccggaagggcggctcttccaggtcgaatacgccatggaagcaatcaagcttggttccactgcagtggggttgaaaacaaagcatggaatcatactggcagtggagaagcgcattacatcgcctttgctggagccaagcagtgtagagaaaattatggagattgatgaacatattggttgtgctatgagtggattgatagctgatgctcgaacacttgtggaacatgcacgcgttgaaactcagaaccataggttctcatatggtgagcctatgagcactgagtctacaacgcaagctttgtgtgatcttgcacttcgatttggagaaggtgatgaagattctatgtctcgacctttcggagtatctcttctaattgcagggcatgatgagaacgggccttgtttatactatacagacccttctggtacattctggcaatgtgatgcaaaatctataggatccggagttgaagcagcagatattgccttaaaagaatcataccgtaaggatatgacattggaagaagcagagagtcttgcactttctattttgaagcaagtaatggaagataaggtgaccgccaataatgttgacattgcaaaagtggctcccacataccatctctacaccccagaagaggtggaggccgttataaaccgcttatgagtaattactactgccatgatttcgtagagagttgaggcgcttttttgtgccatgctcaattctggaaactattttttcattgcacgacagcttttggtttgtcattcaagacattgcaattgaaggaaacaaatgtgggcaagtgagccaaatgtgtacttctaccc

SEQ ID NO: 1328 - DNA, 1110 bp, Cedrus atlantica
tgcagctctcacgaaatcttttccaacatagaaactctcactactttccttcgcgcacactccatatatacatatcccttttgtcatttgagtgtttcggcttttacttgtcagctgagcgcaacaacacagagcactgcagctacaaatctgtgtcaacaaataaaacaccatgtttctcaccaggagcgagtatgacagaggagtcaacaccttttccccggaagggcggctcttccaggtcgaatacgccatggaagcaatcaagcttggttctactgcagtggggttgaaaacaaagcggggaatcatactagcagtggagaagcgcatcacatcgcctttgctggagccaagcagtgtagagaaaattatggagattgacgaacatattggttgtgctatgagtggattgatagctgatgctcggacacttgtggaacatgcacgtgtggaaactcagaaccataggttttcctatggcgagcctatgagcactgagtccacaacacaagctttgtgtgatcttgcacttcgatttggagaaggtgatgaagattctatgtcacggccttttggagtatctcttttaattgcagggcatgatgagaatgggccttgtttatactatacagacccttctggtacattctggcaatgcgatgcaaaatctataggatctggagttgaagcagcagatattgccttaaaagaacaataccgtaaggatatggcattggaagaagcagagactcttgcactttctattttgaagcaagtcatggaagataaggtgactgccaataatgttgacattgcaagtgtggctcccacataccatctctataccccagaagaggtggaggctgttataaaccgattatgagtaatttcgactgcaatgattttttagatggttgaggtgcttttttgggccatgctcaattctgagaagtattttttcattgcacgatagtttttaattgaaggaaacaaatctgggcaaatgagctaaacatgtacttctactgcagatacgtaaggggaattatttttaacagtcatcatccaaatataaaatatggtaaaatgatggtcattttacatttc

SEQ ID NO: 1329 - DNA, 834 bp, Raphanus sativus
ttccaagtcgagtatgccattgaagctattaagctgggttctactgcaattggagtcaagacaaaagagggagttgtgcttgctgtcgagaagcgtatcacctcccctttactggagccgagcagtgtggagaagattatggaaattgatgaccatattggctgtgccatgagcggcttaattgctgatgcccgcacacttgttgagcatgcaagagttgagactcaaaaccacagattctcgtatggcgagccaatgactgtagagtccactacccaagcgctgtgtgatctcgctttacggtttggtgaaggagatgaagaatcaatgtctcggccgtttggagtctcccttctcattgctggtcatgatgaaaatggaccgagcttgtactacacggatccgtctggaacgttctggcagtgcaatgcaaaggcgattggttcaggatcagaaggagctgatagctctcttcaagagcaattcaacaaagatctgtcacttgatgaagctgagacgatcgctgtatctatcctcaagcaagttatggaagaaaaggtgactccaaacaatgtggacattgccaaggtagctccagcttaccatctctacactccgcaggaagttgaagcagtcattagtcgtctttgagggagatctctcaatacgggtgatgtatctaatcacctttgcgtctacttcgaatcttgtcaccaagtggctttctttcactttgtctgttagagaaactgatgtttcatgagacagtttagtctctgttgtgtaagagaatctttcagtacctttctcggattataaaacttcaactattat

SEQ ID NO: 1330 - DNA, 651 bp, Camellia sinensis
gatagaggtgtcaataccttctctcccgaaggtcgattgtttcaggttgaatatgccatcgaggccattaagctgggttcgacagcaattgggttgaagactaaggaaggagttgtgcttgctgttgagaagcgtatcacttcaccgctcctggagcccagcagtgtggagaaaattatggaaatcgatgagcatattggatgcgcaatgagtgggttaactgctgatgctcgcactcttgttgaacatgcacgagttgaaactcaaaattataggttctcgtatggtgaacccatgactgttgagtctactacgcaagctctgcgtgatttggccctgcgatttggtgaaggggatgaagaatctatgtctcgaccatttggagtatctcttctcattgctggacatgatgagaatggacctagcttatactacacagatccgtctggcacgtgctggcaatgcaatgctaaagctaccggatcaggttctgaaggtgctgacagctctctacaggagcagtataacaaggacattacactcaaagaagcagaaacgattgctctttccatcttgaagcaagttatggaagaaaaggtgaccccgaataatgttgacattgcaaaggttgctccgacttaccatctgtac

SEQ ID NO: 1331 - DNA, 903 bp, Nicotiana benthamiana
cggcacgagcaacaaacagtcgcttcttagctactaaggatttgtttttctaaagctgtaataaatcagatcaaagagtttctcacgagaactgagtatgatagaggtgtgaacacattctctcctgaagaagatgtttcaagttgaatatgctattgaagccattaagttgggatcgacggcaattgggataaagactaaggaaggcgttgttcttgctgttgagaagcgaattacctctccacttctggagccaagcagtgtggagaaaattatggaaattgatgagcatattggctgtgcgatgagtggattgatagctgatgcaaggactcttgttgaacatgcacgagttgaaactcagaaccacagattttcttatggcgagcccatgactgttgagtccacaacacaagctctgtgtgatttggccctgcgatttggggagggtgatgaagagtctatgtccagaccttttggtgtatcacttctcattgctggccatgatgagaatggtccgagcttatattatactgatccttctggcactttctggcaatgcaatgcaaaagccattggttcaggttcagaaggtgctgacagctctttgcaggagcaattcaacaaggacctcagcctaaaggaggctgaaacgattgcactgtcaattttaaagcaagtgatggaagagaaggtgactcccaataacgttgatattgcgagggtatctccaacttatcatctctactcgccttctgaggtggaaactgttatcagccgcctataagaagaaagctctcttgttacgcttgttagccattttttctattatgggcaatgtttacttcccaactgttttagaatttgtggattgtattgcccctcctagcatgttaaattgca

SEQ ID NO: 1332 - DNA, 1083 bp, Gnetum gnemon
caatcggagtactcttgaggatcacacttggaggaggcttttaaaagattcctattcggaggcttgtgatagagatttttgtagcgcaaagcagaaaccacttgttcaattttcagtgttgaaatatctgaaaaaacagaatgttccttaccaggagtgaatatgaccgaggagtcaataccttctctccagaaggaagactgttccaggttgaatatgcaatggaggcaataaagcttggttcaacagcagtggggttgaaaacacagaagggtgtgatacttgcagttgaaaagcgcattacttctcccttattggagccaagtagcgtagaaaaaataatggagatagatgcacatattggatgtgcaatgagtggattgatagcagatgcacgaacactagttgaacatgcccgtgttgaaacacagaatcataagttttcatatggtgaacctatgagcaccgagtcgacgacacaggctctatgtgatcttgctttgcgttttggtgaaggcgatgaggactctatgtcgcgaccttttggggtttctcttttgatagctggatatgacgaaaaggggccttgtctattctatacagatccatctggaaccttttggcaatgtgatgcaaaagctattggttctggtgttgaagctgcagacatagcgctaaaagaacagtaccataaggacatggcacttgaggaggctgagacactggcactaagcattttgaaacaggtcatggaagacaaggtgactcctaataatgttgatatagcatgcgttgccccaacatatcatctttacggtcttgcagaggtggaggcagtaataaatcggctataaactgctttttgaagcagggattttatttattagattgtaaaacttttgattcaccatatcctaattagtgagacataactctactaattattcgtgaaacaaatttgagtgaaatactccagataatgagtttcaaagttcagtacagtgtgcaggatctttgatcctgaatgttgtggcagttaatgccctaagctattctctggtagtcagtaactttgaaattttc

SEQ ID NO: 1333 - DNA, 972 bp, Saccharum officinarum
caagaagctcagaacagaagccatcaaaagcgaggctgcgagagggaagcgagcgagcgagcgagcgagagagagagagagagggcgagggggaggcgccaaagccgagttcttgctcgatcccgcatccgccgccgtcgccgacaggatgtttctcacgaggacggagtacgaccgcggggtgaacaccttctcgccggaggggcggctgttccaggtcgagtacgccatcgaggccatcaagttgggatccactgcgatcgggttgaagacaaaggatggtgttgtcctcgctgttgagaaacgtgtgacctcgccactgctggaaccaagcagtgtggaaaaaatcatggaaattgatgagcacataggctgtgccatgagtggacttattgctgatgctagaacactagtcgagcatgctcgtgttgaaactcagaatcataggttctcgtacggggagccaatgaccgtagaatcttcgacacaggctatctgtgacttagctctgcgctttggtgaaggtgacgaagagtcaatgtcacggccatttggagtctctctcctaattgctggacatgatgagaatggacctagcctgtactacactgacccatctggtactttttggcaatgcaacgcaaaggcaattggatcaggctctgagggagctgatagctccttgcaggagcagtacaacaaggaattgaccctcgaggaggcagagaccatagccctttctatcctgaagcaggttatggaagagaaggtgaccccaaacaacgtcgatataggaaaggttgcccccaagtaccacctctacacccctgccgaggtcgaagccgtcatcgcgaggctggaaaacacttctgagctcttgctattcacgtcatcagtcgggaatagacggtcctaccaagcgtggacatcttggttcttgattatggctgtcggcgtactctgttgttaact

SEQ ID NO: 1334 - DNA, 756 bp, Glycyrrhiza uralensis
aagcaatcgcaaataagcaaaagcaaaagcctatctctgctcgctcgctcgctcttcctcttcccacacaaaccaaccacagtgaaggagcaaactcagtcccagcagcgccttttcgtgatctcatcgaatcgaatcgaagatgtttctcacaaggactgagtatgaccgaggagtcaacaccttttctcccgaaggccgtttgtttcaggttgaatatgcaatcgaggccatcaagctgggatccaccgcaattgggttgaagaccaaagagggtgttgtccttgcagttgaaaagcgtatcacttcgccactgctggagcctagcagtgtggagaaaattatggaaattgatgaccacataggttgtgcaatgagtggattgattgctgatgctcgaacacttgttgagcatgctcgggtggaaactcagaatcataggttctcttatggtgaaccgatgactgttgagtccacaacccaagctctttgtgatctagccttgcgttttggtgaaggtgatgaagaatccatgtctcgaccttttggagtgtctctcctcattgctggccatgatgagaatggacctagtttatactacactgatccttctggcacattttggcaatgcaatgcaaaagctattggttcaggatcagaaggtgctgacagttctctgcaagaacaatacaacaaggagttaactcttcaagaagccgagactattgctttatccattctgaagcaagttatgga

SEQ ID NO: 1335 - DNA, 751 bp, Papaver somniferum
attaagcttggatcaactgcaattgggttaaagactaaagaaggagtagttcttgctgtggagaagcgtatcacttcaccattgctggagcctagtagtgtggagaaaattatggaaatcgatgagcatataggttgcgcaatgagtggactgattgctgatgctcgtacacttgttgaacatgcacgagtcgaaactcagaatcacaagttctcatatggtgagccaatgactgttgaatccacaacacaagctttatgtgatcttgccctacgatttggtgaaggcgaagaagagtccatgtctcggccttttggtgtatcacttctcattgctggtcacgacgaaaatgggccaagcctatactacacagacccgtcaggcacattttggcagtgtaatgcaaaagcaatcggatcaggttctgagggggcagacagctctctgcaagagcagttcaacaaggagatgacactccaagaagccgaaactgctgctctttcgatcttgaagcaagtgatggaagagaaggtgactcccaacaatgttgacattgcaaaggtcgctccaaagtaccatttgtattctccttctgaggtggaggctgtcatcgctcgcctatagaaagcaaacccttgatcatttctcttcggcaaggttttcctgtcttacttcccgccgccttcatgtaatgactttgtcaggagctaaacttcactgtgatctggttttccctgtcttatttcccacc

SEQ ID NO: 1336 - DNA, 893 bp, Raphanus sativus
  misc_feature (541)..(541): n is a, c, g, or t
  misc_feature (768)..(768): n is a, c, g, or t
gacaaacttgtaaaagcatcccagtttcttcgattttgtccgatcaatcagagctgggtgtacagatcgaagaagaagaagaaggaagatgtttctcactaggacggagtatgacagaggagtcaacactttttctcctgaaggcaggttattccaagtcgagtatgccattgaagctattaagctgggttctaccgcaattggagtcaagacaaaagagggagttgtgcttgctgtcgagaagcgtatcacctcccctttgctggagccgagcagtgtggagaagattatggaaattgatgaccatattggctgtgccatgagcggcttaattgctgatgcccgcacacttgttgagcatgcaagagttgagactcaaaaccacagattctcgtatggcgagccaatgactgtagagtccactacccaagcgctgtgtgatctcgctttacggtttggtgaaggagatgaagaatcaatgtctcggccgtttggagtctcccttctcattgctggtcatgatgaaaatggaccgagcttntactacacggatccgtctggaacgttctggcagtgcaatgcaaaggcgattggttcaggatcagaaggagctgatagctctcttcaagagcaattcaacaaagatctgtcacttgatgaagctgagacgatcgctgtatctatcctcaagcaagttatggaagaaaagtgactccaaacaatgtggacattgccaaggtagctccagcttaccatctctacactccncaggaagttgagcagtcattagtcgtctttgaggagactctctcaatacggtgatgcatctaatcacctttgcgtctacttcgaatcttgtcaccaagtggctttctttcactttggctgttaga

SEQ ID NO: 1337 - DNA, 780 bp, Raphanus sativus
  misc_feature (68)..(68): n is a, c, g, or t
gggttcaagaagtgaacctctacgacaaacttgtaaaagcatcccagtttcttcgattttgtccgatnaatcagagctgggtgtacagatcgaagaagaagaaggaagatgtttctcactaggacggagtatgacagaggagtcaacactttttctcctgaaggcaggttattccaagtcgagtatgccattgaagctattaagctgggttctactgcaattggagtaaagacaaaagagggagttgtgcttgctgtcgagaagcgtatcacctcccctttactggagccgagcagtgtggagaagattatggaaattgatgaccatattggctgtgccatgagcggcttaattgctgatgcccgcacacttgttgagcatgctagagttgagactcaaaaccacagattctcgtatggcgagccaatgactgtagagtccactacccaagcgctgtgtgatctggcattacggtttggtgaaggagatgaagaatcaatgtctcggccgtttggagtctcccttctcattgctggtcatgatgaaaatggaccgagcttgtactacacggatccgtctggaacgttctggcagtgcaatgcaaaagcgattggttcgggatcagaaggagctgatagttctcttcaagagcaatttaacaaagatctgtcacttgatgaagctgagacgatcgctgtatctatcctcaagcaagttatggaagaaaagtgactccaaataatgtggacattgcgaaagtagctccagcgtaccatctct

SEQ ID NO: 1338 - DNA, 872 bp, Raphanus sativus
  misc_feature (71)..(71): n is a, c, g, or t
  misc_feature (585)..(585): n is a, c, g, or t
gccattgaagctatcaagctgggttctactgcaattggagtaaagacaaaagagggagttgtgcttgctgncgagaagcgtatcacctcccctttactggagccgagcagtgtggagaagattatggaaattgatgaccatattggctgtgccatgagcggcttaattgctgatgcccgcacacttgttgagcatgccagagttgagactcaaaaccacagattctcgtatggcgagccaatgactgtagagtccacaacccaagcgctgtgtgatctcgctttacggtttggtgaaggagatgaagaatcaatgtctcggccgtttggagtctcccttctcattgctggtcatgatgaaaatggaccgagcttgtactacacggatccgtctggaacgttctggcagtgcaatgcaaaagcgattggttcaggatcagaaggagctgatagttctcttcaagagcaattcaacaaagatctgtcacttgatgaagctgagacgatcgctgtatctatcctcaagcaagttatggaagaaaaggtgactccaaataatgtggacattgccaaggtagctccagcntaccatctctacactccacaggaagttgaagcagtcattagtcgtctttgagggagactctctcaatacgggtgatgcatctaatccgctttgcgtctacttcgaatcttgacaccaagtggctttctttcattttgtctgttagagagactgatgtttcatgagacagtttagtctctgttgtgtaagagaatctttcagtacctttctcggattataaaacttcaactattatctcatatcataaagacacaaaagtacaaccaagttttgataaaatacaaacc

SEQ ID NO: 1339 - DNA, 721 bp, Cyamopsis tetragonoloba
  misc_feature (611)..(611): n is a, c, g, or t
  misc_feature (658)..(661): n is a, c, g, or t
  misc_feature (689)..(689): n is a, c, g, or t
  misc_feature (697)..(699): n is a, c, g, or t
  misc_feature (713)..(713): n is a, c, g, or t
gagagcccttttgtgatttcgttgaatcggattcgagatgtttctcacaaggaccgagtatgaccgaggagtcaacaccttttctcccgaaggccgtttgtttcaggttgaatatgcaatcgaggccattaagctgggatcaactgcaattgggttgaagaccaaagagggtgttgtccttgcagttgagaagcgtatcacttcgccgttgctggagcctagcagcgtggagaaaattatggaaattgatgagcatataggttgtgccatgagtggattgattgccgatgctcgtacacttgttgagcatgcacgagtggaaacgcagaatcataggttttcctatggtgaaccgatgacggtagagtccacaacccaagccctttgtgatctagccttgcgttttggtgaaggtgatgaagaatccatgtctcgaccatttggagtttcccttcttattgccggtcatgatgagaatggaccttgtttatattacactgatccatctggcacattttggcaatgcaatgcaaaagctattggttcagggtcagaaggtgctgacagctctctgcaagagcaatataacaaggacctaactcttcaagaanctgagactattgctttatccattctgaagcaagttatgggaagagannnncactcccaacaatgttgacattgcgaangtgtctcnnnatatcatctttatncccccgct

SEQ ID NO: 1340 - DNA, 803 bp, Papaver somniferum
attaagcttggatcaactgcaattgggttaaagactaaagaaggagtagttcttgctgtggagaagcgtatcacttcaccattgctggagcctagtagtgtggagaaaattatggaaatcgatgagcatataggttgcgcaatgagtggactgattgctgatgctcgtacacttgttgaacatgcacgagtcgaaactcagaatcacaagttctcatatggtgagccaatgactgttgaatccacaacacaagctttatgtgatcttgccctacgatttggtgaaggcgaagaagagtccatgtctcggccttttggtgtatcacttctcattgctggtcatgacgaaaatgggccaagcctatactacacagacccgtctggcacattttggcagtgtaatgcaaaagcaataggatcaggttctgagggagcagacagctctttgcaggagcaattcaacaaggagatgagactccaagaagccgaaacagttgctctttcgatcttgaagcaagtgatggaagagaaggtgactcccaacaatgttgacattgcaaaggttgctccaaagtaccatttgtattctccttctgaggtggaggctgtcatcgctcgtttatagaaagaaaacccttaatcattctcttcggcaaggttttcctgtctttacttcccaccgccttcaagggatgacttcgttaggagataaactttggtattcttttaaattactttggtattcttgatcatgagtgtcagattttacaatcacttggttgacatgaaaacattggaagttaa

SEQ ID NO: 1341 - DNA, 857 bp, Linum usitatissimum
gaagccatcaagcttgggtctactgcaattggatgaagacgaaggaaggagttgtgcttgcagttgagaagcgtatcacttcaccactcctggagccaagtagtgttgagaaagtgatggagatagatcagcatatagggtgtgctatgagtggactaattgcagatgctcgtactcttgttgagcatgctcgtgttgagactcagagtcatagattttcatatggcgagccaatgactgtggagtctacaacacaggctctatgtgatctggccctaagatttggtgaaggcgatgaagagtctatgtctcgaccctttggggtgtcgcttctcattgctggtcatgatgagaatggtcctagcttgtactatacggatccatctggcacattttggcaatgcaacgccaaggctattggttcaggttctgaaggtgcagatagctctctgcaagagcaatacaacaaggaccttactcttctggaagctgaaaccatagcactttcgattctaaagcaagttatggaggaaaaggtaacaccgaacaatgtcgacatagcgaaagtgtctccgacttaccatttgtacactccagcagaggtggaagctgtcatcggtcgcctgtgatgagacttaaggcttaaatgtttccctctatgttggacgttagataatgtattcctaagctttcttcttctttcctcaactgttggggaggaagggaccgaattcatcagcggtgtttgctagttgagcaagttgatgtttgtcaaggattctggtcttttccttagttcgaatattacattctgcgaattgggaagggtagttattgaccagtaatgaccttttgag

SEQ ID NO: 1342 - DNA, 797 bp, Gerbera hybrid cultivar
ctgggctcgacagcgattggattgaagaccaaggagggcgttgttcttgctgtggagaagcgaattacctcaccacttctggagcctagcagtgttgagaaaataatggaaatcgatgagcatattggttgtgccatgagtgggttaatagctgatgcccgtacacttgttgaacatgcacgggttgagacgcagaatcataggttttcctatggggagccgatgaccgttgagtcaaccacacaagcactgtgtgatctggccctgcgatttggtgaaggggatgaggaatccatgtctcgaccttttggggtatctcttcttattgctggacatgatgaaaatggaccaagtttatactatacagatccttcaggcacattttggcaatgcaatgggaaagctataggttcaggttctgaaggcgccgatagctctctgcaggagcaatataacaaggacttgacacttaaagaagctgaaacaatagctctttctattttgaaacaagttatggaagaaaaggtaactcccaataatgtggacattgcaaaggttgctccgacttatcacttgtacacgccggctgaggttgaggctgttattaatcgcctataaatcgggacttgtgtagacaagctatcaaaattctgtttgggttaccattgttgctatgcctacatgcattttgtacttgattgctgagattatgtcctgttttcttttaaataatgtatttcaaaccagaccctttttgtgttgaaccaatcatgaaattgaagaacatcatcggttct

SEQ ID NO: 1343 - DNA, 853 bp, Distylium racemosum
gaggagtctaacactttttctccggaaggccggctgtttcaggtggaatatgccatggaagccatcaagttgggttctactgcagtgggattgaaaacaaatcatggagtcatacttgcagtggagaagcgcatcacgtcgccgttactggaaccaagcagtgtggagaaaatcatggagatagatgaacatattggatgtgccatgagtggattgatagccgatgctcgcacgcttgtcgagcatgcacgtgttgaaactcagaaccataggttttcttatggtgagcctatgagtgcagaatctacaacacaagctctgtgtgatcttgcccttcgttttggagaaggcgatgaagactctatgtcgcgaccctttggagtatctcttctgattgcaggtcatgatgagaaaggaccttgtttatattatacagacccttctggtacattctggcaatctgatgcaaaatctataggctctggagttgaagcagcagacattgccttgaaagaacagtatcgtaaggatatgacattggaagaagcagagactgctgcactttctattttgaagcaagtcatggaagataaggtaacagccaataatgttgacattgcaaaagtggcacctacgtatcacctctatacaccagcagaggtggaggcagttataaatcgcctatgataagatttctgatgcaatgattttgtagggacatgaggttcaactcttttcttagaagagaacttcacaagaaagacaacatggatttactatctatttcatatcaatttcacaatattttaaagaattttatagaagagaatgagctaaacttgccatgaatgaa

SEQ ID NO: 1344 - DNA, 1372 bp, Eragrostis curvula
aacgccaaccttcttcccttaaagcgagcctggggcgagaaggcgacgcagtcctctagcttcgattccgcatcccctccgcggccaaggccaagatgtttctcacgaggactgagtacgaccggggagtgaacaccttctcgccggaggggcggctgttccaggtcgagtacgccatcgaggccatcaagttgggatcgactgctatcggtttgaagacaaaagatggtgttgtcctcgctgttgagaaacgtgtgacctcgccactgctggaaccaagcagtgtggagaaaatcatggaaatcgatgagcacttaggctgtgccatgagtgggcttatcgctgatgctagaacactagtggagcatgctcgtgttgagactcataatcatagattttcgtatggagagccaatgacagtagaatctgccacacaagctatttgtgacttggctctgcgctttggcgaaggcgatgaagaatcaatgtcacggccgtttggagtctctctccttattgctggtcatgatgagaatggacctaacttgtactacactgacccgtctgggaccttttggctatgcaatgcgaaggcgattggatcggttctgaaggagctgacagctcattgcaggaacagtacaacaaggaaactgaccctccaggaggcacaaaccatagccctttcgatcttgaatcaggttatggataaaaaggtgaccccaaacaatgttcatatcgcgaagggcgcccccaactaaccacctctacactccctccgaggtcaaaactgttattgcaaggctgtgaaactgtgtcaatctctttatttccatgatccagcgttgtatgaaaaatgaaaactgtgatggggtgttgtctgcctattgttgccgatgcgctatccatgtttcttttaatataagataaaagctgggttagggcttcctgcccccgaaagctctattcacactctaatccatttgttttgtttttcttaatgttatagaacttgaactaaccctaaaagagacttcttttttgtttttactatatacacaaaaaaaaatattttaattaaataaaaatatttcttggtcttgattcctccctgtgtattccctttgtttaattttaccggctccctctgtcacttccaacccgtaaatgaaaaaacttccccacacaaatcatattcaattaaaccttcgactctttttttaaattttcgccatccccaaaatcagacctgggtgagaaatacattataggtctccatgttgcttgattttcttcccgtggtgctatgaaatttattgtgttttacattccccccccgcctatacaaatttttttcaacccccaacctaac

SEQ ID NO: 1345 - DNA, 924 bp, Vaccinium corymbosum
cacaaggtcgattgtttcagttcatatgccattgagcaattaagctggttccactgcaatttgggttgaagaccaaggaaggcgttgttcttgctgttgagaagcgtatcacttctccgactctggagcccagtcagttgtggagaaattatggaaattgatgatcatattggctgtgcaatgagtggctgattgctgatgctcgtactctcgttgaacatgcccgagttgaaactcaaaatcacaggttctcctatggtgagcccatgactgttgagtctactacgcaagctctatgtgacttggccttgcgatttggtgaaggggatgaagaatctatgtctcgaccatttggagtatctcttctgattgctggccatgatgagaatggacctagcctatactacacagatccatctggcactttctggcaatgcaatgcaaaagctattggttcaggttctgaaggtgctgacagctctttacaggagcaatataacaaggacataacacttaaagaagccgaaacagtagctctctccatcttgaagcaagttatggaagaaaaggtgacacccaataatgttgacattgcaaaggttgctccgacttaccatttgtataccccttctgaggtggaggctgtaataagtcgcctttgagaagaaaatccccttgttatctcccatttgttggttgggcgtttagttacagttatggatgcgtatgatttaaatcgctttgttgggtgcttcttgtattggactctttgataaggcaatcgtttttgttttgttacacaatcacgtacttggatgtaataacttctttcaacatcttgaaccaaaatcttcgaggtttgtggcttcttgttacggaagcataaaaggcaggcgagctaggcagtggatacagaattgaaac

SEQ ID NO: 1346 - DNA, 788 bp, Papaver somniferum
tggatcaactgcaattgggttaaggactaaagaaggagtagttcttgctgtggagaagcgtatcacttcaccattgctggagcctagtagtgtggagaaaattatggaaatcgatgagcatataggttgcgcaatgagtggactgattgctgatgctcgtacacttgttgaacatgcacgagtcgaaactcagaatcacaagttctcatatggtgagccaatgactgttgaatccacaacacaagctttatgtgatcttgccctacgatttggtgaaggcgaagaagagtccatgtctcggccttttggtgtatcacttctcattgctggtcacgacgaaaatgggccaagcctatactacacagacccgtccggcacattttggcagtgtaatgcaaaagcaattggatcgggttctgagggggcgagatagctctttgcaggagcagttcaacaaggagatgacactccaagaagccgaaactgctgctctttcgatcttgaagcaagtgatggaagagaaggtgactcccaacaatgttgacattgcaaaggtcgctccaaagtaccatttgtattctccctctgaggtggaggctgtcatagctcgcctatagaaagaaaatcattctcttcggcaaggttttcctgtcttacttcccgccgccttcatgtaatgacttcgtcagtagctaaacttcactgtgatctggttttccctgtcttatttcccaccgccttcaagtaatgacttcgttaggagataaacttcattgtgatctggtttt

SEQ ID NO: 1347 - DNA, 2377 bp, Hordeum vulgare
cgaaacgcgctctctgtgctagaaagttgcggccccaccaacaagtcgcactttccaagcttcctcccactcaggcagtcttccggaaggccccgattgactgatcccctcgtcgccggccgccgcccccagcgtttctcgccggcgggcatggcgatggagctgagcatggccctggcggcgccgccggggggcgggctgctggccccgccccctcccgccccgcccggcaaggagcagcaggtggcgggggtggggatcctgctgcagatctccatgctcgtgctctcctttgtgctcggccacgtcctccgccgccaccgcttctactacctccccgaggccagcgcttcgctcctcatcggactagttgttggtgggcttgctaatatttcgaacacagagaccaacactaggacatggttcaacttccatgaagaattcttcttcttgttcttattacctcctataatattccaatcaggattcagcttatccccaaaaccattctttgccaactttggggctattgttacttttgccattcttgggacattcatcgcttccatcgtaactgggatgcttgtctatcttggtggactcacatttctaatgtataaacttccactggttgaatgtcttatgtttggtgctcttatatccgcgactgatcctgtcacagtattatcaatattccaggaactgggaagtgatgttaacttgtatgctctggtgttcggcgaatctgttttaaacgatgcgatggcaatttctctttacaggacaatgtcatcagtcaggagtaatgcagcaggaggcgagaacatttttatgatgattctacagttccttgagatctttgttggttcaatgtcatcaggtgtcggagttggatttatctcttctcttctattcaaatacgcgggattggatattgacaatcttcagaacttggagtgctgcctttttgttctcttcccatacttctcgtatatgttagcggaaggacttggcttgtcaggaattgtttctatactattcacagggatggttatgaagcactatacgtactctaacctgtcagataactcgcagcgctttgtttccgccttttttcacttgctatcatctttggctgaaacatttgtcttcatttatatgggctttgatatcgccatggaagaacatagctggtcacacgttgggttcatcatcttctcgattatatttataattgttgcaagggcagcaaatgtcttttcttgtgcctacttggttaatatatcacggccagaacatcggcgtatacctctaaatcaccagaaggctctttgtttcagtgggcttagaggagccatggcttttgcgcttgctctccaatctgtgcatgaacttcctgaaggacatggaaagacgatattaacagctaccacagccattgtcgttttaacggttcttcttattggagggtcgacaggcaccatgttagaagctttggatgtaattggtgatgaaaatacatcaatagaaacttacgaggataacaatggttacattcccccaacttatgaggaaggcacatcgtctggaggaggattgagaatgaaactcaaggagttccacaaaagcacaacatcgttcaccgcccttgacaagaactatctaactccatttttcaccagtcagactgatgatgatgctgatgatttcggtgatcagccccaaaaccagagacaagggttctatgaccaatagcagagtttgagcacgactagctatacacggtgccaagtgccaatggacctaacgatatcgtagaacgtgggatccagattggagccattaaacgatataaacacacacctttgccctagttgagtagcatatggcagagcatactgtaggatagattcataagcctgatcaggacagcatgcctcctgtatatatttacaaggctcagatggtgcatggtggggctccagctgaaacggcaaagctctgcggcggactttgttgacccaaagccgctgccttacaccagatcatttgtttccaacagctcagcgctgatcattgccaactgcgttggctcggaaaacccttgttgtgaagtgaacgtaccgcgtgagccgaacattactgtgatgtatgtactccagatttccagtgaaatctgaaatcattagggccataattacgctgtcacggaaatgcctgtcgtgaagtgacagtgtattgaaaggtaagctcgtcttgcctctgtggttcctgatgtatgtttgccgttgtcttttgttgtgcgaactgatatctgctgtgccgttgtcatgttcttagagctttcgactttgtatgttcctgatgtatgtttgct

SEQ ID NO: 1348 - DNA, 2571 bp, Sorghum bicolor
gacaaaacacatcaaatttgcagcccgttctttcttcgagaccgatgactttttcctttctggttggttcgaacaagacaagcacgaaagcttgccgaacaatcgaatcaaagcatcgaacagcagcaacaacaacatgacattctagcacgaagcaccgggcgttgtacgcatcctcggcgtccaggaatcgcgggcccaccactgcccgcatttccttcccccgaagccgagccgtccgcgaagcgaaccacccggccaccccgcgctacctcctccgactccgagcgaattcttcacgagaccccggacttccttctagaacctcctccgcccccgcccaatcccttgaccgggccacgcccgagcgagactactagggggttccggcgccgccgtcgggggtgatggcgctggagctgcgcctggcctcggcttcgccgccggcgggcggcggcttggcgcagccgccgcccctcgccccgccagggaaggagcagcaggtggccggcgtggggattctgctgcagatctccatgctcgtgctctccttcgtcctcggccacgtcctgcgccgccaccgcttctactacctccccgaggccagcgcctcgctcctcatcggcttagttgttggtggcctggctaatatttcaaatacagagaccaacacaaggacgtggttcaacttccatgaagagttcttcttcttgttcttattacctccgataatattccagtcgggattcagcttatctccgaaaccattctttgcaaactttggggctatcgtaacttttgcaattcttgggacattcattgcttctgttgtgacaggagttcttgtctatcttggtgggctgacatttctaatgtacaagcttccactggttgaatgccttatgtttggtgctctcatatctgcaactgaccctgtcacagtgctatcaatattccaggaactgggctctgatgttaacttgtatgctttggtgtttggagaatctgttttgaatgatgcgatggcaatttctctttacagaacaatgtcatcagtcagaagtcatgcagcaggtggcgagaatctttttatgatgattctccaatttcttgaaacctttgttggttcaatgtcatcaggtgtgggagttggatttatctctgctcttctattcaaatatgctggattggacgttgacaatctgcagaacttggagtgctgcctttttgttctctttccatacttttcgtacatgttagctgaaggactcggcttgtcagggattgtttctatattatttacggggatggttatgaagcattacacatattccaatctgtcagacaactcacaacgctttgtttccgcctttttccatttactgtcatctttagctgaaacatttgtgttcatttatatgggattcgatattgccatggaagagcatagctggtcacatgttggcttcatcttcttctcaattatattcatagttgttgcaagggctgcaaatgtcttttcttgtgcatacttggttaacatgtctcggccacaacatcggcgtatacctctaaagcatcaaaaagcactctggttcagcggtcttagaggggccatggcttttgcacttgctctccaatctgtgcatgaacttcctgaaggacatggaaaaacgatattcaccactaccacagccattgttgttttgacggtacttctcattggagggtcgacagggactatgcttgaagctttggatgttgttggagatgaaaacacatcaatagaaaattacgaggacaacaatggttatatgcctccaagttatgaagaaggtacatcatctgggggaggattgagaatgaaactcaaacaattccacaaaagcacgacatcattcactgcccttgacaagaactatctcactccattcttcaccagtcaaacagacgacgatgacgatgacttcaccggtcagcaaccccaaaaccgaaggctcgcattttatgatcaatagtagaatttgatactctacatatcaagctaaatacacggagcagaactgacgtgcatgacagcgtgtgtgatttggttgaacaaaatatagcaggagcatacgtagttgagtagcatatggcagagcatatctgtatactgtaggacagaaatcataaggctcgaatcagttgttccccttggggatgaggatgatgatagccaggcagcatgtatatatttctaggccgacttgggaatttcgtggggctccagatgaaaagcagagtgttgttagaactttgtctggttattatagaccttaccttgagtaaggttgattgtaataaaccagatcattgttcaatatgtcggctattatgcgcttgttctaaagtgacgcgttgcaccagttgtctcactggctggttgcgtactataataatggtcccatggttgattatgaagattctccacagcactgaaagcaaatatcatcccaggtcaggaaagtacgttgatgtttattattccgacgttacgtttactcctattttaagaaagtactccctcta

SEQ ID NO: 1349 - DNA, 2366 bp, Setaria italica
tgcccgcccgcagcacgaagcaccagcgttgcacgcatcctcctccgcgtccaggaatcccgggcccagcacgcaccccgtcgcctccccttcgccgagccgccccgcccgcgccacctccgatccttctcccctccccttcccctcccctcctttctagaacctcctcctcctcctcctccgccccccgaccttgaccggaccgcgcccgcgcgagtctagtgggggcttccggcgccgccggcgggggtgaagatggcgctggagctgagcctggcctcggcctcggcctcgccgccggcgggctggctagcgccgccgccgcccctggccccgcccgggaaggagcagcaggtggccggcgtggggattctgctgcagatctccatgctcgtgctctccttcgtgctgggccacgtcctccgacgccaccgcttctactacctccccgaggccagcgcctcgctcctcatcggtctagttgttggtggccttgctaatatttcaaatacagagaccaacactaggacgtggttcaacttccatgaagaattcttcttcttgttcttattacctccgataatatttcaatcaggattcagcttatctccgaaaccattctttgcgaactttggggctattgtaactttcgccattcttgggacgttcattgcttctgttgtaacaggggttcttgtctatcttggtgggctgacatttctaatgtataaacttccactggttgaatgccttatgttcggtgcccttatatctgcaaccgatcctgtcacagtgctatcaatattccaggaactgggctctgatgttaacttgtatgctttggtgtttggagaatctgttttgaatgacgcgatggcaatttccctttacaggacaatgtcatcagtcagaagtcatgcagcagctggcgagaacttttttatgatgattctccagtttcttgagacctttgttggttcaatgtcatcaggtgtgggagttggatttatctctgctcttctgttcaagtatgctggattggacgttgacaatctgcagaatttggaatgctgcctttttgttctctttccatatttctcgtatatgttagctgaaggacttggcttgtcagggattgtttctatattattcacggggatggttatgaagcattacacattctccaatctttcagacaattcgcagcgctttgtttctgccttcttccacttactgtcatctttggctgagacatttgtgttcatttacatgggctttgatattgccatggaagagcacagctggtcacatgttggcttcatcttcttctcaattatattcatagttgttgcaagggctgtaaatgtcttttcttgtgcatacttggttaacatgtctcggccagaacatcgccgtatacctctaaagcatcagaaagcactttggtttagcgggcttagaggggccatggcttttgcccttgctctccaatctgtgcatgaacttcctgaaggacatggaaaaacgatattcactactactacagccattgttgtgttgacggtacttcttattggagggtcgacgggaactatgctagaagctttggatgttgttggagatgaaaacacatcaatagaaaattatgaggacaacaatggttacatgcctccgacttatgaagaaggtacatcgtctggtggaggattgagaatgaaactgaaacagtttcacaaaagcacgacatcattcactgcccttgacaagaactacctgactccatttttcaccagtcaaactgatgatgatgacgacgacttcagtgagcaaccccaaaaccgaagagtacgattttatgatcaatagcagaatttgagattctacttatcaagctaaatacacggagcagaactggcatgaatgattgcatgtgccattcggttgaaccaaatataggatcatacttagttgggtagcatctgtataccgtaggacagaaatcaaaaggctcaaatcaactcttcctctggggatgaggattgccaggccacatgtatatatatatctgtattctgtaggcctctttgagatgatggtggagctccagatgagaagcagagtattgttggaactttggttatagcccttaccattaggttaattgtaataagcccccagacattctcactatttactatgtccgctgggagcctgggaagcgtttgttgtaacttgtaagtggcagattggagcagcagtctcactctggtgttgaagttctaaactggacaatgtgggagtacgaaaatatctttcagctaaaagtgagatagcccagtctataaacactgacgtagtttgaacac

SEQ ID NO: 1350 - DNA, 2289 bp, Zea mays
gttcttctggaccgatgactttttctggttggttccaagttccaacatgacaggcacgaaggcaagtcgagcagacagcaacatctagcacgaagcaccggccttgtacgcatcctcccttcgcatcgaggaatcgcgggcccaccgcggcaccaaggccccccgcattccgtcccgccgcggcgtcgctcccttgttctctcccgagccgtccgcgaaccaacccgtgctacctccgattcttcgcctcgtcgttctttctagaacctccgctccgcctaatcccgaacgagactagggaggttccagcgccgccggtgggggagatggcgctggagctgagcctggcctcggcttcgccgccggcgggcggcggcttggcgcagccgccgcccctcgccccacccgggaaggagcagcaagtggccggcgtggggattctactgcagatctccatgctcgtgctctcgttcgtcctcggccacgtcctgcgccgccaccgcttctactacctccccgaggccagcgcctcgcttctaattggcttagttgttggtggcctcgctaatatttcaaatacagagaccaacacaaggacgtggttcaacttccatgaagagttcttcttcttgttcttattacctccgataatattccagtcgggtttcagcttatctccgaaaccattctttgcaaactttggggctatcgtaacttttgcaattcttgggacattcattgcttctgttgtaacaggagttcttgtctatcttggtgggctgacatttctaatgtacaaacttccactggttgaatgccttatgtttggtgctcttatatctgcaactgatcctgtcacagtgctatcaatattccaggaactgggttctgatgttaacttgtatgctttggtgtttggagaatctgttttgaatgatgcgatggcaatttctctttacaggacaatgtcatcagtcagaagtcatgcagcaggcggcgagaacttttttatgatgattctccaatttctcgaaacctttgttggttcaatgtcatcaggtgtgggagttggatttatctctgctcttctattcaaatatgctggattggacgttgataatctgcagaacttggagtgctgcctttttgttctctttccttacttttcgtacatgttagcagaaggacttggcttgtcagggattgtttctatattattcacagggatggttatgaagcattacacatattccaatctttcagacaactcacagcgctttgtttctgccttttttcatttactatcatctttagctgaaacatttgtgttcatctatatgggtttcgatattgccatggaagagcatagctggtcacatgttggcttcatcttcttctcaattatattcatagttgttgcaagggctgcaaatgtcttttcttgtgcatacttggttaacatgtctcggccagaacatcgccgtatacctgtaaaacatcaaaaagcactttggttcagtggtcttagaggggccatggcttttgcacttgctctccaatctgtgcatgaacttcctgaaggacatggaaaaacgatattcaccaccaccactgccattgttgttttgacggtacttctcattggagggtcgacaggaactatgcttgaatctttggatgttgttggagatgaaaacacatcaagagaaaattacgaggacaacaatggttacatgcctccaagttatgaagaaggaacatcctctggaggaggattgagaatgaaactcaaacagtttcacaaaagcacaacatcattcactgcccttgacaagaactatctcactccattttttaccagtcagacagatgatgataacgatgacgacttcagtcagcaaccccaaaaccgaaggctagctttttatgatcaatagcggaatttgatactctacatatcaagctaaatacacggagcagaactgacgtgcatgactgtctatgtgtgatttggtcgaacaaaatatagcaggagcatacttagttgagtagcatatggcagagcatatctgtataccgtaggacaaaaatcataagggttcgaatcagttgttcccatgggggacgaggatgatgatagccaggcagcatgtatatatttctaggcttccttaagaacttagtggggctccagatgaaaagcagtgtgttgttggaattttatagaccctaccttgtgttaggttaaattttaataaacccgaccgtttgtccgctaagtcggctatt

SEQ ID NO: 1351 - DNA, 2132 bp, Triticum aestivum
tggcaggggtggggatcctgctgcagatctccatgctcgtgctctccttcgtgctcggccacgtcctccgccgccacagggtctactacctccccgaggccagcgcttcgctcctcatcggactagttgttggtgggcttgctaatatttcaaacacagagaccaacactaggacatggttcaacttccatgaagaattcttcttcttgttcttattacctcctataatattccaatcaggattcagcttatccccaaaaccattctttgccaactttggggctattgtaacttttgccattcttgggacattcatcgcttccatcgtaacagggatgcttgtctatcttggtggactcacatttctaatgtataaacttccattggttgaatgtcttatgtttggcgctcttatatccgcgactgatcctgtcacggtattatcaatattccaggaactgggaagtgatgttaacttgtatgctctggtgttcggcgaatctgttttaaacgatgcgatggcaatttctctttacagaacaatgtcatcagtcaggagtaatgcagcaggaggcgagaacatttttatgatgattctacagttccttgagatctttgttggttcaatgtcatcaggtgtcggagttggatttatctctgctcttctatttaaatatgcgggattggatattgacaatcttcagaacttggagtgctgcctttttgttctcttcccatacttctcgtatatgttagcagaaggacttggcttgtcaggaattgtttctatactattcacagggatggttatgaagcactatacgtactctaatctgtcagataactcgcagcgctttgtttccgccttttttcacttgctgtcatctttggctgaaacatttgtcttcatttatatgggctttgatattgccatggaagaacatagttggtcacacgttgggttcatcatcttctcgattatattcataattgttgcaagggcagcaaatgtcttttcttgtgcctacttggttaatatatcacgtccagaacatcggcgtatacctctaaatcaccagaaagctctttgttttagtgggcttagaggagccatggcttttgcgcttgctctccaatctgtgcatgaacttcctgaaggacatggaaagacgatattaacagctaccacagccattgtcgttttgacggttcttcttattggagggtcgacaggcaccatgttagaagctttggatgtgattggtgatgaaaatacatcaatagaaacttacgaggataataacaatggttacattcccccaacttatgaggaaggtacatcgtctggaggagggttgagaatgaaactcaaggagttccacaaaagcacaacatcgttcaccgcccttgacaagaactatctaactccatttttcaccagtcagactgatgatgatgctgatgattttggtgatcaaccccaaaaccagagacgaggattctatgatcaatagcagagtttgggcatgactagctatacacggtgccaagtgccaatggacttaacgatatcgtagaacgtgggatccagattggaaccatcaaacgatataaacatacacctttgcctttgttgagtaacatatatggcagagcatattgtaggatagaaatcataagcctgatcaggacagcatgcctcctgtatatatttacaaggctcaaatggtacatggtggggccccagttgaaaaggcaaagttctgtgacgaactttgttgacccaagcccttgtcttacaccagatcatttgtttccaacagctcatcgctgatcactgccaactgcattggctcggaaaacccttgttgtgaagtgaacgtaccacggttaaacattactgtgatgtattccagtgaaatctaaaactgttaggggcataattaagctgtcacggaaatgcctgtcataaagtgacaatgcattgaaagataagcccgtcttacctctgtggttcctgatgtatgtttgcggttgtctgttgttgtgcaaactgatatctgctgtgtcgctgtcatgttcttagagctttcgactccgtatgttcctgctgtcatgttcttagagctttc

SEQ ID NO: 1352 - DNA, 2415 bp, Oryza sativa
aaaaaagccgaagaactaaaattctccacccacctgaaaaaaaaaaaaattctccgcccgaaatcgcgaccccaccaaagtccaaaccccgcattccccccacgctttcccccccgcgagccttctggaagaagcacgcatcgattgaccgcgaccgacctcgccgccggcgaccgtacggattccgcccctccccgccgcggcggcggcaccaccggggcgcgcgcgccgggatggcgctggagctgagcctggtgtccgcttcgccccctggtgggctggcggcgagcccgcccccgcccgccgccatcccggggaaggagcagcaggtggccggggtggggatcctgctgcagatctccatgctcgtgctctccttcgtgctcggccacgtcctccgccgccaccggttctactacctccccgaggccagcgcgtctctcctcatcggtctagttgtcggtgggcttgctaatatttcaaatacagagaccaacactaggatgtggttcaacttccatgacgaatttttcttcttgttcttattgcctccaataatattccaatcaggattcagtctatccccaaaaccattctttgcaaattttggggctattgtaacttttgccatccttgggacattcattgcttctgttgtaacaggagttctcgtctatcttggtgggttgacatttctaatgtacaaacttccatttgttgagtgcctcatgttcggtgctcttatatctgcaactgatcctgtcactgtgttatcaatattccaggagctgggcactgatgttaacttgtatgctcttgtgtttggagaatctgttctaaatgatgcgatggcgatttcgctttacaggacaatgtcattggtcagaagtcaagcagcagctggggagaacttctttatgatggttttccagttccttgagacctttgttggttcattgtcatcaggtgttggagttggatttatctctgctcttctgtttaagtatgctggactggatattgacaatcttcaaaacttggagtgctgcctttttgttctcttcccatacttctcgtatatgttagcagaaggacttgggttgtcaggaattgtttccatactattcacaggaatggttatgaagcactatacattttccaatctctcaaacaactctcagcgcttcgtttctgccttctttcacttgctgtcatctttagcagaaacatttgtgttcatttatatgggctttgatattgccatggaagaacatagctggtctcatgtgggcttcatattcttctcaattatatttataatcattgcaagggcagtaaatgtcttttcttgtgcatatttggttaacatgtcacggccagaacatcgacgcatacctctaaagcatcagaaagcactttggtttagtgggcttagaggggccatggcttttgcacttgctctccaatctgccaatgaacttcctggaggacatggaaaaacaatattcacaaccaccacagctattgttgttttaacggtacttcttatcggaggatcgacgggcaccatgctggaagctttggatgtaattggtgatgaaaacagatcaatagaaaattatgacgacaacaatggttacatccccccaacgtatgaggaaggttcatcatctggaggaggattaagaatgaaactgaaggaattccacaaaagcacgacatcgttcactgcccttgacaggaactatctgactccatttttcaccagtcaaactgatgaggatgatgatgtcttcggtgaacaaccccaaaaccagagacgcggattctatgaccaatagcttggatgagttgccacctgacagccacatacacgatacttagcatggtagcatgtgatgagattggaagcgatcgtaagtatacaacttctcatagttgaatagcatatgaaagagcataccgtaggatagatatcataacacaacttgattcgtcggcgatgacgaaagcatgctgcttcatgtatatattttaggcctcgattagtacgtggtggagctgtaatgagacaaaaatgattgtaagggaaaaaaaactgagcccaagcccatgtcatgagttagaatgattgcaataacccagagctgatcattggcagcttactgtcaagttggaaaagcatgttaaccaaatcaccagctgtgtcattggctggtcttgaagttactgatcatcattggggcttaaatcattcatgtttgaaaacttgtcgaatttccgatgacacttgttggctgttgcattcaatatgatagtggtactagtactagtagtaccatattgtccttggatgtgccgtgttgatgacactcaaaatatctgccgttgtccggctactgaatagaaattggc

SEQ ID NO: 1353 - DNA, 2783 bp, Panicum virgatum
ttttgcttaatgagaaatcaaataattttaaatttgattaaattcatacaaaatagtattatttatgttataaaataagtatcattagattaattatgtaatatattttatactaaatatatttcgagatacaatattaataatttttagtacaaatttagttaaatttaaaattatttaactttttatgaaacgagagttgcattttaaagacgaacgagacaaaaaccaagctgaaaatccagcatgcaccaagcagcagcatcgatcgagcagcagcggcggcgacaacgaccctccgcgcagcacgaggcagcaagcgtcgtaagcccaggaatcccgggcccaccgcgcacccccgtcgtcccccgcttccccgcgccacccccgattcttctccccggcgttctctcctctagattctagaacctcttcctccgcccccagcccttgaccgcaccgcgcccgcgcgagaccaggggggtccggcgccaccgccgggggttcaggacggcgatggagctgggcctgagcctggcctcggcctcgccgccggcgggcgggctggcgcctccgccgcccctagcgcctccagggaaggagcagcaggtggccggcgtggggatcctgctgcagatctccatgctcgtgctctccttcgtgctcgggcacgtcctgcgccgccaccgcttctactacctgcccgaggccagcgcctcgctcctcatcggtctagttgttggtggccttgctaacatttcaaatacagagaccaacactaggacatggttcaacttccatgaagaattcttcttcctgttcttattacctccgataatatttcaatcaggattcagcttatctccgaaaccattctttgcaaactttggggctatcgtaactttcgccattcttgggacgttgattgcttcagttgtaacaggggttcttgtctatcttggcggactgacatttctaatgtataaacttccactggttgagtgccttatgttcggtgcccttatatctgcaaccgatcctgtcacagtgctatcgatattccaggaactgggttctgatgttaacttgtatgctttggtgtttggagaatctgttttgaatgatgcgatggcaatttctctttacaggacaatgtcatcagtcagaagtcatgcagcagtcggcgagaacttttttatgatgattctccagttccttgaaacctttgttggttcaatgtcatcaggtgtaggagttggatttatctctgctcttcttttcaaatatgctggattggatgttgacaatctgcaaaatttggagtgctgcctttttgttctctttccatatttctcgtatatgttagccgaaggacttgggttgtcagggattgtttctatattattcacgggaatggttatgaagcattacacatactccaatctttcagacaattcacagcgctttgtttctgcctttttccacttactgtcatctttggctgaaacatttgtgttcatttatatgggcttcgatattgccatggaagagcatagctggtcacatgttggcttcatcttcttttcaattatatttatagttgttgcaagggctgtaaatgtcttttcttgtgcatacttggttaacatgtctaggccagaacatcgccgtattcctctaaagcatcagaaagcactttggtttagcgggcttagaggggccatggcttttgcacttgctctccaatctgtgcatgaacttcctgaaggacatggaaaaacaatattcaccaccactacagccattgttgtgttgacggtacttcttattggagggtcgacgggaactatgcttgaagctttggatgttgttggagatgaaaacccatcaatagaaacttatgaagacaacaatggtttcatgcctccaacttatgaagaaggtacatcatctgggggaggattgagaatgaaactcaaacagtttcacaaaagcacgacgtcattcactgcccttgacaaaaactacctgactccatttttcaccagccagactgacgacgacgacgacgatgcttcagtgggcaaccccaaaaccgacgagtaagattctatgatcaataacagattttgggcttccacctatcaagctaaatacacggagcacaactgatggcatgatggtgttcaagtataggagcatacttacctgagtagcatatggcagaagatatctgtataccgtaggtcagaaatcataaggctcaaatcaactcttatggggatgaggatagccgggccgcatgtatatatgtctctaggcctccttgagaacttggtggagctccagatgaaatgcagggtttttctggaaatttgtctggttgtagcctttacgttatgttaattttaataacccagacattatgatcgtaaagtggcagattgcagcaggcagtctcactggctgaagtacagtgccattcatccaactggaccatgtgggaataaaaaaaaactcttatagtaaaaaatcacaaggtggttcgtggaatgcaatgaatggtctagaattgagcttctagtcaactaaaggttgttctgggaagttctgctctactttgtaggagttagtttagtggcacactcactttctaatgagaatggggaacataaacatgtttatgaaacggggctagcccctttatcttaaacagaacagaaaatggaactgcctaatgaagacatgatatcctgcctaatggaacagaaaatgtttatgaa

SEQ ID NO: 1354 - DNA, 2069 bp, Triticum aestivum
gggaatcctgctgcagatctccatgctcgtgctctccttcgtgctcggccacgtcctccgccgccaccgcttctactacctccccgaggccagcgcttcgctcctcatcggactagttgttggtgggcttgctaatatttcgaacacagagaccaacactaggacatggttcaacttccatgaagaattcttcttcttgttcttattacctcctataatattccaatcaggattcagcttatccccaaaaccattctttgccaactttggggccattgtaacttttgccattcttgggacattcatcgcttccatcgtaacagggatgcttgtctatcttggtggactcacatttctaatgtataaacttccattggttgaatgtcttatgtttggcgctcttatatccgcgactgatcctgtcacagtattatcaatattccaggaactgggaagtgatgttaacttgtatgctctggtgttcggcgaatctgttttaaacgatgcgatggcaatttctctttacaggacaatgtcatcggtcaggagtaatgcagcaggaggcgagaacatttttatgatgattctacagttccttgagatctttgttggttcaatgtcatcaggtgtcggagttggatttatctcttctcttctatttaaatatgcgggattggatattgacaatcttcagaacttggagtgctgcctttttgttctcttcccatacttctcgtatatgttagcagaaggacttggcttgtcaggaattgtttctatactattcacagggatggttatgaagcactatacatactctaatctgtcagataactcgcagcgctttgtttcggccttctttcacttgctatcatctttggctgaaacatttgtcttcatttatatgggctttgatattgccatggaagagcatagctggtcacacgttgggttcatcatcttctcgattatatttataattgttgcaagggcagcaaatgtcttttcttgtgcctacttggttaatatatcgcggccagaacatcggcgtatacctctaaatcaccagaaagctctttgttttagtgggcttagaggagccatggcttttgcgcttgctctccaatctgtgcatgaacttcctgaaggacatggaaagacgatattaacagctaccacagccattgtcgttttaacggttcttcttattggagggtcgacaggcaccatgttagaagctttggatgtaattggtgatgaaaatacatcaatagaaacttacgaggataacaatggttacattcccccaacttatgaggaaggtacatcgtctggaggaggattgagaatgaaactcaaggagttccacaaaagcacaacatcgttcaccgcccttgacaagaactatctaactccatttttcacgagtcagactgatgacgatgctgatgatttcggtgatcaaccccaaaaccagagacgagggttctatgatcaatagcagagtttgactagctatacatggtgccaagtgccagtggacttaatgatatcgtagaacgtgggatccagattggaaccattaaacgatataaatacacgcctttgccttggttgagtagcatatggcagagcatactgtaggatagaaatcataagcctgatcaggacagcatgcctcctgtatatatttacaaggctcaaatggtacatggtggggctccagttgaaaaggcaaaagttctgtgacgaactttgttgacccaagcccttgtcttacaccagatcatttgtttccaacagctcatcgctgatcattgccaactgcattggctcggaaaacccttgttgtgaagtgaacttaccgcgattgaacattactgtgatgtattccagtgaaatctaaaactgttcggggcataactaagctgtcacggaaatgcctgtcgtgaagcgacaatgtaagataagcccgtcttacctctgtggttcttgatgtatgtttgcggttgtctgctgttgtgcaaactggtatctgctgtgtcgctgtatgttcctgatgtatgttt

SEQ ID NO: 1355 - DNA, 2391 bp, Pennisetum glaucum
cccgcccatcctttctagaatctccacctcctccgccctcgcccttgaccggacgactagggggagttccggcgcccccggcgggggtgaagatggcgctggagctgagcctggcctcggtctcgccctcgccgccggcgggcgtgctggcgccgccgccgcccctggccccgccggggaaggagcagcaggtggctggtgtggggattctgctgcagatctccatgctcgtgctctccttcgtgctcggccacgtcctgcgacgccaccgcttctactacctacccgaggccagcgcctcgctcctcatcggtctagttgttggtggccttgctaatatttcaaatacagagaccaacactagaacgtggttcaacttccatgaagaattcttcttcttgttcttattacctccgataatatttcaatcaggattcagcctgtctccgaagccattctttgcaaattttggggctattgtaactttcgccattcttgggacgttcattgcttctgttgtaacaggggttcttgtctatcttggtgggctgacatttctaatgtataaacttccactggttgaatgccttatgttcggtgcccttatatctgctaccgatcctgtcacagtgctatcaatattccaggaactgggctctgatgttaacttgtatgctttggtgtttggagagtctgttttgaatgacgcgatggcaatttctctatacaggacaatgtcatcagtcagaagtcatgcggcagctggcgagaacttttttatgatgattctgcagttccttgagacctttgttggttcaatgtcatcaggtgtgggagttggatttatttctgctcttctgttcaagtatgctggattggatgttgacaacctgcagaacttggagtgctgcctttttgttctctttccatatttctcgtatatgttagctgaaggacttggcttgtcagggattgtttctatattattcacggggatggttatgaagcattacacattttccaatctttcagacaattcgcagcgcttcgtttctgcctttttccacttactgtcatctttggctgagacatttgtgttcatttacatgggctttgatattgccatggaagagcacagctggtcacatgttggcttcatcttcttctcaattatattcatagttgtggcaagggctgtgaatgtcttctcttgtgcatacttggttaacatgtctcggccagaacatcgccgaatacctctaaagcatcagaaagcactttggtttagcggtcttagaggggccatggcttttgcccttgctctccaatctgtgcatgaacttcctgaaggacatggaaaaacgatattcaccactaccacagccattgttgtgttgacggtgcttcttattggagggtcgacggggactatgctagaagctttggatgttgttggagatgaaaacacatcaatagaaaattatgaagacaacaatggttacatgcctccaacttatgaagaaggtacatcgtctggtggaggattgagaatgaaactgaaacagtttcacaagagtgcagcacgacatcattcactgcccttgacaagaactacctgactccatttttcaccagtcaaactgatgatgatgacgatgacttcagtgagcaaccccaaaaccgaagagtacgattttatgatcaatagcagaatttggtattcttatcaagctaatacatggagcagaactgacatgaatgattgcatgtattaaaccaaatataggagcatacataggtgggtagcatatgtataccgtaggacagaaatcaaaaggctcaaatcaactcttcctctggggggatgagggtacccaggccacatgtacatatatctgtatcctgtaggccactttgagattgtggtggagctccagataagaagcagtgttgtggaactttacttggttatagcccttaccattatgttagttgtaataagctcccagacattctcactgtttactatgccccttcggtgcctgggaagcgtttgttgtaagtggcggattagagcagcagtcccactctctggtgttcatctaaactggacaatgtgggagtattgagtatctttcagctcagagtgagatcgcccagtctgtaaacgcagatgtggtttgaacataaggtgaatcgcgtgatgcaatcaacaatttcagaattgagcttgttgagtgctaaagttttggtggcgtgttagcattcggacaaaccatttctatcgaaaattgggaaacatgaacctgtcttcggatcgatgtaagttgggggttagcccatttgtataatagagtacgttgtggacgcagagctttcactcataatcgg

SEQ ID NO: 1356 - DNA, 2022 bp, Triticum aestivum
agcgcttcgctcctcatcggactagttgttggtgggcttgctaatatttcaaacacagagaccaacactaggacatggttcaacttccatgaagaattcttcttcttgttcttattacctcctataatattccaatcaggattcagcttatccccaaaaccattctttgccaactttggggctattgtaacttttgccattcttgggacattcatcgcttccatcgtaacagggatgcttgtctatcttggtggactcacatttctaatgtataaacttccactggttgaatgtcttatgtttggcgctcttatatccgcgactgatcctgtcacggtattatcaatattccaggaactgggaagcgatgtgaacttgtatgctctggtgttcggcgaatctgttttaaacgatgcgatggcaatttctctttacagaacaatgtcatcagtcaggagtaatgcagcaggaggcgagaacatttttatgatgattctacagttccttgagatctttgttggttcaatgtcatcaggtgtcggagttggatttatctctgctcttctatttaaatatgcgggattggatattgacaatcttcagaacttggagtgctgcctttttgttctcttcccatacttctcgtatatgttagcagaaggacttggcttgtcaggaattgtttctatactattcacagggatggttatgaagcactatacgtactctaatctgtcagataactcgcagcgctttgtttccgccttctttcacttgctatcatctttggctgaaacatttgtcttcatttatatgggctttgatattgccatggaagagcatagctggtcacacgttgggttcatcatcttctcgattatatttataattgttgcaagggcagcaaatgtcttttcttgtgcctacttggttaatatatcgcggccagaacatcggcgtatacctctaaatcaccagaaagctctttgttttagtgggcttagaggagccatggcttttgcgcttgctctccaatctgtgcatgaacttcctgaaggacatggaaagacgatattaacagctaccacagccattgtcgttttaacggttcttcttattggagggtcgacaggcaccatgttagaagctttggatgtaattggtgatgaaaatacatcaatagaaacttacgaggataacaatggttacattcccccaacttatgaggaaggtacatcgtctggaggaggattgagaatgaaactcaaggagttccacaaaagcacaacatcgttcaccgcccttgacaagaactatttaactccatttttcaccagtcagactgatgaagatgctgatgatttcggtgatcaaccccaaaaccagagacgaggattctatgatcaatagcagagtttgagcatggctagctattatacacggtgccaagtgccaatggacttaatgatatcgtagaacgtgggatccagattggaaccatacacacacctttgccttagttgagtagcatatggcagagcatactgtaggatagaaatcataagcctgatcaggacagcgtgcctcctgtatatatttacaaggctcttggatggtacatggtggagctccagttggaaaggcaaagttctgtgacgaactttgttgacccaagcccttgtcttacaccagatcatttgtttccaacagctcagcgctgatcattgccaactgcattggctcgaaaacccttgctgtgaagtggacgtaccgtgtctgagtcgaacattactgtgatgtatgtattccagtgaaatctgaaaccattagggacataactacgctgtcacagaaatgcctgtcgtgaagtgacaatgtatcgaaggtaagcctgtcttacctctgtctctgtggttcctgatgcatgtttgcagttgtctgttgttgtgcgcacttaaatctgctgtgttgctgtcatgttcttagagcttttgattccgtatgatcctgatgtatgtttgc

SEQ ID NO: 1357 - DNA, 855 bp, Avena sativa
caagtcccaacataccaccgcgagctactcccagtacaatcctcggatcgccgattagcacgccgccgagaagatggtgaagcttgtgcaggacgaggagaaccagaggctgctcctggacgaccacaaggagaagcacttcacctccggcgaggtggtccgggacatcatcatcggggtgtccgacggcctcaccgtgccattcgcgctcgccgccggcctgtccggcgccaacgcgtcctccgcgctcgtgctcaccgccgggctcgccgaggtcgccgccggcgccatctccatgggtctcggagggtacctcgccgccaagagcgacgccgaccactactaccgggagctgcagcgcgagcaggacgagatcgacaccgttcccgatactgaggccgccgagatcgcggagatactctctgagtacgggctgggccccgaggagtacgggcccgtcgtcacctccctccgcaacaaccccaaggcctggctcgagttcatgatgaagttcgagctggggctggagaagccggacccgcggcgcgcgctgacgagcgcggcgacgatcgcgctggcgtacgtcgtcggcgggctggtgccgctctcgccctacatgttcgtgccgtcggtcgaccgcgccatgctcacctccgtcgtcgtcacgctcgccgcgctgctcttcttcggatacgtcaagggccgcttcaccgggaaccgccccttcctaagcgccatccagaccgccgtcatcggcgcgctcgcctcctccgccgcctacggcatggccaaggccgtccaggccgtctgattggttcatcgagctcgcgctgtggaacggggctacgtgccaag

SEQ ID NO: 1358 - DNA, 1235 bp, Leymus cinereus x Leymus triticoides
  misc_feature (8)..(11): n is a, c, g, or t
cacgaccnnnntaactgagcgcagaaaatagctaagcacaccagctcgctcgtaagcacactcccacgccgaccggcaagatggtgaagcctgtgcaagacgaggagaaccagaggctgctcctggacgaccacaaggagaagcacttcacctccggcgaggtggtccgggacatcatcatcggcgtctccgacggcctcaccgtgcccttcgccctcgccgccggcctgtccggcgccaacgcgtcttcctcgctcgtgctcaccgccgggctggccgaggtcgccgccggcgccatctccatggggctcggagggtacctcgccgctaagagcgacgccgaccactactaccgggagctgcagcgcgagcaggacgagatcgacaccgtccccgacacagaggccgcagagatcgcggacatactctctgagtacgggctgggccccgaggagtacgggccggtcgtcacctccctccgcaacaacccaaaggcctggctcgagttcatgatgaagttcgagctggggctggagaagccggacccgcggcgcgcgctgacgagcgccgcgacgatcgcgctggcgtacgttgtcggcggcatggtgccgctctccccctacatgttcgtggcgtcggtcgacagcgccatgatgacctccgtcgtcgtcaccctcgccgcgctgctcttcttcggctacgtcaagggccgcttcaccgggaaccgcccgttcctcagcgccatccagaccgccatcatcggcgcgctcgcctcctccgccgcctacggcatggccaaggccgtgcaggccatctgatcgagctcgagtcgcgccgtccgggggctaagtaccaagaaaaataagtacagcaagttgcctacctgtgtatgtatgatgaagtgttgccatagtcgagtggtagctgtacgtgcagactctagcgttcatctggtaagtgtactggtagcccaagtgtactgatgtgcaccgttcgttttgttttctgtttcgtttcgaggtcgatgatgtacactatgttagtagtgtatttgggtgtatttgttttttcttctgtcgcgttaggtaagtatactagtatttgtaaggcaagttgcgttatttaggtgtggtggtaatgtgatgggctttgaatcagctggcaaatgggtctcgcgaatcctctaagcagaggcccatataacttttctgaagtgagtttcgtttctgaattca

SEQ ID NO: 1359 - DNA, 1250 bp, Secale cereale
ggtcgcgcgcgccgactcttgtcaaggcagatcacgagctagctaactgagcgcaggaaatagcttagcacaccagctcgctcgtaagcagcacactcccacgccgaccggcaagatggtgaagcctgtgcaggacgaggagaaccagaggctgctcctcgacgaccacaaggagaagcacttcacctccggcgaggtggtccgggacatcatcatcggcgtctccgacggcctcaccgtgcccttcgccctcgccgccggcctgtccggcgccaacgcgtcctcctcgctcgtgctcaccgccgggctcgccgaggtcgccgccggcgccatctccatgggtctcggagggtacctcgccgccaagagcgacgccgatcactactaccgggagctgcagcgcgagcaggacgagatcgacaccgtcccggacacagaggccgcagagatcgcggacatactctctgagtacgggctgggccctgaggagtacgggccggtcgtgacctccctccgcaacaacccaaaggcctggctcgagttcatgatgaagttcgagctggggctggagaagccggacccgcggcgcgcgctgacgagcgcggcgacgatcgcgctggcctacgtcgtcggcggcatggtgccgctctccccctacatgttcgtggcgtcggtcgacagcgccatgatgacctccgtcgtcgtcaccctcgccgcgctgctcttcttcggctacgtcaagggccgcttcaccgggaaccgcccgttcctcagcgccatccagaccgccatcatcggcgctctcgcctcctccgccgcctacggcatggccaaggccgtgcaggccatctgatcgagctcgagccgcgccgcgcccggggggcggtgaagtaccaagaaaaataagtacagcaagctacctacctgtgtatgtatgatgaagtgttgccatagtcgtcgagtggtagctctacgtgcagactctagcgttcgatttggtaagtgtactggtagcccaagtgtactgatgtgcaccgttcgttttgttttctgtttgtgtactggtagcccaagtgtactacagtgtgttggtagtgtctttgggtgcacttgttttttcttgccatctgtcgcgttaggtaagtaatactatttgtaaggcaagttgcgttatttaggtgcggtggtaatgtgatgggctttgaatcatctggcaaatgagtgtcgcgaatcctctaagcagaggccca

SEQ ID NO: 1360 - DNA, 1263 bp, Secale cereale
ggcagatcacgagccagctaaccgagcgcaggaaatagcttagcacaccagctcgctcgtaagcagcacactcccacgccgaccggcaagatggtgaagcctgtgcaggacgaggagaaccagaggctgctcctcgacgaccacaaggagaagcacttcacctccggcgaggtggtccgggacatcatcatcggcgtctccgacggcctcaccgtgcccttcgccctcgccgccggcctgtccggcgccaacgcgtcctcctcgctcgtgctcaccgccgggctcgccgaggtcgccgccggtgccatctccatgggtctcggagggtacctcgccgctaagagcgacgccgaccactactaccgggagctgcagcgcgagcaggacgagatcgacaccgtcccggacacagaggccgcagagatcgcggacatactctctgagtacgggctgggccctgaggagtacgggccggtcgtgacctccctccgcaacaacccaaaggcctggctcgagttcatgatgaagttcgagctggggctggagaagccggacccgcggcgcgcgctgacgagcgcagcgacgatcgcgctggcctacgtcgtcggcggcatggtgccgctctccccctacatgttcgtggcgtcggtcgacagcgccatgatgacctccgtcgtcgtcaccctcgccgcgctgctcttcttcggctacgtcaagggccgcttcaccgggaaccgcccgttcctcagcgccatccagaccgccatcatcggcgctctcgcctcctccgccgcctacggcatggccaaggccgtgcaggccatctgatcgacctcgacctggagccgcgccgcgcccgggggacggcgaagtaccaagaaaaataagtacagcaagctacctacctgtgtatgtatgatgaagtgttgccatagtcgtcgagtggtagctctacatgcagactctagcgttcgatttggtaagtgtactggtagcccaagtgtactgatgtgcaccgttcgttttgttttctgtttgtgtactggtagcccaagtgtactacagtgtgttggtagtgtatttgggtgcccttgttttttcttgccatctgtcgcgttaggtaagtaatactatttgtaaggcaagtttcgttatttaggtgcggtggtaatgtgatgggctttgaatcatctggcaaatgagtgtcgcgaatcctctaagcagaggcccatataactttctgaagtgagtttcgtttctgaa

SEQ ID NO: 1361 - DNA, 1258 bp, Secale cereale
gctaactgagcgcaggaaatagcttagcacaccagctcgctcgtaagcagcacactcccacgccgaccggcaagatggtgaagcctgtgcaggacgaggagaaccagaggctgctcctcgacgaccacaaggagaagcacttcacctccggcgaggtggtccgggacatcatcatcggcgtctccgacggcctcaccgtgcccttcgccctcgccgccggcctgtccggcgccaacgcgtcctcctcgctcgtgctcaccgccgggctcgccgaggtcgccgccggcgccatctccatggggctcggagggtacctcgccgctaagagcgacgccgaccactactaccgggagctgcagcgcgagcaggacgagatcgacaccgtcccggacacagaggccgcagagatcgcggacatactctctgagtacgggctgggccctgaggagtacgggccggtcgtgacctccctccgcaacaacccaaaggcctggctcgagttcatgatgaagttcgagctggggctggagaagccggacccgcggcgcgcgctgacgagcgcggcgacgatcgcgctggcctacgtcgtcggcggcatggtgccgctctccccctacatgttcgtggcgtcggtcgacagcgccatgatgacctccgtcgtggtcaccctcgccgcgctgcttttcttcggctacgtcaagggccgcttcaccgggaaccgcccgttcctcagcgccatccagaccgccatcatcggcgctctcgcctcctccgccgcctacggcatggccaaggccgtgcaggccatctgatcgagctcgacctcgagctcgagccgcgccgcgcccgggggcggcgaagtaccaagaaaaataagtacagcaagctacctacctgtgtatgtatgatgaagtgttgccatagtcgtcgagtggtagctctacgtgcagactctagcgttcgatttggtaagtgtactggtagcccaagtgtactgatgtgcaccgttcgttttgttttctgtttgtgtactggtagcccaagtgtactacagtgtgttggtagtgtatttgggtgcacttgttttttcttgccatctgtcgcgttaggtaagtaacaagtacaatttgtaaggcaagttgcgttatttaggtgcggtggtaatgtgatgggctttgaatcatctggcaaatgagtgtcgcgaatcctctaagcagaggcccatatagcttttctgaagtgagtttcgtttctaaag

SEQ ID NO: 1362 - DNA, 1280 bp, Triticum aestivum
acaccaaaacccacccttgtcatcgcagatcacgagctagctaactgagcgcaggaaatagctaagcacaccagctcgctcgtaagcacgctcccacgccgaccggcaagatggtgaagcctgtgcaggacgaggagaaccagaggctgctcctcgacgaccacaaggagaagcacttcacctccggcgaggtggtccgggacatcatcatcggcgtctccgacggcctcaccgtgcccttcgccctcgccgccggcctgtccggcgccaacgcgtcctcctcgctcgtgctcaccgccgggctcgccgaggtcgccgccggcgccatctccatggggctcggagggtacctcgccgctaagagcgacgccgaccactactaccgggagctgcagcgcgagcaggacgagatcgacaccgtcccggacacagaggccgcagagatcgcggacatactctctgagtacgggctgggccccgaggagtacgggccggtcgtcacctccctccgcaacaacccaaaggcctggctcgagttcatgatgaagttcgagctggggctggagaagccggacccgcggcgcgcgctgacgagcgcggcgacgatcgcgctggcctacgtcgtcggcggcatggtgccgctctccccctacatgttcgtggcgtcggtcgacagcgccatgatgacctccgtcgtggtcaccctcgccgcgctgctcttcttcggctacgtcaagggccgcttcaccgggaaccgcccgttcctcagcgccatccagaccgccatcatcggcgcgctcgcctcctccgccgcctacggcatggccaaggccgtgcaggccatctgatcgagctcgagccgcgccgcgccgcgcccgggggacggctaagtaccaagaaaaataagtacagcaagctacctacctgtgtatgtatgatcaagtgttgccgtagtcgagtggtagctgtacgtgcagactctagcgttcgatctggtaagtgtactggtggcccaagtgtactgatgtgcaccgttcgttttgttttctgtttgtgtactggtagcccaaagtgtactgcagtatgttagtagtgtatttgggtgtacttgttttttcttgccatctgtcgcgttaggtaagtatactatttgtaaggcaagttgcgttatttaggtgcggtggtaatctgatgggctttgaatcagctggcaaatgagtcttgcgaatcctctaagcagaggcccatataacttttctgaagtgagtttcgtttctgaa

SEQ ID NO: 1363 - DNA, 1291 bp, Hordeum vulgare
gcctacacccaaaacctcccctgtcaaggcagatcacgagctagctcaactaagcgcaggaaattgtagctgagcgcaccgcctcgctcgcaagctcactcccacgccgaccggcaagatggtgaagcctgtgcaagacgaggagaaccagaggctgctcctcgacgaccacaaggagaagcacttcacctccggcgaggtggtccgggacatcatcatcggcgtctccgacggcctcaccgtgcccttcgccctcgccgccggcctgtccggcgccaacgcgtcttcgtcgctcgtgctcaccgccgggctcgccgaggtcgccgccggcgccatctccatggggctcggagggtacctcgccgctaagagcgacgccgaccactactaccgggagctgcagcgcgagcaggacgagatcgacaccgtccccgacacagaggccgcggagatcgcggacatactctccgagtacgggctgggccccgaggagtacgggccggtcgtcacctccctccgcaacaacccaaaggcctggctcgagttcatgatgaagttcgagctggggctggagaagccggacccgcggcgcgcgctgacgagcgcggcgacgatcgcgctggcctacgtcgtcggcggcatggtgccgctctccccctacatgttcgtggcgtcggtcgacagcgccatgatgacctccgtcgtcgtcaccctggccgcgctgctcttcttcggctacgtcaagggccggttcaccgggaaccgcccgttcctcagcgccatccagaccgccatcatcggcgcgctcgcctcctccgccgcctacggcatggccaaggccgtgcaggccgtctgatcgagctcgagccgccccgtccgtcccgggctaagtaccaagaaaaataagcacagcaagctatacccacctgtgtatcagtatgtatgatgaagtgttgccatatagtcgagtggtagctctacgtgcagactctagtgttcgatctggtaagtgtactggtagcccaagtgtactgacgtgcaccgttcgttttgttgtccgttttgtttcgaggtcgatgatgtacactatgtcagtagtgtattttggtgtattttttttttctgtcgtgttaggtaagtatactactagtatttgtaaggcaagttgcctatttaggtgcggtggtaatgtgatgggctttggatcagctggcaaatgggccttgcaaatcctctaagcagagggccatgtaacttttctgaaccccctaaaaaaaatataacttttctg

SEQ ID NO: 1364 - DNA, 1288 bp, Oryza sativa
caccaatgctctaacccctataaatcccctccccaacccttcccatttcgctcacacatcgatcacagaaagctaagctaaagtgctaaactaagcacgagaaaatctaatcaaccaagcttagattagatcattagctatatatagctaggcgatttaatcatccacgagctagcttattagctaagcagtagcagcagcagaagatcgaagatggtgaaggagttcgtgcaggacgaggagaagcagcggctgctgctggacgagcacaccgagaagcacttcaccgccggcgaggtggtccgcgacatcatcatcggcgtctccgacggcctcaccgtgccgttcgccctcgccgccggcctgtccggcgccaacgccccctccgccctcgtcctcaccgccggcctcgccgaggtcgccgccggcgccatctccatgggcctcggagggtatctggcggcgaagagcgacgccgaccactaccaccgcgagctgcagagggagcaggaggagatcgacaccgtgccggacacagaggccgcggagatcgcggacatactgtcgcagtatgggctgggcccagaggagtatgggcccgttgttaactccctccgcagcaaccccaaggcctggctcgaattcatgatgaagtttgagttgggactggagaagccggaaccaaggagggcgctgatgagcgcgggaacgatcgcgctggcttatgtggtgggtgggctggtgccactcctaccctacatgtttgtgccgacggccgaccgagccatggccacctcggtcgtcgtcacgctcgccgcacttctcttcttcggctatgtcaagggccggtttactggcaaccggcccttcatcagcgccttccagaccgctgttatcggcgctctcgcctccgccgccgccttcggcatggccaaggccgtgcagtccatctaagtactgtagccggagctccggctgcaggcatccaagtaaatgtaattaatttagcagatccaataagtattgcagaaatgtatgtataagtatttatgtacgtttgctgcgtgcttgtagtgtattagatgttctggaggtgtatccgtagttagccctaagtgtaccatgtacacgagtgtaatcactcattttatatcgtcttctattttggctcccttttttatattcggttgggattaattaataatgtattgtcgatttgtaagcaatgatgtgctttgttatctatacttacttaatttaattaggtagttcggtgcattgagaggaa

SEQ ID NO: 1365 - DNA, 1786 bp, Setaria italica
cagccctgcccattccgcatcgcctacactgaaaacctcgcagcacagcaaattacaatcctagcacaagcaccgctgcccacaccaatcgctcggagattaaccaagcgagcgcgcttaatcagcgaagcacgcgaattaacacaccagcgatctttaatttgtagtgtgtgtgagggagagtttgcatttagaagagagatggcgctcaacggcgggaagacgtacgtgcaggacgaggagaagcagcggctgctcctggaggagcacaccgagaagcacttcaccgccggagaggtcgtccgggacatcatcatcggcgtctccgacggcctcaccgtgcccttcgcgctcgccgcggggctctccggcgcaaacgcctcctccgcgctcgtgctcaccgccgggctcgcggaggtcgccgccggcgccatttccatggggctcggagggtacctggcggcgaagagcgaggcagaccactacaaccgcgagctgcagcgcgagcaggacgagatcgacactgtccccgacgtcgaggctgccgagatcgctgacatcctgtcgcagtacgggctgggccccgaggagtacggccccgtggtgacctccctccgcaacaaccccaaggcgtggctggagttcatgatgaagttcgagctcggcctcgagaagcccgagccccggcgggcgctggtgagcgccgccacgatcgcgctctcctacgtcgccggcgggctcgtgccgctgctcccctacgtgttcgtgccgcgcgccgagcgcgccatggccgtgtccgtcgccgtcacgctcgccgccctgctcttcttcggcttcgtcaagggccgcttcacgggcgaccggccgttcctcagtgccgtgcagaccaccgtcgtcggcgcgctcgcctccgccgccgcctacgccatggccagggccgtgcagtccatatgatgatcatcagcgatgaaggaagcagctagtagtaattaagcctggctacttgctaattatatatatgcagatgcaacgaggaacgaaaataagtccagctatgtgtatgtggctatatacggtcactactggtcggctggtagctgtgcagatggcaaggtgtagtgcaactgtactactggtagtgtattctgtttgctggttgcgtgtagtgagtgttttaaatgttgtgttgtgttgtgttgtgttgtgttgtaaggagatgtgtggattatttaggcgaaatcaaagtatgggctgctgggctttggatcgactgtcaatctttctttgtggcggcagatgaccgaaatgggctggttgatttggcaagcggaggcccaaattcagtttgctctgggccttctcttttttcttcttcttattatcctttcaataagttcagcgatttctgcatcttggtggcatcttgcaatactatatagttaatccaccaccacttacttaggatgtttgattctggcctctcaagctcgccaaacggcaccctcaagcaaaagttttcttttcacatcaaaggggatcgagacctcatgctgattgagtgaaatgccagtggcatcttgttggtcagtcacagagataacgacttgggcgtgggcaattggccgctgcaaaggtaaaaaggttgagaggtaaaatctgctgatgaaacaaaaactgaaggacccgttgcccaattgacacaacctttttcaggctgtaattagttggtataaagtgggatcactgaaagtctgaaactttacactatactgccaaattcgccttt

SEQ ID NO: 1366 - DNA, 995 bp, Pennisetum glaucum
caacactgaaaacctcgcagtacacagcaagagatcccaagcattagtcgctccaagattaaccaagcgagcgcgcttaattagcgaagcacgcgaattaacacaccagcgatctttaatctgtagtgtgtgcgaggagaggagggagagtttttgcattgagagaagagatcgagatggcgctcatcaacggcggcggcaagacgttcgtgcaggacgaggagaagcagcagctgctcctggaggagcacaccgagaagcacttcaccgccggcgaggtggtccgggacatcatcatcggcgtctccgacggcctcaccgtgcccttcgccctcgccgcggggctctccggcgccaacgcctcctccgcgctcgtgctcaccgccgggctcgcggaggtcgccgccggagccatctccatggggctcggagggtacctggcggcgaagagcgaggcggaccactacagccgcgagctccagcgggagcaggacgagatcgacaccgtccccgacgtcgaggccgccgagatcgccgacatcctgtcgcagtacgggctgggccccgcggagtacggccctgtggtgacctccctccgcaacaaccccaaggcgtggctggagttcatgatgaagttcgagctcgggctggagaagcccgatccccggcgcgcgctggtgagcgccgccacgatcgcgctctcctacgtcgccggcgggctggtgccgctgctcccctacgtgttcgtgccgcgcgccgagcgcgccatggccgtgtccgtcgccgtcacgctcgccgccctcctcttcttcggcttcgtcaagggccgcttcacgggcgaccgccccttcctcagcgccgtccagaccaccgtcatcggcgcgctcgcttccgccgccgcgtacggcatggccagggccgtgcagtccatatgatcgacgacgatggtcatccagccaggacttatatatatgcaaaacaacgagcgagctgag

SEQ ID NO: 1367 - DNA, 780 bp, Zea mays
gcgagaagagatggctctgaacggcggcaagacgttcgtgcatgacgaggagaagcagcggctgctcctggaggagcacaccgagaagcacttcaccgcaggcgaggtggtccgtgacatcatcatcggcgtctccgacggcctcaccgtacccttcgcgctcgccgccggcctgtccggcgccaacgcctcctccgcgctcgtgctcaccgcggggctcgccgaggtcgccgccggcgccatctccatggggctcggagggtatctggcggcgaagagcgaggctgatcactacaacagggagctgcagcgcgagcaggacgagatcgacaccgtccccgacgtcgaggccgccgagatcgccgacatcctgtcggagtacgggctggggccgcaggagtacggccccgtggtgacctccctccgcaacaaccccaaggcgtggctggagttcatgatgaagttcgagctggggctggagaagcccgagccccggcgcgcgctggtgagcgccgccaccatcgcgctgtcctacgtcgcgggcgggctggtgccgctgctcccctacatgttcgtgccggaggccgggcgcgccatggccgtgtccgtcgccgtcacgctcgcggcgctgctcttcttcggcttcgtcaagggccgcttcacgggcgaccgcccatttttcagcgccgtccagaccaccgtcgtcggcgcgctcgcctccgccgccgcctacgccatggccagggccgtgcagtccatatgacgatgatgattaatgag

SEQ ID NO: 1368 - DNA, 1217 bp, Zea mays
cagctcagcgttcgcctcaccaacagaaaacctcggagctagcagcaagatcttagcacaaacaccacaccccacaggctgattaatcactccaagactaatcaaacgaacgcttagctaatagcgcgcgatcttttttccccctccccctcttgagtcttgagcgtgcgagaagagatggcgctgaacggcggcaagacgacgttggtgcaggacgaggagaagcagcagcttctgctggagaagcacaccgagaagcacttcacagcgggcgaggtggtccgggacatcatcatcggcgtctccgacggcctcaccgtgcccttcgcgctcgccgcggggctgtccggcgccaacgcctcctccgcgctcgtgctcaccgcggggctcgccgaggtcgccgccggcgccatctccatggggctcggagggtacctggcggcgaagagcgaggctgaccactacaaccgggagctgcagcgcgagcaggacgagatcgacaccgtccccgacgtcgaggccgccgagatcgccgacatcctgtcgcagtacgggctgggcccggaggagtacggccccgtggtgacctccctccgcaacaaccccaaggcgtggctggagttcatgatgaagttcgagctcgggctggagaggcctgagccccggcgcgcgctggtgagcgccgccaccatcgcgctgtcctacgtcgcgggcgggctggtgccgctgctcccctacatgttcgtgccggaggccgcgcgcgccatggccgtgtccgtcgccgtgacgctcgcggcgctgctcttcttcggcttcgtcaagggccgcttcacgggcgaccgccccttcttcagcgccgtccagaccaccgtcgtcggcgcgctcgcctccgccgccgccttcgccatggccagggccgtgcagtccatatgaagactggtgtgatgcagcaaaaatagtgaagcaggccggtcgccgcatgccccatatcaatcatcaccggccggctaggttggcgagggaaaataagtgcagctctatatgcatacgtggctacggtcactgcttctttgtttgatggctgcgtggtgtactattgtcagatgtggattattatttaggtcaagtcgattccaaactgtgacccgctgggctttggatccatttgtttttatctatctactggtaaattaaatgactgatgttgggctgtgtaa

SEQ ID NO: 1369 - DNA, 1531 bp, Sorghum bicolor
tgcccatttcgcctcgccaacacagaaaacctcgcaggagcaagatctaattagcagaaacaccacatcccagtatcccacaggctgattaatcattcgaaattgaagactaatcagacgagcgcttagctaagtagcgcgcgatccttttttttcttgagcgtgcgagcgaaagagagtactgaggcgcgagaagagagatggcggcgctgaacggcggcaagacgttcgtgcaggacgaggagaagcagcagctgctcctggaggagcacacggagaagcacttcaccgccggcgaggtggtccgggacatcatcatcggcgtctccgatggcctcaccgtgcccttcgcgctcgcagcggggctgtccggcgccaacgcctcctccgcgctcgtgctcaccgcggggctcgccgaggtcgccgccggcgccatctccatggggctcggagggtacctagcggcgaagagcgaggctgaccactacaaccgggagctgcagcgcgagcaggacgagatcgacaccgtccccgacgtcgaggccgccgagatcgccgacatcctgtcgcagtacgggctgggcccgtcggagtacggccccgtggtgacctccctccgcaacaaccccaaggcgtggctggagttcatgatgaagttcgagctcgggctggagaagcccgagccccggcgcgcgctggtgagcgccgccaccatcgcgctgtcctacgtcgccggcggcctggtgccgctgctcccctacatgatcgtgccggaggccgggcgcgccatggccgtgtccgtcgccgtcacgctcgccgcgctgctcttcttcggcttcgtcaagggccgcttcacgggcgacaggcccttcttcagcgccgtccagaccaccgtcgtcggcgcgctcgcctccgccgccgcctacgccatggccagggccgtgcagtccatatgatgattaagcagcttgcaggccgtatcatcagctcatcaccggtcgatcggccggcagcctagctaggttggccggccgttggcgacgaaaaataagtgcagctatgcatacgtggcttctgtcactggtcagctgctggtgactgtacacatggcaacgcgtagtgtacttgtactagtgtactatactactactagtgtgtatgtactctgtttgatggctgcgtgtagtcagtctaagatgacgtgctgtattttcacctgtggattatttaggtgatgaagtcaactgtggcccgctgggctttcaatccattgttttatctgtctatctaatggcaaataaaatggctgaaaatgggctgtgtaatgttgcaaggggaggcccaaactgggtttcctttgggctttgtctctgttttctcctcaactactactactactacctaataaggatttctgaataaaagagggtggtgttgctaaaaaaaactaacaaggatttctatatgtttgttcctaactaccttgtaaagctgtaataatagttaatcctcatgggacatatgattctgg

SEQ ID NO: 1370 - DNA, 1346 bp, Panicum virgatum
aacctatagtcatgattctagaacgcgcggtgctagctcagcagcagcgagaactcccattacgtatgatataatcccgatcccaatgcaatgatcacgctagtaatacaaaacctgacagagaaaatagaaaatcaggtggtgcaatcggccgaggagaagcagagggagtaaccagcagacatttacaccggacctttctgaagccactgctgccgatccaagaaaaaaaaattgcagcaagccagcaaccaccccatgtccaacctggtcatttcgccgcccgtgttaaccctataaatccccctcccagctctgcccattccgcatcgcctgcactgagaacctcgcagcatcccagcacaaacaccgccgctgcccacaccaaccagcgatttgtgtggagattttaattcgagggagagtttgcattgaggtgagatggcgctgatcggcggcagcaaggcgttcgtgcaggacgaggagaagcagcggctgctgctggaggagcacaccgagaagcacttcacggccagcgaggtggtccgggacatcatcatcggcgtctccgacggactcaccgtgcccttcgcgctcgccgcggggctctccggcgccaacgcctcctccgcgctcgtcctcaccgccgggctcgcggaggtcgccgccggcgccatctccatggggctcggagggtacctggcggcgaagagcgaggcggaccactacaaccgcgagctgcagcgcgagcaggaggagatcgacaccgtccccgacgtcgaggccgccgagatcgccgacatcctgtcgcagtacgggctgggccccgcggagtacggccccgtggtgacctccctccgcggcaaccccaaggcgtggctggagttcatgatgaagttcgagctggggctggagaggcccgagccccggcgcgcgctggtgagcgccgccacgatcgcgctctcctacgtcgccggcgggctggtgccgctgctcccctacgtgttcgtgccgcgcgccgggcgcgccatggccgtgtccgtcgccgtcacgctcgccgcgctgctcttcttcggcttcgtcaagggccgcttcacgggcgaccgccccttcctcagcgccgtccagaccaccgtcgtcggcgcgctcgcctccgccgccgcctacgccatggccaggggcgtgcaatccatatgaatacgatcactgcaccggtcatcatgcagctacactacacgttgccatctgcacagtccatatatatatatgtgtgtgtgtgtgtgtgtgcagctagcaagaaaaataagcgcagcaatgtatacgtggctgctggtagctgtgcagat

SEQ ID NO: 1371 - DNA, 1131 bp, Panicum virgatum
  misc_feature (1034)..(1034): n is a, c, g, or t
gcactgagaacctcgcagcagcatcccagcacaaacaccgccgctgcccacaccaaccagcgatttgtgtggagattttaattcgagggagagtttgcattgaggtgagatggcgctgatcggcggcagcaaggcgttcgtgcaggacgaggagaagcagcggctgctgctggaggagcacaccgagaagcacttcacggccagcgaggtggtccgggacatcatcatcggcgtctccgacggactcaccgtgcccttcgcgctcgccgcggggctctccggcgccaacgcctcctccgcgctcgtcctcaccgccgggctcgcggaggtcgccgccggcgccatctccatggggctcggagggtacctggcggcgaagagcgaggcggaccactacaaccgcgagctgcagcgcgagcaggaggagatcgacaccgtccccgacgtcgaggccgccgagatcgccgacatcctgtcgcagtacgggctgggccccgcggagtacggccccgtggtggcctccctccgcggcaaccccgcggcgtggctcgagttcatgatgaggttcgagctggggctggagcggcccgagccccggcgcgcgctggtgagcgccgccaccatcgcgctctcctacgtcgccggcgggctggtgccgctgctcccctacgtgttcgtgccgcgcgcggggcgcgccatggccgtctccgtcgccgtcacgctcgccgcgctgctcttcttcggcttcgtcaagggccgcttcaccggcgaccgccccttcctcagcgccctccagaccaccgtcgtcggcgccctcgcctccgccgccgccttcgccatggccagggccgtgcagtccatatgatacgtactgctaccgacatgtaaatgtgcaggtgcagctagcaagaaaaataagcgcagctagcaatgtacacgtacgtggctggtagctgtgcagatggcaccgtgtatgtatccagtgtagctgtactacttctggtagtgtattttgtttgctggttgcgtcgtgnagtgttcaagtgacgacgtgttcttgtagtgttgtgtttgtaaggagatgtggattatttaggggcgaaatcaagtgctgctgggcttttaatttgg

SEQ ID NO: 1372 - DNA, 2504 bp, Panicum virgatum
cggcagtagccccgaaggctccacacgccatgggagcccctcccgtcccttggcagcacgcgtcaaccggaaggcgagcgccccactgcaagcggggcccaccggtcagcccccgtcggcgtcaaacctggagctgataaatagccgcggcggggggagccggggaggtggtgctcctcaccggcctcggcgtcgtcgcctctcaccaacccacccgtccgccacccacctctttgctccccttgcgaatcggagaccacgtacactaccccgcccgtccccgggcaagcgaaagctaagagcggaacaagttcctgcgacggcgaggaggactggatcgcagcgccatgtcgctcgacgagctcgccgacaaggaggcgtcatcacccgaggaaattcagcttgtgcagtcggatgccaagttccggagcttcagcccaccgccgattccgatcccagctgctccgggcatcagatcattggtcgattcggtttctgacgagagattagatgtcattgcctcacatcaacgtgaaaatggatccatctctacagttagctctactgttagttcactagaatcagagaaagctgcctatgaattccttgctcaaactcctatcaagtcaaccgatgcacaccttgttgagttttcagaggctatgagaactgttgcaaaagccttacgacgagtggctgaaggcaaggctgctgctcaagcagaggcgacagagtggaaacgcaagtatgaattagagatggcgcacaagcaacagagtaaagtcaaaggctgtggcagttatatcaataatgacttagacaaactggccagtcaactaaccctggacacagctgcatctgatcaattaggatgttgtggaaaacatggtatatgttcacatgaggttctccaggacgaagttcctggacctatcccaagatctaatcacaagatggttgggagaaaggcatcatttaaactttcatggggatgtaatggggataaaaatggccagcataagcatgattttgtgtcctttgaaaaaggtgatataacaacaacagaacggagcaataagcagatcttactgaaatgggaatcacaacctcaaacagtgctttttataactaaacctaattccaactctgtgcgcgttctttgtgcagaaatggtcagatggcttaaggagcataaaaatataaatgtctttgttgagccacgtgttagcaaggagcttataacagaggattcatcttacaatttcgtccaaacatgggataatgatgatgagataaagctgctgcacacaaaggttgatctcattgtaactcttggcggtgatggaactgttctgtgggctgcatcattgttcaaaggaccagttcctccagttgttgcattctccctcggatcactgggcttcatgacacctttcctgagcgagcaataccgtgattgcttagacaatgtgctgaacggaccctttagcatcacactaagaaaccgtctgcagtgtcatgtaatccgtgatgcagcaaaggaggaactcgtgactgaggagccaatcttagtgttaaatgaagttacaatcgaccgaggaatatcatcttaccttacctacctggaatgctactgcgacagttcttttgttacttgtgtacaaggagatggactaatcatttcaactacatctggaagcacagcatattcactagcagctggaggatccatggtccatccgcaggtcccagggatccttttcaccccaatctgcccgcattccttgtcattcagacctttgatactgcctgaatacgtgactctgcgtgttcaagtgccttacaatagcagggggtctgcctgggcatctttcgatggcaaagatcgaaagcagctatcacctggcgacgccctgatatgcagcatatctccttggcctgtgcccacagcctgcctggcggactcaacgaccgatttcctccgcagcatccatgagggcctccactggaacctgaggaaatcccagtcatttgatggcccgcgtgattgatgtaatagtttttgcagttatatcagtcctgtgccagaattctaagctgggtaaggcactgatgggtgtgttctcttctctcagaacagaagcatttcctccaagtgcagctaacagcgaggtgagaggataattgtacctacacgagtgcgttctcctttaccattacattacatacataatatagaaggttgcatacatgtagagagtatagtgcagaatccaaatatactactggccacgagtacacgtgtgtagactgtagaggcatttgaacttgataacggcacatgtggtggatggtaccaaatacactgatctggataaagtatggggatggcagccactcaaaaatgtagagtacggccccaatgtatgtatgcatacatatgatgtgcccccatgatggaaatgaaataatttgtgtgagccatctatgaaatgtcagcttct

SEQ ID NO: 1373 - DNA, 2095 bp, Pennisetum glaucum
gaaattcaggtcgcgcagcagccggattccaagttccggagcttcaacccggggccgatcccgatccccccagccgctcctccgaccgtcagatcattggcacactctgtttctgatgagagagttgatgtcttggcctcacatcaaagtgaaaatggatccggatccatctctacggctagttctactgttagttcactagaagtagagaaagcagcctatgaatatcttgctcaaactcctatcaagtcaactgatgcacaccttgtcgagttttcagaggccatgagaactgttgcaaaggccttacgacgggtggctgaagggaaggctgctgctcaagcagaggcggcagagtggaaacgcaagtatgaattagagatggcgcacaagcaacagagtaaaatcaaaggctgtggcagttgtgtcagtaatgacttagacaagctggccagtcaactaaccctggagacatcagcatcagatcaattaggatgctgtggaaagcatggtatatgttctcatgaggttctccaggacgaagttcctggacctatcccaagacctaaccacaagatggttgggagaaaggcatcatttaaactttcatggggatgtaatggggataaaaatggccagcataagcatgattttgtgtcctttgaaaaaggtgatataacaacagcagaacggagtagtaagcagatattactgaaatgggaatcaccaccacaaacagtgcttttcataaccaaacctaattccaactctgtgcatcttctttgtgcagaaatggtcagatggcttaaggaacataaaaatataaatgtctttgttgagccacgcgttagcaaggagcttctaaccgaggattccagctataacttcgtccaaacatgggatgatgatgaggagataaagcagttgcacacaaaggttgatctcattgtaactcttggtggtgatggaactgtactgtgggctgcatcgttgttcaaaggaccagttcctccagttgttgcgttctcccttggatcactcggcttcatgacacctttcccgagcgagcagtaccgtgattgcttggacaatgttctgaacggaccatttagcatcacactgagaaaccgtctacagtgtcacgtaatccgagatgcggcaaaggatgaactcgtgactgaggagccaatcttagtgttgaacgaagttacaatcgaccgaggaatatcatcttaccttacctacttggaatgctactgcgacagctcttttgttacttgtgtacaaggagatgggctaatcatatcaactacatctggaagcacagcatattcactagcagctggaggatccatggttcatccgcaggtcccagggatccttttcactccaatctgtccgcattccttgtcattcagacctttgatactgcctgaatacgtgactctgcgcgttcaagtgccttacaacagcagggggcatgcctgggcgtctttcgacggcaaggatcggaggcagttgtcacccggcgacgccctgatctgcagcatttctccttggcccgtgccaaccgcctgcgtgatggattcgacgaccgatttcatgcgcagcatccaggagggcctccactggaacctgaggaaaccccagtcatttgacggcccgcgcgattgatgcgacgattttccaggttgtatcagtccagtggcagaatcccaaaagttggctaaggcgcactgatggcatgggtttgttctcgcacagaaacagaagcgtcgtttcctcaagtgccgctgacggcgagagggcaattgtacctaggccggcgggtggtgttctcctttaccattacatacatacttacatacatacatgatatagaaggttgcatacatgtagagggtatagtgcagaatccaaatgtaccacgagcgtgtagagagaggcattcgaacctggtaataacagcacgtacatgtggcggatgataccaataccatacacactgatctggataaaagtatggggggttggcaacgacgactcaacagaatgttaagagtacgccaccaatgtatgtgtgtgtatatacttg

SEQ ID NO: 1374 - DNA, 2774 bp, Sorghum bicolor
cgctcccttcccagcacgcgtcagccggaagccgaccgtcccactgcagctgggccccaccgacaagcgcccgtcggcgtcaaaccagaagccgataaatagccgcgccgggcggggagaggtggtgctccagtcctcaccggcctcggcgtcgtcgcctcgcaccacacccaccggccacccgtccaccacccacctcttcttctccttctctccccacctcgcgaatcggaggccaagtacactgcccacccaagcccccaggaccgggagccaagagcagaactagtagtacgggggggtgttctctgcgacggcgaggacgcgaagcggaccggatcgcggcgccatgtcgctcgacgagctcgccgacaaggagccgtcgtcctccgaggaagttcagcttgcgccgtcggattccaagttccggagcatcggccctgcgccgattccgatcccagctcctccgagcatcagatcattggtcgactcggtttctgatgagagagtaaatgtagatatcgtggcctcacatcaaagtgaaaatggatccatctccacagctagttctactggttcactagaatcagagaaggcagcatatgaatttcttgctcaaactcctgtcaggtcaactgatgcacaccttgttgagttttcagaagccatgagaactgttgcaaaagccttacgacgagtggctgaagggaaggctgctgctcaagcagaggcagcagagtggaaacgtaagtatgaattagagacagcgcacaagcagcagagtaaaatcaaaggctacaacagttgtatcagtaacgacttggacaaactggccagccaactaaccctggagacacctgcacccgatcaattaggatgttgcggtaagcatggtatatgtgcacatgaggttctccaggacgaagttcctggacctatcccaagatctaatcacaaggtggtggggagaaaggcatcatttaaactttcatggggatgtaatggggataaaaatggtcagcataagcatgattttgtgtcctttgaaaaaggtgatataacaaccgcagaaaggagcaataagcagatcttactgaaatgggaatcgccaccacaaacagtgcttttcataaccaaaccgaattccaactctgtgcgtgttctttgtgctgaaatggtcagatggcttagggagagtaaaaacataaacatctttgttgagccacgtgttagaaaggaacttctaacagaggattcctactacaacttcgtccaaacatgggataatgatgaggagataaagatgctgcacacgaaggttgatctaattgtaactttgggtggtgatggaactgttctgtgggctgcgtcgttgttcaaaggaccagttcctccagttgttgcattcgcccttggatcactgggcttcatgacgcctttcccaagcgagcaataccgtgagttgttggacaatgtgctgaatgggccatttagcatcacgctgagaaatcgtatacagtgtcatgtaatacgtgatgcggcaaaggatgaaatcatgactgaggagccattcttagtgttaaatgaagttacaattgaccgaggaatatcgtcttaccttaccaacctggaagtctactgtgacagttcttttgttacttgtgtacaaggagatggactaatcatatcaaccacatctggaagtacagcatattcattagcagccggaggatccatggttcatcctcaggtcccagggatccttttcaccccaatctgtccgcactccttgtcattcagacctttgattctgcctgaatacgtgactctgcgcgttcaagtgccatacaacagcaggggggctgcctgggcatcctttgacggcaaagatcgacagcagctatcgcccggtgacgccctgatctgcagcatttctccttggcctgtgcccacagcctgcctggtggactcgaccaccgatttcttccgcagcatccatgagggcctccactggaacttgaggaaatcccagtcatttgacggcccgcgtgattgatgcaacagatttttttcagttatatatcagtccagtgccagaattcaagctgggaatcctcaaagtgcagctaacatcaagaggaataattgtatctactcgagggtgctcacctttaccgttcatgtgtgttatatatatacaaagttgcgtgcgtttagatatgaggtatagtgcagagtccaaatatatagccatggccatgcatgtgtgtgtacaggtttctgtgcttcagtgcttgattatagcacacgtgggagaagatatgtacactgattctggataaagtatggggagagatagatagatagatagatatggatggcaaagactgaacatgttgaataatgcaccaccaatgtatgcatgtatacatgtgatgctccccagatctgaatgaaataatccgcgagccatacgcgatgagatggcagcttctgttacagcttgcagtcatgcgatctgcgcacttgtgacgattgatgggaagcctccatccctttttcagcttctatgctgataactgaactgatgaatgttgaatggagtcatggagtgggcatgcttactcctgtgacggccagatgggtggtgcaagtggcctgcctgctgcccacttgcacggttggacctgcgagcgagggcgatcggtcacgcgttttgaatccgtgatcaggattaacaaaagctgagtagctttcgacgtgattctgcggct

SEQ ID NO: 1375 - DNA, 6365 bp, Oryza sativa
ggaggtggtgctcctcctcctcaacagcgtcgcctcgcgtcggcgtcgcctctcaccacccaaccaccagtccaccacccacctctctccctcccctcccctccccaaacccaacccgagccgaggccggaatttcctttttggtgcgacgacgacgaggtgagggtgagccaaccgccggatcgcgccgccatgtcgctcgacgagcttccgcacaagaagctggcatcctcggagggaattcggttcgcgcggtcggattccaggttccggagccttagcccagcgcccatcccaatcccaactgccccaagcttcagatcattggtcgacccggtttctgatgagagagtaaaccatgatactgtgacctcacatgaaagtgaaattgggtctgggtccatctccacagttagctcaacagttagttcagtagaatcagagaaagcagcttatgaattccttgctcaaactcctatcaagtcaaccgatgcacaccttgttgagttttcagaagctatgagaactgttgcaaaagcattgcgacgagttgcagaagggaaagctgctgctcaagctgaggcggaagagtggaggcgtaaatatgaattagagatggcacacaaacagcagagaaaaatcaaaggctatggcagttgtgccaataatgaattagaaaagttggccagccaactaacactggagacgcctgcatctgatcaagcgggatgttgtggaaatcatggtatatgttcacatgaggttcttcaggatgaaagtcctggtcctaacccccgatctagtcacaagctggtgagtagaaaggcatcatttagactttcatggggatgcaatggggataaaaacggccagcacaagcatgattttgtatcatttgaaaagggagatataacaacagcagagcgcagcaacaagcagattttgctgaaatgggaatcctcgccacaaactgttcttttcataaccaaacctaattctaactccgtgcatgttctttgtgctgaaatggtcagatggcttaaggaacataaaaagataaatgttgttgtagagccacgtgttagcaaggaactcttaacagaagattcctactacaatttcatccaaacatgggatgatgatgaggagaaaaagatgttgcacacaaaggttgatctcattgtaactcttggtggtgatgggactgttttatgggctgcgtctttgttcaaagggccagttcctccggttgttgctttctccctaggatcactgggattcatgacacctttcccaagtgagcaatatcgtgattgtctggacaatgtgctgaatggaccatttagcatcacattgagaaaccgtctacagtgccatgtaatccgtgatgcagcaaaggatgaacttgagactgaggagccaattttagtgttaaacgaagtcacaattgaccgtggaatatcatcttaccttacctacttggaatgctactgtgatagttctttcgttacatgtgtacaaggggatggactgatcatatcaacaacatctggaagcacggcatattcattggcagctggaggatccatggttcatccacaggtcccaggaatcctattcacgccgatctgcccgcattccctgtcattcaggcctttgatactgcctgaatatgtgaccctgcgcgtacaagtgccacataacagcaggggccaagcttgggcatcattcgatggcaaagatcggaagctgctgtcacccggggatgctctcatctgcagcatttctccatggcctgtgcccacggcttgcctggtggattcaacaaccgatttcctacgcagcatccacgagggtctccactggaacctgaggaagtcccagtcattcgacggcccgcgtgattgatcccagctcctggatacagtccagtgtcagagttgagagtttcagctggccatcagaagagtttcccacgagtccagctaacaccgagcggataaatgtacctagcagagtttgttgcttgttaccattccatatacatatacatatacatatacatatactagaaggctgctgcgtgtagatttggggtaagtactggggactgaagaatgaatcgaaatagaaagtatcgagaatacactgtgccatgatgaatgtataacagtagatgtggcaggcaacatatactgatgtgcactagcatctgaagtagcatgggagagtagataccggtgacaagtcatcgaagtgtaaaaacacaacatgtatactggtatatatatgtacccccatgatctgaatgaaataatttgaccatggaaaggaaaccctgcgtactctgctgttacagtttggtgttcatgcaatccgccaattgagggtgtggagcagtggaagcttcactccagtttccacaaatcacaactgatgcatggatggtgagagcaacaacgcatccctgatttgaacccgtgcgtgcacggtcggtctcggtcagtgatacagtgatacagcctcagttcccgtgcagtgtcgcgttccggcgagagttggattccgagtggccggcgaccccatccggcagccaccccagcggcggaggaacgtgagctcttttgttgctttctatctgtccaacctaccccccctcacgggcctcgcccacgccacgcacgccaatccaaccagcgtcccatttccctcctcgtctccccccgcgtccacttctccactcccaccaccaccatgcaacgcagccgctggcactagatctcccacgaccacctcgcctcgccaccatatctgcagctccactcccctcctcctcgttactgctgaaatggcgacgcctatcgcgttactgctgttcgtgctggtggtggcggcggcggctgacagtacgatgccgatgccggtgaacgaggaggtgctggggctggtggtgttcaagtcggcgctgtcggacccctccggcgcgctggcgacgtggacggagtccgacgcgacgccgtgcgggtgggcgcacgtggagtgcgacccggcgacgtcgcgcgtgctccgcctcgcgctcgacgggctcggcctctccggccgcatgccgcgggggctcgaccgcctcgccgcgctccagtcgctctccgtcgcccgcaacaacctctccggcgagctccccccggggctctccctgctcgcctcgctccgctccatcgacctctcctacaacgccttctccggcccgctccccggcgacgtcccgctcctcgcctccctccgctacctcgacctcaccggcaatgccttctccggcccgctgcccgccacgttccccgccaccgtccgcttcctcatgctctccggcaaccagttctccggcccgctgccgcagggcctctccaagagctccttcctgctccacctcaacctgtccgggaaccagctctccggctcgccggacttcgccggcgcgctctggccgctctcgcgcctgcgcgccctcgacctctcccgcaaccagttctccggcaccgtcaccaccggcattgccaacctccacaacctcaagaccatcgacctcagcggcaacaggttcttcggcgccgtcccgagcgacattggcctgtgccctcacctcagcaccgtcgacataagctccaacgcgttcgacggccagctccctgactctatcgcccatctcggctcgctcgtctacttcgccgcgtccggcaaccgcttctccggcgatgtccctgcttggcttggcgacttggcggcgcttcagcacctcgatttctccgacaatgcgctcaccggccgcttgccggactcgctcgggaagctcaaggacctcaggtacctgagcatgtcagagaaccagctctccggtgccatcccggacgccatgtccggctgcacgaagctcgccgagcttcacctgagggccaacaacctcagcggcagcatcccggatgcactgttcgacgtcgggctggagacgctcgacatgtcgtcgaacgcgctctcgggcgtcctgccgtcgggctcgacgaagctggcggagaccctgcaatggctcgacctctccgtcaaccagatcaccggcggcatcccggcggagatggcgctcttcatgaacctccgctacctcaacctgtcccgcaacgacctccgcacccagctgccgccggagctcggccttctccgcaacctcaccgtgctcgacctccgcagcagcggcttgtacgggacaatgccgagcgacctgtgcgaggccggcagcctcgccgtgctccagctcgacggcaactccctcgccggccccatccccgacaacatcggcaactgttcgtccctctacctactgagcttggggcacaacagcttgacggggccgataccggtgggcatgtcggagctgaagaagctggagattctgaggctggagtacaacaacctgagcggcgagataccgcagcagctgggcgggatcgagagcctcctggcggtgaacgtctcgcacaaccgcctcgtaggccggctgccggcgtcgggcgtgttccagagcctcgacgcgagcgcgctggagggcaacctcggcatctgcagcccgctggtgacgcagccgtgcaggatgaacgtggccaagccgctcgtgctcgaccccaacgagtacccgcacggcggcgacggcgacaacaacctcgagaccagcggccgcggcccggcgtcgccgaggaaacggcggttcctgagcgtgtccgccatggtggccatctgcgcggcggtgttcatcatcctcggggtcatcgtcatcaccctgctcaacatgtcggcgcggcggagggccggcgacggcgggacgacgacgccggagaaggagctggagagcatcgtgtcaagctcgaccaagtccagcaagctcgccacgggcaagatggtgacgttcgggccgggcaacagcctccgttccgaggacttcgtgggcggcgccgacgcgctgctgagcaaggcgacggagatcggccgcggcgtgttcgggacggtgtaccgcgcgtccgtcggcgagggcagggtggtcgccatcaagaagctcgcgacggcgagcatcgtggagtcccgcgacgacttcgaccgcgaggtccgcatcctggggaaggcgaggcaccccaacctactccccctcaagggctactactggacgccgcagctccagctcctcatcaccgactacgcgccgcacggcagcctggaggcgcggctccacggcaacggcgacggcgcgttcccgccgctgacatgggcggagcggttccgcatcgtggccggcacggcgagggggctcgcgcacctgcaccagtcgttccggccgccgatgatccactacaacgtgaagccgagcaacatcctgctcgacgagcagtgcaacccgatggtcggcgacttcgggctggcgcggctgctgccgaagctggacaagcacgtgatgagcagccggttccagggcgggatggggtacgtggcgccggagctggcgtgccagagcctccggatcaacgagaagtgcgatatctacggcttcggcgtgctcatcctggagctcgtcacggggcggagggccgtcgagtacggcgacgacgacgtggtcatcctcatcgaccaggtccgcgtcctcctcgaccacggcggcggcagcaacgtgctggagtgcgtcgacccgagcatcggcgagttcccggaggaggaggtgctgccggtgctcaagctcgggatggtgtgcacgtcgcagatcccatccaaccgcccgtccatggccgaggtcgtccagatcctgcaggtcatcaaggcccccgtcgctgcatcgtcagccagaatcgaagctttctgaattctgatcgatctgacgacgccacatcattactcctactaaaccacagggttaatgattccaaatcatcgaatcgatcacttgcattgcattgcatgcatgcatccgcaagtactacgtgttccctagtgcaaaaattgaaaggtctgagcagtaggcagtaatagtagtacgtacaactgttcctgccgtgctaattttctcagggtctttttttgtctctgcttttggatgtcagataaatctcattattattacgtggtgccttgttcgatctacacttctacagttctactactactctgctactgcaagtacgtgacccattactgctgcatcgtttctaaccgttcttaatactgccattggaccattggtgccagctctggatggattctgtacatgcaacgcatggaaatatgctcacttgtgactggtctgagttgtaacaaagttggcgtgttgcattgcgccc

SEQ ID NO: 1376 - DNA, 2308 bp, Zea mays
cgaagccaaccgtcccagtctgggccccaccggcgagagcccgtcggcgtcaaaccaggacccgataaatagccgcgccgggcggggagaggtggtgctcctcaccggcctcggcgtcgtcgcctcgcaccgcacccaccggtccaccacccacctattcttcttgtctctctcccccctcgcaaatcggaggccaagtacactgcccacccaagtacccaaccaagtcaggagcagaacaagtagtacgggctgtgttttctgcgacggcgagccaagagcagaacaagtagtacgggcgtgttctctgcgacagcgagcggaccagatcggcggcgccatgtcgcacgacgagctcgccgacaaggagccgtcgtcctccgaggagtttcagctcgcgccgacgggttccaagttccggagcctcagccctgcaccgattccgatcccagcttctccgggcatcagatcattggtcgactcggtctctgatgagacagtaaatgtagatgtcatggcctcacatcaaagtgaaaatggatcaatctctacagctagttctaccgttagtttactggaatcagagaaggcagcatatgaatttcttgctcaaactcctgtcagatcaaccgatgcacatcttattgagttttcagaggccttgagaactgtcgcaaaagccttacgacaagtggctgaagggaaggctgctgctcaagcagaggcagcagagtggaaacgtaagtatgaattagagacagcgcagaagcagcaaagtaaaatcagaggctacagcagttgtatcagtaataacttggacaaactggccagccaactaaccctggagacacctgcacctgatcaattaggctgttgtggtaagcatggtatatgtgcacaccaggttctccaggatgaagttcctggacctatcccaagatctaatcacaaggtgggagggagaaaggcaccatttaaactttcatggggatgtaacggggataaaaatggccagcataagcatgattttgtgtccttcgaaaaaggtgatataacaacagcagaacggagcaataagcagatcttactgaaatgggaatcaccaccacaaacagtgcttttcataaccaaaccgaattccagctctgtgcgtgttctttgtgctgaaatggtcagatggcttagagagtataaaaatgtaaacatctttgttgatccacgtgttagcaaggaacttctaacagaggattcctactacaacttcgtccaaacgtgggataatgatgatgatataaagatgctgcacacgaaggtcgatctaattgtaactctgggcggtgatggaactgttctgtgggctgcatcattgttcaaaggaccagttcctccagttgtcgcattcgcccttggatcactgggcttcatgacacccttcccgagcgagcactaccgtgagttgttggacaacgtgctgaatgggccatttagcatcacgctgagaaatcgcatacagtgtcatgtaatacgagacgcggcgaaggatgaaatcgtgaccgaggagccgttcttagtgctaaatgaagttacgatcgaccgagggatatcgtcttaccttaccaacctggaagtctactgcgacagctcttttgttacttgtgtgcaaggagacggactgatcatatcaaccacatctggaagtacggcatattccctagcagctggagggtccatggtccatcctcaggtccctgggatccttttcaccccaatctgcccgcattccttgtcgttcagacctttgatcctgcccgagtacgtgactctccgcgtccaggtgccgtacaacagcagggggcacgcctgggcgtccttcgacggcaaggaccggaagcagctgtcacccggtgacgccctgatctgcagcatttctccctggcccgtgcccacagcctgcctagtggattcgaccaccgacttcttccgcagcatccatgagggtctccactggaacttgaggaaatcccagtcgtttgacggcccgcgtgattgattcaacagtttctttaccgttccatacttatatacaaaggttgcgtgcgtttagatgtgaggtagtatagacgtatagttgagaatccaaatatatagccatgaccatgcgtgtgtgtacatgattctgtgcttcagtgctccccagatctgaatggaataattggcgagccatacacgtatgacgagatggcagcttgcagtcgtgcgatctgggcacttgtgacgattgatggggaggaagcctccatcctttttt

SEQ ID NO: 1377 - DNA, 2115 bp, Zea mays
gtgctcctcacaccggcctcggcgcctcgcaccacaaccacctcctaccccttctcttcttcttctccccccttgcgaatcggagaccaagtgcaattgcccacccaagccccggaaccgggggccaagagcagtacagggggttggtttctgcgacggcgaggacgcgaagcggattcggatcgcgccgccatgccgctcgacgagctcgccgacaaagggccgtcgtcctccgaggaagttcagctcgcgccgtcggattccaagttccggagcctcagtccttcgccgattccgctcccaactcttccgagcatcagatcattggtccactcggtttctgacgagagtgtaaatgtagatgtcgcggcctcacatcaaagtgaaaatggatctatctctactgttagttcactagaatcagagagggcagcatatgaatttcttgctcaaactcctgtcaggtcaactgatgcacatcttgttgagttttcggaggctatgagaactgttgcaaaagccttacgacgagtggctgaagggaaggctgctgctcaagcagaggcagcggagtggaaacgtaagtatgaattagagacagcgcacaagcatcggagtaaaatcaaaggctacagcagttgtatcaataatgacttagacaaactggtcagccaactaaccctggagacacctacatctgatcaattaggatgttgcggaaagcatggtatatgtgcacatgagattctccaggacgaagttcctgggcctatcccaagatctaatcacaaggtggtggggagaaaggcatcatttaaactttcatggggatgtaatggggataaaaatggacaacataagcatgattttgtgtcctttgaaaaaggtgatataacaaccgcagaacgaagcaataagcagatcttactgaaatgggaatcgccaccacaaacagtgcttttcataaccaaaccgaattccaactctgttcgtgttctttgtgctgaaatgatcagatggcttagggagcataaaaatataaacatctttgttgagccacgtgttagcaaggaacttctaacagaggattcttactacaacttcgtccaaacatgggataatgatgaggagataaagatgctgcgcacaaaggttgatttaattataactcttggtggtgatggaactgttctgtgggctgcatcattgttcaaaggacctgttcctccggttgttgcatttgccctgggatcactgggcttcatgacgcctttcccaagcgagcaataccgtgagttgttggacaatgtgctgaatgggccatttagcatcacgctgagaaaccgcatacagtgtcatgtaatacgtgacgaggcaaaggatgaaatcgtgtctgaggagccattcttagtgttgaacgaagttacaatcgaccgaggaatatcatcctaccttaccaacctggaagtctactgtgacagctcttttgttacttgcgtacaaggggatggactaatcatatcaactacatctggaagtacagcatattcattagcagctggagggtccatggttcatcctcaggtcccagggatccttttcaccccaatctgcccgcactctctgtcattcagacctttgattctgcctgaatacgtgaccctccgcgttcaagtgccgttcaacagcaggggcaatgcctgggcatccttcgacggcaaagaccgacagcagctgtcgcccggtgacgccctgatctgcagcatttctccctggcccgtgcccacagcctgcctggtggactcgacgaccgatttcctccgcagcatccatgagggtctccactggaacttgaggaaatcccagtcatttgacggcccgcgtgattgatgcaacagctgttcagttatatttcagcccggtgccagaattcaagctgggaattctcaacaggaataactgtagctactccagggtgctctcacctttaccgttccatacttgcctatatacaaaggttgcgtgcgttagatgtgaggtatagatagatgtatagaatatggatggatgataacgactggacatgttgaataatacaacgccaacgtatgcacg

SEQ ID NO: 1378 - DNA, 2109 bp, Hordeum vulgare
ggcctttacctgctactgacggacgaatgcctcgttttctctctgccgcaggacgcggcccagctcgcgcagcagccggactcgaggttccggagcctcaacccggggccgatacccatcccggcggcgcccagctccagatcgctgctcgacaaggtttctgatcaaacagtagatctggatctcacagcctcacatcaaagtgaaaatggctccatctctacagttagctctactgttagttcagtggaatcagagaaagcagcttatgaattccttgctcaaactcctatcaagtcaaccgataaacaccttgtggagttttcagaggctatgagaactgttgcaaaagcactgcgacaagttgctgaagggaaggctgctgctcaagcagaggcggcagagtggaaacggaaatacgagttagagacggcgcaaaagcaacaaaccagaatcaaagactgtggcacttgtactgatgataacctagggaaaatggccagccaactatcacttgaggcacctgcatctgatcaaacaggatgttgtggaaaccatgggatatgttcacatgaggttctccaggatgaagttcctgaacctaacgcaagacctagtctcagtatggtgggaagaaaggcatcatttagactttcatggggatgcaatgggaacaaaaacggccagcacaagcatgactttgtttcctttgaaaaaggagacattacaaccgcagagcgcagcagtaaacagatcttgctgaagtgggaatcccggccacaaacagtgcttttcataaccaaacctaactccaactctgttcgtgttctctgtgctgaaatggtcagatggcttaaagagcacaaaaatattaatgtctttgtggaaccctgggttagcaaggaacttctaacagacgattctaaccacacagtgcaaacatgggataatgatgacgacaaaaagatgttgcacaagaaggttgacctcattgtaactcttggcggtgatggaactgttctatgggcggcatcattgttcaaaggaccagttcctccagttgttgctttcgccatgggatcgctgggtttcatgacacctttccaaagcgagaaataccgtcattatttggacaacgtgctgaaggggccttttagcataacgctgagaaaccgtctccagtgtcatgtaatccgggacgcagccaaggacgagctcgtgactgaggatccaatcctagtactgaacgaagttacaatcgaccgcggaatatcatcctaccttacctaccttgagtgctactgcgacagttcattcgtcacatgtgtacaaggggatggactcatcatatcaacgacatcaggaagcacagcatattcgttagcggccggagggtccatggttcacccacaggtccccggcatcctgttcacgccgatctgcccccactcgctgtcgttcaggccgctgatcctgccggagtacgtgacgctgcgcatccaagtgccgtataacagccggggccacgcgtgggcgtccttcgacggcaaggaccggaagcagctggcccccggcgacgcgctcatctgcagcatctccccctggcccgtgccgacggcgtgcctcgtcgactccaccaccgacttcctccgcagcatccacgagggcctccactggaacctcaggaagacgcagtcgctcgacggcccacgcgactgaaggaccgataaatgaaatctgtgttgagccgggcaaaaggcagggcgcccgtggatttggttcgtgttccttttattgtttacctgtagaagttggccggaggtggtagtagtggcatgtatacagtgagtgagtggccacgggttgcttgagcttgatgcaatgtatgacagctcaagtggcaagcgacgatgcgctcatgtgggcgtagtatggggtagtagatgtggccatatggatatggaaattggctgctactcaaaatgtatgtagagaaaatacacacacggcatgtatagtcgcaccgtacccccctccccccatgatgtgaatgaaataatacattcgttggtcaaggaattgcaatctactgcatcagctctgttatac

SEQ ID NO: 1379 - DNA, 2278 bp, Brachypodium distachyon
ggtggtgctcgccatcagcttcccctctcctcgggcttcttcttcggctcgcacgcacgcgcccaaccaccactccgccacccacctcccgcaaatcccacaccacgtagtacgacatacactgccgcccaaccccctgctctgccaaggcgaaaaccaacctccaagcgaaagccaaacggaaatcgaccaacgccgacggccacggcgagcgcgagcgcaggcggaatggatcgcgccgccatgcccgcccaggaggtttctgatcaaagagtaaacctagatgtcataagctcataccaaagtgagaatggatccctctctacagttagctctacagttagttcagaagagtcagagaaagcagcttatgaactccttgctcatactcctatcaagtcaactgatgcacaccttgtggagttttcagaggctatgagaactgttgcaaaagcactgcgacgagttgctgaagggaaagctgctgctcaagcagaggccgcggaatggaagcgtaaatacgagctagagacagcacagaagcaacaaactaaaatcaaagattgtggcagttcaaccggtaataacttagggaaactggccagccaacggacgcttgagacacctgcctctgatcaaacagcgtgttgtgggaaccatgggatatgttcgcatgaggttctccaagacgaagttcctggatctaacccaagatctagtcacaagatggttggaagaaaggcatcatttagactttcatggggatgcaatggggacaaaaacggtcagcacaagcatgactttgtttcctttgaaaagggagatataacaacagcggaacgcagcaataagcagatcttactgagatgggaatcccgaccacagacagtgcttttcataacaaaacctaattccaaccctgttcgtgttctttgtgcggaaatggtcagatggcttaaggagcataaaaatattaatgtctttgtggagccatgggtcagcaaggatcttctgacagaagattccagccacaacttggtccaaacatgggataatgatgaggagagaaaggtgttgcacaaaaaggttgatctcattgtaacacttggcggtgatgggactgttctatgggcagcatcattgttcaaaggaccagttcctccggttgttgcattctccatgggatcactgggtttcatgacacgtttcccaagccaacaatatcgcgattgtttggacaatgtgctgaatggaccttttagcataacactgagaaaccgtctacagtgtcgtgtaatccgtgatgcagcaaaggatgaacttgagactgaggagccaatcctagcactaaacgaagttacgattgaccgtgggatatcatcttaccttacgtacctggagtgctactgtgacagttcttttgttacatgtgtacaaggggatggacttatcatatcaacaacctctggaagcacagcatactcattagcggccggaggatccatggttcatccacaggtcccgggaatacttttcacgccgatctgtccccattccttatccttcaggccgctgatactgccggagtatgtgaccctgcgcgtacaagtgccatacaacagcaggggccacgcgtgggcatctttcgacgggaaagaccggaagcagctggcccccggcgacgctctcatctgcagcatctctccctggcccgtgcccacggcttgcctcgtggattccaccaccgatttcctccacagcatccacgagggcctccattggaacctcaggaagactcaatccctcgacggcccgcgcgattgatggatgcggtgcctttgcccgtggatgcatacctttcctcccaagattttagctgacatcgagaggataaagtgtacctgtgcgagtttgttcttgatactagtatctcctttactgttcagtctatacgtatagaagattgcacttagaagttggaggtagtactagcgcaggcagtgcagaatccaagtatataatggagtggccatggcccatgggttcctgaaactgatgcaaatatgcaatgtactactggaacagcacgggtggcaagcgatacagtagttctactgatctggacagagtatgggagagtagatataatatgggtggcagaagaatgtgggcaaatgtatagtcgcacatgatttcgctgaatgaggaaataatactacgattcgttagacagctgaaggcaatgatctttataatcagattacttgcatcatgtctc

SEQ ID NO: 1380 - DNA, 2155 bp, Secale cereale
ccgcccccaacaagcaagccaaaacacacgcacgctccgcccagcccgaagcggaagccaaacaggaatcgcccacgccgacgactgaggcgaggcggagcggagcagagaaggccatggccacggacgcggcgcggagccagccggatcacgccgccatgccgctgggcgagcccgcccaccaggaggcggtccagcagctcgcgccgcagccggacacgaggctgcggagcctcaacccggggccgatacccatcccggcggcgcccagctccagatcgctgctcgacacggtttccgatcaaacagtaaatctggatctcacaggctcgcatcaaagtgaaaatggctccatctctacagttagctcagtggaatcagagaaagcagcttatgaattccttgctcaaactcctatcaagtcaactgataaacaccttgtggagttttcagaggctatgagaactgttgcaaaagcactgcgacaagttgctgaagggaaggctgctgctcaagcggaggcggcagagtggaagcggaaatatgagttagagacggcgcaaaagcaacaaaccagaatcaaagactgtggcacctgtaccgatgataacctagggaaaatggccagccaactatcacttgaggcacctgcatctgatcaaacaggatgctgtggaaaccatgggatatgttcacacgaggttctccaggacgaagttcctggacctaacccaagacctagtctcagtatggtggggagaaaggcatcatttagactttcatggggatgcaatgggaacaaaaacggccagcacaagcatgactttgtttcctttgaaaaaggagacattacaaccgcagagcgcagcagtaaacagatcttgctgaagtgggaatcccggccacagacagtgcttttcataaccaaacctaactccaactctgttcgtgttctctgtgctgaaatggtcagatggcttaaagagcacagaaatattaatgtctttgtggaaccgtgggtaagcaaggaacttctaacagacgattctaacaatacagtgcaaacatgggataatgatgacgacaaaaagatgttgcacaagaaggttgacctcattgtaactcttggtggtgatggaactgttctgtgggcggcatcattgttcaaaggaccagttcctccagttgttgcattcgccatggggtcactgggtttcatgacacctttcgaaagtgagaaataccgtgattgcctggacaacgtgctgaagggacctttcagcataacactgagaaaccgtctccagtgtcatgtaatccgcgacgcagccaaggacgagatcgtgaccgaggagccaatcctggtgctaaacgaagttacaatcgaccgcggaatatcgtcctaccttacgtacctggaatgctactgcgacagctcattcgtcacatgcgtacaaggggacggactcatcatatcgacgacatcaggaagcacggcgtattcgttagcggccggagggtccatggttcacccgcaggtccccggcatcctgttcacgccgatctgcccccactcgctgtcgttcaggccgctgatcctgccggagtacgtgacgctgcgcatccaagtgccatacaacagccggggccacgcgtgggcgtccttcgacggcaaggaccggaagcagctgttccccggcgatgcgctcatctgcagcatctccccctggcccgtgccgacggcgtgcctcgtcgactccaccaccgacttcctccgcagcatcaacgagggcctccactggaacctccgcaagacgcagacgctcgacggcccgcgcgactgatggatgaatttgtgttgagcttgggcaatggcagggcgcccgtggatttgattcgtgtctgcttactgtttgcctgtagatgttggccggaggtggagtagtggtatgtatgcactatacagtgagcggccacgggttccttgggcttgatgcaatgtatgattgacagcacaagtggcaagcgatgcgctcatgtggatatagtatggggtagtagatgtggccatatggatggaaattggctgctactcaaaatgtagagaatatacgcacggactgtataggcgcgcccccatgatgtgaatgaaata

SEQ ID NO: 1381 - DNA, 2748 bp, Oryza sativa
cataactccaacatttgtgcttcccctctactcctctccacgttagttagagggtacactgatccctttctcttctctagtcgcttcactttagtagccacaggatgatgaatgaatcccacgaccaaacttccaaaccccacgtctcaacagccgattaatcaaatccatcatcccaaatcccgttttcttacagaaaaaagaaaaaaaaacactattcccgaatcccaaacccagacacgaccagcaccagcagcaaaagcgcaagcaaaacacacgcgagcacgcgagtctgaaactgaaggaaaccaaaccaaaaaaaactccaaccatcgtttgcctccctcgctctgacctcctctccctctcctccgcggccggccccgccgcgagcccgccaccctccggcctctgacggcgagcgaccacccaccacctcccgcttgcttcagatctcctcctccctccctcccgccggccgggccccgcgaccgcccgcccgctcgcttcccctcccgccaacgccgcatataacaccccctccctcccttaccgctcaccgaacgcgcggcgtgatcccctccctccctccctccctccgctgcgatcccggccggacccgtcgagctcccgggatctggtcgtggcacgctcaggggaggggctcccggcgggaatggaggtcttcggccccgtcaccgccggccaggtgtcatttttgcttggtctattccctgttctcattgcatggatctattcagaagtcctggagtacagaaaatcttcgtctatgaaagttcactccgattccaatttggagaatggaactgtcaaagaagatgataaaacggtattgctggaaggaggcctgtcaaagtcaccatctacaaagtttcggatcaattctacaaaagcaaacctcataaggtttataacaatggatgaatctttccttctggaaaatcgtgctgtactgagagcaatggcagaatttggcatcgttctggtttatttctacatttgtgatcggacaaacatatttccagaaagcaagaagagttacaaccgtgatctgtttctgtttttatacattcttctcatcatagcatcagcattaacatcacttaagaagcaccatgacaaatcagcattctcagggaaatctatactctatcttaatcgccatcaaacagaggaatggaaaggttggatgcaggtcctgtttttaatgtaccactattttgccgccactgaaatatacaatgcaattcgtgttttcattgctgcctatgtctggatgactggatttgggaacttctcatactattatattaagaaagactttagtcttgccagatttgctcagatgatgtggagacttaatttttttgtggctttctgctgcattgtccttgacaatgattacatgctctattacatatgcccaatgcacactttgtttactcttatggtatatgggtcccttggtctctttaataagtataatgagataccttcagtgatggcaatgaagattgtcagctgcttcttagcagtgatcttgatatgggaaattcctggtgtatttgaactgctgtggagtccatttacatttctgctaggctacaaggacccagagccttcaaaagcaaacttaccactgttgcatgagtggcatttccgatctggccttgatcgttatatatggattattggaatgatctatgcctacttccatccaaatgttgaaagatggatggaaaagcttgaagaatctgaaactaaggttaggttgtcaattaagggaaccatcattagtatttccttggtggctggctatttgtggtacgagtatatttacaaactagacaaaattacatacaacaagtaccatccgtacacatcatggattcctatcactgtttatatctccctaaggaattgcactcagcagcttagaaacgtctctttaactctttttgcgtggcttggcaagattactctggagacctatatctctcagatccacatttggctcaggtctaacatgcctaacgggcagccaaaatggcttctctctttcattccgggttacccactgctcaactttatgcttgctacagcaatatatcttcttatatcatacagagtgtttgagctgacaggtgtgttgaagtcagcttttattcccagcagagataacaatcgtctatatcaaaattttgttgccgggattgccatctccgtatgtctgtatttcctctcaattgtacttcttaagattcccattgtataggtaaaagaacctcaacagacaacacaaatcaatgcatctattatatactagacaacagaaaggttttgtggcgcagttccaggaaaagaaaatgttcacggtagaagtttgcttgtgaattgttgttagaatgatccgtcgaccgtcggcgcctagttccaccttgcagatggagataagtgcactccaaataggaagaggatattgttttccacccctttggaaagtaatgtatacattcaggcagtccttgcgttcttttagaagtaatagttggttgcagacttttagccataaaaagtgtacaaggaatttctgtaaaatcaaagtcactgaaacacccagtggtagattcgtgcattggtcatatttcagagcagctactgtggtgtactttccaatatatgttgaccattgcttaaagcacctttaatgaaaaattaaagcacaac

SEQ ID NO: 1382 - DNA, 2439 bp, Setaria italica
atgaggaagcaagcgagcgagcgaagggtggcaccaaacgcaaccaccacgatcccgtcaacccaaccaaccaacatccaacaaagcgctgcgcccttttccggctttccccccatcatttcccacgtcctccccgcccgcccccgaccgcgaccagccaccgtctcgcccgccccgcctcgccccggcggttgcttcagatctcctcttcccccccaccccgagcgcccagcgcggcagcagcgccaacccgcgcgccattgcacgcgcgcgctgctgctgtcctctggatctgggggtgatcggtcgcaagccgagtcggggggaggagcgggatctcgggcgcacggaatggaggtcttcggccccgtcacgcccggacaggtgtcatttttgctaggtctattccctgtcctcatcgcatggatctactccgaaatcctcgaatacaggaagtcttcatcgcatgggaaagttcattcagatgcaaatttggataatggaaccatcaaggaggaagacaagacggtattacttgaaggaggccagttgaaatcaccatccacaaagttccggaacttgtctaccaaagccaatttgattcggtttataacaatggacgaatcttttctgcttgaacaccgtgctgtactgagagccatggctgagtttggcattgttctggtttatttttatatttgcgaccggacaaacatatttccagaaagcaagaagagctacaaccgtgatctgttcctgtttctgtacattcttcttatcatagcatcagcgcttacctcacttaagaagcaccatgaaaaatcagcatttaccggaaagtccatactctatcttaatcggcaccaaactgaggaatggaaagggtggatgcaggtcttattcctgatgtaccactattttgctgcctcagaaatatacaatgcaattcgtgtgttcattgcttgctatgtctggatgactggatttgggaacttctcatattactatatcaagaaagattttagtattgcaagatttgctcagatgatgtggaggctaaatttctttgtggcattctgttgcattgtccttgacaatgatctcatgctctactatatctgtccaatgcacacactatttactcttatggtttacggagcacttggtctgtttaacaaatacaacgagataccatcagtcatggctattaagattgcttgctgcttcttgtctgtaattttgatatgggaaattcctggggtatttgaactattgtgggccccctttacattcctactaggctataaagatccatcacctgctaaggcacacctaccccttctacatgagtggcatttccgatctggccttgatcgatatatatggattattggaatgatttatgcttacttccaccctaatgttgaaagatggatggagaagctggaagaatctgagactaaggttagattatcaatcaagggaaccatcgtgactctttcagtgatggctggttacctgtggtatgaatatatatacaagctagacaaagttacatacaacaagtaccatccctacacgtcatggatccctataactgcttatatctgcctgcgcaattgcacccagcagttgaggagtgcctctttggctcttttcgcatggcttggcaagattacactggagacttatatttctcagatccacatttggcttaggtctagcatgccaaatggacagccaaaatggcttctttgtttcataccagattatcctatgcttaacttcatgcttacaactgcgatctatcttcttctgtcataccgtgtgtttgagatcacaaatgtcttgaagggggcatttatccccagtagggataacaatcgtctataccaaaattttgttgctgggatcgccatctcagtgtgcctgtatttctgctcacttattcttctgaagattcctgttgtatagggatgaagatataccaaatgaagcaatcttggtagaaaggtcgcttctgcaagatgtttgattgataggatgttttagctctggccacgtttcccgtttgcatcaggagaatagtcggaatacctgaagctgctgctcgtccgaacaactgggacattgaactgccagaggctgcagatatagaagtccaaattttgatctttttgttcgttgaaaacattgtacacaattaggcaaacccgtgcattctttggaagttgtagcaactactagcgtatgttgatacaatacaagccttgtaagagttatcctgtacaattgtaccatagacggggctttcctctttgtaaaaggaaaatatacaggcagagcccacgcatttcaactgtaactaaaatagtattcgcatgatactacatgaggcgccctgaaattcaagactgcttggtgctttcggttcagttc

SEQ ID NO: 1383 - DNA, 2485 bp, Oryza sativa
aggagccccatccccaccaaacgcaacaaccaccacatcccgtcaaccgatgcaaccaaccgcttcgcgtctcctccccgtcattctcctgctgcgcctgcctctgccgccgactccccgctccgctccggcctccctcccgtcccgaccgcgaccagccaccgcccccgtccctcccgcgcgcgcggttgcttcagatctcctcttcccccctccctcacccgccgccaacccctcccgccattacgtagcagtatataaagtcctatccccatcaccctcccatttcgctgcttctccctccctacccgcgccatggcctgctgattgctgctgctgctgctgctgttgactcgtctcccgtggatctggatcttgatccccgcgagaggaatggaggtcttcggccccgtcacgcccggccaagtttcgtttttgctgggtcttttccctgtcctcattggatggatctacgccgaaatcttagaatacaggaaatctttgttgtatgggaaagttcactcggatgctaatttggagaatgagactatgaaggaagatgataaggctgtattacttgaaggagggcagtcaaaatcgccatctacaaagctccgaaacatgtctacaaaagcaaatttaatacggtttataacaatggacgagtcttttctgcttgaaaaccgtgctgtgctaagagcaatggccgaagtgggcattattctggtctacttttacatttgtgaccggacaaatatatttccagaaactaagaagagctacaaccgcgacctgtttctgtttctgtacattcttcttatcatagcatcggcacttacttcacttaagaagcacaatgaaaaatcagctttcactggaaagtcaatactctatcttaatcgtcaccaaactgaggaatggaaagggtggatgcaggtcttgtttctgatgtaccactatttcgctgccacagaaatatacaatgcaattcgggtgttcattgctgcctatgtctggatgactggattcgggaatttctcatattattatatcaagaaagattttagcattgcaagatttgcacagatgatgtggaggctaaatttctttgtggccttctgttgcattgtccttgacaatgattacatgctgtattatatatgtccaatgcacacactttttactctgatggtatacggatcacttggtctgttcaacaagtacaatgagaaaccatctgtcatggctattaagattgcttgctgcttcttgactgtcattttgatatgggaaattcctggggtatttgaatttttatgggccccctttacatttcttctaggatataaggatccagagccttccaaggcaaacttacccctgctacatgagtggcatttccgatctggccttgatcgatacatatggattattggaatgatctatgcttacttccaccctaatgttgaacgttggatggagaagttggaggaatctgagactaaggttagactgtttatcaagggagccattgtcactctttctttgacggctggttacctatggtatgaatatatctacaggctagacaaaattacatacaacaagtaccatccctacacgtcatggattcctatcactgtttatatctgcctacgcaactgcacccagcagttgaggagtgcctccttggctcttttcgcctggcttggcaagatcacactagagacatacatttcccagattcacatttggctcaggtctagcacgccaaatgggcagccaaaatggctcctatcttttgtaccagattatccattgcttaacttcatgcttactacagcaatctatcttcttctatcataccgggtgtttgagatcacaggtgtactgaagggagcttttattcccagtagagacaacaatcggctatatcaaaattttattgcagggattgccatatctgcatgcctgtatttctgctcacttattcttgtgaaaattactattgtataggtagaattgccaagtaaatgaccttgatagaaggtcgttcctgaaaattgtgtgcttggtatctggtggtaagatattcagctcaggcctcaattccattttgcatttggaggtaaagatacagttcccatgaaggacctgccgatcttctagttgggaattgaattgccagaggatgtaggtatagaagtcaaattttgatttatcatttcccccatttaaaacactgtacacagttagcgaagttgtgcattctttgggagttgtagatgctttcctaagttgatacaacagtgtaagaatttcctcccctcaaagcactgtaacatgtggtgtactatacagaatgatactacaaggaagggtttcccttttgtaaaacgaaatataaagggcaagccccaatctttctttctttctttctccttctccatatgcatgcagcatggtacttttggtttatccattg

SEQ ID NO: 1384 - DNA, 2627 bp, Panicum virgatum
tttccccgtcccccctccgcccgcctgaccgcgaccagccaccgactcgcccgctccgcccccgccccccgcggttgcttcagatctcctcttccactccgagcccgagcgccctccagcgcggcagcgccaaccggcgccactgcgcgcgcatataaatcccatccccatcgctctcgccacccgcctacctgctgcgcgtttgctccgcgcgccatgatctgaaccccgggtcggtgcggctaccgtcctctggatctagggggtgatcggtcgccggccgagtcggggggaggagcgggatctcgggcgcacggaatggagatcttcggccccgtcacgcccggacaggtgtcatttttgctaggtttattccctgtcctcatcgcttggatctactccgaaatcctcgaatacaggaagtctttatcacatggcaaagttcattcagatgctaatttggacaacggaaccatcaaggaggatgacaaagcagtattacttgaaggaggccagtcaaaatcaccatctacaaagttcaggaacttgtctaccaaagccaatttaatacggtttataacaatggacgagtcttttctgcttgaaaaccgtgctgtgctgagagccatggctgaatttggcattgttctggtctatttttatatttgtgaccggacaaacatatttccagaaagcaagaagagctacaaccgtgatctgtttctgtttctgtacattcttcttatcatagcgtcagcgcttacttcacttaagaagcaccatgaaaaatcagcatttactgggaagtccatactctatcttaaccgccaccaaactgaggaatggaaagggtggatgcaggtcttatttctgatgtaccactattttgctgcctcagaaatatacaatgcaattcgtgtgttcattgcttgctatgtctggatgactggatttgggaacttctcatattactatatcaagaaagattttagtattgcaagatttgctcagatgatgtggaggcttaatttctttgtggcattctgttgcattgtccttgacaacgatctaatgctctattatatctgcccaatgcacacactgtttactcttatggtatacggatcacttggtctgtttaacaaatacaacgagataccatcagtcatggctattaagattgcttgctgcttcttgtctgtaattttgatatgggaaattcctggggtatttgaactattatgggccccctttacatttctactaggctataaagatccatcacctgctaaggcaaacttaccccttctacatgagtggtatttccgatctggccttgatcgatacatatggattatcggaatgatctatgcttacttccaccctaatgttgaaagatggatggagaagctggaagaatctgagactaaggttagattatcaatcaagggaaccattgtgactctttcgttgatgactggctacctgtggtatgaatacatatacaagctggacaaagttacatacaacaagtaccatccgtacacgtcatggatccctataactgcttatatctgcctgcgcaattgcacccagcagttgaggagtgcctctttggctctttttgcgtggcttggcaagattacactggaaacttatatttctcagatccacatttggcttaggtctagcatgccaaatggacagccaaaatggcttctttgtttcataccagattatcctatgcttaacttcatgcttacaactgcgatctatcttcttctgtcataccgtgtcttcgagatcacaaatgtcttgaagggggcttttatccccagtagggatagcaatcgtctataccaaaattttattgctgggatcgccatctcagtgtgcctgtatttctgctcacttattcttctgaagattcctattgtataggtaacatctggaaagcatattgcatttacagggatgaaagatataccctaggaagcaatcttgatagaaggttgatcctgcaaaatgtttgcttcataggatcttcagctctggcctcaggatgttccctcttgcggttggagatagtcgggatgcctgaatctgctgctcatccgaacagctgggatattgaactgccagaggctgcagatatagaagtccaaattttgatcattttgttcgttgaaaacattgtacacaattaggcaaaatccgtgcattctttggaagttgtagcaactactagcgtatgttgatacaatacagccttgtaagagttgtatcatgtacaattgtaccatagaagggctttccacttgtaaaagaaaatatacaggcagagcccacgcatttcaactgtaacctcatagtattcgcttacgcctagagtcatcctgtctctgctcagaattgtttgttgctacacgaggcaccctgattcaagactgcttgttgctttcaaaccaaacagcggacagtgcatttgtggttggcgcacactgaacgctaacgaagcggctgccgagtgccggacaccgtgcgccagtcgtgcccgcggccgttcgcccactccggcagccggcgatccccgggacgaggggagaacgaaaacaagacaacccgaa

SEQ ID NO: 1385 - DNA, 2064 bp, Pennisetum glaucum
ccccgtcacgcccggacaggtatcatttctgctaggtctattccctgtcctcatcgcatggatctactctgaaatccttgaatacaggaagtccttatcccatgggaaagttcattcggatgctaatttggataatggagcgatcaaggaggatgacaagacggtattacttgaaggaggccagttgaaatcaccatctgcgaagttccggaacttgtctaccaaagccaatttgatacggtttataacaatggacgaatcttttctgcttgaaaaccgtgctgtactgagagccatggctgagtttggcattgtcctggtttatttttatatttgtgaccggacaaacatatttccagaaagcaagaagagctacaaccgcgatctgtttctgtttctgtacattcttcttatcatagcatcagctcttacttcacttaagaagcaccatgataaatcagcattttctggaaaatctatactctatcttaatcgccaccaaactgaggagtggaaagggtggatgcaggtcttatttctgatgtaccactattttgctgcctcagaaatatacaatgcaattcgtattttcattgcttgctatgtctggatgactggatttgggaacttctcatattactatatcaagaaagattttagtattgcaagatttgctcagatgatgtggaggctaaatttctttgtggcattctgttgcattgtccttgacaatgatctcatgctctactatatctgtccaatgcacacactatttactcttatggtatacggatcacttggtctgtttaacaaatacaacgagagaccatcagtcatggctattaagattgcttgctgcttcttatctgtaattttgatatgggaaattcctggggtgtttgaattattgtgggccccctttacattcctactaggctataaagatccatcacccgctaaggcacacctaccccttctacatgagtggcatttccgatctggccttgatcgatacatatggattattggaatgatttatgcttacttccaccctaatgttgaaagatggatggagaagctggaagaatctgagactaaggttagattatcaatcaagggaaccatcgtgactctttccgtgatggctggttacctgtggtatgaatatatatacaagctggacaaagttacatacaacaagtaccatccctacacgtcatggatccctataactgtttatatctgcctgcgcaattgcacccagcagttgaggagtgcctctttggctctttttgcatggcttggcaagattacactggagacttacatttctcagatccacatttggctcaggtctagcacaccaaatggacagccaaaatggcttctctgtttcatacctgattatcctatgcttaacttcatgcttacaactgcgatttatcttcttctgtcataccgtgtgttcgagatcacaaacgtcttgaagggggcttttatccccagtagggataacaatcgtctataccaaaattttgttgctgggatcgccatctcagtgtgcttgtatttctgctcacttattcttctgaagattcctgttgtataggggtgaagatataccaaatgaagcaaatcttgatagaagggtcgctcctgcaagatgtttgattgataggatgtttcagctctggcctcgcttcccatttgcgtcaggggaatagtccgaatgcctggagctgctgctcgtccgaacaactggggacattgaactgtcagaggccgcagatatagatgtccaaattttgatcttttttgtacgttgaaaacattgtacacaattaggcaaacccgtgcattctttggaagttgtagcaactactactagcgtatgttgatacaatacacagccttgtcagagttatcctgtacaattgtaccataggcgggttttccactttgtaaaaggaaaatatacaggcagagcccacgcatttcaactgtaataactaaatagtactccgtattcgcgtgttgctacatgaggcgccctgagattcgaga

SEQ ID NO: 1386 - DNA, 3184 bp, Sorghum bicolor
tccccttcgtcccccatcatttccccctgccccgcccggcacgaccgcgaccagccaccgtctccgcccctgccccgcccgcggttgcttcagatctcctcctccaccaccaccacccccagcagcagcagccaccagccagctcctccccgcaccaggatactccccacccgctcgccacgccattgcgcgcgcgcgcgcgcgcgcatataaatcccacatccccatcgctctcgcctctccccacccgcccgcccgcacgccgcgcccctactacgcagcacgcaccacctcccctccgcgttcggtgaagcggccctggatctgggctgatcggtcgccggccgcgtcggcggggagggaggatcgagatctcggctcgaggggtgcccgccggaatggaggtcttcggccccgtcacgcccggacaggtgtcatttttgctaggtctattccctgtcctcatcgcatggatctactctgaaatcctcgaatacaagaaatctttgtctcatgggaaagttcattcagacactaatttggataatggaaccatcaaggaggatgacaagtcagtattacttgaaggaggacagttgaaatcaccatctacaaagttcaggaatttgtctaccaaagcaaatttgttacggtttataactatggacgagtcttttctgcttgaaaaccgtgctgtactgagagccatggctgaatttggcgttgtcctggtttatttttacatttgtgaccggacaaacatatttccagaaagcaagaagagctacaaccgtgatctgtttctgtttctgtacattcttctcatcatagcatcagcgcttacttcacttaagaagcatcatgaaaaatcagcattttcaggaaagtccatactctatcttaatcgtcaccagactgaggaatggaaagggtggatgcaggtcttatttctgatgtaccattattttgctgctactgagatatacaatgcaatccgtgtgttcattgcttgctatgtctggatgactggatttgggaatttctcatattactatatcaagaaagattttagcattgcaagatttgctcagatgatgtggaggctaaatttctttgtggcattctgttgcattgtccttgacaatgatctcatgctttattatatctgcccaatgcacaccctatttactcttatggtatatggatcacttggtctatttaacaaatacaatgagataccatcaatcatggctattaagattgcttgctgcttcctgtctgtaattttgatatgggaaattcctggggtatttgaactattgtgggccccctttacatttctgctaggctataaagatccatccccatccaaggcacacttacccctgctacatgagtggcatttccgatctggcctcgatcgatacatatggattgttggaatgatttatgcttacttccatcctaatgttgaaagatggatggagaagctggaagaatctgagactaaggttagattatcaatcaagggaaccattgtcactctttcgttgacggctggttttctgtggtacgaatatatatacaagctagacaaagttacatacaacaagtaccatccctacacgtcatggatccctataactgtttatatctgcctgcgtaattgcacccagcagttgaggagtgcctctttggctctttttgcatggcttggcaagattacactagagacttatatttctcagatccatatttggcttaggtctaacatgccaaatggacagccaaaatggcttctttgtttcataccagattatcctatgcttaacttcatgcttactacggcgatctatcttcttctatcataccgtgtgtttgagatcacaagcgtcttgagggcggcctttatccccagtagggataatagccgtctataccaaaatttcattgctgggatcgccatctcagtgtgcttgtatctctgctcacttattctcctgaagattcctgttgtatagggatgaagatacaccaagcaatcttgatagaaggtttcttgtaaaacgtttgcttgataggatgttcaggtctggcctcgattcccttctgctgttgtggagatacttggggatgtcaggagaagcggctaagttggacatatgggaattgggaaattgaattgccagatgctgcagatacagaagtccaatttttgatctttttgttcgttcaaaacactgctgtatacaagtaggcaatccgctcattcttttggaagttgtagcaactactgctcgccagcctatgttgatgcaacctcgtgtaagagttatcctgtagaactgcaccgtgttgtaccataggtattttgatgctgtacaaaaacaacgggcttttcctctttcttgaaaagaagaatataaaggcagagccctttgcttcccccaaatgtaacatttcgctgaaatttggatactactaattgcagatttgttggaagagataaacactgtataatggctgataagacctgctgatgagctcaagcaaacaggacccaccgtcttttgctttggaccatccagtctagcctacctgctctgaactgttcatcctgtacgtgcgtaccgggctcagtcaggctcagaccggtggtaggcacggctcgaacgttcggtggtgccgtcgcccgtcgggcgcaggcggggcagcctcggccgcccgtggtggtcgtcgtcgcgcccggcgccgcttctcacgcgcctgacgccggccggccggggcatcaaggtcaagctttgggttaatgctatggcagatgccgctgggagttggtagtaggttccatcacctcaatcatggagcgagacaatcttggattcttggtgcaacctacccaacttcaaatcccgtctttcacgcaagaactaaatacactctagtgtggacttggacttgaagaaagtcttggagtagttcaagcacagttcgtcgtctttgagaaaaaaaaaaaagaaacacagttcatctgcaggctaatagctttgtcgatgacttttaggattgtgatgggcagctaatataaccccaactccccaactaacgtgcgataaactgtagggtatatctagcatcgtgtgttcagcaatatgagatcttttgttgtttgtttgttccccat

SEQ ID NO: 1387 - DNA, 2537 bp, Brachypodium distachyon
aaaaaaaagaaaaaaaagggtagtaggaggcaccaccaaacgcaaaccacccaccgtcgaccaaccaaccaacggcaggcggcagcgcttcttcttcttcctccgtcatttcccttccccgtccggcccgaccgcgaccagccaccgccccccgcgcttgcttcagatctcctcctccacctccctccctcccgcctttcctgagatatatatatataaatcctctcgaccgacctatccccatcacgctcctccccacccacccacccgtacgcacacacgcgcttccccctcttcgtccctcccatggtctgctgatccacgagcgcgcggctcttcttctggtggatctggtgcgcgtggatcgggatctcggccgacccggggagatcgatggaggtcttcggccccgtcacgcccggccaggtctcatttctgcttggccttttcccagtcctcattgcatggacctatgccgagatcctggaataccggaaatctttgtcacacgggaaagttcactcagatgctacattggagaatgaaactacgaaggaagatgagaaggctatattaattgaaggaggccagttgaaatcaccatctgtaaagttccggaatatgtctaccaaagcaaatttaatacggtttataacaatggacgagtcctttctgcttgaaaaccgtgctgtactgagagccatggccgaatttggcgttgttctggtgtacttttacatttgtgaccggacaaacatatttccagaaagcaagaagaactacaaccgcgatttgttcctgtttctgtacattcttctcatcatagcatcggctcttacttcacttaagaagcaccaggaaaaatctgcattttctggaaagtccatactctatcttaatcgccaccaaactgaggaatggaaagggtggatgcaggttttgtttctgatgtaccactatttcgctgcctttgaaatatacaatgcaattcgtgtgttcattgcttgctatgtttggatgactggatttgggaacttctcgtactactatatcaagaaagattttagcattgccagatttgctcagatgatgtggaggctaaatttctttgttgccttctgttgcattgtccttgacaatgattttatgctgtactatatctgccccatgcataccctatttacgcttatggtgtacggatcacttggtctgtttaacaagtataatgaggtgccatcagtcatggctattaagattgcttgctgcttcttgagtgtcattttgatatgggagattcctggggtctttgaaattttgtgggccccttttacgtttctgctcggctataaagatccagagccttctaagtcaaacttgcccttattgcatgagtggcattttcgatctggccttgatcgatacatatggattatcggaatgatttatgcttacttccaccctaacgtggaaagatggatggagaaactggaagaatctgagaccaaagttagattgtcgatcaagggtaccattgtgaccctttcggtcatggctgcttatctatggtatgaatatatctacaagctagacaaaatcacgtacaacaagtaccacccctacacgtcatggattcctatcaccgcatatatttgcctacgcaattgcacccaacagttgaggggcgcatcgttagctcttttcgcttggcttggcaaggtcacactcgagacttatatttctcagatccacatttggctcaggtctagcataccaaacgggcagccaaaatggcttctctctttcataccagattatccgatgctcaacttcatgcttactacaacaatctatctttttctatcataccgggtatttgagctcacaaacgtgctgaagaatgcctttgttcccagtagagacaacaatcgcctgtatcagaattttattgctgggattgccatctctgtatgcctgtattgctgctcgcttattcttctgaaaattcctgttgtataggtaaacagttccattttcgatggatgtagaattgccaagtaaatgatgttggtggaaggctgcttcttcagaaacatttgcctgtaggatgctgttcagttttggcatcagttccgtttatacctggaggtaaaaggcactccctgaagaagacgcctaactgcataagctgggaactgaatggcctgtacaatttttgatcttttttttgttcccttcctctcaaaagaactgtacacagttagccaacccatgcattctctggaagtttgtagcagcagcccccggaaggctgacacacgaccatgtaagagctgggaatttctctacgagcattgccagtgtgatgtaaccattcatagagatccattcatgcgaggaagggatttcctcttgtagaaaagaaaagatatgaatgcaaacccacgctttcttccaagctttgcttcttgatctcaatcaaagtttgaagttcgaatttcggcaaatacttgcttctgaaccgctggtggtccagctcc

SEQ ID NO: 1388 - DNA, 2164 bp, Triticum aestivum
ccgcccgcgccgccgctgggatcgggatcgggatctcgcgcgggagggacgggcatggaggtcttcggccccgtcacgccaggccaggtgtcatttttacttggtcttttcccggtcctcattgcatgggtctactccgagatcctggagtacaagaaatcttcgttacatgggaaagttcactcagatgctactttggaaaatgaaacttccaaggaagatgagaaggctatattaatcgaaggaggccagttgaaatcaccatcggcgaaattccggaacatgtctaccaaagccaatttaatacggtttataacaatggacgagccttttctgttagaaaaccgcgctgtactgagagccatggctgaatttggcattgtgctggtttacttttacatttgtgaccggacaaacatatttccagagagcaagaagaactacaacagagacctgtttctgtttctgtacattcttctcatcatagcatcagcacttacttcacttaagaagcaccaggagaaatcagcattttctggaaagtccatactttatcttaatcgccaccaaactgaggaatggaaagggtggatgcaggtcttatttctgatgtaccactattttggcgcatcagaaatatataatgcaatccgtgttttcattgcttgctatgtttggatgactggatttgggaatttctcgtactattatatcaagaaagattttagcattgcaagatttgcacagatgatgtggaggctaaatttctttgtggctttctgttgcattgtccttgacaatgattttatgttgtactatatctgcccaatgcacaccctatttacacttatggtgtacgcatcacttggcctgtttaacaagtataatgagataccatcagttatggctattaagattgctggctgcttcttggctgtcatcttgatatgggaagttcctggggtattcgaaattttgtgggccccctttacgttcctgcttggctataaagatccagagccttctaagtcacacttacccttgttgcatgagtggcatttccgatctgggcttgatcggtacatatggattattggaatgatttatgcttacttccaccctaatgtggaaagatggatggagaagctggaagaatctgagactaaggttaggttgtcgatcaagggtaccattgtgactctttcggtcctggctggctatctgtggtatgaatatatctacaggctggacaaaattacgtacaacaagtaccatccctacacgtcatggattcctatcactgtatatatttgcctacgcaattgcacccaacagttgaggggcgcttctttggctcttttcgcttggcttggcaaggtcacactggagacttatatttctcagatccacatttggctcaggtctagtgtaccaaacgggcagcccaaatggcttctgtctttcataccgggctacccgatgcttaacttcatgctaacgacatcaatctatcttttgctatcataccgggtatttgagatcacaaacgtgctgagggcagccttcattcccagcagagacaacaaccgcctgtaccagaatttcgttgccggggttgccatctccgtatgtctgtattgctgctcactcgttcttctaaaaattccggctgtatagatgaatagttcttatggatgtagaattgccaagtaaatgataccggtggaaggctggctgcttcttccacacgcacaaaagaggtttgcttggcggggatgctcggttccatttgcatctaggggatcccctaaggagctgcccttgggaacttgatcgctgtggagggagacgcaaatttttgatcatttttcttcttgttgtaaaagccaacccattcttctgggagttgtaacagctgtcggccgtgtaactgtcaactttggtgtgcaccttgttgttttgtaacatgtcttagatattcttcttctatacatacgaggaaagcgtttccctcctgtaaaaaagaaatagcgagttgaactgtgaggcataccttgtcgtgctccgaattatttctgagttattttgagaagggcgaatgggggaagggccccatggagcctgatactcaaatgccatctttatgccttgcaaaagaagaaaa

SEQ ID NO: 1389 - DNA, 2254 bp, Triticum aestivum
ccctccgccacgccaaccccaaccccaatcccaccccctccggccattgcgctccccacacatatataagccctatccccatcacctagcccgcgacctcgccgtccgtctccctcccccgtccaactcgctctcctgccctgctcgaggggcatggcctgctgacgactgatctggtacagaatcctctcccggatctgaccggcccgccggcgccgctgctgggatcgggatcgggatctcgcgcgggagggacgggcatggaggtcttcggccccgtcacccccggccaggtgtcatttttacttggtcttttcccggtcctcattgcatgggtctactccgagatcctggagtacaagaaatcttcgttacatgggaaagttcactcagatgctactttggaaaatgaaacttccaaggaagatgagaaggctatattaattgaaggaggccagttgaaatcaccatcggccaaattccggaacatgtctaccaaagccaatttaatacggtttataacaatggacgagccttttctgcttgaaaaccgtgctgtactgagagccatggctgaatttggcattgtgctggtttacttttacatttgtgaccggacaaacatatttccagaaagcaagaagaactacaacagagacctgtttctgtttctgtacattcttctcatcatagcatcagcacttacttcacttaagaagcaccaggagaaatcagcattttctggaaagtccatactctatcttaatcgccaccaaactgaggaatggaaagggtggatgcaggtcttatttctgatgtaccactattttggcgcgtcagaaatatacaatgcaattcgtgttttcattgcttgctatgtttggatgactggatttgggaatttctcgtactattatatcaagaaagattttagcattgcaagatttgcacagatgatgtggaggctaaatttctttgtggctttctgttgcattgtccttgacaatgattttatgttgtactatatctgcccaatgcacaccctatttacacttatggtgtacgcatcacttggcctgtttaacaagtataatgagataccatcagttatggctattaagattgctggctgcttcttggctgtcatcttgatatgggaagttcctggggtattcgaaattttgtgggccccctttacgttcctgcttggctataaagatccagagccttctaagtcacacttacccttgttgcatgagtggcatttccgatctgggcttgatcggtacatatggattattggaatgatttatgcttacttccaccctaatgtggaaagatggatggagaagctggaagaatctgagactaaggttaggttgtcgatcaagggtaccattgtgactctttcggtcctggctggctatctgtggtatgaatatatctacaggctggacaaaattacgtacaacaagtaccatccctacacgtcatggattcctatcactgtatatatttgcctacgcaattgcacccaacagttgaggggcgcttctttggctcttttcgcttggcttggcaaggtcacactggagacttatatttctcagatccacatttggctcaggtctagtgtaccaaacgggcagcccaaatggcttctgtctttcataccgggctacccgatgcttaacttcatgctaacgacatcaatctatcttttgctatcataccgggtatttgagatcacaaacgtgctgagggcagccttcattcccagcagagacaacaaccgcctgtaccagaatttcgttgccggggttgccatctccgtatgtctgtattgctgctcactcgttcttctaaaaattccggctgtatagatgaatagttcttatggatgtagaattgccaagtaaatgataccggtggaaggctggctgcttcttccacacgcacaaaagaggtttgcttggcggggatgctcggttccatttgcatctaggggatcccctaaggagctgcccttgggaacttgatcgctgtggagggagacgcaaatttttgatcatttttcttcttgttgtaaaagccaacccattcttctgggagttgtaacagctgtcggccgtgtaactgtcaactttggtgtgcaccttgttgttttgtaacatgtcttagatattcttcttctatacatacgaggaaagcgtttccctcctgtaaaaaagaaatagcgagttgaactgtgagg

SEQ ID NO: 1390 - DNA, 2522 bp, Hordeum vulgare
atccctagtcgagtcgaccaaccctgctgccccttttccccatcatttcccccgcccgtcggtccgtccgtccgtcgggcccgaccgcgaccagccaccgccccgtcgctgcttgggttgcttcagatctcctcctccacctccaccctccaccctccgccctgggaagggatctcactccctctccctctcccgccattgcagcctccacgcacatatataaacgccctatccccatcacctcctgcccatggtccgctgctgactgatttggtaccaatcctcccccggatctgacccgcccgcccgcgctgccgccgctgggatcggccgggatccggatctcgctcgcgcgggaggggacggccatggaggtcttcggccccgtcacgcccggccaggtgtcatttttacttggtcttttcccggtcctcattgcatgggtctactctgagattctggagtacaagaaatcttcattacatgggaaagttcactcagatgctactttggaaaatgaaacttccaaggaagatgaaaaggctatattaattgaaggaggccagttgaaatcaccatcggcgaaattccggaacatgtctaccaaagccaatttaatacggtttataacaatggatgagccttttctgcttgaaaaccgtgctgtactgagagccatggctgaatttggaattgtgctggtttacttttacatctgtgaccggacaaacatattcccagaaagcaagaagaactacaaccgggacctgtttctgtttctgtacattcttctcatcatagcatcggcacttacttcacttaagaagcaccaggagaaatcagcattttctggaaagtccatactctatcttaaccgccaccaaactgaggaatggaaagggtggatgcaggtcttatttttgatgtaccactatttcggcgcatcagaaatatacaacgcaattcgtgttttcattgcttgctatgtttggatgactggatttgggaatttctcgtactattatatcaagaaagattttagcattgcaagatttgctcagatgatgtggaggctaaatttctttgtggccttctgttgcattgtccttgacaatgattttatgctgtactatatctgcccaatgcacaccctatttacacttatggtgtacgcatcacttggcctgtttaacaagtataatgagataccatcagttatggctattaagattgctggctgcttcttggctgtcattttgatatgggaagttcctggggtattcgaaattttgtgggccccctttacgtttctgcttggctataaagatccagagccttctaagtcacacttacccttattgcatgaatggcatttccgatctgggcttgatcggtacatatggattattggaatgatttatgcttacttccaccctaatgtggaaagatggatggagaagctggaagagtcggagaccaaggttaggttgtcgatcaagggtaccattgtgactgtttcggtcgtggctgggtatctgtggtatgaatatatctacaggctggacaaaattacgtacaacaagtaccatccctacacgtcatggattcctatcactgtatatatttgcctacgcaattgcacccaacagttgaggggcgcttctatggctcttttcgcttggcttggcaaggtcaccctggagacttatatttcccagatccacatttggctcaggtctagtgtaccaaacgggcagcccaaatggcttctgtctttcattccgggctacccgatgcttaacttcatgctaacgacatcaatctatcttttgctgtcataccgagtatttgagatcacaaacgtgctgagggcagccttcattcccagtagagacaacaaccgcctgtaccagaatttcatcgccggggttgccatctccgtatgtctgtattgctgctcactcgtccttctaaaaattccggctgtatagatgaatagttcttacggatgtagaattgccaagtaaatgataccggtggaaggctgcttcttccacgcgcacaaaagaagttcgcttggcggggatgcccggatccatttgcatctaggggctcccctaagaagctgcccttgggaacttggatcactgcggagggagacgcaaatttttgatcattttttttcttctttgtaaaagccaacccattcttctgggagttgtaacagctgtcagccgtgtaactgtcaaccttggtgtgcacattgttgttttgtaacatgtcttagatatattcttctatacatacaaggaatgcgtttccctcttgtaaaaaagaaatagcgagtcaactcatgaactgtgaagcatacccttgtcgtgctccgaattatttcctagttatttcgagaagggcaaatgggggaagggctccatggagcctgatactcaaatgccatctttttgccttgcaaaaaaaaaaaactaaaagtgtgtgcatacacatatatatttcttttgaac

SEQ ID NO: 1391 - DNA, 2263 bp, Secale cereale
cctacctccccacccgccgccacctccaatcccactccctcccgccattgcagtctccctccacatatatatacgccctatccccatcacctagcccgcgacctcgccgtccctctctcccccgcgtctcctgccctgctcgcggggcatggcctgctgacgactcattcggtacgaatcctcccccggatctgacccgcccgcccgcgccgccgctcctgggatcgggatcgggatctcgcgccggagggacggcatggaggtcttcggccccgtcacgcccggccaggtgtcatttttacttggtcttttcccggtcctcattgcatgggtctactccgagatcctggagtacaagaaatcttcgctacatgggaaagttcactcagatgctactttggaaaatgagacttccaaggaagatgagaaggctatattgattgaaggaggccagttgaaatcaccatcggccaaattccggaacatgtctaccaaagccaatctgatacggtttataacaatggatgagccttttctgctagaaaaccgtgctgtattgagagccatggctgaatttggcattgtactggtttatttttacatttgtgaccggacaaacatattcccagaaagcaagaagaactacaacagagacctgtttctgtttctgtacattcttctcatcatagcatcagcacttacttcacttaagaagcaccaggagaaatcagcattttctggaaagtccatactctatcttaatcgccaccaaactgaggaatggaaagggtggatgcaggttttatttctgatgtaccactattttggcgcatcagaaatatacaatgcaattcgtgttttcattgcttgctatgtttggatgactggatttgggaatttctcatactattatatcaagaaagattttagcattgcaagatttgcacagatgatgtggaggctaaatttctttgtggctttctgttgcattgtccttgacaatgattttatgttgtactatatctgcccaatgcacaccctatttacacttatggtgtacgcatcacttggcctgtttaacaagtataatgagataccatcagttatggctattaagattgctggctgcttcttggctgtcattttgatatgggaagttcctggggtattcgaaattttgtgggccccctttacgtttctgcttggctataaagatccagagccttctaagtcacatttacccttattgcatgagtggcatttccgatctgggcttgatcggtacatatggattgttggaatgatttatgcttacttccaccctaatgtggaaaaatggatggagaagctggaagaatctgagactaaggttaggttgtcaatcaagggtaccattgtgactctttcggtcctggctggctatctgtggtatgaatatatctacaggctggacaaaattacgtacaacaagtaccatccctacacgtcatggattcctatcactgtatatatttgcctacgcaattgcacccaacagttgaggggcgcttctttggctcttttcgcttggcttggcaaggtcacactggagacttatatttctcagatccacatttggctcaggtctagcgtaccaaacgggcagcccaaatggcttctgtctttcataccgggctacccgatgcttaacttcatgctaacgacatcaatctatcttttgctgtcataccgagtatttgagatcacaaacgtgctgagggcagccttcattcccagcagagacaacaaccgcctgtaccagaatttcgttgccggggtcgccatctccgtatgcctgtactgctgctcactcgttcttctaaaaattccggctgtatagatgaatagttgttatggatgtagaattgccaagtacgtaaatgataccggtggaaggcggcttcttcttccacatgcacaaaagaggtttgcttggcgggggtgctcggttccatttgcatctaggggctcccctgagaagctgcccttgggaagtttgtcgctggagggagacgcaaattttggatcatcttttttcctgttgtaaaagccaacccattcttctgggagttgtaacagctgtcaactctggtgtgcacattgttgttttgtaacatgtcttagatatattcttctatacataccaaggaaagcgtttccctcctgtaaaaatgaaatagcagagtcaaatcatcaactgtgaagcataccttgtcgtgctctg

SEQ ID NO: 1392 - DNA, 2093 bp, Triticum aestivum
tggaggtcttcggccccgtcacgcccggccaggtgtcatttttactcggtcttttcccggtcctcattgcatgggtctactccgagatcctggagtacaagaaatcttcgttacatgggaaagttcactcagatgctactttggaaaatgaaacctccaaggaagatgagaaggctatattaattgaaggaggccagttgaaatcaccatcggcgaaattccggaacatgtctaccaaagccaatttaatacggtttataacaatggatgagccttttctgctagaaaaccgtgctgtactgagagccatggctgaatttggcattgtgctggtttacttttacatttgtgaccggacaaacatatttccagaaagcaagaagaactacaacagagacctgtttctgttcctgtacattcttcttatcatagcatcagcacttacttcacttaagaagcaccaggagaaatcagcgttttctggaaagtccatactctatcttaaccgccaccaaactgaggaatggaaagggtggatgcaggtcttatttctgatgtaccactattttggcgcgtcagaaatatacaatgcaattcgtgttttcattgcttgctatgtttggatgactggatttgggaatttctcgtactattatatcaagaaagattttagcattgcaagatttgcacagatgatgtggaggctaaatttctttgtggctttctgttgcattgtccttgacaatgattttatgttgtactatatctgcccaatgcacaccctatttacacttatggtgtacgcatcacttggcctgtttaacaagtataatgagataccatcagttatggctattaagattgctggctgcttcttggctgtcattttgatatgggaagttcctggggtattcgaaattttgtgggccccctttacgttcctgcttggctataaagatccagagccttctaagtcacacttacccttattgcatgagtggcatttccgatctgggcttgatcggtacatatggattgttggaatgatctatgcttactttcaccctaatgtggaaagatggatggagaagctggaagaatctgagactaaggttaggttgtcgatcaagggtaccattgtgactctttcagtcctggctggctatctgtggtatgaatatatctacaggctggacaaaattacgtacaacaagtaccatccgtacacgtcatggattcctatcactgtatatatttgcctacgcaattgcacccaacagttgaggggcgcttctttggctctttttgcttggcttggcaaggtcactctggagacttatatttcccagatccacatttggctcaggtctagtgtaccaaacgggcagcccaaatggcttctgtctttcataccgggttacccgatgcttaacttcatgctaacgacatcaatctatcttttgctatcataccgggtatttgagatcacaaacgtgttgagggcagccttcattcctagcagagataacaaccgcctgtaccagaatttcgttgccggggttgtcatctctgtatgtctgtattgctgctcactcgttcttctaaaaattccggctgtatagatgaatagttcttatggatgtagaattgccaagtaaatgataccggtggaaggctgcttcttccacacgcacaaacgaggtttgcttggcggggatgcccggtcccatttgcatctaggggctcccctaagaagctgcccttgggaacttgatcgccgtggagggagacgcaaatttttgatcatttttcttgttgtaaaagccaacccattcttctgggagttgtaacagctgtcagccgtgtaactgtcaactttggtgtgcaccttgttgttttgtaacctgtcttagatattcttctatacatacaaggaaagcgtttccctcctgtaaaaaagaaatagcgagtcaacgcatgaactgtgaagcataccttgtcgtgctctgaattattttcgagttattttgagaagggcaaatgggggaaaggcaaatggagcctgacactcaaataccatctttatgccttgc

SEQ ID NO: 1393 - DNA, 2101 bp, Secale cereale
ctcctgccctgctcgcggggcatggcctgctgacgactcattcggtacgaaccctctcccggatctgacccgcccgcccgcgccgccgctcctgggatcgggatcgggatctcgcgccggagggacggcatggaggtcttcggccccgtcacgcccggccaggtgtcatttttacttggtcttttcccggtcctcattgcatgggtctactccgagatcctggagtacaagaaatcttcgctacatgggaaagttcactcagatgctactttggaaaatgagacttccaaggaagatgagaaggctatattgattgaaggaggccagttgaaatcaccatcggccaaattccggaacatgtctaccaaagccaatctgatacggtttataacaatggatgagccttttctgctagaaaaccgtgctgtattgagagccatggctgaatttggcattgtactggtttatttttacatttgtgaccggacaaacatattcccagaaagcaagaagaactacaacagagacctgtttctgtttctgtacattcttctcatcatagcatcagcacttacttcacttaagaagcaccaggagaaatcagcattttctggaaagtccatactctatcttaatcgccaccaaactgaggaatggaaagggtggatgcaggtcttatttctgatgtaccactattttggcgcgtcagaaatatacaatgcaattcgtgttttcattgcttgctatgtttggatgactggatttgggaatttctcgtactattatatcaagaaagattttagcattgcaagatttgcacagatgatgtggaggctaaatttctttgtggctttctgttgcattgtccttgacaatgattttatgttgtactatatctgcccaatgcacaccctatttacacttatggtgtacgcatcacttggcctgtttaacaagtataatgagataccttcagttatggctattaagattgctggctgcttcttggctgtcattttgatatgggaagttcctggggtattcgaaattttgtgggccccctttacgtttctgcttggctataaagatccagagccttctaagtcacacttacccttattgcatgagtggcatttccgatctgggcttgatcggtacatatggattgtaggaatgatttatgcttacttccaccctaatgtggaaaaatggatggagaagctggaagaatctgagactaaggttaggttgtcgatcaagggtaccattgtgactctttcagtcctggctggctatctgtggtatgaatatatctacaggctggacaaaattacgtacaacaagtaccatccctacacgtcatggattcctatcactgtatatatttgcctacgcaattgcacccaacagttgaggggcgcttctttggctcttttcgcttggcttggcaaggtcacactggagacttatatttctcagatccacatttggctcaggtctagcgtaccaaacgggcagcccaaatggcttctgtctttcataccgggctacccgatgcttaacttcatgctaacgacatcaatctatcttttgctgtcataccgagtatttgagatcacaaacgtgctgagggcagccttcattcccagcagagacaacaaccgcctgtaccagaatttcattgcgggggtcgccatctccgtatgcctgtactgctgctcactcgttcttctaaaaattccggctgtatagatgaatagttgttatggatgtagaattgcgaagtacgtaaatgataccggtggaaggcggcttcttcttcttccacacgcagaaaagaggtttgcttggcgagggtgctcggatcccccgagaagctgcccttgggaactttgtcgtcgtggagggagacgcaaattttggatcatcttttttcctgttgtaaaagccaacccattcttctgggagttgtaacagctgtcggctctggtgtgcacattgttgttttgtaacatgtcttagatacattcttctatatatacaaggaagcgtttccctcctgtaaaaattgaaatagcagagtcaaatcatcaactgtgaa

SEQ ID NO: 1394 - DNA, 2421 bp, Secale cereale
ttgcagtctccctccacatatatatacgccctatccccatcacctagcccgcgacctcgccgtccctctctcccccgcgtctcctgccctgctcgcggggcatggcctgctgacgactcattcggtacgaatcctcccccggatctgacccgcccgcccgcgccgccgctcctgggatcgggatcgggatctcgcgccggagggacggcatggaggtcttcggccccgtcacgcccggccaggtgtcatttttacttggtcttttcccggtcctcattgcatgggtctactccgaggtcctggagtacaagaaatcttcgctacatgggaaagttcactcagatgctactttggaaaatgaaacttccaaggaagatgagaaggctatcttaattgaaggaggccagttgaaatcaccatcggcgaaattccggaacatgtctaccaaagccaatctaatacggtttataacaatggatgagccttttctgctagaaaaccgtgctgtattgagagccatggctgaatttggcattgtactggtttatttttacatttgtgaccggacaaacatattcccagaaagcaagaagaactacaatcgggacctgtttctgtttctgtatattcttctcatcatagcatcggcacttacttcacttaagaagcaccaggagaaatcagcattttctggaaagtccatactctatcttaaccgccaccaaactgaggaatggaaagggtggatgcaggtcttatttctgatgtaccactatttcggtgcgtcagaaatatacaatgcaattcgtgttttcattgcttgctatgtttggatgactggatttggaaatttctcgtactattatatcaagaaagattttagcattgcaagatttgcacagatgatgtggaggctaaatttctttgtggctttctgctgcattgttcttgacaatgattttatgttgtattatatctgcccaatgcacaccctatttacacttatggtgtatgcatcacttggcctgtttaacaagtataatgagataccatcagttatggctattaagattgctggctgcttcttggctgtcattttgatatgggaagttcctggggtattcgaaattttgtgggccccctttacgtttctgcttggctataaagatccagagccttctaagtcacatttacccttattgcatgagtggcatttccgatctgggcttgatcggtacatatggattgttggaatgatttatgcttacttccaccctaatgtggaaaaatggatggagaagctggaagaatctgagactaaggttaggttgtcgatcaagggtaccattgtgactctttcagtcctggctggctatctgtggtatgaatacatctacaggctggacaaaattacgtacaacaagtaccatccctacacgtcatggattcctatcactgtatatatttgcctacgcaattgcacccaacagttgaggggcgcttctttggctcttttcgcttggcttggcaaggtcacactggagacttatatttctcagatccacatttggctcaggtctagcgtaccaaacgggcagcccaaatggcttctgtctttcataccgggctacccgatgcttaacttcatgctaacgacatcaatctatcttttgctgtcataccgagtatttgagatcacaaacgtgctgagggcagccttcattccgagcagagacaacaaccgcctgtaccagaatttcgttgcgggggtcgccatctccgtgtgcctgtactgctgctcactcgttcttctaaaaattccggctgtatagatgaatagttgttattgatgtagaattgccaagtacgtaaatgataccggtggaaggctgcttcttcttcttccacacgcagaaaagaggtttgcttggcgggggtgctcggatcccctgagaagcttagtcgtcgtggaggaagacgcaaattttggatcatcttttttcctgttgtaaaagccaacccattcttctgggagttgtaacagctgtcggctctggtgtgcacattgttgttttgtaacatgtcttagatacattcttctatatatacaaggaagcgtttccctcctgtaaaaattgaaatagcagagtcaaatcatcaactgtgaagcatacctcgtcgtgctctgaattatttccaagttatttcgagaagggcaaatgggggaagggctccatggagcctgatactcgaatacaatctttatgccttgcaaaagaaaaagaaaaaactgaaaaagtgtgcatacacatatactgtgtataccttgtatgtgcgaatttttatgaagcggagtaatatactttcatatgtggcgtacaaaaaagaccaatatgtacatgaaaatggggcttggatttc

SEQ ID NO: 1395 - DNA, 2073 bp, Triticum aestivum
ccgtcacccccggccaggtgtcatttttacttggtcttttcccggtcctcattgcatgggtctactccgagatcctggagtacaagaaatcttcgttacatgggaaagttcactcagatgctactttggaaaatgaaacttccaaggaagatgagaaggctatattaattgaaggaggccagttgaaatcaccatcggccaaattccggaacatgtctaccaaagccaatttaatacggtttataacaatggacgagccttttctgcttgaaaaccgtgctgtactgagagccatggctgaatttggcattgtgctggtttacttttacatttgtgaccggacaaacatatttccagaaagcaagaagaactacaacagagacctgtttctgtttctgtacattcttctcatcatagcatcagcacttacttcacttaagaagcaccaggagaaatcagcattttctggaaagtccatactctatcttaatcgccaccaaactgaggaatggaaagggtggatgcaggtcttatttctgatgtaccactattttggcgcgtcagaaatatacaatgcaattcgtgttttcattgcttgctatgtttggatgactggatttgggaatttctcgtactattatatcaagaaagattttagcattgcaagatttgcacagatgatgtggaggctaaatttctttgtggctttctgttgcattgtccttgacaatgattttatgttgtactatatctgcccaatgcacaccctatttacacttatggtgtacgcatcacttggcctgtttaacaagtataatgagataccatcagttatggctattaagattgctggctgcttcttggccgtcattttgatttgggaagttcctggggtattcgaaattttgtgggccccctttacgttcctgcttggctataaagatccagagccttctaagtcacacttacccttattgcatgagtggcatttccgatctgggcttgatcggtacatttggattattggaatgatttatgcctacttccaccctaatgtggaaagatggatggagaagctggaagaatctgagactaaggttaggttgtcgatcaagggtaccattgtgactctttcggtcctggctggctatctgtggtatgaatatatctacaggctggataaaattacgtacaacaagtaccatccctacacgtcatggattcctatcactgtatatatttgcctacgcaattgcacccagcagttgaggggcgcttctttggctctcttcgcttggcttggcaaggtcacactggagacttatatttcccagatccacatttggctcaggtctagtgtaccaaatgggcagcccaaatggcttctgtctttcataccgggctacccgatgcttaacttcatgctaacgacatcaatctatcttttgctatcataccgggtatttgagatcacaaacgtgctgagggcagccttcattcccagcagagacaacaaccgcctgtaccagaatttcgttgcgggggttgccatctccgtatgtctgtattgctgctcgctcgttcttctaaaaattccggctgtatagatgaatagttcgtatggatgtagaattgccaagtaaatgataccggtggaaggctggctgcttcttccacgcgcacaaaagaggttcgcttggcggggatgctcggttccattcaggggatcccctaagaagctgcccttgggaacctgatcgccgtggagggagacgcaaatttttgatcatcttttttcttgttgtaaaagccaacccattcttctgggagttgtaacagctgtcaaccgtgtaactgtcaactttggtgtgcacattgttgttttgtaacatgtcttagatatattctttctatacatacaaggaaagcgtttccctcctgtaaaaagaaatagtgagttgaactgtgaagcataccttgtcgtgctccgaattatttctgagctatttcgagaagggccagcgggggaagggctccatggagcctgacactcaaataccatttatgccttgc

SEQ ID NO: 1396 - DNA, 2139 bp, Secale cereale
cgccgctcctgggatcgggatcgggatctcgcgccggagggacgggcatggaggtcttcggccccgtcacgcccggccaggtgtcatttttacttggtcttttcccggtcctcattgcatgggtctactccgagatcctggagtacaagaaatcttcgctacatgggaaagttcactcagatgctactttggaaaatgagacttccaaggaagatgagaaggctatattgattgaaggaggccagttgaaatcaccatcggccaaattccggaacatgtctaccaaagccaatttaatacggtttataacaatggatgagccttttctgctagaaaaccgtgctgtactgagagccatggctgaatttggcattgtgttggtttacttttacatttgtgaccggacaaacatatttccagaaagcaagaagaactacaacagagacctgtttctgtttctgtacattcttctcatcatagcatcagcacttacttcacttaagaagcaccaggagaaatcagcattttctggaaagtccatactctatcttaatcgccaccaaactgaggaatggaaagggtggatgcaggtcttatttctgatgtaccactattttggcgcgtcagaaatatacaatgcaattcgtgtttcattgcttgctatgtttggatgactggatttgggaatttctcgtactattatactcaagaaagatttttagcaattgcaagatttgcacagatgatgtggaggctaaattctttgtggctttctgttgcattgtccttgacaatgattttatgttgtactatatctgcccaatgcacaccctatttacacttattggtgtacgcatcacttggcctgtttaacaagtataatgagataccttcagttatggctattaagattgctggctgcttcttggctgtcattttgatatgggaagttcctgggtattcgaaattttgtgggccccctttacgtttctgcttggctataaagatccagagccttctaagtcacacttacccttattgcatgagtggcatttccgatctgggcttgatcggtacatatggattgtaggaatgatttatgcttacttccaccctaatgtggaaaaatggatggagaagctggaagaatctgagactaaggttaggttgtcgatcaagggtaccattgtgactctttcagtcctggctggctatctgtggtatgaatacatctacaggctggacaaaattacttacaacaagtaccatccctacacgtcatggattcctatcactgtatatatttgcctacgcaattgcacccaacagttgaggggcgcttctttggctcttttcgcttggcttggcaaggtcacactggagacttatatttctcagatccacatttggctcaggtctagcgtaccaaacgggcagcccaaatggcttctgtctttcataccgggctacccgatgcttaacttcatgctaacgacatcaatctatcttttgctgtcataccgagtatttgagatcacaaacgtgctgagggcagccttcattcccagcagagacaacaaccgcctgtaccagaatttcgttgccggggtcgccatctccgtatgcctgtactgctgctcactcgttcttctaaaaattccggctgtatagatgaatagttgttatggatgtagaattgccaagtacgtaaatgataccggtggaaggcggcttcttcttccacatgcacaaaagaggtttgcttggcgggggtgctcggttccatttgcatctaggggctcccctgagaagctgcccttgggaagtttgtcgctggagggagacgcaaattttggatcatcttttttcctgttgtaaaagccaacccattcttctgggagttgtaacagctgtcaactctggtgtgcacattgttgttttgtaacatgtcttagatatattcttctatacataccaaggaaagcgtttccctcctgtaaaaatgaaatagcagagtcaaatcatcaactagaaaaaaagaaaaaaaaaaaaaaaaaaaaaaaaaaaagaaaaaaaaaaaaaaaacaaaaaaaactagaacgactacgaacgaaggacaacgaacggaagggaagtagg

SEQ ID NO: 1397 - DNA, 1778 bp, Secale cereale
caggtgtcattttttacttggtcttttcccggtcctcattgcatgggtctactccgagatcctggagtacaagaaatcttcgctacatgggaaagttcactcagatgctactttggaaaatgagacttccaaggaagatgagaaggctatattaattgaaggaggccagttgaaatcaccatcggcgaaattccggaacatgtctaccaaagccaatctaatacggtttataacaatggatgagccttttctgctagaaaaccgtgctgtactgagagccatggctgaatttggcattgtgctagtttacttttacatttgtgaccggacaaacatattcccagagagcaagaagaactacaacagagacctgtttctgtttctgtacattcttctcatcatagcatcagcacttacatcacttaagaagcaccaggagaaatcagcatttttctggaaagtccatactctatcttaatcgccaccaaactgaggaatggaaagggtggatgcaggtcttatttctgatgtaccactattttggcgcgtcagaaatatacaatgcaattcgtgttttcattgcttgctatgtttggatgactggatttgggaatttctcgtactattatatcaagaaagattttagcattgcaagatttgcacagatgatgtggaggctaaatttctttgtggctttctgttgcattgtccttgacaatgattttatgttgtactatatctgcccaatgcacaccctatttacacttatggtgtacgcatcacttggcctgtttaacaagtataatgagataccttcagttatggctattaagattgctggctgcttcttggctgtcattttgatatgggaagttcctggggtattcgaaattttgtgggccccctttacgtttctgcttggctataaagatccagagccttctaagtcacacttacccttattgcatgagtggcatttccgatctgggcttgatcggtacatatggattgttggaatgatttatgcttacttccaccctaatgtggaaaaatggatggagaagctggaagaatctgagactaaggttaggttgtcgatcaagggtaccattgtgactctttcagtcctggctggctatctgtggtatgaatacatctacaggctggacaaaattacgtacaacaagtaccatccctacacgtcatggattcctatcactgtatatatttgcctacgcaattgcacccaacagttgaggggcgcttctttggctcttttcgcttggcttggcaaggtcacactggagacttatatttctcagatccacatttggctcaggtctagcgtaccaaacgggcagcccaaatggcttctgtctttcataccgggctacccgatgcttaacttcatgctaacgacatcaatctatcttttgctgtcataccgagtatttgagatcacaaacgtgctgagggcagccttcattccgagcagagacaacaaccgcctgtaccagaatttcgttgcggggtcgccatctccgtgtgcctgtactgctgctcactcgttcttctaaaaattccggctgtatagatgaatagttgttattgatgtagaattgccaagtacgtaaatgataccggtggaaggctgcttcttcttcttccacacgcagaaaagaggtttgcttggcgggggtgctcggatcccctgagaagcttagtcgtgtggaggagcgcaaattttggatcatcttttttcctgttgtaaaagccaa

SEQ ID NO: 1398 - DNA, 2104 bp, Secale cereale
gcttcagatctcctcctcccccaccctccgccacgccacgccaaccccaatcccactccctccggccattgtgctcctcggacacatatataagccctatccccatcagcctagcccgcgacctcgccgtccccctctctcccccgcgtccagctcgctctcctgccctgctcgcggggcatggcctgctgacgactcattcggtacgaaccctctcccggatctgacccgcccgcccgcgccgccgctcctgggatcgggatcgggatctcgcgccggagggacggcatggaggtcttcggccccgtcacgcccggccaggtgtcatttttacttggtcttttcccggtcctcattgcatgggtctactccgagatcctggagtacaagaaatcttcgctacatgggaaagttcactcagatgctactttggaaaatgagacttccaaggaagatgagaaggctatattgattgaaggaggccagttgaaatcaccatcggccaaattccggaacatgtctaccaaagccaatctgatacggtttataacaatggatgagccttttctgctagaaaaccgtgctgtattgagagccatggctgaatttggcattgtactggtttatttttacatttgtgaccggacaaacatattcccagaaagcaagaagaactacaacagagacctgtttctgtttctgtacattcttctcatcatagcatcagcacttacttcacttaagaagcaccaggagaaatcagcattttctggaaagtccatactctatcttaatcgccaccaaactgaggaatggaaagggtggatgcaggtcttatttctgatgtaccactattttggcgcgtcagaaatatacaatgcaattcgtgttttcattgcttgctatgtttggatgactggatttgggaatttctcgtactattatatcaagaaagattttagcattgcaagatttgcacagatgatgtggaggctaaatttctttgtggctttctgttgcattgtccttgacaatgattttatgttgtactatatctgcccaatgcacaccctatttacacttatggtgtacgcatcacttggcctgtttaacaagtataatgagataccttcagttatggctattaagattgctggctgcttcttggctgtcattttgatatgggaagttcctggggtattcgaaattttgtgggccccctttagtttctgcttggctataaagatccagagccttctaagtcacactttacccttattgcatgagtggcatttccgatctgggcttgatcggtacatatggattgtaggaatgatttatgcttacttccaccctaatgtggaaaaatggatggagaagctggaagaatctgagactaaggttaggttgtcgatcaagggtaccattgtgactctttcagtcctggctggctatctgtggtatgaatatatctacaggctggacaaaattacgtacaacaagtaccatccctacacgtcatggattcctatcactgtatatatttgcctacgcaattgcacccaacagttgaggggcgcttctttggctcttttcgcttggcttggcaaggtcacactggagacttatatttctcagatccacatttggctcaggtctagcgtaccaaatggtcagcccaaatggcttctatcttttataccgggctacccgatgcttaatttcatgctaacgacatcaatctatcttttgctgtcataccgagtatttgagatcacaaacgtgctgagggcagccttcattccgagcagagacaacaaccgcctgtaccagaatttcgttgccggggtcgccatctccgtatgcctgtactgctgctcgctcgttcttctaaaaattccggctgtatagatgaatagtagttgttatggatgtagaattgccaagtacgtaaatgataccggtggaaggctgcttcttcttcttccacacgcacaaaagaggtttgcttggcgggggtgctcggatcccctgagaagctgaactttgtcgctggagggagacgcaaattttggatcatcttttttcctgttgtaaaagccaa

SEQ ID NO: 1399 - DNA, 1958 bp, Avena sativa
gtgtcatttttgcttggtcttttccctgtcctcattgcatgggtctatgcggagatcctggaataccggagatcttcgtcatatgggaaagttcactcagatgctgctttggagaatgaaactttgaaggatgatgagaaagctatattaattgaaggaggccagttgaaatcaccatcggcaaagttccggaacatgtctaccaaagcaaatttgatacggtttataacaatggatgagtcttttctgcttgaaaaccgtgctgtactgagagccatggctgaagttggcattgttctagtttattattacatctgtgaccggacaaacatatttgcagaaagcaagaagaactacaaccgcgacctgtttctgtttctatacattcttctcatcatagcatcagcacttacttcacttaagaagcaccaggagaaatcagcattttctggaaagtccatactctatcttaatcgccaccaaactgaggaatggaaagggtggatgcaggtcttatttctgatgtaccactattttggtgcgtcagaaatatacaatgcaattcgtgttttcattgcttgctatgtttggatgaccggatttgggaatttctcgtactattatatcaagaaagattttagcattgcgagatttgctcagatgatgtggaggctaaatttctttgtggccttctgctgcattgtccttgacaatgattttatgttgtactatatctgcccaatgcacaccctatttacgcttatggtgtatggatcacttggtctgtttaacaagtataatgaaataccatccgttatggctattaagattgcttgttgcttcttgagtgtcattttgatatgggaagtccccggggtcttcgaaattttgtgggccccctttacgtttctgcttggctataaagatccagaaccttctaagtcacacttacccttattgcatgagtggcatttccgatctgggctcgatcggtacatatggattattggaatgatttatgcttacttccaccctaatgtggaaagatggatggagaagctggaagaatccgagactaaggttaggttgtcgatcaagggtaccattgtgacggtttcggtcttggctggctatctatggtatgaatatatctacaagctggacaaaattacgtacaacaaataccatccctacacatcatggattcctatcactgtatatatttgtctacgcaattgcacacaacagttgaggggcgcctccttggcacttttcggttggcttggcaaggttacactggagacctacatttctcaaatccacatatggctcaggtctagcgtaccaaatgggcagccaaaatggctactctgtttcataccagagtacccgatgcttaacttcatgcttaccacaacaatctatctctttctatcataccgaatattcgagctcacaaacgtgctgagagcagccttcattcccagcagagacaacaatcgtctgtatcataattttgtcgccggggttgtcatctccgtatgtctgtacttctgctcgcttgttcttctgaaaattcctggtgtataggtaaacaagatttcatgtcgatgaatgtagaattgccaagtgggaaaatgttgggtggaaggattttgcttctgcaagaagacattttgcttggtaggatgctctcagttctgacaccttgagggtgcggacatagtggagccatttttgtattttgttttctttttgtgaagaagatcattttacacagctagcccaacccctcggcattctctgaaagttgtactgtagcagtcacggaaaaactggggaatcctgctgtagtattgcaatgtgttatatgtaccatgtgtagacaggaaacattcataccagggttttccgcttgtaagctgaatatgtaaaggcaaagcccatgaatcatgatg

SEQ ID NO: 1400 - DNA, 1889 bp, Triticum aestivum
gggtctactccgagatcctggagtacaagaaatcttcgttacatgggaaagttcactcagatgctactttggaaaatgaaacctccaaggaagatgagaaggctatattaattgaaggaggccagttgaaatcaccatcggcgaaattccggaacatgtctaccaaagccaatttaatacggtttataacaatggacgagccttttctgttagaaaaccgcgctgtactgagagccatggctgaatttggcattgtgctggtttacttttacatttggaccgacaaacatatttccagagagcaagaggaactacaacagagacctgttctgttctgtacattcttctcatcatagcatcagcacttacttcacttaagaagcaccaggagaaatcagcattttctggaaagtccatactttatcttaatcgccaccaaactgaggaatggaaagggtggatgcaggtcttatttctgatgtaccactattttggcgcatcagaaatatataatgcaatccgtgttttcattgcttgctatgtttggatgactggatttgggaatttctcgtactattatatcaagaaagattttagcattgcaagatttgcacagatgatgtggaggctaaatttctttgtggctttctgttgcattgtccttgacaatgattttatgttgtactatatctgcccaatgcacaccctatttacacttatggtgtacgcatcacttggcctgtttaacaagtataatgagataccatcagttatggctattaagattgctggctgcttcttggctgtcattttgatatgggaagttcctggggtattcgaaattttgtgggccccctttacgttcctgcttggctataaagatccagagccttctaagtcacacttacccttattgcatgagtggcatttccgatctgggcttgatcggtacatatggattattggaatgatttatgcttacttccaccctaatgtggaaagatggatggagaagctggaagaatctgagactaaggttaggttgtcgatcaagggtaccattgtgactctttcggtcctggctggctatctgtggtatgaatatatctacaggctggacaaaattacgtacaacaagtaccatccctacacgtcatggattcctatcactgtatatatttgcctacgcaattgcacccagcagttgaggggcgcttctttggctctcttcgcttggcttggcaaggtcacactggagacttatatttcccagatccacatttggctcaggtctagtgtaccaaatgggcagcccaaatggcttctgtctttcataccgggctacccgatgcttaacttcatgctaacgacatcaatctatcttttgctatcataccgggtatttgagatcacaaacgtgctgagggcagccttcattcccagcagagacaacaaccgcctgtaccagaatttcgttgcgggggttgccatctccgtatgtctgtattgctgctcgctcgttcttctaaaaattccggctgtatagatgaatagttcgtatggatgtagaattgccaagtaaatgataccggtggaaggctggctgcttcttccacgcgcacaaaagaggttcgcttggcggggatgctcggttccattcaggggatcccctaagaagctgcccttgggaacctgatcgccgtggagggagacgcaaatttttgatcatctttttcttgttgtaaaagccaacccattcttctgggagttgtaacagctgtcaaccgtgtaactgtcaactttggtgtgcacattgttgttttgtaacatgtcttagatatattctttctatacatacaaggaaagcgtttccctcctgtaaaaagaaa

SEQ ID NO: 1401 - DNA, 1559 bp, Panicum virgatum
attaattagtcttatagtttatagacggttctaattaattttataatcagtaaaagtttaatattttggcacatttcatttcagaaactttagatcctaactgccctcttctttcgatctcgccttcctgtgaggcgactcggcagccggccctcacctttccccaccggcagccggcgctcctgggactggaagacgacgccgcgacggcgaccccgcgggcacggcggcgcttccgctgctccttctccgcccaccagctgccgcctgctgccagtctgactcctccatccaggcctccaggccgaaccgccccaccgtccgcggtccaccgagccgacaagaaattatcgggtgtatgcccatgtcttatactgggtccgcctctgagagaaggtcggtctgccctaactgaccaaaggggttcattcagagatgcgtttttcaagagaagatctggttgggtcagtgttcattgcttttggggtcactttgtttgtgggtttcttctatgctgccatcgtgtccaagctgcttccaccatatgaaaacagtcttctagctgccatccaaaatgattggtattactgcctacttgtgccattgacgcttcctgtcataatcgtggcagtctatctgcattggcttagcatgaagatgtttaaacatgcatgaagcaaaatttccatggattttatagagcaagtatgcagttttgttccagtttcagaaactctggataagatgaggattaaggacggagggagtagtttgttctactactgtgtgacggttgtgcaaacaaagaggtttcttttgttcgcagatgtgaagatgttttggagaattgtggtacagatgctagagaacactggatattttttaccttttatatgctgtgctccaaggccaagctggaggcaccaaaatcagcagacgggagcaactatctttgctgggcctctataaggaagtatcgaattgcaagttgtgttgactccctagtcgctgaagaaggcagaacgtgctgcaaaacatctgaacattttggtgtccttcttgagtgttttcttcttttagtcaatgtggtgattgtaatattttacatggttgaaaacatcttttttgcctgctgtatggatttttgacggtcgacttatcctcccatgctctcagcgtgcttgatggtcgatttaaaggaagagtgtcagcaactggttcagttagtatgccacctcgtggtggaatttgtattggaaaagggtacagatagcctgtgcagtgccattgcaagtcagagatgatattcgttactcacttggtgtcaacctccagagaaaacttgctggtcctctgctggctgacacttatgtaactctcctaaaagatcaacaatgcatggtatggacaaatacttgctaagggagagttgagtcttgacatgggtgatagtatcaagggaaagggaacgattcgggtaatgtaataacagtgttttattccattttattctgataatctctttgaagaactttgaaaggtgaaaaaaattacggaag

SEQ ID NO: 1402 - DNA, 890 bp, Pennisetum glaucum
gcagttggtggcagatttctttatcagctatctccgaagcaccaaaaggttcgagtgatacctaggcaagtccggtctgctcatcattggagaaaggggttgattcagagatgcatttctttaaaggagatctggttgggtccgcgtttatggcttttggtattactttgtttgtgggtttcttctatgctgctgttctgtccaagcttcttccaccatatgaaaataagcttctagccggcatccaaaatgattggtattactgcctacttgtgccgttgacacttcctgtcataactgtggctgtctatcttcattggcttagcatgaagatgttcaaacatgcttgaagcaacattcttttttgtgggaatttatggaagtatgcagctttgttccaatttcagaaattctggatcacgacgaggatcatggtggtttagctcaaagtgtcatgtcaactgcacttcacacagtccctagtttgtgtttgtcatctccaattatagctttgattatggttcattcagaaatattcatcaattctttttgtacgacgctagtgctaacagtatatgttgctaaatatggattgccatcttataacattcgaggagcttggtgcttatttccagtctgatgacgataagtggtgcccttgcattacggacttcagattcacgcttctcatttagtttgttctgccactgtttggaggttgtggaatcaaagaagcgcgtgctgttttcagatttgaagatgctccagagaatcgtggatccgtggtgctgccgctaaaaaaaatgtgtgttttatgctccaatgccaagctgaatcagtacaaggagcaactatttttgccaggtgtgtacaaagaagttcttgaaatt

SEQ ID NO: 1403 - DNA, 1195 bp, Panicum virgatum
ccccctccccacattccctgcccctggtaaccctagctcccgtccacgcctccacggtccggcggcggcgtggcactccggcctccggcaggggcagcggcggcagcgctaggcacagcgtttgggcaggcaagggccaggcggcccgcgcggagccggagcgcccagcgggcagcgtcggcggcgcttgccacggcgccggcggcagcgggcgtcctgggcccgagcacagagcagagcaggcctgggcgggcgggcaccaggcggccggctgcggcagtgcggctggagcctggaggagtacttctgaaaaaacaaaggagctgtaacgaaggcgaccccggtgaccggcggctgcggcaatacaactcctgtgcagggaatttccaacaagaacgtctgggagttctccatcaccaggaagttccagggagtggatgaaattatcgggtgtatgcctatgttaaatactgggtccgcctctgagagaaggtcggtctgcgcatcattgaccaaaaggggttgattcagagatgcattttttgagagaagatctggttgggtcggtgttcattgcttttggggtcactttgtttgtgggtttcttctatgctgccgtcgtgtccaagctgcttccaccatatgaaaacagtcttttcgctgccatccaaaatgattggtattactgcctacttgtgccattgacgcttcctgtgataatcgtggcagtctatctgcattggcttagtatgaagatgtttaaacatgcatgaagcaagattttcgtagatttcgtagaacaggtatgcagttttgttccagtttcagaaactctggatgatgagccatacgatgaatctttgggagagggttatcgagcatcgcctaagaagagtgacaagtgtgacccaaaaccaatttgggttcatgcctggaaggtcaaccatggaggcgattttcttaatacgacaattgatggagagatatagtgagcagaagaaggacttgcacatggtcttcattgaccttgagacggcatatgacaaagtaccgagaaatgtcatgtggtgggccttagagaagcacaaagtcccaactaagtacattaacctcattaaggatatgtacaaggatgcgacgacgtttgtccggatatgtgatggcaacaccactgactttcctattaacataggcc

SEQ ID NO: 1404 - DNA, 760 bp, Brachypodium distachyon
aagggcaatgcacctgccgcaacttcgctgagcatcaaagggggttaatctagaggtgatgcggttttctagagagcagctggtgggttcagcatttgttgcatttggcatcctactgtttgtgggtttcttctacgccgccgttgtgtccaagctgcttccaccatatgagaaccggcttctgtctgccatccaaaatgataggtattactgcctgctcgttcccttgacacttcctgttataattgtggcggtgtacctgcattggctaagcatgaagatgttcaagcatgcatgaagctaggaagaactacatgaagaaggttgcagttttgctcaaatggttgtctcactgggattatgaagatactactacctctgttcctgaatgtaagacgttcacccgcaaaaaataaaaaagaatgtaagacgttttggtaggctaaattaggaacagagggagtaactgataaatctctgaattaatgacagtcttctgcaatagaccatttttttgttgcaaacacatcagcttagattatttgtcaagcatgatagatgtcaatgcgccgagttgcccttgcaatcacgacggacagatactaaaatgtgtacatttatgtttggaaaaaagatagttgtactagttgttaatgcttatgaagggaactgcagttgtagttgttaaacaatttgaacagaacttatctatatgtaaactaagctttcatggatgatatatttgatcgttagattccta

SEQ ID NO: 1405 - DNA, 1097 bp, Panicum virgatum
caagagaagatctggttgggtcagtgttcattgcttttggggtcactttgtttgtgggtttcttctatgctgccatcgtgtccaagctgcttccaccatatgaaaacagtcttctagccgccatccaaaatgattggtattactgcctacttgtgccattgacgcttcctgtcataatcgtggcagtctatctgcattggcttagcatgaagatgtttaaacatgcatgaagcaaaatttccatggattttatagagcaagtatgcagttttgttccagtttcagaaactctggataagatgaggattaaggacggagggagtagtttgttctactactgtgtgacggttgtgcaaacaaagaggtttcttttgttcgcagatgtgaagatgttttggagaattgtggtacagatgctagagaacactggatattttttaccttttatatgctgtgctccaaggccaagctggaggcaccaaaatcagcagacgggagcaactatctttgctgggcctctataaggaagtatcgaattgcaagttgtgttgactccctagtcgctgaagaaggcagaacgtgctgcaaaacatctgaacattttggtgtccttcttgagtgttttcttcttttagtcaatgtggtgattgtaatattttacatggttgaaaacatcttttttgcctgctgtatggatttttgacggtcgacttatcctcccatgctctcagcgtgcttgatggtcgatttaaaggaagagtgtcagcaactggttcagttagtatgccacctcgtggtggaatttgtattggaaaagggtacagatagcctgtgcagtgccattgcaagtcagagatgatattcgttactcacttggtgtctacctccaaagaaaacttgctggtcctttgctggctgacacttatgtaactttcctaaaagatcaacaatgcatggtatggacaaatacttgctaagggagagttgagtcttgacatgggtgatagtatcaagggaaagggaacgattcgggtaatgtaataacagtgttttattccattttattttgataatctctttgaagaactttgaaaggc

SEQ ID NO: 1406 - DNA, 316 bp, Panicum virgatum
gagtttctgaaactggaacaaaactgcatacctgttctacgaaatctacgaaaatcttgcttcatgcatgtttaaacatcttcatactaagccaatgcagatagactgccacgattatcacaggaagcgtcaatggcacaagaattccttaccaatcattttggatggcagcgaaaagactgttttcatatggtggaagcagcttggacacgacggcagcatagaagaaacccacaaacaaagtgaccccaaaagcaatgaacaccgacccaaccagatcttctctcaaaaaatgcatctctgaatcaaccccttt

SEQ ID NO: 1407 - DNA, 1436 bp, Triticum aestivum
gtgtttccatatgctcccattcgtatttcataccggattgcatcggttcaacccatcgttattctcactgctctctcctgataacataattagaggctacaggagactgcagagagcaatgcttgctttacaagtgtctgtcatgctttggcgtctgtgaatggttggtgagcacattaagtattcatccctgctaggttgtaaatcttatccctagcgtaaattaactcgaaaccgcacaccttggtattacactatattgctactgtcccttcttctgctcgaaaatcagtggtgttgaggtgttctacagccatatagagtgtgacatgttatgtgtttctgctggtggggtgtgagcgtcactgcctcactggcaggcgtgctcatgtggcagcacaatcttgtgcagaggttaaatgctagccgcgtgaggctgcaaccttgtgtacctgtgcggcaagcaatcacccaacgctattcagttgctgaagtaccaaactgattcgtgcattcattattcgactggttcaaagacttcaacgtctttttgaaatcgaacaagtggtatgtaaccgatatatctatttgcttagtatagttttgcgaagtttatctaaacaagagttatatcaagtcctgttctgagatatactgaaatttgtaacatagtggttaaactgttctctcatgaaaagttcaaatttactgattctttcctttgttcagtgtctctgtaggatcgaagctacagtccgtggcaaagaagtccaaagagatgatacacttttctagagatcagctgatggggtcagcatttgttgcatttggcatcatattatttgtgggtttcttctatgccgctgttgtgtccaaaatgctcccgccttatgagaactggcttctagctgccatccaaaatgacaggtattactgcctacttgtgcccttgacacttcctgtgataattgtggctgtctatctgcattggctaagcatgaagatgttcaagcatgcctgaagaactgcacatctgttttgcagaagaagtcagttttcaagcgtaaattgatggcaacttactaaattgacctcatagtgtcactactaggtattaaaatgagcacattcatgtttagaaagtgtagttgtatttgtgaaatgcttatgatgggaaatacatatttacttgttaaatgtttatatgatggaaaatgcactcgtagttcttatataatttttctttctcaatggtgaaattcctggcctctcgtttaaatagatactaggtttatagatagatttctatgtgtcttgtgcatattcttatgccctgtgtaccatatatcctgtattgaccctacaaatgtgttagcatagttttgtgctgtcaacacaaacaaccgtttcttttatgtagaaactcttctcttgtt

SEQ ID NO: 1408 - DNA, 1791 bp, Zea mays
ccagtctacagcggctgccgtcgggccgtgccgctgcttgctgggctggtgctggctgctcgtgccgtccggccgtccctgctctgctggagtgctggacgctcggagaggcggagagcagacgccggcagagacgcagagggcagaccgtgtcctctctccactgtccagtgatccagtctcctccggcctccgcggccgtgggtgcacggagccggacagccgatcagccggccgcgagcccgccgcgaggacaaaggaggccgccggaccggagcctggagactggagagccagccgccagagccgaggtatcctgttgccggcttgccgctgttggatctagcggccaggagggcgatttggtgccgttgccgtactgccgtgagccaagagtgactgctgttggcgctcggcgattgggcccatattgccatacactgtctctatggagctgaagtgttatgtattggcagcgtgactggtacttgacaatactctagattaccgaacaacagtttgagccagggattatagccaaaagggattatacccccaaggggttcaagtgataaagaggggattaactcaatccctcctggattcaatacctctctggaataaaaacctgtaaaccgaacatgcccctagggaagtaatccattgcaaacgaacatgccctcagggtttactattgtgtccgctcccaccgggtctgcgcatcagagaccgacaagactgggaaatccagagatgcatttttctaccgatcagctgatcggctcggcgttcattgcctttgggctcacattgttcgtgtgtttcttctacgttgccgtcgtgtccaagctgcttccgccacatcaaaatggattcctggccgccatccaaaacgactggtattactgtctgcttgtgccgttgacgcttcctgtaataatcgtggctgtctacctgcactggctcagcatgaagatgttcaagcacgcatgaagcagtcatgcagcttccttccggtttcagaatcctggtcaaaatcgaggagtgtagcaccaattagttcgagtgatgtctctctgcccacatcatcattagatctcccagatgttgcagatctctttgctccccctgcagacaatgcatcaaggaagagggaatcaaatgggtctgctcttcatgactcgcgcaataaatttccaaggatgcaatcacaatcccaaggcataggaagtgctgcagggaacgccctaattccaccgcagcttcgtggaaggagcaatgttgttaccgaagacatgagcaaactctttgtggctaaacgaaaagagtagcatcttaaccttttctggacctgaacctctgtttggactccatagactgataaacgcatgtactgagtgcaatggatgtgccggcatgatccaaggttgttgctgaatcctaaagaaccggacgaaggatgctaacggtaggacgacctggtctcttagcctaccgtgggctgttgtcagatgtcaaaaatgccctcttagaagtttagaacatttctttggtgctcactcgcgtttcatgttcaacggtgctacatgactggtgctggatgcatgtaaactctgcaaccctatcatgtcatggcagctagatgctactacgtctatcttttggtcggtgattacaaccatgtattacgtctagtagtggtaatagatcgcgatccaaatgcttcttaataaaatagtagaactctaaataattttagttaaaaaatgaatagaaataagattctgattt

SEQ ID NO: 1409 - DNA, 1093 bp, Zea mays
tgcaggtctctatggagctgaagtgttatgtattggcagcgtgactggtacttgacaatactctagattaaccgaacaacagtttgagccagggattatagccaaaagggattatacccccaaggggttcaagtgacaaagaggggattaactcaatccctcctggattcaatacctctctggaataaaaacctgtaaaccgaacatgcccctagggaagtaatccattgcaaacgaacatgccctcagggtttactattgtgtccgctcccaccgggtctgcgcatcagagaccgacaagactgggaaatccagagatgcatttttctaccgatcagctgatcggctcggcgttcattgcctttgggctcacattgttcgtgtgtttcttctacgttgccgtcgtgtccaagctgcttccgccacatcaaaatggattcctggccgccatccaaaacgactggtattactgtctgcttgtgccgttgacgcttcctgtaataatcgtggctgtctacctgcactggctcagcatgaagatgttcaagcacgcatgaagcagtcatgcagcttccttccggtttcagaatcctggtcaaaatcgaggatgcattcacaatcccaaggcataggaagtgctgcagggaacgccctaattccaccgcagcttcgtggaaggagcaatgttgttactgaagacatgagcaaactctttgtggctaaacgaaaagagtagcatcttaaccttttctggacctgaacctctgtttggactccatagactgataaacgcatgtactggtcccatagtgcaatggatgtgccggcatgatccaaggttgttgctgaatcctaaagaaccggacgaaggatgctaacggtaggacgacctggtctcttagcctacagtgggctgttgtcagatgtcaaaaatgccctcttagaagtttagaacatttctttggtgctcactcgcgtttcatgttcaacggtgctacatgactggtgctggatgcatgtaaactctgcaaccctatcatgttatggcagctagatgctactacgtctatcttttgatcggtgattacaacca

SEQ ID NO: 1410 - DNA, 1523 bp, Panicum virgatum
attaatccttcaaggctccctcccactcccactgaaagagccaccaattaaccctgtgctgacttgtcccagtgacgtgaacccatcgccggcgatcggccaagatcggcggcgagcagggtgccgggtcatcgattcgatcgtctccgagttcgcagccttggagaagggcagcatgcaagaggggcacggcgagaccgtcaactacagggtgttcgccggcacgtggaacgtcggcggcaaggcgccgccggatgatcttgacctggaggattggctggacaccaaggccggctcccacgacatctacgttctcgggttccaggagatggtgccgctgaatgtgaggagcgtgctcggccccaagcagagatcggcggccatgaattggcagcggcttatcggggacgcactgaacggcgggaggaggagcgtgatggatggagaagacgcggcgatggatcacggacagggcgcgttcaggtgcgtcatgagcaagcagatggtcggcatcttcgtcgccgtgtggacgaggagcggcctccgccggcacgtccgccaccccggcgtctccgccgtcggcgccggcgtcctcggccggctcggcaacaagggcgcggtgtcggtccggttcttgctgcacggcacgagcttctgcttcgtctgctgccacctggcctccggcggcggcggcggcgacgcgctacgccggaacgccgacgcggcgtacatcctcgcgaggacgagcttcctcaactccggcggcgcgccggcgccggcaccggaggagctgcccaggaagattcttgaccatgatcgggtggtgttgctcggcgacctcaactaccggatcgccatggacgacgccgaggcgcggcagctggtgagggccaggaaatggagcatgctgctggagaacgacgagctgctgctcgagctcgccgagggccggcggttcgacggctggcgcgagggccacgtcaccttcgccccgacctacaagtaccaccgcaactccgaccagttctgctggtgcgccgacggcggcgccgccgccggccgcggcaagcagcaccgcgcgccggcatggtgcgaccggatcctttggcgagggaaggggatgaggcagatccggtacgagtggtgcggtggctacaggctctccgatcaccggccggtgagggccgtgttccacgctgtgtgtgaggtggtggaaaccaaagcatgttaactaagctgcaggcttctgtcctctgaaacagttaacaaacgagatgctgtaaattttacagaaattcaacaacagcttggtttcctgcatccgttttcaaaaatagggcctcgatgatttacctgaggatgaaaggctcttgttttcgcctttgtatctgcaggtgaaaattcatgtaaatttcctgttcttttccctgctgaagaaatggaatccggggatcattgtccagtcgattcatgtaccattaggatgcaaccttttatggattgaatcgatgatattttttctt

SEQ ID NO: 1411 - DNA, 1557 bp, Panicum virgatum
agtttctgaacctttccctgcaacctcatgccctcccattaatccttcaaggctccctcccactccctctgaaagagccaccaaccctgtgctgacttgtcccagtgacgtgaacccatcgccggcgatcggccaagatcggcggcgagcagggcgccgggtcattgactcgtcgtctccgagttcgcagccttggaaaagagcaggatgcaagaggggcacggcgagaccgtcaactacagggtgttcgccggcacgtggaacgtcggcggcgaggcgccgccggatgatcttgacctggaggattggctggacaccaaggccggctcccacgacatctacgttctcgggttccaggagatggtgccgctgaatgcgaggagcgtgctcggccccaagcagagatcggcggccatgaagtggcagcggcttatcggggacgcactgaacggcgggaggaggagcgtgatggatggagaagacgcggcgatggatcacggacagggcgcgttcaggtgcgtcatgagcaagcagatggtcggcatcttcgtctccgtgtggacgaggagcggcctccgccggcacgtccgccaccccggcgtctccgccgtcggcgccggcgtcctcggccggctcggcaacaagggcgcggtgtcggtccggttcttgctgcacggcacgagcttctgcttcgtctgctgccacctggcctccggcggcggcgacggcgacgcgctacgccggaacgccgacgcggcgtacatcctcgcgaggacgagcttcctcaactccggcggcgcgccggcgccggcaccggaggagctgcccaggaagattcttgaccatgatcgggtggtgttgctcggcgacctcaactaccggatcgccatggacgacgccgaggcgcggcagctggtgagggccaggaaatggagcatgctgctggagaacgacgagctgctgctcgagctcgccgagggccggcggttcgacggctggcgcgagggccacgtcaccttcgccccgacctacaagtaccaccgcaactccgaccagttctgctggtgcgccgacggcggcgccgccgccggccgcggcaagcagcaccgcgcgccggcatggtgcgaccggatcctttggcgagggaaggggatgaggcagatccggtacgagtggtgcggtggctacaggctctccgatcaccggccggtgagggccgtgttccacgctgtgtgtgaggtggtggaaaccaaagcatgttaactaagctgcaggcttctgtcctctgaaacagttaacaaacgagatgctgtaaattttacagaaattcaacaacagcttggtttcctgcatccgttttcaaaaatagggcctcgatgatttacctgaggatgaaaggctcttgttttcgcctttgtatctgcaggtgaaaattcatgtaaatttcctgttcttttcccctgctgaagaaatggaatccggggatcattgtccagtcgattcatgtaccattaggatgcaaccttttatggattgaatcgatgatattttttcttg

SEQ ID NO: 1412 - DNA, 3191 bp, Sorghum bicolor
taagatgcgcactcgtgttagttggaccttacccatcactacaggaattctttcatcttactatattctatcgccacattgttccttctatacccttctttggcacacatgatccacacacacgagtacacctgcccccgactgaacccccggatggacgacgatgaatgatgggggttgcttccgcgtcggaaagcgtcacgccgtccgctttacttcacgtttactgcggcgctacgtgacgccaactgagccaagagcgaggcactgccagcagcagctccgtcggtctcccttgcccctcacctcactccctcccccctcccaggtccgccgcaaactccggcgcgcgtcggccggcagtattgctgaggaagtaataaagatgcgtggacgtggccgtgaaaatttgtagacgaagcaagtgcggtggtgcggcaggctggcgggggcactagcaggcgcaggggagcgagcgaccgaccgtcggaactcggaaggtggctgcgatcgacctgccaaccgcccccacgcagcccgcgcacgcacgcacccagcagtagcagcacacacgcacgcacgcctctagaaattccaaaacgagcacggcccggcacgaggccgcccctgcctgcctgcctgcctgccagtgccagtgccggtccctccctctctcggctcggctggtgctggcctggatcctccacgcgacggacgccgcctgccccgcggctttagcgccccactcccgccccgcccgcggctctcttctcgtctcgtcgtccagtggtggcggtggtggtggtggagtgcagatccgcccatccgtacgtggattgcctttcgtctttgcccattgctgttggccagttggcgtggatttgagagctgcgtgtcggcatcatccgtggtttgattacttctccggcactcaagatcgagggaagtcgcagcaggacttgtttcggttcaactggacgaactcccgtgtcctgcgccaggaccgccactgatgagcccactcagatttaggatggcttgtcattgctgagcttctccaggaaagactggaatttttgcgccgcgccaacctttaactgtatttcatgatacaaaaaaatgtcatcaaactccagtctaaccgaatccctacatgagaaaacaattgtctttggccttaaactttgggttgtgattgggattgctgtcggagcatccctcttgggtattcttctcattcttctcatatgccttaccattcaaagttgtatcaagaggtcgcgcaagccactcaaggaccgtcgaatgcaccagatacctccagcgtacaaagatatcaaggaagtggggatggtggatcaatttccagccaatgattttgttgtacatgatgggcttctactcactattcagaatgagcctgagcctgttgaatcagttgatagagatgcaattcagttggctcaggaggaaaagttgaaacaaagagaagagaacaatgtctctggttcttttcccatcacggatggctgcgagggaaatcagattgtttctgccgatgaacagtcttcaacacatgctactattgactctgcaccattggcgggcttacctgaattttcttatcttggttggggccattggttcaccctcagagatctagagcttgcaaccaaccgttttgcaaaggataatgtaattggtgagggtggatatggtgttgtgtatcgtggcagattatcaaatggcaccccagttgctgtcaagaaaatccttaacaatttaggacaggccgagagagaattcagagtggaagttgaggcaattggccatgtccgccacaagaatttggtccgccttttgggttactgtgttgagggtactcaaaggatgcttgtgtacgagtatgtgaataatggaaatcttgaaagttggctccatggggaattgtcccaatacagttctctcacttggttggctcgcatgaaaattcttttgggaactgcaaaggcccttgcttacttacatgaggcaatcgaaccaaaagttgtgcatcgcgacatcaagtccagcaatatcttgattgatgatgagtttaatgccaaaatatcagactttggtttggccaagatgcttggtgctggtaaaagtcatattgctacacgagttatgggtacctttggctatgttgcacctgaatatgctaacagcggacttctaaatgaaaagagtgatgtctatagctttggggtcgttctgttggaagctattacaggtagagatccaattgactatgatcgccctacaaatgaggtaaacctagttgactggcttaaaatgatggttgccaacagacgttctgaagaagtggtggacccaaacctggagagaagaccttcaacaaaggagctgaaacgtgcccttttgactgctttgaggtgtatcgatttgaatgctgagaagaggcctagcatggaccaggtggtccggatgttggattctaacgaacccatacctcaagaggaaaggagacaccgacaaaaccgaatcccagagagttcagaaactgagccactgcggggcaagaataacagtggcaggagtgatgcccctgagcatgaagcgaggccaccacgacctaagagtcgaactttttcgtccaaatgagggaaacaaaaaagaaaagaaaaggcgtattaggagatatatatggtatagacactggaatgctgagatgcgcattgtgggaagcaggaaatctcagtttcgatacataaccaattggtggatttttcattcttggatgtgatgcttgacaatacatttttgtgttccttaacacatgtacagtggtgtgtcgtagttgaagggtgtatagtactattagtttgtaacttcaaaagaagaacgcattcctaccaaaaaaggaaaaggggaaaaaaaagatgggcgtgtgtggtggtcggttgcagtaactgttgtctggttgccatgaactccaaagtgcatcaatgtaacattggataatgtttgtatttgtatcgtttactcgaagagtataaaggggagaaagaagaattggcttcactttctgagctccatgtttgactgtcacgttgatgagaaggcatgttgatgagctaaaattactccaccccatgccaggagcccggctcaggggcataaacctc

SEQ ID NO: 1413 - DNA, 2519 bp, Panicum virgatum
cgcgccaaccgccccacgccgcgcacgcactcgcacagcacacgcctctagaaattccaaaacgagcacggccgggcacgaggccgcgccttgccagtgccggtccctccctcgctcggctggtgctggcctggatcctcctctccgccactccacgccgcgccgcgccgtaatctctctgctccacctccgctgctctcgcgtctcgtccagtggtggccgtggtggtagtggagtgccggcagatccgcccgcccgcccgtacgcggattgcctttcgtcttcgcccattgctgttggttggagattgctgtggatttgcgagctgcttgtatccatggtttgattagtttcttcttcctcttctcacggcgctcaagatcgacgccagcaggacttgttgcgggttccactgagccagctactgggccacgtagatttaggatggctagcacccgccaccattgctgagcttctccagtaaagactggatttttctcgccgccccgacctgtgcgcttgatgttcaaaagatgtcatcaaactccagtctaaccgaatctctacatgagaaaacaattgtctttggcctcaaactttgggttgtgattgggattgctgttggagcgtccctcttgggtattcttctcattcttctcatatgcctcaccattcagagctgtatcaggaggtcacgcaagccactccacgaccgtccaatgacccagatacctcctccctgcaaagatatcaaggaagtgagtaatgattttgttgtacatgatgggcttctactcactattcaaaatgagcccgagcatggtgacctggtcgatagagaagcgattcagttggctcaggaggaaaagttgaaacaaggagaagagaacaatctttctggttctttccgcattacggatggctgtgatggaattcagatcgcttccctcgatgaacaatcttcaacgcatgctactgttgactctgcgccattagtgggcttacctgaattttcttatcttggttggggccattggttcacacttagagatctagagcttgcaaccaaccgttttgcaaaggataatgtgattggtgagggcggatatggtgttgtgtatcgtggcagattatcaaatggcactccagttgctgtcaagaaaatccttaacaatttagggcaagctgagagagaattcagggtggaagttgaagcaattggccatgtccgtcacaagaatttggtccgccttttgggttactgtgttgagggtactcaaaggatgcttgtgtatgagtatgttaataatgggaatctcgaaagttggcttcatggggaattgtcccagtacagctctctcacttggttggctcgtatgaaaattcttttgggcactgcaaaggcccttgcttatttacatgaggcaatcgaaccaaaagttgttcaccgtgacatcaagtccagcaatatcttgattgatgatgagtttaatgccaaaatatcggactttggtttggcaaagatgcttggtgctggtaaaagtcatattgctacacgagttatgggtacctttggctatgttgcacctgagtatgctaacagtggacttctgaatgaaaagagtgatgtctatagctttggggttgttctattggaagctattacaggtagagatccaattgactatgagcgtcctccaaatgaggtaaacctagttgactggcttaaaatgatggttgctaacagacgttctgaagaagtggtggatccaaacctggaaagaagaccctcaacaaaggagctaaaacgtgcccttttgacagccctgaggtgtatcgatttgaatgccgagaagagacctagcatggaccaggtggtccggatgttggattctaacgaacccatacctcaagaggaaagaagacaccgacagaaccgaacccctgagagttcagaaaccgagccattgaggggcaagaacaacagtggcaggagtgatgcccctgagcatgaagcaaggccacctcgacctaagagtcgaacattttcgtccaaatgatggaaacaagaaacgaaaagaaaaggcatactaggagatacgatatagtcaactggagtgctgcatgcaaagcacacaccgtgggaagcaggaaattacaatacttaaccaattgatgcatttttcattcttggctgcaatggttgataatacatttttgtgttccttgacacacatgtacagtggtgtatggtagttgaagggtgtatagtactagtagtttgtaaaaacttcaaaactcgaaaagaagaatgttttcctaccaaaacaagggaggggggggggggggggtaggcgtgtggtggtcggtgacagtaactgttgtgtggttgctggtataaactacaaagcgcgaggggagatcagtgtaaccttggatattgcttgtattgtatggtttactcgaagagtataaagagagaaaaaaaaagaggaagaagaaatggcttcatttcctta

SEQ ID NO: 1414 - DNA, 2301 bp, Zea mays
tggtggcggtggtggtggagtgcagatccgcgcatccgtacgtggattgccttccgtctttgcccattgctgttggccagtcggcgtggatttgagagctgcgtgtgtgtgtgtgcatccgtggtttggttacttctccggcactcaagatcgaagtcgcaggacttgtttgggttcaactgaactcccgtgtcctgcgccaggaccgccactgatgagacactcagatttaggatggctttcatccgccgccattgctgagcttctccagtaaagactggaatttttcgccgcgccaacctttaactgtatttcatgatacaaaaaaatgtcatcagactccagtctaaccgaatccctacatgagagaacaattgtctttggccttaaactttgggttgtgattgggatcgctgttggagcgtccctcttgggtattcttctcattcttctcatatgccttaccattcaaagttgtatcaagaggtcacgcaagccactcaatgaccgtcgactgcaccagatccctccagcgtacaaagatatcaaggaagtggggatggtagaccaatttcctgccaaagattttgttgtacatgatgggcttctactcactattcagaatgggcctgagcctgttgaaccagttgatagagatgcgattcagttggctcaggaggaaaagttgaaacaaagagaagagaccaatgtctctgcttcttttcccattatggatggctgcgagggaactcagattgtttctgtcgatgaacagtcttccacgcacgctactgttgactctgcaccattggcaggtttacctgaattttcttatcttggttggggccattggttcactctcagagatctagaccttgcaactgaccattttgcaaaggataatgtaattggtgagggtgggtatggtgttgtatatcgtggcagattatcaaatggcaccccagttgctgtcaagaaaatccttaacaatttaggacaggctgagagagaattcagagtggaagtcgaggcaattggccatgttcgtcacaagaatttggtccgccttttgggttactgtgttgagggtactcaaaggatgcttgtgtatgagtatgtgaataatggaaatcttgaaagttggctccatggggaattgtcccagtacagttctctcacttggttggctcgcatgaaaatccttctgggaactgcaaaggcccttgcttacttacatgaggcaattgaaccaaaagttgtgcaccgtgacatcaagtccagcaatatcttgattgacgatgagtttaatgccaaaatatcagactttggtttggccaagatgcttggtgctggtaaaagccatattgctacacgagttatgggtacctttggctatgttgcacctgaatatgctaacagtggacttctaaatgaaaagagtgatgtctatagctttggggttgttctgttggaagctattacaggtagagatccaattgattatgatcgccctacaaatgaggtaaacctggttgactggcttaaaatgatggttgccaacagacgttctgaacaagtggtggacccaaaccttgagagaaggccttcgacaaaggagctgaaacgtgcccttttgactgctctgaggtgtatcgatttgaatgctgagaagaggcctagcatggaccaggtggtccggatgttggattctaatgaactcataccgcaagaggaaaggagacaccgacaaatccgaatccctgagagttcagaaaccgagccactgcggggcaagaataacagtggcaggagtgatgctcctgagcatgaagcgaggccaccacgacctaagagccgaactttttcgtccaaatgaaagaaaaagggcatattaggaggtatatggtagacgctgagacgcgcaatgtgggaagcaggaaatctcagcttcgatacatgacgacacagattgatggattttttttcgttcttggatgtgatgcttgacaatacatttttgtgttccttgacacatgtacagtggcgtgtggtagttgaagggtgtatagttgtattacttagttcctagttcgtaaaaaaaaacttcaaaagaagaatgcattcctaccaaaaaagggaaagggaaaaaagatgggcgtgtgtggtggtcggttgcagcaactgttatctggttgctatgaactccaaagtgcatgaagagatcaatgtaaccctggatgatgtttgtgtttgtttcgtttactcgtagaatataaaggggagatagaagaattggcttca

SEQ ID NO: 1415 - DNA, 1822 bp, Pennisetum glaucum
aagccactcaatgaccgtccaatcatccagatacctcctgcatacaaagatatcaaggaagtggggacggttgatcagttttcagctaatgattttgttgtacatgatgggcttctactcactattcaaaatgagcctgagcctgttgagtcagtcgatagagatgcagttcagttggctcaggaggagaagttgaaacaaagagaagagaaaaatctttctggttctttccgcattacagatggctgtgatgtaattcagattgtttctgctgaggaacagtcttcaacaaatgctactgtcgactcagcgccattggcaggcttacctgaattttcttatcttggttgggggcattggttcaccctcagagatctagagcttgcaaccaaccgttttgcaaaagataatgtgattggtgagggtggatatggtgttgtttatcgtggcagattatcaaatggaaccccagttgctgtcaagaaaatccttaacaatttagggcaggccgagagagaattcagggtggaagttgaagcaattggccatgtccgtcacaagaatttggtccgccttttgggctactgcgttgagggtattcaaaggatgcttgtgtatgagtatgttaacaatgggaatcttgaaagttggctccatggggaattgtcccagtacagctctctcacatggttggctcgcatgaaaattcttttgggcactgcaaaggcccttgcttacttacatgaggcaatcgaaccaaaagttgtgcaccgtgacatcaaatccagcaatatcttgattgacgatgagttcaatgctaaaatatcagactttggtttggccaagatgcttggagctggtaaaagtcacattgctacacgagttatgggtacctttggctatgtcgcacctgaatatgctaacagtggacttctgaatgaaaagagtgatgtgtatagctttggggttgttctgttggaagctattacaggtagagatccaattgactatgagcgtcctccaaatgaggtaaacctagttgactggcttaaaatgatggttgccaacagacgttctgaagaagtagtggatccaaacctagagagaagaccttcaacaaaggagctaaagcgtgcccttttgacagctctgaggtgtattgatttgaatgctgagaagagacctagcatggatcaggtggtccggatgctggattctaacgaacccatacctcaagaggaaagaagacaccgacagaaccgagcccctgagacttcagaaactgagccattgaggggcaagaacaacagtggcaggagtgatgcccctgagcatgaagcaaggccacctcgacctaagagtcgaacattttcttccaaatgagtcaaacaagaaaagaaaaaaagaaggcatactaggagatacgatgacaactggagtgcggcacacgaaacacacattgtgggaagcaggaaatttcgacacataaccaattgatgaatttttcattcttgggtgcaatggttgataatacatttttgtgttccttgacacatgtacagtggtgtgtgatagttgaagggtgtatagtactagtagtttgtaaaaacttataatgtgaacgcgttcctacaaaaagggaaaaaaagaaagaaaaaagataggcgtctgtggtggtcggtgacagtaacgattgtgtggttgctggtatgaactacaaggttcgagtggagatcaatgtaaccttggatgttgtattgtatcatttactcgaagagtataaagagaagaaataagaaatggcttcatttggtgggcttac

SEQ ID NO: 1416 - DNA, 2060 bp, Triticum aestivum
accttgcctcgccagtccactaccaaccacgctgacaactccccttctcctgccgccaccaccttccaattccatctccaaatcccctccctccttccccatacattccctccccacactgcaattgcttcgtcctcttcctcctcccgctgctgcgctggatcccaggtgcttgatgatcacaagatgtcatcaaattccacgctcacagaatcacttcatgagaaaacaatcgtctttgggcttaaactttgggttgtgattgggatcgctgttggagcatccctcctgggtattcttcttatccttgtgatatgcctaaccatccaaacctggatcagacggtcacgaaaggcattcaaggagcttcccatgacccagataccttctgcattcaaggacatcacagaagtcagggtggctgaccaattttcatccaatgattatgttgtacatgatgggcttctactcgccattgagaatgggcctgttgaatcaatggataaagatgcagttcaattggtgcaggaggacaattcgaggcatagagaagagaacaatctttcaggttctttagttcacactgatggctgtgatggaattcaatctgtttctgtctgtgaacagccttccgtacatgctactgccgattctgcgccattggacggcctacctgagttttcttaccttggttggggccattggttcactctcagagatctagatgttgcaaccgaccattttgcaaaggacaacgtaattggtgagggtggatatggtgttgtgtaccgtggcagattatcaaatggcaccccagtcgctgtcaagaaaatccttaacaatttagggcaggccgagcgggaattcagagtggaagttgaggcaattggtaatgttcgccacaagaatttggtccggcttttgggatattgtgttgagggtacccagaggatgcttgtatacgagtttgttaacaacgggaatcttgaaagttggctccacggagaattgtcccagtacagctctctcacttggttagctcgcatgaaagttcttctggggactgcaaaggcccttgcatacttacatgaggcacttgaaccaaaggttgtgcatcgtgacatcaaggccagcaatatcttgatcgacgatgagtttaatgccaaaatatctgactttggtttggccaagatgcttggtgctggtaaaagtcatattgctactcgagttatgggtacctttggctatgttgcgcctgagtatgctaacagcgggcttttgaatgagaagagtgatgtctacagctttggggttcttttattggaagttattacaggtagagatccaattgactatgatcgccccccaagtgaggtaaacctagtcgattggcttaaattgatggtcgccaacagacggtctgacgaagtggtggatccacaccttgagagaagaccatcgacaaaggaactcaaacgtgcccttttgacagctctgcggtgtatcgatctgaatgctgagaagagaccaaggatggatcaggtcgtccggatgttggattctagcgaaaccatacctcaagaggaacgaagaccacgacagaaccggatctctgagaatactgaaaccgtgccattgaggggcaagaacagcatcgagaagagtgatgcccctgagcatgaggagaggccccctcggccaaagagtcgtccattttcgtccaaatgaggtaaagaaagaaggaaaccctaaacatcttctggagatataaagatagagagagataccagcgcgcggaagaacatggtggagaattcttctgaatacgtaacagattgatcgatttttatttttcacccctcggagcggggatttttgcatttgttgatacatggaatggaatgtacagtggtgtgtatgacggctcaaggatgtacagaactagcttgtaaaacggtctgaaaggctctcagctggtgtggttgctggtatgagctacagacttctcttatctctactactatcgtattgtacacaccaagagtataaatcaaagaaaa

(The sequence listing continues in the following parts.)

What is claimed is:

1. A method of increasing growth rate and/or biomass of a plant under nitrogen-limiting conditions, comprising:
    (a) over-expressing within the plant an exogenous polynucleotide comprising a nucleic acid sequence encoding a polypeptide having at least 95% sequence identity and conservative amino acid substitutions with respect to the polypeptide set forth by SEQ ID NO:589, or encoding the polypeptide selected from the group consisting of SEQ ID NO: 589, 3631, 3632, 3633, 3634, 3635, 3636, 3637, 3638, 3639, 3640, 3641, 3642, 3643, and 3645, and
    (b) selecting plants resultant from step (a) over-expressing said polynucleotide for an increased biomass and/or growth rate under nitrogen-limiting conditions as compared to a control plant of the same species which is grown under the same growth conditions,
    thereby increasing the growth rate, and/or biomass of the plant under the nitrogen-limiting conditions.

2. The method of claim 1, wherein said polypeptide is selected from the group consisting of SEQ ID NOs: 589, 3631, 3632, 3633, 3634, 3635, 3636, 3637, 3638, 3639, 3640, 3641, 3642, 3643, and 3645.

3. A method of producing a crop comprising growing a crop plant transformed with an exogenous polynucleotide comprising a nucleic acid sequence encoding a polypeptide at least 95% identical and having conservative amino acid substitutions with respect to the polypeptide set forth by SEQ ID NO:589, or encoding the polypeptide selected from the group consisting of SEQ ID NOs: 589, 3631, 3632, 3633, 3634, 3635, 3636, 3637, 3638, 3639, 3640, 3641, 3642, 3643, and 3645, wherein the crop plant is derived from plants selected for increased biomass and/or increased growth rate under nitrogen-limiting as compared to a control plant of the same species which is grown under the same growth conditions, and the crop plant having the increased biomass, and/or the increased growth rate, thereby producing the crop.

4. The method of claim 1, wherein said exogenous polynucleotide encoding said polypeptide comprises the nucleic acid sequence selected from the group consisting of SEQ ID NOs: 377, 94, 1620, 1621, 1622, 1623, 1624, 1625, 1626, 1627, 1628, 1629, 1630, 1631, 1632, 1633 and 1635.

5. The method of claim 3, wherein said exogenous polynucleotide comprising the nucleic acid sequence selected from the group consisting of SEQ ID NOs: 377, 94, 1620, 1621, 1622, 1623, 1624, 1625, 1626, 1627, 1628, 1629, 1630, 1631, 1632, 1633 and 1635.

6. The method of claim 3, wherein said exogenous polynucleotide encoding said polypeptide comprises a nucleic acid sequence selected from the group consisting of SEQ ID NOs: 377 and 94.

7. The method of claim 3, wherein said polypeptide is selected from the group consisting of SEQ ID NOs: 589, 3631, 3632, 3633, 3634, 3635, 3636, 3637, 3638, 3639, 3640, 3641, 3642, 3643, and 3645.

8. The method of claim 1, further comprising growing the plant expressing said exogenous polynucleotide under nitrogen-limiting conditions.

9. A method of selecting a transformed plant, comprising:
    (a) providing transgenic plants transformed with an exogenous polynucleotide comprising a nucleic acid sequence encoding a polypeptide having at least 95% sequence identity and conservative amino acid substitutions with respect to the polypeptide set forth by SEQ ID NO:589, or encoding the polypeptide selected from the group consisting of SEQ ID NO: 589, 3631, 3632, 3633, 3634, 3635, 3636, 3637, 3638, 3639, 3640, 3641, 3642, 3643, and 3645, and
    (b) selecting said plants for an increased growth rate and/or biomass under nitrogen-limiting conditions as compared to a control plant of the same species which is grown under the same growth conditions,
    thereby selecting the plant having increased growth rate and/or biomass under the nitrogen-limiting conditions as compared to the control plant of the same species which is grown under the same growth conditions.

10. The method of claim 9, wherein said polypeptide is selected from the group consisting of SEQ ID NOs: 589, 3631, 3632, 3633, 3634, 3635, 3636, 3637, 3638, 3639, 3640, 3641, 3642, 3643, and 3645.

11. The method of claim 1, wherein said polypeptide is set forth by SEQ ID NO: 589.

12. The method of claim 1, wherein said polynucleotide is set forth by SEQ ID NO: 377 or 94.

13. The method of claim 3, wherein said polypeptide is set forth by SEQ ID NO: 589.

14. The method of claim 9, wherein said polypeptide is set forth by SEQ ID NO: 589.

15. The method of claim 1, further comprising:
    (c) isolating plants or regenerable portion of said plants selected according to the method of claim 1 step (b) having said increased growth rate and/or said increased biomass under said nitrogen-limiting conditions so as to obtain isolated plants or regenerable portion of said selected plants; and
    (d) planting or regenerating plants from said isolated plants or regenerable portion of said selected plants to thereby obtain plants characterized by said increased biomass and/or said increased growth rate under nitrogen-limiting conditions.

16. The method of claim 1, further comprising generating a plant line by:
    (a) isolating a plant or a regenerable portion of said plant selected according to the method of claim 1 step (b)

having said increased growth rate and/or said increased biomass under said nitrogen-limiting conditions so as to obtain an isolated plant or a regenerable portion of said selected plant; and
(b) using marker assisted selection of said isolated plant or regenerable portion of said selected plant for selective breeding of plants characterized by said increased biomass and/or said increased growth rate under nitrogen-limiting conditions.

17. The method of claim 9, further comprising:
(c) isolating plants or regenerable portion of said plants selected according to the method of claim 9 step (b) having said increased growth rate and/or said increased biomass under said nitrogen-limiting conditions so as to obtain isolated plants or regenerable portion of said selected plants; and
(d) planting or regenerating plants from said isolated plants or regenerable portion of said selected plants to thereby obtain plants characterized by said increased biomass and/or said increased growth rate under nitrogen-limiting conditions.

18. The method of claim 9, further comprising generating a plant line by:
(a) isolating a plant or a regenerable portion of said plant selected according to the method of claim 9 step (b) having said increased growth rate and/or said increased biomass under said nitrogen-limiting conditions so as to obtain an isolated plant or a regenerable portion of said selected plant; and
(b) using marker assisted selection of said isolated plant or regenerable portion of said selected plant for selective breeding of plants characterized by said increased biomass and/or said increased growth rate under nitrogen-limiting conditions.

19. A method of selecting a transformed plant, comprising:
(a) providing transgenic plants transformed with an exogenous polynucleotide comprising a nucleic acid sequence encoding a polypeptide having at least 95% sequence identity and conservative amino acid substitutions with respect to the polypeptide set forth by SEQ ID NO:589, or the polypeptide selected from the group consisting of SEQ ID NOs: 589, 3631, 3632, 3633, 3634, 3635, 3636, 3637, 3638, 3639, 3640, 3641, 3642, 3643, and 3645; and;
(b) selecting transformed plants for an increased leaf number, plot coverage, rosette area, rosette diameter, relative growth rate of leaf number, relative growth rate of plot coverage, and/or relative growth rate of rosette diameter under nitrogen-limiting conditions as compared to a wild type plant of the same species which is grown under the same growth conditions,
thereby selecting the plant.

20. The method of claim 19, wherein said polypeptide is selected from the group consisting of SEQ ID NOs: 589, 3631, 3632, 3633, 3634, 3635, 3636, 3637, 3638, 3639, 3640, 3641, 3642, 3643, and 3645.

21. The method of claim 19, wherein said polypeptide is set forth by SEQ ID NO: 589.

22. The method of claim 19, further comprising:
(c) isolating plants or regenerable portion of said plants selected according to the method of claim 19 step (b) having said increased leaf number, said increased plot coverage, said increased rosette area, said increased rosette diameter, said increased relative growth rate of leaf number, said increased relative growth rate of plot coverage, and/or said increased relative growth rate of rosette diameter under said nitrogen-limiting conditions so as to obtain isolated plants or regenerable portion of said selected plants, and
(d) planting or regenerating plants from said isolated plants or regenerable portion of said selected plants to thereby obtain a plant line characterized by said increased leaf number, said increased plot coverage, said increased rosette area, said increased rosette diameter, said increased relative growth rate of leaf number, said increased relative growth rate of plot coverage, and/or said increased relative growth rate of rosette diameter under said nitrogen-limiting conditions.

23. The method of claim 19, further comprising generating a plant line by:
(a) isolating a plant or a regenerable portion of said plant selected according to the method of claim 19 step (b) having said increased leaf number, said increased plot coverage, said increased rosette area, said increased rosette diameter, said increased relative growth rate of leaf number, said increased relative growth rate of plot coverage, and/or said increased relative growth rate of rosette diameter under said nitrogen-limiting conditions so as to obtain an isolated plant or a regenerable portion of said selected plant, and
(b) using marker assisted selection of said isolated plant or regenerable portion of said selected plant for selective breeding of plants characterized by said increased leaf number, said increased plot coverage, said increased rosette area, said increased rosette diameter, said increased relative growth rate of leaf number, said increased relative growth rate of plot coverage, and/or said increased relative growth rate of rosette diameter under said nitrogen-limiting conditions.

\* \* \* \* \*